United States Patent 9,328,346 (POLYCOMB-ASSOCIATED NON-CODING RNAS) - sequence listing, part 91

SEQ ID NO: 17057 - RNA, 16169 nt, Homo sapiens
cagcccgcgagggcggaagugggagcugcgaccgcgcucccugugaggugggcaagcggcgaaauggcgcccuccgggagucuugcaguuccccuggcaguccuggugcuguugcuuuggggugcucccuggacgcacgggcggcggagcaacguucgcgucaucacggacgagaacuggagagaacugcuggaaggagacuggaugauagaauugugagugcggggcggccaggguccuacguccgugccuggacacacgacuucaccccgcacguuccucgugcgggucgcaggcuccccaggacugcgccuccgaguugcggagcgagcguccccgacuucugcagcuccccaaacucuugggaucugccgccagcuuggucccacccccucgucucuuacccgugaauguuaaguuucuucuggggugcacccucguuucguuucuuggguuguggugcgcccaaaggguuagugccaaugcgaauucugacauuuuucaugacuuugaggaugcgacuggggcgcggggagggagguguccgacucgugucuaaguaguuaaagugauucuucacagacuucuacacuuauuuucaccacauuuuacauaagagaauauugagcaaaauuucuccucucguuuugucuguccuuaaaagauagucucuuuaugguguuggaauuuggcgcuuuuaagcuuuuuuuaauggauuggguacguuucuuuuuuauuguaaauacugagucaauucaaguuggguuauuuuuaaguuuucguuuucucuuuuugccuccucuuuugcuuucucuuuuuuucacuccucaucucauuuuuccuuugggugucuuuguaguguagagaauaccuuggguugugacuccuaggucuuuguaaaugguauuacauuaaaagauaauguauuaauguauacacucucaagagcgccaggucaucauuuauugcucgaacgaaaucauguauuuuguguggugauuucaauuuaauaauaucuguucugccgcggugggaaauaaaguaucugucuuugcuuuagaugcuaagucguuguugauggugguauuauacauauuagcaguauuuacugauaauaguaaaagcauaauuauuaacaguguacuggacaccacuaagcaccuuuacacgaauaccauauuuaauucccuacaaauucucuaugacagguguuuuucacguuuuacaaaugaguaacaagauaccuaaauacuuuaguuaaccuaugcagauauugcugugcuggcuuucuuugggucuucagaguaggcauacaauaauuguuguuagaacaccuucuucuuuaaaaagguucagcuggaaguggcguacgcuacccaggagauugagguaugaggaugacuugagcccagggguucaagagauccugggcaacuagcaaaauaaauaaguaaauaaauaaaaaugaaaagacaacaggguucaggugaguguuuucuugugucacgaauacagcaaggguugucaaguuaaggaggccagugaaagugacauccccaagggagaacccagaaggcuaaaucaguaaguccuguguuauuuuuuaaaaaaacaaaacuggccggcgcgguggcucacgccuguaaucccagcacuuugggaggccgaggccgguggaucacgaggugaggagaucgagaccauccuggcuaacacggugaaacgccguuuguacuaaaaauacaaaaaauuaccugggcgugguggcacgcgccuguagucccagcuacucgggaggcugaggcagaagaaucgcuugaaucugggagucagagguugcagugagccgaggucgcaccacugcacuccagccugggcgacagagugagacucaaucucaaaaaaaaaguagaacauuuauauggaggguaagauaaagggaaauuuucauaguaugcauguagucugcaauucugaaaugaauuuucauucaggcaccauugaaagcuucaggggagaggaacugugacacuuuuucagucaucaucaugaguaacuuguuuuagaucgugccuguaaaauaguguuauaagcaauauauuaagcaauagugaucguguguguauaugcaaaauacagucaaguauuacucaaggauauuuuuuaacucauuaugguccaacuauauaaauacagcaaucagaaguaguauuaaggagaacaagacuaacaaaacauugaguaugagguaaauccacauuggagcaucuaucugaaauuaugcuauagaguaguaguuuuucuuuuuccuuaaguagagauucuaaaguaaguuuuuagaaagcaacugacagccugggcaacauggcaaaaaccagucucuacaaaaaaauacgaaaaauuagcugggcgugugggcaggcaucuguagucccagcuacuugggcugaggugggaggaugucuugagcccgggagguugagguugcagugagcccagauggcgccacugcccuccagccuggguaacaaagcgagacccuguuucaaaaaauaaaaaagcaacugagcaacaaaacgaaccugaaaaagaaggacucuaguaguuuuaguaauagucugcuccuaauuacaagugaauuaucuacaguaaauccauuucugcucagaaguuuugucauggagauauuuucauuguaauacgauuuauuguuaggagcuuggcuuuuauacuaccaguuugucuuguucuacaaugucuauuuuaggaguuugguuuucauaaaacaagugaagaaaaugugaaguacagaaaguauaguuuuguguuuaacugcuuuaggcuuuauucuuccugguucuguuaaaaaaaaaaaaaaaaaaagaacaacccugugguguauuauaagauaaaauacaauaaaguggaaaaauaagauccucaggagauaauaccagaggaguaauuuaaaugcuaauaugcuugcauuuguaaauccaaggucuuggaaacaggaugaccuaacuggccaagaguuuuguuuggccugcuuaguauuuguguguggguuauuuuuugagguaacauucucauauaaaaaugcagcucuccaucuucuuuuaaauaugaauagccagccuuagugugccagcauccuuaguggcaauccuacuuaauaaugguugccacuuuaagauggaauaugugcuuucuuauucaccacagcccaggacacuucuguuuuuccaacaccuugcauuugugacucugcauuauaaauuauuaaaauugguaagcucuaacuuuggucuugagcuuucugguggccacaccguuaauagagaaaugcaaaaguuuucuaaagagcuguuuugcaugugaaaaaauccugugucuuauucucagaauuuuauuugauuagcaucaucaguucaucauucuugauuuccggauuguuagaucuacccuuaaaaguuuuucaucugcauaaaauuaaccaccuuaucaucuucaguguuuucauaugaaauauucuucauaaauuauacauuuaaauuuuuuaucccaagauaaauggucauacuaaagugcuuaacuuuuuuuaaaaaaaaaucuguauuucuuaguuaugccccguggugcccugcuugucaaaaucuucaaccggaaugggaaaguuuugcugaauggggagaagaucuugagguuaauauugcgaaaguagaugucacagagcagccagguacuguaagucuuugguuaguuuuguuucuuugcuguuuggguugauauauuuauccuuuuuucuacauugcauagucuuaauucuaccuuucuuuagguuuugaaaaccuaacagucugcagcuaguuaaccugacuuguccaccucccugcugggggcucagugugcaaugguugcaaaauggagauucccugguuguguauacaccucauuucuugaauguguugcuuuaaggguucuugaagacauuacccucuuuuuauucuugcccacauaacugccucugauuuguuguucuuugcaucccaggccccagacuaguauguaagaugccuuugagaaguccuaggacacugugguucaggugaacauuggccaagccacauuugcauccauaccaggcuucagaauaaggagcaugugguugaguguuuuucuggagucaaggucacguucccugacaaaagaagaccugaaucucugaaauugaguuuuaaauuuaguaccuaugauuugaggaugugggcuucuaaauauaaagcccucgugguugugaggucaagugcacuccugacuuggucccuggacaaguggcagguccugcccuuaaggagguuccuuccacagaccaaucucaucuuaccguucucgguagucacacuacccuuggauucuuggcugucccaucccaaaugguaauaauagguaauauuuaucgagcgcuugccuauuauagcacucuuccaaauaucuuguguuuauuauuuaauccuuauacaaccccgugaaauauguaauguccccauuucacagauaagaaaacugaggcacaggucaauucucuguaauaucagugcuugacacauggcuaacaauaaauguuagcugcuauuauuuuugccugucucaugaaagauucauaguauuuuccauuuuuagcagcaccauaaacugccuuuguuuguugaaugucaaguacaauuccauuggauuuuagaucuaagacccuauuaccuugugcucucccaugagcacaaggugcucuuauuacuaguagucuuaauuuugacagugauauaaauguugaaguguuuuuauuuaaaaauguauucaguacucuaguucuacauacuuuuuaacugagauaaugugcaguauuguguuuuuuaaaguugcuuuaaguacauaauucauuuuuaaauuauguauuacgaagcucaacuauuagguauaauuucauauucuuuccuauuaguauguauuuaaauaauucaaagucacguuuuaaguagucagugauuggccuauguaaaaccugcuguguguucuuuauuuguaggacugaguggacgguuuaucauaacugcucuuccuacuauuuaucaguaaguauuugaagauucuaaauuauggagaaggaugcauuauaguguaaucagaaguaguaggccucuggcuuggaucaugcuggaagagcugagguaaucucauuauauucagcagguauuuuagagggcuuguuuugcuuaguguuauccuaggugccuuuagguaguugagugaugugugaaacagucucuguucucaaagauuuacaguuguuuuggaaagugauguucuugugaaauggugugauccuguucagcguguuaagucauuaugcauccaaaguaguggugaguccuguagguaauuggauaaaggagaaaucacaguuaccuggauugguucccagagaauaugggguuuaaaugaaaccuuggaaguagaauuuuaagaguggagcguaagcauuuuauugugaggacaaucucauaaacagucauuaacaggaacauguuauguccaaaaaguagcuaagaaagugcuguuguacagccuuggguagaguaauaggugacaguuggguaauaaaacagaaugagcaagauuauguagucuucagugucaggucuauuaguuugacuuuaucuucuaaauugaggguaugaaaucucaagucuguguaccccaacaucauguagcugguagguuaaauaccaggagguacugaaaauaaguugacaauucuuuguauuuauagcuugcuuuucuuugcccuuuuuucuuuuuuuuaugguuuuaaaauucaccccuacucccuuuacaucuauauaaauuucuguucgcugucuccauaagugcuucuguccugcccuucucauucaguccuuuuccccacgugccccuucagucucucccuuugcuuuucacuucuuagugcccugugaccuuauuuggaauuuccugcccuuuuucuuuuagucaaaauuguuuaccauauccuuucuccuguuuccugccugucgaaaucuuaccuaugcuucaaauaauagcucaaaugacacuucacaaaaacuuuguguuuugggguggggggcuuccucgugguuuuuaccucugaguggauaaagggucccuuaacccuacuuaacaggucccuaguagggagcugaugaguuuuugcacuuaaagauguuggagccaagagaacauuugugacucugacagaacuuucuacauugggaaugggaaggaggagguggaucuaaggaaggcugcaaagcucacuaaauagucacugaaaugagaggaagggaagcaccauaccagaugccuccagugauuuaaagcagggugucugaggugaugcuauuauagccaaaaguacuagaaaaaugccuuaaaauuuuaaguuauagcuuaacagcuaauaauuacuaugugccaagcacuauucuaauaauuuuuauauaauucuuuuaauauguguauuacacauaaggcuuaaaaguacuuuccugagauuuaucuacuuacuguauuucauaguuucauuacuuggaagaauaacaguaauuacauuuuaaggcuuaugauuuaaaaaaauguaaccucauuguuaaauugggggcuaaaaugucaugaguagguaaauaguauaauuugcuauuaauacuuguacauugcuaaugcuuuugaauguuagaauugacuguaaagugaagugaaaaaauagcaaaauaaauauuaaauuauuucucagugcuggauaauauuuaauucugauucucuuuaguuguaaagauggugaauuuaggcgcuaucaggguccaaggacuaagaaggacuucauaaacuuuauaagugauaaagaguggaagaguauugagcccguuucaucaugguuugguccagguucuguucuguaaguaugagggcuuuuucucuuacccauuucauaauuaauuggaacagauaauuauauuuuauguaaagcauucauacucaguuuguuucuugagcuguuaagguauauccacauuuauuacauguuugauuuuuuuuuuuuuuuuuuuuuugagauggagucuugcucugucgcccaggcuggagugcaguggcgcaaucucggcucacugcaagcucugccuccuggguucacgccauucuccugccucagccucccgaguagcugggacuacaggugcccaccgccacacguggcuaauuuuuuuguauuuuuaguagagacgggguuucacuguguuagccaggauggucuugaucuccugaccucgugauuugcccaccucggccucccagagugcugggauuacaggugugagccacuaugcacggccuacauguuugaucuuuuuaguuugaccuucuaagucaaacauauuuucaugcuucuugaguuagagaaggcauuuuauagaaguaaguuguacaccuuuucaggaauauuuuagcuugcuagauuuggucauauguaucaucaaaaacuaaaugccccuaagagucuucacaguguaauggguaaagcuaucacucgaguguaauaauuugaaugaguaggcucaaacuuguacucaugcuaccuccagacuucaauuugucuuuuaauguucugucuccauagagaccgucaauaauugccgauaccaacuaaauuaauuacauaaacuucaacucuugaugucaagcgacugaauuauguuugguugguuauuccaccugucugauaacuucuuauaugaauaguguguauaaacggugaccguaauagugugccuaagcacugagcuuuauagauaucuagaggguagaugaauuuccucguagcaacuggcuauggagugauaaggauuggaaguagcaagcaugcuuucugcuuugcuguuggaguacaaggccucacuggucaugugagagaccucugggaacagugaguuuugcugaggucaccauggacugauccuguguggccaucugucucuuccuguccucucaccacacuuaccuuuggaggauagggaguugggacaguaaucacauaagagaaaaaugcucuagauucuggggaugggagaaagauuagcccuguuaacacucacccauugaacuaccaugcccaacucaauuuuggauccuacuguuucugaaauaaauuacugcagacuacagugaggcuauacagugcuuuauguuucaguuccuuguuucucuucucacuuggcuuuuaaacaacagaagcaacaugauuaaaauaccuuucugugucgaacuaaaaguauaacugauuuuuguucucugaaaucucaucucauaaaugaaucuuguccuuccaguagaagaaaguaguugcuuguaagucuauuuucaagcagcuacaauugggaacucacagaccuuucuuauuucugaaacaugccuuuuuaaaacuggccauuuaauuauguaaaauacuaauuuuugcuuauaugaugacuuagcauuuauuuccuauguaauaauuuuguauaucauuaaaagaugucaaacuaaugcucuuguaaauuuuaauuaauuucaauaaaaaagagggauaguucuuaaauggaaagaauuggcuugacaauuguuuccaguccuuacuuuagccucccuuuggucuugcuuugaaggcuuuuaagggugaguaagaguugccuuuuccaacugguuucauggaacuuguaacccuuuacucaguguauuggagaaaucaucagaugaaauacaaaauauuaacaucaaaacagugggagaaaaggaaaaaaauacugucaaguauuuuuauuuaugaggcugucacaugguagugucaauuuagaaacaguuuucaugaagaaggcuuauuacaggcaugaaaucagugaugugucacuagucuugauuaacagcaauaaaaucugucauauuggggaaauuauagaguagaaaauaguauguauagacaaaucuguguauguuacucaguuuuuuaaucaucucuuuuauuuuuaggaugaguaguaugucagcacucuuucagcuaucuauguggaucaggguauggacuaaaauauuuuuaucuuaaacauuuuuaccacuaucacuuuaacaaaaaugaacagauuuuuaguuuuuuuuuuucuuuugauuuuagacuugccauaacuacuuuauugaagaccuuggauugccaguguggggaucauauacuguuuuugcuuuagcaacucuguuuuccggacuguuauuaggacucguaaguauuucauuuuuggagugcuaggaagaaagauauuuaaaaaugugauuauuuaaaauaguuacauuagcuguggcauauauucuacauucagauuucuuacaauguuuauuuuuacaguguaugauauuuguggcagauugccuuuguccuucaaaaaggcgcagaccacagccguacccauacccuucaaguaaguauauuuuaaaauguuuauuuuuuauucacgauaguccuauucauuucuguaaucacaaucacacauuucacagguugcucuuccagcuuagaauucuaacuguggauuguuggucuuuaucagcuauggcauaaaggaagguagaggagauguauauuucauauaagaauguagcccaguggauuuuggaacauuguuauuuucuugacucuuauauuauggggaauuuuaacauugcauauagcauguagcuauuuaauaauauuuauuuggugucguuuuauaaguggaguauauucuacucuugaagucuuucauuaguauaccggccgccacauuugaagauuauucuuugaaugccagccaacuguaaguuuuuucugguaggauauugggaaaagcaaucccuauaguugauuuaggaugccacugacacugaacuguacuacagaacaauuuaaauaauuacaagcauuuaccaaucuuguaauuguacuguuaauggaagcauuuauauuugcaguucuuaaagaacuuuuacuuaucuguuaccucguuugcucuucagcaccucuguaguagagugcauagguguuacugcucccauuuuguacuugaggagacuaagguucacagucacacagaagugacaaagcugauuuuaacuaaaucagacuuguggccugauauuccuucauuuauuaugucuuuuguuuguuuguuuguuuguuuguuuuugagacggagucucgcucuguugcccaggcuggagugcaguggcgcgaucuuggcucacugcaaccucugccuuccggguucaugcuauucuccugccuugcccugccgaguagcugggacuacaggugcccaccaccacgcccggcuaauuuuuuguguuuuuaguagagacgggguuucacuguguuagccaggauggucucgaucuccugaccucgugauccgccagccucggccucccaaagugcugggauuacaggcgugagccacugcgcccagccaugaugucuuucuuaacuuagcuuauugagaucaaaauuuccgaaaugaagucuauggagauugaauuuauaguguaccuuguccuuucauacugguaggucaucuuuucauuucuuagauaguugcauugauacuaaaaaggacaugcauaggggauggaaucauuuuauccaaaaagggccacugaugucuaggaaaaaaacguaagcacagauuacuuaaaagacaaauguauuguuagguuuaagguuuuugaagugaaaugaauauaaaauguuuacucaccaacuuuuaaauugugaauaaaauguaagauauaauuuaguagauacaaaagauagauauauaaaaguagcuauaccgauggucccugaccuacaaucauucaacuuaaaauugacuuuacgauggugcaaaaugaauaugcguucaguagaaaccguacuuuaaauuuugaauuuugaccuauucugggcuacugguauggaguacuuuugugaugcugggcagauuagguuagguuagguguauuaauguauuucaacuuauguaaggauagguuaguuguauuaaaugccuuuuugacuuaugauauuuucagcuuaugaugauuuaucaggguauaaccccaucauaagucaaggagcaucuguauuauguuuuguuuuuuuauauucugucuucacccucacauaaaucauauggccgucagaaaauccguugugugauaagugugcaacuagcauuggaucccauaaauguaccaaaguaccuacuaagucaugugaugugcaggcuguuacugccacuguugccaggucguccuccugucucccaagaguuuacuuugggagucugcauagauugauuucucugaggauguagguguuggagucugagucaucuuaccacuuagagcaaacuugagagugucugagacuugcccgaagaacuuguucaaacagauugcugauuccccacccuggguuuuggacucagaaguucuguauuggggccaagaauuuccauuucuuaaaauucccaggugaaguugauguugcuggucugaggaccacuauuugagaaccccugucuuagagaaagugguuaccaaugggaaaaucuauaggccccggggccugaaauaacuugucuuuugguguugaccauacaaacuuuuuaaaagaauacugacucugauagaauccuuucugugcaauaucguggaauacguaacugguguacacaaagagguaaguguucucaaacaagauggguaagucagugaauaggcacaauuuuagaaacuuuaaaagaguugaaccuaaggaaaugacagagauaauacucuaccucuuuuaggaaguuacaagggaauucauuucuuggaaaugaaauuuuuaaaaugacuuggcuaauuaaugucaagcuacuuaaguuuuucuguccucuauuaugauccacaguaaaagucacuaaagaaaucuuucccuuuaaauaucuguuaauuuggagggauugaaagguauaaaguaaaggguuuuuugaaugccuuuccaaaucauucaaaaagaaggcaagcauggucuaugagccagagagaucugauugggcaucccaacucuaccacuuaguagcaaagcaguaugacagacauuuuuuacccucugagcguguaaccuccuuugugaaaugaaaguaauuaaauuugccccuuuggaucauuaugacacuuaggagauagguauguaaugcucacauuauccuaguaacauauaagcaguaagcacuauguauaugauuguguaauuuauuuuucuuuaguaauacaacugauauuaauccagacuuuaaagugauauugccaugccccuuccguaauggaacacaugauuugaauuguuuuucaguaugugugcuugucuugauuuugaguugcuaggguugcuaaggaaacccaacucaaucuacuguuaagcaaaauuggaauuuauugguuuauguagggaugaagucugaggucaggguugacuggauccuuaaggcucaaaugauguuguuaagaugcuguuucugaguuacucaguucuccacaccuugacuuguucaauucucaguugaguguuuagaauuuuuuauuuuuuauuuuucuaguuuuuuucugcucacaaggacaucuggaucaguuuggcccuuuccagucacuagcauaaggugguuagagaaaaccauagucacaaucuaagaauaagaaggaaauucauuuuuuuucuacacccaccuauuuuuuggagaaauucuggugcacucugcuuguguaaaggucucauuuuuuggaaaccaggguuucucagccuugacacuauugacguuuuuggccagaugauucuuaguugugauggacugccuuuuauacacuguugaauauuuaauagcauucuacuugccaauagcacugcccuucugaggugugaaaaaacaaauaucucuagacauuguuaaguguuccuugaggagggcgagaacuuacccuugguagggaaccacugcuguaaacuaguauucaccaggaccgccugggguguggcauagaaaaggggcuguuagcccaaaauaaagauggaugccaggcagacuaaacaacagaugguucauuacugguaauuuuuccccaugguuuauucugccuuauuaacccaauccuuccuugcggguguccccucccuggccccaccauucuugauugccuaggauugggggcagucugagaucauugaacagaguaaagcucuuugacccaguucugucuccuguaucucaccauggugugcucuaagcuuaaguuaacuagcagcuggccauauaaaacaucgaaaggguguguauuuauucauugagauguacacuuaagauuuguacauuuuauucuuguaacuauguuguaauaaaaucauacauaugggggaugaguaaggggaagcacauuuauaagaccagaagaagauauggacagaaauacaaccuucaacuguaaaugugugauuucuguuccccugggaacugaaacaaggauacuguuuaaguuuuaguauacuuguugaccagaaguuuaauagcaaauuaauaugagauaguuuuuuuaaaaggcagucaaauuuagcaguggggguuguguaucaccauuagugacaguaauaguaaguucugauaaccuacuaccauuggaccaaccaguuuuuuuuaaugcuguauauuuucucacaacuuccauauucacaacauuaaugcugauucauuaauuucaguucaguuuauaaauagguggguaauuagaaugacuuugauaacuaaaauggcucaaacaauuuuuauuuuuauaauauucaugguuuuuuuuaucuuaucuugaauaacuuuccuuuuggacauccaaacaugauaaauuuaugccaaagcaguuuuggggcauaugagacauuguaucuugauuuuacucuaaagcaaaucuaauacaucaacaaaaauacauuuuuggucuuugucuuuaagaaaaauuauuaucagaaucugcacaaccuuugaaaaaaguggaggaggaacaagaggcggaugaagaagauguuucagaagaagaagcugaaaguaaagaaggaacaaacaaagacuuuccacagaaugccauaagacaacgcucucuggguccaucauuggccacagauaaauccuaguuaaauuuuauaguuaucuuaauauuaugauuuugauaaaaacagaagauugaucauuuuguuugguuugaagugaacugugacuuuuuugaauauugcaggguucagucuagauugucauuaaauugaagagucuacauucagaacauaaaagcacuagguauacaaguuugaaauaugauuuaagcacaguaugaugguuuaaauaguucucuaauuuuugaaaaaucgugccaagcaauaagauuuauguauauuuguuuaauaauaaccuauuucaagucugaguuuugaaaauuuacauuucccaaguauugcauuauugagguauuuaagaagauuauuuuagagaaaaauauuucucauuugauauaauuuuucucuguuucacugugugaaaaaaagaagauauuucccauaaaugggaaguuugcccauugucucaagaaauguguauuucagugacaauuucguggucuuuuuagagguauauuccaaaauuuccuuguauuuuuagguuaugcaacuaauaaaaacuaccuuacauuaauuaauuacaguuuucuacacaugguaauacaggauaugcuacugauuuaggaaguuuuuaaguucaugguauucucuugauuccaacaaaguuugauuuucucuuguauuuuucuuacuuacuauggguuacauuuuuuauuuuucaaauuggaugauaauuucuuggaaacauuuuuuauguuuuaguaaacaguauuuuuuuguuguuucaaacugaaguuuacugagagauccaucaaauugaacaaucuguuguaauuuaaaauuuuggccacuuuuuucagauuuuacaucauucuugcugaacuucaacuugaaauuguuuuuuuuuuuuuuucuuuuuggaugugaaggugaacauuccugauuuuugucugaugugaaaaagccuugguauuuuacauuuugaaaauucaaagaagcuuaauauaaaaguuugcauucuacucaggaaaaagcaucuucuuguauaugucuuaaauguauuuuuguccucauauacagaaaguucuuaauugauuuuacagucuguaaugcuugauguuuuaaaauaauaacauuuuuauauuuuuuaaaagacaaacuucauauuauccuguguucuuuccugacugguaauauugugugggauuucacagguaaaagucaguaggauggaacauuuuaguguauuuuuacuccuuaaagagcuagaauacauaguuuucaccuuaaaagaagggggaaaaucauaaauacaaugaaucaacugaccauuacguaguagacaauuucuguaauguccccuucuuucuaggcucuguugcugugugaauccauuagauuuacaguaucguaauauacaaguuuucuuuaaagcccucuccuuuagaauuuaaaauauuguaccauugaagaguuuggauguguaacuugugaugccuuagaaaaauauccuaagcacaaaauaaaccuuucuaaccacuucauuaaagcugaagaccaguaugauuucugguugcuuuuugaagguaugcuuuauuacuuuguauuuaacgauguucagaugaguaguuguguguuccuauauauguacuugauauguguaaucaaaagacugccuucuuuuucuauugagauguuuaaggacaguaaugcucauuaaucaagcauuuuuuuuuuuuaguguucuaguauaugugacauggccaauuuuuuuauuagaaaauaugugaccagaaagauucuauagaguaaaaaaucaaagcaaaacaaaaaccacaaaaagaccccuguacuauagaaaauguaaaguuggcugaacagauagggucuugaaauuucagga

SEQ ID NO: 17058 - RNA, 3111 nt, Homo sapiens
gugcucuguagagugauaaaacuuaccacguucucuuccuccgaugcuugauuccacccgggguucacaauaagucugugcaauguguuuguugaaaaacugguucucacuuucuuccaggugugcaggguuucugagccaggagcaguugaggagugggaagaacaucuggaaagacugggaguaaggacgccccaucugauggaagaaaggaaacacaugcccacccauuuuugcaccugggucuuucauuugccuuuacacuggacucuugcaagcccuaagcaggacauugcaucaagcuaaugggcuuguguugaggucucuuucaacucaccccaagccuugggagagucauauuucugacaacuaaauucaugaagucuuccuaagccucuuuuaaaucaugauucucccuuugaaacaauaggcacacacauuaaaguccaaauagucauuaaccuuuaucaccauucacuaggaggucagaacagaagagcaccauguaggaauggacagccuugugggugucguggaugcauggucccaucuggaacccuggggcacagauaucaugagcagaggaggcagcagggccagggguggaugcgaauucugccucuaccacuucuaaccaguacacccugggcaguguacuugacugcuuuguucuucagucuccuccucugugagguugagauaaugguagcaacuaauuuaggagauuauugugagaauuaaaugagauugucuaugucauaauagguaugcaauaagugccuaauauauguugauuuuuuacucuguuuucuagagaagacagauguagaauuuagucuucaugauggguggcuucugaagaugucaaaagggacaaugccucagaggcuggcagcccccugacauggugaaauaggcagccguguggucaggccagggcacaagauucacacacucccucucucccucaguaaugcucagguugucuacaggaaacauccuauaguccuacauaucuuguuccccacguugaacaaagugaggagaaagacauaaaaggauuucucugcucuugcucaguuuucaucucaugaaagaauaagacuugccucaaauuucaugaguguacagucgaguucuuaccuggcagaacuaaucuucugggggaacaauaauaggucauguuaauuaaguacucauucuccuaaguauauuuuuuauuaucucauuuuuuucucauagcaacccucuaaagagggucuauugucauccccaucuuacagaggaaacugagcacagaaugguaacuugcccaaggucaucauuuagccagaacuuaaacccauugggucaaacuccagcacccacuauacaaagcugucucaucucaaccagcccucucuccuucugacucacuucgguauuucauuuuuuaauugacauuugcuaagaaggucaaauggaugacgaaggauguuguugagcacucauuuuagcaaaguuguaucuagcacuuaaucaugugaccaauugcuguacuaagacuaggggauaaagggaggggaggacaugcaguccaugucccuaaugaacauuccaucuccuugauuggcgggggagagagagaaagagagagagaggccacaugaaagaaaaauaacaauguaagaaagggagagaggaagagagaggaagcagagaucugggagaguacagaggagugaugcggugauucaaccccacaaggaaggucagugugucuucuuugcauauacgguaaacagaagaaacugaagcuuagagaucuuaaauagcaaauccuaguuugcuuagcaagucaguggggggagguaggagacuagugucugacucugaagcccacacccucuucacugcacauaugucucccugauccugaaaggguaguuuacgaccauguccuuaagggccugaauguugcacuaaggagcuugggcuuuauucucuaaugaauauaaguacccacaaugcuccucugcucuaaaguuaagagcaucaucuagggauugccgggcagaaggcaaaucccacugguuuccuucuacgcacacauauauccccuccaaggguguccagugagccaaucaaccacuuuuuucacuuuuaugcaaacacagcagcuggauuagcugcaccugcagccucugcugugucacacaugauaaaaggaucaaagucuagaacaugacuucagacuauaauuuaagauaauuaagauuuuuaaccuaaauuacauuuuaacauuucauaacagagcugucaagauucuaucuaucaaaacucuaucaagcaaacaaaagaggauaauuauauuuucagacacaugcagucaucacucugcuuaaguucucauaaaaaagacuucugucuucuuucacauucucauuuucaauugcucuuccucuucccagccacccuuggauucugagacuaugcauucuuaaacaagaggaaaauauuccagaggaguuuguaacucaggccaugaaaguguuucucagaagcggcaguucuaauuagaacugcaucuaaaggaaauaucucuucauugguagggacaucuugccucacuaaauagacucugauuggggaugagaaaaggcagcauauuaaacucuucaaaucaaagagaacaaugaaaugccaaaaaguuuccuccuagaagcugaauuugcuuucaucuugucccauuaagauauggagauuguugcaaaaucuuugaguugccacaggaagaauacuaacuauuuuggguauugcuggaugccugcccaucauccacuucaccucuccccugaccauuaggaaucagccaugucagugagguaaaaaugacccuacuccccgcugcaguggccuaaggcacucaauguaaucuuauccucauuaagacugugauugauucaggaauacacaaggaauacaugcugcagccaacccuugcacggcgucccccaguucccaugacugcucaagacaggggcacaggaucuuacuuggccccauggccaagaaugaagcccacaaguuuuguuggacaguagagaggagagaaauguucuuccuuuggac

SEQ ID NO: 17059 - RNA, 1836 nt, Homo sapiens
cuuuacauccaaccaguugauggggucuuccugagugggcuccuaaaugccccucuguaucuugucccauaucccgacucugaccccuuuugucucuuuccugcauuacugcaaccaugcccccauugggucccuacuuacaggaauagccuuccuaaauaucuccuccaccuuaaggguucagcaaucuauuugaaauaugaacugucuucaucaaacccuugagcgaccauccaccaccuagagcaggagacccagcccuuuuguauggcguacaaggcacccuaugaucuauacaaaggcacccuaugaucuauacugccuauggcaagagccuauccauuacugacucuccgugcuuuacucucucacaggacagagcugcccaugguugcuugcuugcauuuugcuguuucucacuuccaccccuuagguacugcucucuaaagagaaugccuuuccucaccccagcgccccgccuccagauaagccuagcuaaccccugcucacuucuucauuaggaaucaucacuaaccaacucucuccacucccucaggaguuuauauuccgauuauuugucuaugcgucuguaucacauuuccucaagaccuaauaggaaagaugaugauucccaauuuaagcgcagggcuucuaauuacuuuagguaaucaaaauauucucuugcuugaaacaugagguuuaugaaaucccagcauuugggaggccaagcugguggaucacuugagguuggaaguuugagaccagccuggccaacaugguaaaaccccgucuuuacuaaaaauacaaaaaucagcgaaguguguuggugcacgucuguaaucccagcacuuugggaggccaaggcgggcagauccccuuaggucaggaguucgaaaccagccuggccaacauggcgaaaccccaucucuacuaaaaaauaauaauaauaaauuagccagacauggugguucaugccugcaauccuagcuacucgggaggcugaggaaggagaauugcuugaacccaggaggcggagguugcauugagccgagaucacaccacugcacuccagccuggguaacagagugagacuccaucucaaaaaaaaaaaaaaaaaaaaaaaaggauuuaugagcucccaaggaggaguuuaaaaugcccuaggugccacacucugcccuucacagguguuuacauuccaggugagaaggaagaacuuggaaagaagaugagaacccauccgcagagggcuaccuggggccgaggugcugagguagcuaggacuacuuuagcucagaccuuggugugucugaggugggauggagauugaaauccacuccaucuccugauaccggcauaaucacaacaauaaaugaugucugaaguggacgugcagcagcagagaacaggcagagaaauguaaaaaacaacaacaucaacaacaaaaaaaaccccgugcccuugauauuaugggaaaagaaauaaggaauacacucacaucuuaauggaaauagaggaauucagaauuuuaaagccuggucaaggcucagauagacucgaucaaggacagagaccccuaggauaguuaauuuuggaguuaugagcucuggcaagaaugugaacaaagaagagagcagcaacaagaccuagugcaaacaccaagaaggcaaauccuacagcuuccaagcaccucuacagggacugucuacuuuagucuucccuucaucccuaauccucaugccuuagcagucuccuuuuguguucuuugguuuaugcuuaccauuugaagggugacggaggcaacuucuaaaaauauauuuucaucuuaauugaaac

SEQ ID NO: 17060 - RNA, 793 nt, Homo sapiens
uuuguuuuuguuuuuguuuuuuuuacacaauauuuauugagugccuccucucccgaguccuugcagucucuaggucacuuuuucugcuuguagauuuuguacacaagccccagaaacauggcugggagcaggggcgcugcguacuguucagugagacccauaauguggcuguaaccgucuuccucauacugcaagaacacggccggcagauccagcuccucauacagugccuucaccuggacuaccuucuuggccuucuucuguccguaauuuuccuucaggaucugguacuguuccagaguggaucguugcagacacugaaccaccagccagcugcauuuguuguccuggaugucagugccaacuuugcgggucacagugggguccccaaagaggucaagguaaccauccugaauuugaaaaaacucucgaucuccaguaggaucuucuaagcauuggcgugcugcuucucaccaucgauuccuaccauguacauggcugcagcuacaggaagguagaaagaguagaaagcuaucuuguacuugacaauagauuuguaccuguuuucagugaaucugccaaaauccacauuguccuaggggcugugaugagguccagggucugcccaaucucaggcugacaggaaaucugcaggaagagcucgaucagguucagguaauagggcugugcuuggcaauagagcuucagcagguaguagauacaugcuuccagaaggauagcauaauugauggcauccuaccccaugcccaucuucugauaacagcagaucugu

SEQ ID NO: 17061 - RNA, 793 nt, Homo sapiens
acagaucugcuguuaucagaagaugggcaugggguaggaugccaucaauuaugcuauccuucuggaagcauguaucuacuaccugcugaagcucuauugccaagcacagcccuauuaccugaaccugaucgagcucuuccugcagauuuccugucagccugagauugggcagacccuggaccucaucacagccccuaggacaauguggauuuuggcagauucacugaaaacagguacaaaucuauugucaaguacaagauagcuuucuacucuuucuaccuuccuguagcugcagccauguacaugguaggaaucgauggugagaagcagcacgccaaugcuuagaagauccuacuggagaucgagaguuuuuucaaauucaggaugguuaccuugaccucuuuggggaccccacugugacccgcaaaguuggcacugacauccaggacaacaaaugcagcuggcuggugguucagugucugcaacgauccacucuggaacaguaccagauccugaaggaaaauuacggacagaagaaggccaagaagguaguccaggugaaggcacuguaugaggagcuggaucugccggccguguucuugcaguaugaggaagacgguuacagccacauuaugggucucacugaacaguacgcagcgccccugcucccagccauguuucuggggcuuguguacaaaaucuacaagcagaaaaagugaccuagagacugcaaggacucgggagaggaggcacucaauaaauauuguguaaaaaaaacaaaaacaaaaacaaa

SEQ ID NO: 17062 - RNA, 2376 nt, Homo sapiens
uguucaauaaauauucucuucuuccuuccgcuuuccccuuucgcccuuggcagagaagcaaauaauugaguuaaaaccuugauuuguggcaaugugaauaaauuauagcuaauuccaggaacuuagcugcauccuaccuugacccauuuuuucuacuggacucuuauauugcucuauauguuuuagcuacacagguuuauuaaacauggauacagaugaaaaacagacuuguuauguuagaaguuauaaguugcucaugcauuaagauuuugacacacaggaaguuugaaugaaugagugaaaaagguuccaaguuauuaaaauguucugguaccugauuuauucauuugccauaccaguaauucuaaggugggugaagcuccuuuacuuccugaagaaacaaguuaguuucuuaaacuaagcauuaaaagaaagcuggaauuauuuguuuccagaaguguuaguagucaugcuaaguugcccuucuuuggcuagauuguccaauguuuuuuaggccuguuuugucuauuuuugucaagauauaaauguuuaauugcuuuaaaaaaacugugugguugcagaaaaaaauuguacuguuauauuguugagaucaaugagacuuuucuguauuuacuuuuucagacauuauuuugaacucaggcucagucucagagauuucuucaacauguaauuuucuaauguuuccuuuccugcaaggaaugagacaauauauucuuggaauauuaaaguacuuuugaaguaacucauacguuuucuccccucuuccauuuguuuagcuauugaggguuugcuuuaaaacaaauuuauguagaaauaucaguacuauaauaguauugugauacuguguauuucuuaagcauaugccaggaaggagagcauuaguuagguguccaaaaaacagccaacaaaacaaaucagcucugaaaaucgugaagcagugaauauuuuagaauuauuuuugaaaccucuuucagaacuguuuuuagaccccgugguaauuugcuauguaauuuaauacuaguuuaggcacuccauguacaguugguauguuuccuuuugaaagauaauaaucuauuuauaauaaaagucugaauauuucaaucucggaauuccucuuuaaaacuugaaucaguuuuacuauugcuuuuuaaaauguuaccuauuuauauuugcuuuguauaucaaugcuacacuucuuguuuuguuuuagguauuuaaaccaugucagagcugccucaccacaggaccuugcuggaggcuauacuucuucucuugcuugucacagagcacuacaggaugcauucagugggcuuuucuggcagcccaguuaaccauuuauaagauuuggaccuuggagcugaaccagggagcuagcaaaaguaaagcagacuuauaaaauuauagcuaugugcagcugcacaacacaguccuuccacuagcagcuguguuaaaguauuuauaaggagaaaauuucagaacuaaguugaguaauauaggggauauauauuugugaaaaauaauuuuuacuuauauuuuucagaggauuugacacgauaagccucaucugauggaagagaggaauaaauaauucaccuauauguguuugagguugugacagacuuauaaaaucuuuuuaaaaaauaaagcuauaauuuauauuaaguucugugguuuuucucuuauuacaguguuuuacuugaacacauuuuaaauaccauuuugauuacaacauuuacuguuaauauccaagucuauuauuucuucucauaaaauguuccccuuuuuccuaaugucuuguuaauacuaguccagacaaguggauauauuuccuuugaccaaguuauggcaagaaaaaccugacccaugauaaugucauucccucaauacuaaggacucaaugccuguuuuaagcaguggaaaaugaggcaaaccuugaucaagguguuauaguucccagcugugagccacacucaggauaaaacaaaacccagcauuaaccugcuuuagugacacauucaaagaaguuaauaaaauuuaauacuuaaaugauaccuuucaccuccaauguaagcucauuuuaugaugaauccuuuggagacuggagaagguacauuuuaaguacaguucccuauguauaaauuguauacugauacaguuuuuuuguugaaacuucaaaggcuuuuauuaccaggguuuugcuuaaagaguuuagauaugaauaggaugauauugcagcaucucaaccuuguaugagucuguuacauagagcauuggauaugggauauaguuucuuaaggaaauuaagggauuuccuaucaaaucucuauuacaacagauguuaguuuuauggguaga

SEQ ID NO: 17063 - RNA, 71518 nt, Homo sapiens
gcuccucuccuuccaggcccuggugaaguacggaaugccggaagggccgggcucaaagcuccgccucuggcgcgaccgacgacuggagcgcagggcagggguagaggcucguagauggaacugguagucagcuggagagcagcauggaggcguccugggggagcuucaacgcugagcggggcugguaugucucuguccagcagccugaagaagcggaggccgaagaguugaguccguugcuaagcaacguaagugggcuguguucgcuuccccgcgcugacgcccuccggcuucccucaagugccugccaaauaagacccagaaaaggaggaccgcaccgggacaggggagaugcuggagccugaacccugggggauggggucugaaggcagccgccgagauucagaugagauuggcgcaguuaugaacgugauagcagccuagcauacucuagaaagaaaagaugaaaagcgucggguggaagagaugcagcguugaguggaagcugcgaacaugaugggaugagcggcccuaggauuauguacucacugcuguuaguuaguauuuuugucaccuuauuuucuccaccagucucgugaggucuuugcaagagucacaggauuuuccucuuccgacuuagucauggggggagggaaaauaauaaacauuuuaauacagaaauucuuagcgguagaauggaaguggcuugguaguaagugcauagcacguuccugacccuaaagccugugcagugggcacuccgcuuuuuaacucgaguccuagacacuguucccaggacuuuguucccggugcuguuuguggggagggggauguuuucagggauacugccagaacaacgugaauugcuucuguuuauaauauugucauugcaagauauuccugaccauccuuccaguuugguagaacuaauucauuagauauauaaguagagauuaguugugcaguccuaguaauugaggagaaacaacugcccacagcagucccagguugacucagcaauucuuuaguaaucacaugagcugaggccuuaucccuccucucucuccccacuccauucccauccuaucuucaucucuugcagucacaagguuagucauggcccuuccugaacucugccugucuuguguacugguggaaaucauuuuccuaagaaacccuagauuccuggagcugcaguagugggaggugggaaggaaaggaaaggaaauuaguguugguuaagcaacgagugugucauacaaacccuggugguuugcagcuuuuuuccauaaucuuucauuuauggaauuucuuuacgaaauuuuaacuucaccguccaaacauuuaacacuacuaaauuugugugcuuacaggaacuucacagacagcgauccccagguguuucauuugguuuaucaguguuuaauuugaugaaugccaucaugggaaguggcauccuuggcuuagcuuauguuuuggcuaauaccggugucuuuggauuuaggugagucuucauauuuuagcaucaaauuuuuuuuuccauuuugauaauauacggagaaguagagagauagauuccagaagcugcuauuauacaauuucuaguuaguuauuucugggguuuuagcauuuuucuuguuauucuuguugcuaguguguaccuuggagggcuacuacauagcuucuuaaauacacagaagugugacuaguuuuuaaaaaugggaacuugauccacauuucauuuauaaugaaauaugacacuuaagaguggcauauucauuguaucuccuuggccaaagugaaucaaagccaugcagauuaacuuccaaauagcaauuuugugagugcaaauacaacacauaaucuuuucauuccucgcugucucuuuguauuguuaaguagucuuauuucacuuucagaggccagacauguguuuugugccuguucuuuuuuauguuucaggacuuagcuuguaggccaguuugcccaaaauagaagacaauccuggauauucugugcuuucauaguacuuuguauauucauucuguuauuauaauuguuacaaugauauguuuggaaauuaauguucccacuaaacugaaauccuuuacaacuggaggucaaggcaggcggaucacuggaacccacgaguuugagaccaaccugggcaagauggugaaaccccaucucugcccaaaauacaaaaauuagccugguaugguggagugcgccuguaguccuagcuacuugggaggacugcuugagccugagagguugaggcugcagugagccaugauugggcuacugcacucuagccugggugacagagugagauccugucuaaaaaauuuaaaaaauagaaaaauccuuuauaacuggaccuuauucuuagcaucuagcaccacauggcuaauagaaugaauuaacaaauuggcuuugucaguagaagcagaucuauuuacuaggaaauuuaaaaugccuagggagucucuuuuauguuuauuuccugcuuuuauuccaaauuuuuugauaagcaaagcaacuuuuaaguaacccaacuugcuuuuauuauggaauguacucacaaacuuucauuauuuuuaaaauuaaaaacuauaugugacaccuuaagcaagacauagucagaggacuuuuuuuuugauucucuuugaaaaaucauaauuuaugcaccagggucuuacaugcagauauauacugcugaaugugugcucacccagucauagcaaccaucauuuuuggugaugcuaaaguguuauuuugugaaguuccugaugucaguuuaaugacauuuguacuuuuaccucucaauuuuauuuauuaacaaguauuaacuggaccacagagagaaaauuucuucaaugacuggggcaguucacuggggauagcuguauagaagcuuguccugcuggugucuuccuaaaaaugaauaggaaauuaucuaaguuuuuucuuucacacuguuggugagaggaccucaaucauuacauuguuugcacauuuuucaaauugcaucauuagagguguguuaacuacauuauuuuaauuuaguuugguuuggagagugugugcguuuaauagaugcuagaaaauacagccuaaauaaaucuuaaguacaccuuaauaagaugaagguaugauaaggaggucaauaucacuggaaguagagggaggaagggaaaaagagaagacaaugagauugcauaaguaaaacuucuguuuagacuuaaaauaagaagaaaaccagucauaaaaaggaaauauuacaagauuauuuaauggcugauucagcagucagcagacaagacugcaaaaugaggaaguuugcuuguauuuuuaaaaaaguuugguuuuuauuuuuuuuuauuuuaaaaucaguauauuuucauuuaaauaaaauugguaaauacaaaaaaguagaaaaguaucuucuuaauuuccuuaaugaacauaauucugcuacucagagauaguuccugugaauauuugacuguuaagcaauuuguuuuuguaaugagacaccauacaaaagacaaacuuuugggagguuuugaccagguguucuuuuauguuuuagcuucuugcugcugacaguugcucuccuggcuucuuacucaguccaucuucugcuuaguauguguauucagacaggugaguaaaaauguuaugcugcuucauuuaauaaaggagucucuugaguuuguaucuacauauagaacuggaugucucaaaucuaauauccagugagcauacauuuuuauuagauagggugaucggaauggagaauuugaaaaaccaggauauacagacccaauacugugggggaauauccaagcacaggaugggaggagguaauuagcauuuuuaccugcuuuccuccacaacacaaccuaauuuucuggaguagaguagaucaugggagggucuaaaagguguucaaaggauccaaaccuuaugcuuauggagaaaucauuuucucaaggagagaacaccuucucagagcuacuguugccuucccugcccccaucugccugcuagucagagguagggauggcagaauuaggauuguaggaaguaaggucacaaagcuuuaauuuauuuagacacauuuuguauuuuuaauugcaagucuagaauaggguaguuuuuuccuaagagaaauaaguaugugcaguuaauucaauauauuuguguauauacuuuuucccauuuggaauuuuauuaugcaauucagucauguauugaauaaguucuuuuaggauccaguaaauaaaaguauaugaauuauagaagugcuuuucuaagauuuuccuuuugucauuaacaaauauucuauguucaucaguccuggucuuuuuaucugucuagucucuuuugucuuuggauuaggucagcuuugaugccaaaaucauggguuuaauucuuauauggaugaguucguuuugcuuuaucuggccuugugauguucagauuuuaagaagaaaaguagauacacaaaauagauaaaaauggauuucuuaauucauuuaguguuucuauaaaagaauaccugaggcugcauaauuuauaaauaaaagagguuuauuuugcucauaguucuacaggcucugcaagaagcauggcccuucuuaugaggggcuuuucugcuccaucugcaucuaguaaggggcucaggcugcuuucauucauuguggaaggugaaggggagcuaggauaugcagagaucacauggcaagagaggaagcgagagaggaggggcaugccagguucuuuuuaacaaccagcucucaugaaacuaauaaaagugaaaacucacucauuaccccaaggaaggcaccaagccauucaugagggaucuggccccagggcccaaacaccuccccuuuggcccuaccuccaacacuggggaucugauuucaacaugagauuuggaggggucugacaaaccaaacuauaucagugagacuauucugugcugaaacaggugagugaagcccagugauguuucuuaagaauuuuaagacucuucagaauaauucugaagccacugcucuaguuuguuuuccuaaaaccuguccaucaucagaaauacucauagaucuuuuuauacacagagagcucuaagccucagggauucuaauuucaaaaaucugaggugagacucaagaauauguuuuuaacaaggcaaaaccaguuuaggauccauaguuuauagcucuaacuuguaccagugcuuuggccagccagugccagauauguuuuuaacaaguccuccaagugauucuuaugcaaaucuaguuuaggauucauaguuuauagccacaacuucuaacagugcuuuggccauccagugcacgccuuugcucucaaggggcuugggugaaugugcagacagaugaaaauacuaggaagcaguacaaauauuaauccuaaaguaacagguuguucauaaaagcauccugaauuuaggaauaauagcuuuagauaaauauauuuguaaauccugcugaaacuugaauuuuaauugcauguauugaaauuuugcugaaugugaaaaaaauuuuacuuaauugugauacuuuaacaucuugguagauucuuucaauucauucuguuaaaagauuaauacuuuagucaacuauguggcaauuaugucuuucaagcuucauuuuaaaacuucauuuuaguuuuaauuuaaguaaaauguuuuauuucgguuaugugggaguaguauucaguguguggagauuucuaaguaauuuuaauuuuuuacuccuucgguucacauguauuuaacuuuaagauucugacacuguguuuguucuuuucuguaacucuggggcguaugaagugaauauaucuguuucucuucuuuuuucuuuuucuuugauuucuguagccuacuugggcccaugaacuaacuacuucaugguucugccugcacauugacucaccugucuuccguugauugaauuccuucaaucuuuguaaaauucucuguggagguaggcuuuuccuuuuuuuuuuuuuuuucaauacauacauucauauauaaagacuagaguauaauacguaacuaacucucucccaacaguuuguuggacugucauaaaggauuauuaugcucagauugaauucauugguaagagaaagagcuaucaugaguuuuuaugaaauaacuucuucauuuauuugcuggugguaaaggguaaagagaaauuuucaucuuuauaaaaguaaaggauuucuucacaugaaauucuacuuuagauuuuauggagcguuuggggucuaucaggacuuuucaugggagcugagguggaauguaaagaaccuuauucucucuagccuucguuugucaucuguaaaauggcaaugauaacacuuccuucuuggaauuguucugagagugaaauaaaauaauguauaugaaaugucaaguccuuggcaaaugagugcucccuggggcaaaaaugcccacuggggcaaaaaucccuaaagauugcaggguguuguacacacuacuaucucagaaauaguugguucguugccauucuuuuggaauacuucucaugcucugauacuaaacccacagcuccccuccacuggcuuccaugucacugucaacuggagagagugagaguccuagaacucugcauaccucuggccgaaccacaacucccuagucguugaucccuacuacucacuggauugucaccauuauuugccuugagaccauuuggauuaugacauuauaccaucuaucucaauuuguguuagucauuucaaguauauuagguuaucuuucauuucucagacucaucccauauggcugucaucuguuucugaccucgucuuccacugcucucuaacuccugaaacccuuccacugugcucucuggaacucacagucaaucaucagcaaaacucacaugucucuaauucucuucugaacauuucugucuguuucuuacacuacgagaaccuccucugaggcuucccuguaguucucucaaguggucagucuuuucucuuuaugucucucauacuaauuugaagaugguauagguguccuguuugucccacauuucugcuucucaaccaucuuccucuccuugaaccccccagcuuuuaaucucaugaauguauaccaucuacggcucuccuuacuauugucaucuauagacuccuagaccauuuccugucauuucaugaaaguuuuagcuaaauuuuagcuucuacucaccuuuuaguucucuucaguauuaccccuguuauaauucuggaugauuucaauaugcauguagcuaauccuucuaaugcuuucaguuccugaaccucuucuucucuaaugaucauauucucuaccuacacuggccacuuauuuucuccuauggucauaccacugaucuugucauuaccaaaauagcauuuguuaguaucugcccaucugccaccaccaucuccuuuguuucuaacucacccucucaaguacuucaacucugacaguuuucaccccuaccaagacuucuaucaauucauugauucuaccaccuuugcacugaccccccacacucauucuuacuucccucuuuauccaguugagguuuuguaguauguuauuuaaucccuugccuaucccuugaaccaucauauuucccugguaaaauuccaaccauaguuaaauauaacucugccugcuucacauuugcacccaugcauuugaaucuuccugaggaaaagcacaaccaugcagacugauaucacuauaauucaacgucuaguguaccuaugaugcuaucacacaauucugguucacuucuuugguucaucacuucauuuagcucauucaucugcuaucuaggagauugcuuuuuuauaucuucuccugucaaaccuucgacacuuuuuucuuugauuucacccauaacugauauucuucgcuuucuguuucacugaaaaaauagaagcaaucauaaaagaauuuuauaagcucuugccaccacuuauuuaucugugccuauauacucuguuccuugggaugaauucuuuguguuuauuucuaaggccuaccccccaacuugugcuaugaucccaccugcucuugccuacaucacuccagccacuuucucccuucuuucuuauuucuuggcccuuuucuaccauuuccuuccuaucauuuuacaaauagucuaauuucugucaucauaaaaaucucuuuuacuuugcaucuuuugaauaugccucaugucuucaugacagcacuccuuaaaauaauugucuaaaccaggccagguguggugucucaugcccguaauccuagcacuucgggaggcagacccaggaggaucacuugaagucaggaguuugagaccagccugggcaacauggugaaaccccaucucuacaaaaaaaaauacaaaaauuugugugaggugacaugagccuguaguccuagcuacuggggcagcugaggcaggagaaucacuugagccagggaggcagagguugcagugagcugagaucaugcuguugcacuucagccugggggacgggagugaaacccugucuccaaaaagaaaaagaauuaucuaaaccagaugucuccaguuccucuccucccacuccuaucaggcuuuuccacugaaacuguuguagcagugacuuccacauugcuaaauccaaugaucaguucucagucagcagcaugugacagagcugauaacuccuugcucucugaaagacaagucacgcuuuccuaguucuuccuguuucaucaaacacuccuuuucucuucuguugaauucucuuaaucuccccauccucuaaacauugguguaccccugggacuauuccucugaucucuuuucuuuucccuucuuuucuuuuuuuuuugagacagagucucacucugucacccaggcuggaaugcaauggugugauuuuggcucacuguaaccuccguccugcaggguucaagcgauucuccugccucagccgucugaguaggugggauuauagaugugugccaccacacccagauaaguuuuguauuuuuaguagaaacaggguuuugccauguuggccaggcuggucucaaacuucuggcuucaagugauccacccaccuuguccucccaaagugcugggauuacaggugugagugaucucuuuucuuuuacacucauuaucgggcucauggugauucugaaauuuauaucccuggccuggaacucuccccugaauuucagucucaucuccagcugccuccgugacaucuccacuuggaugucuaacagcucagauuuguaaaacuccccaucuuuauacuaccaaucuacacuuucuacuguucccaucuaaguaaaugguaaugucuuucuucuaauugcuuaggccaaagaucuuuaaguuauucuguaucuccccuuuuuccccucauccugcauguucaguccaugccauacuguucccuucacuucaaaaaaaauuuuuuuucgagauagugucuugcuguguggcccaggcuggaauguaguggcgugaacauagcucacugcagccucgaccuccugccucagccucccggguagcugguaaucacaggcacacaucaccaugcacgucaccacaccuaacuaaccucagccuccugagcagcugguacuacaggcuaugugcgucaccacaccuggcucauuuuuuaauuuuuugcagagaugggcucuuaccacgaugccuaggcuguuuuccaacaccagcucaagcaauccuccugccuugaccucccagagugcuugggauuacaggcaugagccaucgugccuggccaaaaaauuaauaaucugauaauuuucucauuuaauugcuaccacccaucuucaguuacuauuaccaccaucaaaaguaauaguuuaucuuuuuguuuuuacuuccacucuuacuuccugcagucuauucuuaacaaaacaaccauaaugaucuguuaauguaaguuaggucauagcauuccuuugcucaaaauccuccaguugcuucccaguucaaucaaaguaaaagcaaaaaucauuacaaaguccaacacaagucuucugcccuuuuuaucuccuugauuuaucuuccaguacucccucacugguuucagucacacuuuuaauuuuuaucuuauguaacauauacuuauauagcacuuagcaucauucuaaggacuuuaugaauaugaauauucauuuaaucuucauaauaauauuaugagguacguaucaauauuauuuccauuuuuugaaaugagguaacuguggcacagagagguuaaaguaacuuguccaagagaggugaaaguaacuucccaguuaggaaguauaggagccaggauucaaacccacacagucuggcucuaaaauugugcucacucuuccccagucgugcuggguagucuccugcuuccauaccuuugugcuuucugugcucuucuuggacguuucuucccccaguuucccacaugacuuugcucacucaucaccuucaaggcuuugacaaaucuuaccucuucugugaggucuuuuuauacaaucucauuuaaaauuacaaacagcaacgguugaucuacagugucaucaaggaaggaggaucuaccuuucuguuccauuauucuugugugugccuuccccauccuugaggucuaggacgacuuguggagugcagacaucgcauccguguucuagagagcagaaagagagaaagggaugccuaccagcugaaucucacuuaagacuccauuuucuuguugccagaacuuaauaugcccgauggccauacuaaauugcauagggaccuagaaaauguagcguuuauuaaagguggcaaugagcccaacuaaaagucaggguucuguuacucagguagaagaagggaagagacaaccagcagucucuaccccaccaggguuccaucuuuauccguacuuguacuuuacuaucuuugaauaacauuauaaacuuuuauagcuuagcuaccaaaaauagguugacgacucucauccaugcugccgaaacauaucagcuaccucugauauuggagaucuccauuuagauguuccagaggcuuugugagcucaacguguuuaaaauuaaacuuaucuuucaucuuuaauggcucaaaugugcuccucuuccuguaccguaccuccgugaaugguaccaccaguuuauaucuccuucaccucguacauucacccaguuauaaauuaauuuuguaaauauuucucggaucugccuaauucuccuuccuuauugcuacuguguagaucacgccauaaccccuccccaggauuacaguagaguuaaaucauaacagguauuuaaguucaugucauuuuaauucauacaguucaaaaguggggaagaaaauaacuuuaaauagugcuggguaauccugccuguauucuacucagugaacauauauucaucuggggacugagugugaggugggaaauauaauaauguugcucccucuguuauauuuuuuuucuuuaaagauaacuuuuuuuuuuuuaagacaaagucucgcucuguuguccaggauggagugcaguggcgcgaucuagccaaaccgcaaccuccgccuccuggguucaagcaauucucaugucucagcccucuggcaucuuaagagacuuccuaugaguuccugccuccaaacuuuuuuuuuuuuuuuugaggcagucuugcucugucgcccaggcuggaaugcagugguggaucuuugcucgcugcaaccucugccucccggguucaagugauucuccugccucagccucccaaguagcugggauuacaggcacccaccaccacauccggcugauuuuuguauuuuuuaguagagacgggguuuuacagcguuggccaggcugguauagaacuccugacuucaggugaucugcccaccucggccucccaaacgguugggauuacaggcgugagccaccgcaccuggccagauaacauuuuuuagcauacugucuucauggugcuguuuuaagagauuugcauguauuauucucacaauagcaaugugagguagaaauuguuacauccacuuuagagauaggaaacugaggcacugagugauuaacuagcuugcuuaagguugcacagcuagcuaguuagaagagcuaauauucgauuuaggcaagcuaacuccagaguccacuuucauaacacugugcugccauuuccccacuauuauaggaaccuggaagcuuauuuucuggagaagguaaacuaaaaggacucagcaaucauagauauuagguguaguuaaggccaagaucaccuuacugaaaacagggagauuaagugaaagucuacuaacugaaggagagucccaguuaguaggaguucugagacugcuggcagcaagucuucuacuuucacuuaagggauuggaggaauauuuucaacagaauuucuccugcccaagagaaaagaccuacagguaaaaauaguugagggcccuucaagaaagagcugaguaccuccuguuuaaucaucauauaguuaagcauaccacucaauaagccucuucuguguacacagagcuuguauuuagucuuuuaaugcaucacacuuacgucaagaaauagccaaguaucaccagauauuucaggaaaaccuuuaaugugaaagauauauacuaaaacagccacauacacacacacaagccaauaaugagauaccucuacacauguauuagaaugacaaaaaucugaaacacugacaauaccaaauacuggcgaggaugugggacaacaggaacucucauucauugcuggugggaauaagaaaugguacagcuacuuuggaauacaguuuggcaguuuuuuaaccaaacuaaauauaaucucaucauaggauccaucaguagugcuccuugguauuuacccaaaugaguucaagacauauuucuacacaaaaaccuccauaaagauguuaauaacagccuuauauuuaccaaaaucuggaagcaacuaaaauguuccucagaagugaaagaauuuuaaaaacugauauauuuguacaaugggauauuauucagcacuaaguagaaaugaggugccggagccuuggcucacgccuguaaucccagcacuuugggaggccaaggcgggcggaucaccugagguugggagaucgagaccaaccugaccaacauggggaaacccugucucuacuaaaaauacaaaauuaccugggcguggugcugcaugccuguaaucccagcuacucaggaggcugaggcaggagaaucgcuugaacccgggaguuggagguugcggugagcugagaucaagccauugcacuccagccugagcaacaagagcaaaacuccgucucagaaaaaaauuagcugggcaugauggcgggcaccuguaaucccagcuaguugggaggcugaagcaggagaaucgcuugaaccccggaggcggagacugcagugagcugagaucaugccauugcacuccagccugggcgacaagagcaaaaccucgucucaaaaaaaaaaaaaaaaauacccagcaugguggcucacgccuguacucccagcacuuugggaggccgaggugggcggaucaccugaggucaggagaucaagaccagccuggccaacauggugaaaccccgucucuacuaaaaauacaaaaauuagccaaguguggugacacacaccuguaaucccagcuacuugggaggcugaggcaggagaaucacuucaacccaggugauggagguugcagugagcugaaaucgugccacugcacuccagccugggcgacagagcaagacuccaucucaaaaaaaaaaaaaaaaaaaaaagaagaagaaaugaggcaucaagccaugaaaagucauggaggaaucuuaaauguauacugucaagugaaagaaaccaugugauccagcaauuccucuucuggguuuauacccaaaggaaaugaaauugguaccuuguagagauaucuaugcucccauguucauugcagcauuauuaacgauagccaaguuagagaaacaaccuaagugucaguaagugaguauauaaaaaauugugauauguacguacagugcaauauuguucagacuuaaggagauccugccauuuucaacaacaugcauagacauggagaacauuaugcuaaaugaaaugagccagacacagaaggaaaaauacugcaugaucucacauucauguggaaucuaaaaaagucaaauacauaugaacagaguagaacagugguuaugugggggaugggaagauguucaucaaaggguauaaaguugcaguuauguagaaugaauaagucuacagagcuaauguacagcaugaugacuauauguaauauuguuuacugaaaauuugccaagagaguagauuucaggugcuuuuaccacaaggaaggaagaaagggaggaggaagggcaagagggaaggaagggagggaggaaagaaaagauaacugugagaggguagauacguuaauuugcuugacucuaguaaucauuucucuguguauaucaaaacaucauguuguacaccuuaaauguauauaauaaaacaaaaaaaucugaaaaggcuacauacuguaugauuccaaguaugugacauucuggaaaaggcaaaacuaugcagaaaauaaaaaagaucagugguugccagaguuuagcagagggagcgugaauaggcagagcacccucaccuuuaggacagugaaaugaaucuguaugauacuauaaaguggacacgugucauuauauauuugucaaaacccauagaauguacagcacuaaaagugaacccuauaauguaaauuauggacuuugugugauaaugacauguuaauauagauacauugauuguaacaaauguaccacucuggugcaggauguugauuguaggggaagcugugcauguguugggggcaggagguauaugggaacucuguacuuucuguucaacuuuguugugaaccuaaaacugcuccuaaaauuauuaaagaaaacacaaggaaagaaacagacucagaggaaaagaggaaacagacaauacaagaccagaugaaaacuuaaaaagcuacauuuaauaacuuuagagaacuaaaagaagauccugcauucuugaaacaaaaauaaggaauuauaaaaaggguauauucagaaaaccaaaaguccuagaagucaaaauuaguucaauuguuggguugggagaguuacagaaguuuccuggggguggaaaaaaagagaaagcuugaaaaugggagagaaaagauaagaaaauuagaagaucaguccaggaaguccaacaugcaaauaauagaaauucugcaacaagaaaaaaguaaaagggaugguagaaaauuauuaacaaaauaauacaaaaauugauguaacugaaggaaauuaguuucaagauuaaaaguuuuccucccgguauccaguauaauacuuguaagauaauuguuacccaagacauacugugaaugaucagaaauccaguuauauagauaauauucuaaaagcuuacagagagaaggaacaaacaacacaaaaaaaauuccugcaaagaaucaagaaccacaguagugaaagucuuccuaggagcaauacuguaaacuagaugacuauaaaacaaugccuucaaaauuccuggggggaaaugauuuuaauauagaauucuauaacuagccaaacuguugcuuaagugugaaguuugaacaaugacauuuucauauauacaaggucucaaaaauuuuuauucacccuuacuuagugaacaauagaguauacccuuuaccaaaguuagagaguaacaaagaaacaaggaaucaggcacaggaaagaaguggagggaauucccaggacauaacuaagcagcagaucuaagcaccaucuacagauuggaguugugagguuuuuugugguuuugggaggggguguuuagaugggaucucacucugcugcccaggcuggagugcagugguguaaucuuggcucacugcaaccuccaccucccaggcucaagugauccucccaccucagccuccugaguagcuucccaccucagccuccugaguagcugggacuacaggugugcaccaccacaccuggcuaauuuuuguacuuuuuguagagaugggguuucaccauguuggucaggcugaucugaaacuccuaagcuccagcgauuugcccaccucagcuucccaaaguacugggauuauagaugugagccacugccuggcuggaguuguucuuuucacaaaggcacaguccucgcuccaggucaugccugcccucuggauuguguucaggauggaaacucuuuucuuauuccucugaguaaagggauugucuuucucauuugucggucuaacucuuaauuuguguuaacagugcuugaguagauuagcagucaggccgggcuguuaaaaaagucagaauaaaauagggauugaaccaagguaguaauaaggugaauaaaagaaagaaacagguuaacaaaugguggggugcagcagaguuccaguugagaggagcugauaucugaguaaauguggacaauaaaggagaaguagaugucugguguaucucccagguuuccggcuugagccacuggauuaaugauagugucaucaaugaagauaggaacacaguaggaggagguuguucaaaauaaaaaugaguucaguuuuagacuuauauguagguggacaaggcuuagaacugaagcacaggcuagaaauucauucauucaauacucuugucuacuaauaagaaagagauaaauaagagccaguuacuucccugaaaaagcucauagucuaauaggggaaacaaauacauaagcaaauaauuuauaucuaguaugauaaauuuaacaguuuaaauauguauaaggcauagugauaucuuagaagagagagugacuuugauaugggcaggaggcagggaaauacuggguagaagagggugguuccccagcaaaggcccccaccccccaagccuggaaacccauggcccuaauugggaacaggcauuucuguuuucauguccaaauguugccuucugccugccauccccgcauccuguacccauauaaaccccaaauuccagguccacaggcaggagagcagacaaacagaggagcagaagaggagcacaguaaaggagagaagagaaggaguguuugaacgucaaggagaggucgguuggggacagcuggagaggagauuggccaugggacagcagaacuccaggggaagaucaucuucccacuccauccccuuuccagcuccccauccaucucacugagagccaccuccaucaccuaauacaauucccacauucaccauccuucaaauccgucugugaccugauucuuccuggacacaggaaaagaaucuggguacgaagagggcacugggcugguuaauacuuaagcaaucuguggaaggcagagcuaaaagagcacuguagcaugcccacuggggcuucaggaguugcaggcauguauuccuagaugcugcuguggggcuggagcccaaaagcgcucuccccgcccccuacaccugccggucugcgagcuccgccuccuguaagggguuugagagugcagcagccgaacagaacagacaagccacagcccugucgcaggcccugcccuucgugggggaucaggggacucucccguuucaacuuucccuuaguuggagggugagggucaguaaauguucauggacaacuaagcugaaaaggaauuugacuagcagacaaggcaagagagaauauuccagcaugugcaaggauacaaagccauauacuaccuauuguauucaaaguaccaaaaauaguuuacuguuauuaguaguacauaaaguacaaaggagaaaauuaaacuggagaguuagacaagucucagaucccaaggaauuuguaguuuuugcugaagcagugagaagccacugagguuguugaaaaagagucaaaguagauacuggaauccacuguugguugcuuccaaaaagaauuuugguccuuucuagugcccagaacauaaucucuuucucuggcaaagaaaacguagucuucugucuuccuuuuccuaaagaagguuacaauuauuuuaugaagauuguaauuuugaguaaugauaauggaauaaagaaggagugaaauggccuuugugugcuccucauuuuuuuucuuuuuuaaggcaaaaagguuuuaaaacccucuggagcacugauucugaauaccuucuuuuuauaacauuuucuaaaugcucccuuuacuauaugaaaugaaauucccauagguauuauacccuacugcagugagcugaguaaugcuucccgaaaagguagccacauccuagucccugaaaccuguaauuguuaccuuauauggcaaaaaagaacuuugcagaugugacugaguuaagauguugagauggagagauuauccugguggacucuaaauucagucacauguaucauggagggaauaucauagaggagaugcaggcaacaugaccucugaggcagagauuggaaugacaugaccacaaaucaaggcaugccagcagcuaccagagacugcaagaggcaaggaauggauucuuucuagagcuuucagaagaguggcccuguggacaccuugauuuagacaucgugaaacugguuuuggauuucuggacuuuagaacugagaaagaauaaauuucuguuguuuuaagccaugaaguuugugauaauuucuuacagcagccuuaggaaacuaauacacuacuuacauaauauaaugccauaacaaugaaauaaagaagacacaaaaaguaaauguuagugaugugacuuuccauuuaggaaacaauuuuuugcaaaguuccaaacaaaacaaauuauagucuuuucugcauuuacaugguaauuguauuucuggaaaauuuaauauauauucaaaccauuaaccaauguuuguagcaucugccaugugcuugacacacagagaguauuuaauaaaagcuggauacaugggugaugaauagauggauguauuaaagcuacaaagagaguacauaaguuccaaaauaaacaugcaaggcaaaaauuauguguagucaaacguaucuuuaaaaauucuugggcaggcccaguggcucacgccuauaaucccagcacuuugggaggacaaggcagguggaucacgaggucaggaguucgugaccaguagccugcccaacauggcgaaacccaucucuacuaaaacuacaaaaaauuagccgggcgugauggcgggcgccuguaaucccagcuacucgggagcccgagucaggagaaucgcuugaacccgagaugcagagguugcaauaagcugagauugccaccacugcauuccagccugggcgacaagagugaaacuccacuuccaagggaaaaaaaaaauucuuuacauagcuuaucaaauacaguguucaauaucuacaugacguacuggacacugacacauaccauuucucaauaaagagcugacagcccucucuccccauucccucagcaucguuuggguaucuuaugaaggacaugaguuguuuuagggauguaaugaauuccauucagcacuaugagguacucucaccgacaaucacagaagaauuaaaacugacugaaaggcaauagauauguuucccauuucaaagcucacuguggacauuuucuuaugguuuggaaugguugugagcuguccaaacuauauuuugauguguuuuucuucuuuugaucagggaucauaguucaguaaacccacaguuaaacuaagugggcugaucguaugggucuaucuaaagugaauuuguguacuugucucauccuucuuauuaaugagugguucuaaacuggacuugguuuuucucccauggggcauuuggcaaugucuggaggcauuucugauugucacagccggggauuggggagggcagggugaggcaaggggcuauuggcagguaguggguaaaggccaggaaugaugcuaaacauucugcaauacacaggacagcccccaacaacaaauaaugaucugggcccaaaaguaguggcaagguugagaaacccuggcaacauuaugugugugcuccccuuguguagugauuccuuuguaguguuugccuugacauuagauuaaguguucccuuaagcagaagcugaauuuuuuguuauugaguugcagugaaggaugggugugaaucucugcaggguuaaacauuuuuacauuaaccuuuccuuuuuauuuuuaucaaaaguaauauaugguuacauguaugugugcaugugugcacacacuuaugcagaacuuagaacaguuccccacccauucuucccuaguuuuaucgcauuucccagaguuagcaacauguaaagaguuuuguuuuuaauuuuuuuggugauugccucucuaagucuaaauaauagcuuuugguuaucuauugauuuaagagauuaucuauugacucuucacugcagaagguuagcaaaagcucagcuacacuaaucccuccccuucuuccuucuaauauucauuaguuuauauucgauuguccuuucauugauuauuuuguaauucuaaauuaaauacauauaaacauuuaauuuuguuccaucaacuuuagucaguaucuuuuuaucuucugccuuuauuauacuagcgcuucuguucuuucaccuuccuuauuccuauuuccuauagucugucugcuguaccuuuacauugucagauugacaauauuuacuuucuguuuuauaauuauauuuguuuguuuuuauccauagguugaagccaaaaguugaaaacuauuaccauuuauaggauauaacuguaaauauuguucacugaagagcuaaguaguauacugagaucccagaaucaucucuauauaugcaauaucacauccucugugccaugagaaagaauguuccuaguauucuagcauucuguuuucuguguugaguguuuuaaaaucaugccacauucaguuggcacacuggcaucuaaacacauacuaagaaagaucagaagugucaaugaaauugcauagugaauauucaaaaaaugaaugaccugcaugggcaaauaauacaaaaaaaaaagaucagaggaaaaugauagaaaacacaagaaagacaagaauuucaaaauaauaaggguacauucccaauggccagcuuucugagaguugaacuguauuugaauaacucaugucccucaacccagauccaaagauaauauugcugcugcugaaaccugggcucuuuacuaugaccagaguuuauuaauuguccuauuucauugaggaaaaaaugcaaaacagaacacuggaaugacuagcuggaaauauuccacuauuucaugggaagcagguuucuaaacgauuccuguggaggccaaacucuugcucucgccaaaauauuauagcauuaaagugugccuugaugguacauuaaggaagaaauuuuccccgaauuuacuuaagauuuauagccuuucugcucucacaaaacguagcauugauuucuuuaauaucaaaaaaaguuuccuaaaauaaacugcuaaugauugcuuucagucauuuguuuacuugaggucagucaugccaaguacuguuuguaucaauucuuguaaaagacucaauuaauuuuguaauugucauaauuacuguuauuccuguucuguaggaauaugcuauuaauguaacuggacaucaccacaucuuauuuuuguaucucucaaaacaucuuucauaaaacuuugaugguaggaaagagcugaaaaaaaaucuccuguuaguagaccaaguaguacuucaauuacuaaacaccagagaaaauuaaaauuacaccuuaaauaaaaccaaccagauauuugguagagaaaauggaacuguacaaaaauaugguuuuuaaaaauaaaauucuaccacuuguauuauauucauuauagacuauuggaaaccguucccugccaaaaaaagaaagaaaaagaaaaaaguuugugaccauuuguaauucauuuuagucuuuuuauguauuuuuuucaccuaaaauaauaugggcauuuaaauauuuuaaauauaguuuuaaauggcuacauauuauucuaucaaaaauaccuaccauaauuuauguaaccacuuucucauuguugagcauuuagguuaguuuuguuuuuccaguugaaacaauacccccugaguaucuuugcauauaaugauuucucuugauuuuaguuuuaagacaagcucuuaggggucaaauguuuuaaauauuuuaaagguucauuguucaaauugcauuucaacagucaauaccaguuuacacuguuuucagcauuuuaagaaauugcccaaaugacagagcagaauuuuaaaaguauuucccuaguguugauuugguuuauaugcugagaugcugcagauuuuuuguuguuaaaaagugaguauguggagaucaaacauuuggcugacuguguacacauuuuauuuaguaaagccucaauguuaagcaagaagccauuacucauauucauguugucucaggaauggaaaagugcuucuaauuuuugcaacaaaagaagucugauggcagugacagaaaggaaugacuagcuagauaugcugaccggaaagcuagaauuaggauuugaccauuguagucagucuccauuuaagagccuaaugguuuuuucuucucaauuuggaaguuugcugcauuuagagauauucuuauaaaacuaaaaaaaauagacccagggagcaaguuugagguuacuaaaauguaucccauuauugucagaguugcauuucaaacugucuucauuaaacuguuaguuugauuacauuuucucaaacaguaacuguuguguuuuaauuuuuuaaauuaaaaauaaguuuuaaauuucagguaauugaaagaccaauucuuuuuggaaucuuucaguauuaugguuuugguucacagcgaagguauuugcuugcuacauuugcuaaauauacuaucuauacuucauuuuguugcauaaaaauaagacauacuccgguuagccuuuuugauggguauuaccuugaugacuugcucacugacagagaaacugauguaaaauaggucauuugaaaagcagguguuugauauauccccauauguaacacugaaaagccuucuugcucuagauuuuuggaaggaaagcuuucuuaagaaagaacggaaaagagagaagaaccaaauagacgcaauaaaaaaugauaaagggguuaucaccacugaucccacagaaauacaaacuaccaucagagaauacuacaaacaccucuacgcaaauaaacuagaaaaucuagaagaaauggauaaauuccuugacacauacacccucccaacacuaaaccaggaagaaguugaaucucugaauagaccaauaacaggcucugaaauuguggcaauaaucaauagcuuaccaaccaaaaagaauccaggaccagauggauucgcagccgaauucuaccagagguacaaggaggaacugguaccguuccuucugaaacuauuccaaucaauagaaaaagagggaauccucccuaacucauuguaugaggccagcaucauccugauaccaaagccaggcagagacacaaccaaaaaagagaauuuuagaccaauauccuugaugaacauggaugcaaaaauccucaauaaaauacuggcaaacugaauccagcagcacaucaaaaagcuuauccaccaugaucaagugggcuucaucccuaggaugcaaggcugguucaauauacgcaaaucaauaaauguaauccagcauauaaacagaaccaaagacaaaaaccacauguuuaucucaauagaugcagaaaaggccuuugacaaaguucagcccauucaugcuaaaaacaauaaauuagguauugaugggacguaucuccaaauuagaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaaucaugcaggagaaggaaauaaaggauauucaauuaggaaaagaggaagucaaauugucccuguuugcagaugacaugauuguauaucuagaaaaccccauugucucagcccaaaaucuccuuaagcugauaagcaacuucagcaaagucucaggauacaaaaucaauguacaaaaaucacaagcauucuuauacaccaauaacagacaaacagagagccaaaucaugagugaacucccauucacaauugcuucaaagagaauaaaguaccuaggaauccaacuuagaagggaugugaaggaccucuucaaggagaacuacaaaccacugcuuaaugaaauaaaagaagauacaaagaaauggaagaacauuccaugcucauggguaggaagaaucaauaucaugaaaaucgccauacugcccaagguaauuuauagauucaaugccauccccaucaagcuaccaaugacuuucuucacagaguuggaaaaaacuaaaguucauauggaaccaaaaaagagcccgcauugccaagucaauccuaagccaaaagaacaaagcuggaggcaucacgcuaccugacuucaaacuauacuacaaggcuacaguaaccaaaacagcaugguacugguaccaaaacagagauauagaucaauggaacagaacagagcccucagaaauaaugccgcauaucuacaccuaucugaucuuugacaaaccugagaaaaacaagcaauggggaagggauucccuauuuaauaaauggugcugggaaaacuggcuagccauauguagaaagcugaaacuggaucccuuccuuacaccuuauacaaaaauuaauucaagauggauuaaagacuuaaacauuagaucuaaaaccauaaaaacccuagaagaaaacuuaggcauuaccauugaggacauaggcaugggcaaggacuucgugucuaaaacaucaaaagcaauggcaacaaaagccaaaauugacaaaugagaucuaauuaaacuaaagagcuucuucacagcaaaagaaacuaccaucagagugaacaggcaaccuacaaaaugggagaaaauuuucacaaccuacucaucugacaaagggcuaauaucuagaaucuacaaugaacucaaacaaauuuacaggaaaaaaacaaccccaucaaaaagugggcgaaggacaugaacagauacuucucaaaagaagacauuuaugcagccaaaaaacacaugaaaaaaugcucaccaucacuggccaucagagaaaugcaaaucaaaaccacaaugagauaccaucucacaccaguuagaauggcagucauuaaaaagucaggaaacaacaggugcuggagaggauguggagaaauagaaacacuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacauauguuuauugcggcacuauucacaauagcaaagacuuggaaccaagccaaauguccaacaaugauagaguggauuaagaaaauguggcacauauacaccauggaauacuaugcagccauaaaaaaugaugaguucauguccuuuguagggacauggaugaaauuggaaaucaucauucucagcaaacuaucccaaggacaaaaaaccaaacaccacauguucuuacucauaggugggaauugaacaaugagaacacauggacgcaggaaggggaacaucacacucugaggacuguuguggggugggaggaagggagagggauagcauuaggagauauaccuaaugcuaaaugacgaguuaaugggugcagcacaccagcguggcacauguauacauauguaucuaaccuucacauugugcacauguacccuaaaacuuuaauaauaauaaaauaaaauaaaauaaaagaacagaccagaugcaguggcucacaccaguaaucccagcacuuugugaggccaagguaggaggauggcuugaguccaagaguuugagauuaaccugggcaacauagugaaacccugccuauacaaaaaguaaaaaaugaaaaguuagccugggccugguguauuugcaugugccuguggucccagcaacuccaggggcugaggcaggaggauugcuugagcccaguaguucaaggcugcagugagcugugauugugccagugcacucuagcuuggguuacagaguaagacccugucucaaaaaaauaagaauguacauauuuaauuguaauaugaaacggaugcugaaaaugaacaccgauauaagugacauaucagagaugcucuggagacuugguucauauaauauggaacaaaauuaccuucucaaugccaaauuagaaaaugauauguacauaauuuucagguuuaaaauauauauaccaaggcuuugggauguuaaauauaaggaauguugcccauguauaacauuaucaauuaagcuuaagaauauuaaagauuuguugauuaaaauaauuacuaauuuuugugauagcuuuuacuuuagaauaugugauuugaaaaaaaagaauguugacauuucacauaguuggaaaaaauucuaguucuuaguuuuguaacuuaauuuuauguucuaaaauaugucucaaauccacccuuguaaaauuauuagucuuuuauuauuaaagcauaaaguuugcuacucauaaaucaaauuauauaucucaaauucaaagcuaaauugcccuugugcauuguuuagcaguauguaaauacauuuuagaaaagggcuguaucauucaugaaguuuccaaauucguugaucaauucugauaauaaaguuaaaauuuuuguucuuaauuaguagaucucauuauuuuuucagcauuccacugacuucuuucuaacuuuguaguaaugauagguaaagacuguaucuggcuuaaaaaaugcuuauuuuuacauacauguaggucuuugauuaugaaaguaccgaggaguucuuuuguuuauacaguggcaguugaaagaaaacccauguauaucuugagaagauuuauuggaacuagcuuugagaaaugaugagccauaucuuuaacucaauaaaagauauguauugcuguaccaagccuugguaucugcuauucucuuuaguguaagcacuuuucaaacuauaggauuauacaaauaguagcaucacuaguuaaaacauaaagcuauaugaucuaaagacauaguuuugguuauuuuuugagccauuuaauuuucaucuuuucugugaccacauuuauuaaacaugugacaugaaaauggaauacucuuuuaugaugacaaaagaaaguauaugcccagccaauuaugggauaagaguauuauuuuuugugaacacauuaucaucauucuagacaccuggagaagugaauaucucugaaaguaucauacauuuauacuuuaacuuuauuuacauauccaguuuucagaaaccauugccaaugaaacauuuggacaaugugguaugcaaguacuguauaguaagaaguagggauguucuugaguaauuguuccauuugaauuaauccagcauggguaguuguuagacaaccaugaaaugugcuaagcuuuaccuauucuaagaggacucuauucuuacagaccauaagcguucaaaaguuuuccaagaaaaaaagguuacuucuuuaaauuuagucugcccauucaaaagcuacaauaaggcagguggauuaaacugcuaggaguugcaauguuaguauugagagcauuuaagcaauuuaaaaucuuucagaaugccuaagaucacaaauuuaccccugaucagccuacacagauuaacuuaaaauacauacagagagaugucagauagcuagagggucauaaauuagugaccaaaauuacaucaaucugcauguugacauuguuuaccuuauauugauuagaaacuuuugcuuaggaaaaaggggaaauaacuuuuauuuuaaauuauacuuuaaguucuaggguacauguacacaacgugcagguuuguuacauauggauacaugugccauguuggcgugccgcacccauuaacucaucauuuagcauuagguauaucuccuaaugcuaucccucccccucccccaccccacagcagggaugugugauauuccccuuccugugcccauguguucucauuguucaacucccaccuaugagugagaacaugugguguuugguuuuuuguccuugggauaguuugcugagaaugaugguuuccaauuucauccaugucccuacaaaggacaugcacucaucauuuuuuauggcugcauaguauuccaugguguauaugugccacauuuucuuaauccagucuaucauuguuggacauuuagguugguuccaagucuuugcuauugugaauagugccacaguaaacauacgugugccuuugucuuuauagaagcaugauuuauguuccuuuggguauauacccaguaaugggauggcugggucaaaugguauuucuaguucuagaucccugaggaaucaccacacugacuuccacaaugguugaacuaguuuacagucccaccaacaguguaaaaguguuccuauuuuuccacauccucuccagcaccuguuguuuccuaacuuuuuaaugauugccauucuaacuggugugagaugguaucucacugugguuuugauuugcauuucucugauggccagugaugaugagcauuuuuucauguguuuuuuggcugcauaaaugucuucuuuugagaagugucuguucauauccuucgcccacuuguugaugcgguuguuuuuuucuuguaaauuuguuugaguucauuguagauucuggauauuagcccuuugucagaagaguagguugcaaaaauuuucucccauuuuguagguugccuguucacucugaugguaguuucuuuugcugugcagaagcucuuuaguuuaauuagaucccauuugucaauuuuggcuuuugcugccauugcuuuugguguuuuagacacgaaguccuuaacagcccaugccuauguccugaaugguauugccuagguuuucuucuaugguuuuuaugguuuuaggucuaacauuuaagucuuuaauccaucuugaauuaauuuuuguauaaagcguaaggaagggauccaaguucaccuuucuacauauggcuagccaguuuucccagcaccauuuauuaaauagggaauccuuuccccauuuccuguuuuucucagguuugucaaaguucagauaguuguagauaugcgacauuauuucugagggcucuguuguguuccauugguauauauaucuguuuugguaccaguaccgugcuguuuugguuacuguagccucguaguauaguuugaagucagguagcgugaugccuccagcuuuguucuuuuggcuuaggauugauuuggcaaugcgggcucuuuuucaguuccauaugaacuuuaaaguaguuuuuuccaauucugugaagaaagucauugguagcucguuggggauggcauugaaucuauaaauuaccuugggcaguauggccauuuucacgacauugauucuuccuacccaugcgcauggaauguucuuccauuuguuuguaucuucuuuuauuucauugagcagugguuuguaguucuugaagagguccuucacaucccuucuaaguuggauuccuagguauuuuauucucuuugaagcaauggucaaugggaauucacucaugauuuggcucucuguuugucuguuauugguauauaggaaugcaugugauuuuuacacauugauuuuguauccugagacuuugcugaaguugccuaucagcuuaaggagauuuugggccgagauggugggguuuucgagauauacaaucaugucaucugcaaacagggacaauuugacuuccucuuuuccuaauugaauacccuuuauuuccuucuccugccugauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauacgucccaucaauaccuaauuuauugagaguuuuuagcaugaaugggcuguugaauuuugccaaaggccuuuucugcaucuauugagauaaucaugugguuuuugucuuuggcucuguuuauaugcuggauuacauuuauugauuugcguauguugaaccagccuuccaucccagggaugaagccgacuugauuaugguggauaagcuuuuugaugugcugcuggauucaguuugccaguauuuuauugaggauuuuugcaucgauguucaucagggauauuggucuaaaauucucuuuuuuugguugugucucugccagacuuugguaucaggauaaugcuggccucauacaaugaguuagggaggauucccucuuuuucuauugauuggaauaguuucagaaggaaugguaccagcuccuccuuguaccucugguaaaauucggcugugauugcaucugguccuggacuuuuuuugguugguaggcuauuaauuauugccucaauuucagagccuguuauuggucuauucagagauucaacuucuuccugguuuaguguugggaggguguaugugucaaggaauuuauccauuucuucuagauuuucuaguuuauuugcauagagguguuuauaguauucucugauuguaguuuguauuucugugggaucgguggugauauccccuuuaucauuuuuuauugcaucuauuugauucuucucucuuuucuucuguauuagucuugcuagcggucuaucaauuuuguugaucuguucaaaaaagcagcuucuggauucauugauuuuuuugcaggguuuuuugugucucuauuuccuucaguucugcucugaucuuaguuauuucuugccuucugcuagcuuuugaauguguuugcucuugcuucucuaguucuuuuauugugauguuagggugucaauuuuagaucuuuccugcuuucucuugugggcauuuuguccuauaaaguucccucuacacacugcuuugaaugugucccagagauucugguauguugugucuuuguucuuguugauuugaaagaaugucuuuauuucugccuucauuucauuauuuacccaguagucauucaggagcagguuguucaguugccauguaguugagcgguguugaguuaguuucuuaauccugaguucuaguuugauugcacuguggucugagagacaguuuguuaucauuucugcucuuuuacauuugcugaagagugcuuuacuuccaacuauguggucaguuuuggaauaggugugguguggugcugaaaagaauguguauucuguugauuuggguuggagaguucuguagaugucuauuagguccacuuggugcagagcugaguucaauuccuggagauccuuguuaacuuucugucucguggaucugucuaauguuaacagugggguguuaaagucucccauuauuauugugugggagucuaagucucuuuguaggucucuaaggacuugcuuuaugaaucugggugcuccuguauugggugcauauauauuuaggauaguuagcucuucuuguugaauugaucccuuuaccauuauguaauggccuucuuugucucuuuuuaucuuuguugguuuaaagucuauuuuaucagagacuaggauugcaaccccugccuuuuuuuguuuuccguuugcuugguagaucuuccuccaucccuuuauuuugagccuaugugugucucugcacaugagaugggucugcugaauacagcacacugaugggucuugacucuuuauccaauuugccagucugugucuuuuaauuggaguauuuagcccauauacauuuaagguuaguauuguuaugugugaauuugauccugucguuaugauguuagcugguuauuuugcucguuaguugaugcaguuucuuccuagccuugauggucuucacaauuuggcauguuuuugcagugacugguacugguuguuccuuuccauguuuagugcuuccuucaggagcucuuguagggcgggucuggugaugacaaaaucucucagcauuugcuugucuguaaaggauuuuauuucuccuucacuuaugaagcuuaguuuggcuggauauuaaauucuggguugaaaauucuuuucuuuaagaauguugaauauuggcccccaaugucuucuggcuugugaaguuucugccaagagaucagcuguuagucugaugggcuucccauuguggguaacccgacuuucucucuggcugcccuuaacauuuuuuccuucauuucaacuuuggugaaucugacaauuauauguuuuggaguugcucuucucguggaguauguuaguggcguucucuguauuuccugaaugugaauguuggccugccuugcuaggcuggggaaguucuccuggauaauaugcugcagaguguuuuccaacuuaguuccauucucccuaucacuuucagguacaccaaucagacguagauuuggucuuuucacauagucccauauuucuuggaggcuuuguucauuucuuuuuauucuuuuuucucuaaacuucucuucucgcuucauuucauucauuugaucuuucaucacugauagccuuucuuccaguugauugaaucggcuacugaggcuugugcauucaucacguaguucucgugccgugguuuucagcuccaucagguccuuuagggacuucucugcauugguuauucuaguuagccauucgucuaauuuuuuuucaagguuuuuaacuucuuugccauggguucgaacuuccuccuuuagcuuggaguaguuugaucuucugaagccuucuucucucaacucgucaaagucauucuccauccagcuuuguuccauugauggugaggagcugcuuuccuuuggaggaacagaggugcucugauuuuuagaguuuccaguuuuucugcucuguuuuuuccccaucuuuguuguuuuaucuaccuuuggucuuugaugauggugacguacaggugggguuuugguguggauguccuuucuguuuguuaguuuuccuucuaacaguuaggacccucagcugcaggucuguuggaguuuacuggaaguccacuccagacccuuuuugucuggguaucagcagcagaggcugcagaacagcggauauuggugaacagcaaauguugcugccugaucguuccucuggaaguuuugucucagaggaguacccggccgugugaggugucagucugccccuacaggggggugccucccaguuaggcuccucgggggucagggacccacuugaggaggcauucugucccuucucagaucuccagcugcgugcugggagaaccacuacucucaucaaagcugucagacagagacauuuaagucuggacagguuucucugccuuuuguuuggcuaugcccugccccuagagguggagucuacagaggcacgcagggcuccuugagcuguggugggcuccacccaguucgagcuuccaguccacuuucuuuaccuauugaagccucggcaauggcagcgcccaucccccagccucgcugcagccuugcaguuugaucucagacugcugugcuagcaaugagcgaggcuccgugggcauaggacccuccgagccaggugcgggauauaaucuccugguguaccauuugcuaagaccauuggaaaagcgcaguauuagggugggagugacccgauuuuccaggugccggcugucaucccuuucuuugacuaggaaagggaauucccugaccccuugcacuucccaggugaggugaugccucacccugcuucggcucaugcucgguucacugcacccacuguccugcacccacuguccaacacuccccagugagaugaacccgguaccucaguuggaaaugcagaaaucacccaucuucuguguccggaaauaacuuuuaauauguacagcuugagagaaagaaucuuucagaaaugagauagagaaacauaauaaaagaauccuuggugauuuucuuaaaaaguaaaaaccgucacuacugagaaaaagacauguuuuacaaagacaucugaaaaucauagguauuguggcuuauguuuugggauggaaaugaaagauuugaugaaaauuaccagagauuuuuacauaaaacagcugauuaaagccaaccauccuuuuuaguguugccuuuauuugaggauguuagggagaauuuucucauuuuguguuuaguccugauuggccuggaucauaagaauuauacuguauuuaguuuguaguaggaccugcucuucucuuuaggaccugacacauaaauaguuuuguguaaaagugaacauuguaauuucucuuaacagcuguaacaucuuaugaagaucuuggacucuuugcauuuggauuaccuggaaagguaauuuuuuuuccuccucauuguguccaaaacccaaaguggcauuuuuccuuuuguuucaaguuaaaagagacaaguauauacaagaggaagacauuagaggaauaaaaggaaacuaaagugagaaaagagagaaugauaggagcaggcaaagaaagagaagucuuuguguccuuccuaaaaaugcaucaauacauuuaauucaaugcuugaaucuuuuaauauuuuucauccuaauaaaguagcacaaugacuugaaugacuuuaaaagaguaacgaugaccuguuuuaaguuguauuaauuuugauuauguacucauaugaguaaacccucauaaagacaagaaaagaaaagcaacaucgaauucaaauuguagcauggcuauuuacaaaaccaguaaucagaagaucauaucacuuaagaauugaacauugcuacaagauuaucuagcuauccucucauuuauaggugaggaaauuaaggaccagagaaauuaagggaccuauuugucaacuauuauauaaagccaguaccacauccuagaacucuagaucuacugcuuuucuuacucagaauaagagaaauaacagcaguauuuauggggcacccacuugcaauagggauacuacacuaguuuaauagguagagaaaaauaauugucuuccaccaguaaucaggaguugaacguuacuguuagugcuauaguauauauauuuuuuaauuucugaagaacuacuauacuucuaaaauucauauucauuuuggcuccaaacaggaauucuuuuguuuguaaaucuguuguuuguguuuuuauguuuucgauugacaaauacaaauuguauauauuuauuauggacaacaugucauuuugaaauauguaaacauuguagaauggcuaaauugaccuaauuaauauuugcauuacuucacauacuuaccauuuuuuguuuuauuuuuauucuaaaaggauacucuaucuguaacuggcuaaacuaacuucugaaagugagucuggaggaaauauauauagcuauacaauggaaagaaaaccuguauuuacauuccaguuaacuuugguggaguuuuuuguuuuuguuuuuucagacagaguuucgcucuuguugcccaggcuggagugaaauggcaugaucucagcucaccacaaccuccgccucccugguucaagcgauucuccugccucagccuccuaaguagcuaggauuacaggcaugugucaccaggccuggcuaauuuuguauuuuuaguagagacagauuucucuauguuggucaggcuggucugggccucccgaccucaggugauccaccugccucggccucccaacgugcugggauuacagcguuagccaccgcgcccggcccuaacuuuguuuuuaaaguacaaaaaggaaugcuuaaaucauauacuauauagcaucauggcuuggaccuuagucaccugaaacuuaaacaaaacagaauauguuacuugaggguaaaagguuuuguuaaucuuccuuaguagcaauguuucuguucuagaggauuaggauguuugguguagccagggaucaguuuccuccaucuaguuuaaacaaagaagaaaauauuuuuuguaugagaaaauuccacaauuaauauaacauaaccuauaaacauaacucuaaguaucaacacugacaucacugucauuucauguucauauuuccugcguugcuuguauagcagcaaaguuuaaagaguagggacugcugagagucuucuuuuccuaaaccucuuagaguaguuguguugucauuuuaauacaugcaccaaaaaaguucauaguaggcaggaacacuagacaaagcauacucugaaugaggaguuguuguuugguugcuuguuuaaauuuucuccacacuuccacaguuggguugaaacuuaaccauuuccuucuauccagauguuauauaguuauaauaugggauaauauuaugauaaagaaauuuuuugaaauguuuugaacuuguuaaagauuuauuucaaugucuauaaauugguauuuauucaccagacaaauauuuauugaucaaauacuuuguaccauguacugugcuaggcauuaaaaauauaaguagguaggcagguggguagauagauagauauucuagcuuucaagauauuaaaugcuuaaauucagccaaagaaugaaagaauaaucaucaauaaguuaauauuacuguuuuuugcaauauauuaauugaaaauaaaaccaaauuucauguauaccuacuacugacaguagguaucauuuguacugaagauaguauacacaaguucaaaauagucuuuucacaaauaacuucgacauuuuggaacuaaguuuuacauaggcugaaaugcagaauuuuuucuggagagcguucaaguggcaaucaccacaucuccaaagacacuuugccagauuuucauaucauuagcccuccucugcaaaccucaaggcuccuagguccuaauaacuuagauuguuuucaguguaggcaaaugcugugccacugauagaauuccuaacaaagaugggcaugaaagauuaucuguucccaauucauguagaacugaaugauucuagacagcuagucagcuccaggcauacguugggguuccgauccauuaagacuugagugauugaaaggcccacauggaagcacaguguuuuacuguuuccucuaagcauaucugauuaccuugaguuccccaggaaucucaucaaagaugauaagcuaacaagccuacagacugaauuuaguccucaggcacauuuuauauggcucaaauauuuuuuauuuuuaacugauuaccaacuaagcaucauuaaaguaugaaaaaauuucauuucugacuuucuuugaaaaaucagaucuggcuacauuggauccacauucucacauauuaucaacuggccagagcugaguagcaccugccccauugaagggggaggaauucuccaauauccuacaguucuugccaacucccauugucuuauauucagcuuaauucacauuauugaguuuggaacauuuugccuauauuuucaggguuugagaguaauugggcucuagacuuuauuaaucucugggacugggaugcucaaagucugggaugcugauauagucagaaaacuuauaucauuuccuuuuaggcaauauagcauuggcauagcacacccagccggucuuuuucuacuuauuuaagcagugugauaaaaccagcaagaagggaaugagacaccacucccacacuuuuaauuuuuauacuugauaaucaucgauuacuagcuuuuaacacuuuuaacaauuuaaaagugacugccaagaaaaauuucaaaaacuucuuuauaguaacuuuggaacuauuaaagaaauacuuuuuaaugugaugauuauuaauuuuauguauuucaaaugacuggcagauuucuuuuuaguuucuccucacaacuucugcaucugcuuuuuuaguaauaguuacuggauuuuaauaaaauacugauccuuuuauauuguuuccccuucuaucuucugaauauuucuguucuuuuacaguuggugguggcaggcaccauaauaauucagaauauuggagguaagcaauugcaagugcacuguuuauacauaaaugugauggcaauaauguccuuugaauuguuaucuuacuacagaucuagcugggaacuucuguagacauagcuaucuucagaagccuguguguuggccucuuuacucuuuuuuuuuuuggauccuuuuuagcagcacuugugacaguagcuucuaaauucaguuugagcuaaacccugauugcagucguguuauuaggucugcaacacaccucuaaaacauuggcuuucugugauucugaagguaggauacagucuggaaaagcucuccuggugauuuuaaaauauuuucccucuacuuuuguucuaaucacccuauuggcagauacuacuuuagagggauuaguguuccgugggcugugaacaagcaaguauggacaacaguguccucuuguaaccaagaauuuaaaaugaccaagugguuuaaaacauaaauaaaucugagauaaauaagcauucucacauuuauccuguaucuuguuccuauuaauaaccaauucuagaaaugaucucaauauugagaacuauguagaaauaaaacuacuguuaauuauagacaguuacugaguaaauguauuaaacauuuaaauccaaaauauggguaucauguguguauauguuguaaagaaguugcguagugcugaacaauaucuucguuuucuuuuaucauugacuggagugcuaaauaaaugcucuuaaaggaaaauacacagaaaaguuugacauguacuuuggaucuuauacaggauuguauagucagaggacauuuuaaucuuauuuuuuacauguaacaguuuaauucaaagaugacaguuuuaauaaacuucagcucucauaaucaagaggucugagcuauaucacuuuaaguauuguucaaucaaauuccaucguuaauagguuuuuuugguuaaggaaaaauugacauuccaccagugaauugugcugccauuguuuuagaauccuguuuuaauucuuugaauuuucaugaaaaaauaugaauaaaaagaaugcuuucuugcaugccauaccaaauaauuuucuccuaacacacacuacuucacacuucacaguagaaagucaagaaaaccagucucuucauuuaugaauuuauuauagucauugauuuuaagaucuauuuuggaauaauuuauuuagcaacuaaguauugcuuaacugugcacugauaauguuucugaauaugauguauauuuuuauauuuuuaaucccucuuuauccucucuguauagauucuaagaacuaucacauauuguuuagguuagauugaaccauuguuuaacaguuuauguagacuguucaguucagcaauuuagauccaaauuugugacccuggcacaaggcccacuguuguauucuuugucccuuucaccuugauuccuuccuuguucucuaaucuuguuuauaacuguuauuggagauggcuauacuguagcacuuggcugcuacuagauuuaacuucucuguauguaugcuccuguaccccacuauauuguuaaguuccuuuagcucaaaaguaugccucauuucucuuuguacucccagcaccuauuacaccugggaauugauaaacuuguugagcagaauagagcugaaaugauuuguauaaucucuuucuaaguaccuuaaauauucuagauauauuuaucaagaagagaaaagggaaaugcuagaccggcaucuagcuucagguauuugaaagacugaacaugaaauauaaaaaagacacuagacuaauucaaguauuguuccagagggcagaacuggugcuaauguauagaaaucuacagagaagcuguuuuggguuuucuuauucggaguacccuuguaacuaagcugugugauaaugaggauggccuacaucccuuugaaaaugcuccuuagcccugaaaacauucaaacagagcugguuggucaguugccagaauucuagaaaggauucuugcauuuggagguggauaaaucaugaguuuucccaacucuuaauuuuguugguuugcuugcuugcuuauuuuagaacuuuuuuuuaaaaaggugauuuagaguggucacagcaguuuuuaaugucccuuaaauuuagaaaagcuaguaaugcuuauuuaguuuuuagaaugauauccucaugauuuucuucacauugguuaaaaguguauuaagugcccagucaguaauaaccaaauacauauuuucagaguuuuuucugucuuuuuucguagccagauguacauaaaccauuucuuuauuauaauagaauuggaagcuugcucuugugagcagaacacuagauuggaagucagauaccuugaauucugucuacuccagucucugccauuggguagccaugugucuuguggaaaucccucacucucacugucuuggcuucaguucccucuuuguuaaauuguuggacgguagagugggaagcagggaguuuaaggucccuucuuaccccaaaauuugaauucaaauuuggcacauugggaggcauauuaauuauuuuaacguauuaacguauuuuauuacaggaaaguucaaugcgaggguuauacuugguucaaaagaugauuuggcccuuucuuagguaucuuuaacaaaucaauaacuauugcccuaaaagcauucauggaugcuauuuuuugucacuaagcaaaagggaacuucaguucuuaggacuacccuuuagaaccuccucuuagguuaaagucuaggaacccuagccuuaaaaaguaguuucuugauugauauauacagaaucuguggaacuucuaguccauguaugcuugcaaacaacauacuuauuugggaggauauuuaauauacugugucauuauauuaaauaaguauauauauauauauacaguuuuauuauaauaaauaaguuaaucguacaaugaccaauguuacuucauuaaaauggauuuugauuauuuucuuuauuaauuggaaauauauuggauauuuaaaagauuauauuaaguguaaaucagauugaauuuuuacacaucuuaagugccugucugcaaauaauguaguucagauaacuuuuuuuuaaaagaauguuuguuaguauaaauuaucugacuuuugcagugguuguuuacauuaaaacugaaaaauaauguaauagauucuauuuaggucaagcacucuacuagauacuuuaauuauaacaacucuucaauauagauauuaucuucauuuuauagagaagagaucagugugcaguggagauaaguagcuugcucacauuuaucccauaaugaagcuuggauucaaaccuugcucaguuggccuuuauucuuucugcuaugauauagcaaauguuugaaaaaugugaaaagauuaaauguugaagauuuucuaacuucuuggggacaggaacuauguguuuuuauuuguuuuccuaacuuuaccuaguuucugagaagagcucaauaaguaguauuuguugaaugaauuggacaguuuuuaaaguucugcuuaaaagccuaagauuuugccucaaagagacaauugaauauacuauguaagugauaaaaaaagaaacuugaaagaccauagaaugacuucuaguuuagaauuauauaaaaauuuaaaaguucaaaauacuggggagaguuagaucucauuuauguaaaauggguuaacaauauauugaaauaggcuggguguggaggcccacgccuguaagccuagcacuuugggaggccaaagugggaggauugccugagcucaggaguuugagaccagccugggcaacauggugaaacccagucucuacuaaaaauacaaaaaauuagccaggcuugggguugugugccuguaagucccagcuacucagguggcugaggcaggaaaaucguuuaaacccgguagacggagguugcaguaagccaagaucucgccacugaacuccaaccugggcaacugucucaaaaauaauaauaauaauaauaauaauaauauauauauauacacacacacacacacacauauauguaaaauaucuauuauuuucagguuaagaaaaucauaucuuaauguuucuuaacucucuuauucuuuguaacauuuaaauacuucucaguuuucaugagauacaauuccuguggugaauccaugaaaaaaauugaaauggaaggccuuuaaaagcaaaaugaccauggauugcccuugaucaauauuuguuucaugugucuuucgccaaagacccaguuuauuucccacauuuccauauuccauaaaucaaauuaaugugcucauuuauuuacaucccuaguacuuagcacauaguauacauuuaguaaauaacauuuauuauaggaagaaagaaaggacuaagaggggagagggggaaaagcuagugaccuggcuuaguacuccuucaagagcaaaaagagaguugauugaccaggaagagaaagcccaguauauguaagugagcauauaguuuuuaggaaagcgucuacuguuagaacuucacagaaaaucguuuuucucccccaagauuaaucaggcaccaaguauuagucacaaggcucuaguguggucugacaaauugauugaaaaaaucuacugucuguaaaucucuaaauuuuauaauggaaaaaaaugcaacacacuagauuuaacacucuuauucuaagguuauagaaauccuuggcuuuggaaauuugggaaccauauaguaaauuacuacuuaaaagcaauuccugauaucuucccaauacuaaugaauaacaggcucaacauuggcuagagccagagguaacccucugcagcccauuuccucaggugcuggaguagcauuuguugagagccacugcuacugggacccaaagucagaaaagaugugucuggaaguuuuaacauuuaaugcuguuauaggggacaauucuggcuuagagaguuugaauuuggcagccuaacuaaagauaaaagauuaauaacuguaguagaaaguaaguauaagguaguuuucacauaguuccuguaacaguguuguauuaugugauucuuuucuuaaaaacuaagguaaguaguugguuucacauucauuugaacuccugaaguaaaccauucaguaggcuagaauuaucacuagaaaucaaacacuacaucccaaucaucuucuuagucaagccagaaaaagucuuauuaacucuuacaagcacaugauaacagugaagucaauugauguuauuucugguuucacaacuugcccaauucaaaauguggaaagaugaguagcuccuagggggauguuauauucuuauuuugcucuuauaaauaugaaggauuacuaugaauagcauaugcuuuccuuaauucuucaaagccccaguucuuuaaaggagauuaaaaauuuaaucauuacuacguuuugugaaaggaaaaccauaaacauuaguagucuuacugaaaccuccugaaauugcuagaaugacccagauguuucagucuggcacagaauccacacaccuuacucuugcagccuuuauuaacaccucaguuugguaaucuauggacucggguaaccccauuucuaaaucucagaaagguauaaauaagaucauuuucaauugagaauuauaaaaaucucaaauucucaguauuugaaaaauucacaauauuagaugcuagaaacuacuuggauuugcuuucuuccuguauauucauucaugcauuuuauuuauuuacuuuuugguaggcuaguaaaguacuaagaguguuucagauauacuaguuuguauugucucuugggaaacuaggauugggcgcgcagauacaucgccaucugcuggucaguuuaucuguggugaaacugcagcuuucuugagacuugucuagaaauucuagaaagcacugccuuagaauaggagagguacaggaaauuuggagagucuuuuucacaagcacuucauuugacaacauuuacugguaguguaucuuuuuuaagguuuugaaaauauuuuucauaguaauuucuauugaaaauuauaaaauuuucagaacaguagauauuuuggucauuuuuuaaucaaauuuaagauccugaaaaugauaagacaaagauauacauuuuuuucuagggucaugggggagcauuuucccccauauauuuugauuuucauuuaugcauguguucuguacuauuugagugcauauagaacuucaguggcauuuagauauuuugugggaccaccagauuaaugagacacauugaauagaauaaaccaguuaguauccaugacuaaaaacauguuugaaauaaaauugaaucucucugagacagaaaggcaaacuuauuuuuuccccguagcacauccguuuguuuagggcugaguaauccuuuaagaauugcugaacuucccccaagugcugaaaaccuaauucuguuuuaaaaauagcuguaaguaauucuguccucauacauauauuuuacauguuuaacaaaaaagauucuuaucuucauaaacuguaaugaugucuuaggcccaaacuccaauuaggguugguuuguuuuuuuuaaguuuguaugcuuaauaacgacaacuugggaagcauuuucagagugcugcgaaaaauaacucauaagaauacaguauuuggaagcacagagacugauuuuuauuuuuuggauuucaguggaguguuaauauuucaaauacgugagaauaggaaacuuccucuucagaacuacaaucacagccguaaauacaguagagucauagcaguagaugcaauagaaucucaucaugaaacuccaugaauuuugaacuaaucacaucaccaaaggagcuccaauacugaaaaaugaaauacauugaaaauauaucucaagaugaaaugaaaauucuaaguguuacuaaagcuucugacuaauguucucugugauauucauuuccuuugaagucaacuguuaaucucagcauucaaaaguaguuuguuuaaauacugauuuaaaaaagaaaaauaauucugaagagugguacuucugguagacuuuccuuauuugucuuuguuuuguugguuuacuuuuucacuuugcuccugcacuuucucauggcauacuaguuaauagaacgaguuucucaacccaggcgggcuguuugcaccaucacuagcuugggcaaguuacuucuuugugcuuccuuauauucugugaaauaaguaauauguaccucacagguuuguguaaagauuaagugaggaaauaacuuguguagaauacuaccaagcauacaguaggcaucuaaaaaacaaagauguuagcuguuuucauggaucucugcccagagucccuucccuguuucuguguuucuaacaucucuccucucaaccucccgggcccaauucauuuauuucacuuuauaauuagaucagcagauauuaacaccuugcaacuugcuauuaccuaaucagauuuuaccccauuuuagucacuuuuuaauauuacuguugcuucuccauguuguuuuuaaagagugcuuucaacuucuguguuuucaguugacagauguuuuauuuuuucccagagaaguuucuauuaaaugaguuauauuaguuuaaaauuaaguagaaaagaauaccuauuuaguuaaugugcuaaaacuaagugauuuauaauggcugaauaccugacaucaagguauaucuucuggcacugauuuuggcuuuggugguuuggggccacuuaacuauaugcauggcucuuguggaugacccaguugcagcuauuaauuuagaguagaacauggugugucuuguuuuaggaaucuauacuagguguccaugucacccaaaaucauuugcaaauuuuugcuuaugauuggucuguaagauaagugcuuaaacacuuucuuaugccauuuauaaaagacauaagacaaaaacuguggcagacagcuauuugaucuaguaaaccuuuuaguuaaaaacaaaggcaauaugagcauuccuaucaauaguauaucuuuaaaacuuuuccaguucauuuuauugagcugauuguucuuuuguaugaauuuaauuaagauauauuuccuaacuuaauguguauuugguaaucuuuuuguuucuuuucuguauuauauauaauauaauguguuaaagugcuagcuaguucuuacaugaaaguuuacuugugauuaagaaaaaaauaauuuucauagugaauagaauggugguggccuuuguuuuacuggcuuaauccguguggguuuuccccuauaguaaguucugugguuguauacucuuaaaauauauacuaacauucucuagaaaagaagcaauguuuugcauguuuuauuauauuuguaucuuguaugugaggucuucuuugagagagaaacacguuuggugaguucauauuucuuaaaauauacaugauucuucagacuggaaucuaaugaaauaguacucccauuugaaaaccaaagaguugaggguacaacaaaggauaaaagugaucagaugauuagccaggggcuaauagaaauucuggaaagaaugacagauauuauauuagaaagaaauaggaucucauauucacugaagcuuucuacagcuaaagguccaaaagaaauaauagaaaauuacugaaagagaugaaugucugaaacuuuagaaaugcaugugguguuggauuaauccaagcaagaaagaaagaugggcagauaauaaauuacauuuuauaggaagucugcuuuccuuguuuucaaaguauuuugucuuuuuucuuuucugucucucucacaagauauauuuaaguaagucuaggccgguuucagaaaauucaguucacaauuuuuaucuuugcaccauauguguagaguucuuuggaaucgguaaaauauuauaaaaacuccaaauccuugaauggagaagguuagucuaaaccuuccuucuguucugugccaaauugauagcauuuuuccuuacgagaauaugaacaauacagaacacauuuucacauacaaucaguuguaauaccccauaacuaaaagauuuugcagaaaugucucaguggauuuuagucaacccacugagacauagcuguacuucugcuagggaaaaagaaaucguuguaaacugaaaaaauauguauauguauauuuucaucacagagaagugauuauuuaacuguucuaaauuuuacuuugacauaaauacauguuauuuuacuaaaaaaaauugagaguguauguuuuugugucuauaguauuaucuaucuccauacaaauuuacacgcaaaguagcauguauccuuuuuuuccucaaguuaaauggucacauagcauuguaaucaugaaguucagcuccuuucaaaugauguugauugagaaauauacauucuucuuaaacuauuugagccuuuuaaucaauuuuuccccagauuuuugccauugaaacuugacuuucauuuuuguucuuagcuuuuguaaguuuuguaaggagaaagugaaauguuuccugauauauaaauaaguaauaaaauuaaugugcacacaaaguauacucuuuauucuuuuuuuuuuuuuuuuuugagguggaauuuugcucuuucacccaggcugaagugcaguggugcagucucggcucacugcaaccuccgccuuccaguuucaagcgauucuccugccucagccucccagguuagcugguauugcaggcaacugccaccacgccuggcuaauuuuuguauuuucaguagagacaggauuucaccauguuggccaggcuggucucgaacuccugaccucgucaaccgcccgccuuggccucccaaacacucuuuguucuucaugggcguuuccuuuuuggccccaacacauacacacaaacauaaucucugggaggaaagagaaucuuacucuguuaaauugaaguucugacuacaaaucuucugaguuucuauauauuuaagcuuaaacucaaguauuuacauaugaaugaguucuguauucuguaaccauauuaaaacuuuuccuaguauuuuuauagaauuuguuuuuauagcuacaucagaauuaggaucguuauuaaagugcuauaaaagguaguuauuuaucggacucuguuagauuaaaugugagaaauaaugcuagcuucagguuaugauuacauaauauagaugaacccuguuaauaaaauggaauaaaaguuggaaguuuugucuuuuuaauauauuuaaugguuuauauugaacuuucucuaaucuuuuuagagacuaauuuuaaauguaauucauuauguauucuuuuuuauccuauaauuauauguguucauaaugcagggguggguaguagagagaggaaaagaaagggacagagggaaugagacuucucuguuguggggaggcaucuuucucuaguaagaaggaacagauaauccaguuacuagccauaccuauuaaacuucugugucuaugucuguuguugcuaaacuaaccucuaaugccuuagacggagugauaacauauaagagaguuuuuguaaaacuuuguacaaaauuucauuuaaaaguagccuguaaucaagacuguuucucuuaccuaguuugcuuuggacuugaaauguaaacaaaagauacuuaaugaacuuaacaauuguuauucuucucuacaguuacuuuucuguguguguguguguguguguguguguguguguguguauguaucuuugguauaguguguuauauguuaaucuuccauauguugucauagcucuaauggacaucucuuuuccuagauggauuauuguuuaaaugguuaagaaucauagaauucuaauaggaacacuauuuauucuuuugcagcuaugucaucuuaucuuuuaauuauuaaaacagagcuuccugcugcuauugcagaauuuuugacuggagacuauaguagguaagaaaaaguauuuuacauuguguccguucauguauuaauuugauaaauauguauuaagcuguaaauggcaauacuuguaguggcagguaaaauaaauguaguccuugcccucaagacaguuacaaauuaggcagaagugaagcaguaauagaauagaaacuacucagccaauguuugauuacccauaugaaagcgcuguucugugaaccauaugaagcaccagauauaauccuugcauuccuugggggugugagauaggcuaagacaggucugagauugagaugcucuuaaggaggaauaaaggguaaauuucuggggauaugcaagacacagguuggggaugggagaagguugaauauacugacaguacgggucuuaaacaaaggaggggagugaaugauauugcugucauuucucagcaaaucauagugauaaaaaauguggcaguuacaacuauaccuguuugaaauuccuauuauauaccauggcaaaaaaauaaauuauuugcaaggacuuaauuguuucauuuccuguuuuugaacaauauuauaaacaauacuaaacuacauuguaucucuuuuaucuuucuuuaaaaaaugcaucuuacauuuuugacucaccucuuuauagggaaaaaacaaaauuaauuguacuuuucacuguguagaacaagaacauucuagaaaaaggaacuugaaaagacagaauaaaucauuuuaauugccaucaaguuauuucacauaguuaaguuucaaaccacaguacaaaaccugucagacuuuuagauuugaauacuggguuguucugcuucaauaauugaacuuguucuggaaugcaaggaaagguuucaaaaauuaguuuuuagcuuuuacauuucagcuuccauuaaagaauucuacuuagacaacugcaaauacauauuuguaagaaaagugugguguacuuuagaucugaauagaaaccaucaagaaaauguaguuaaaaaaagacaaguagaaguccuaaaugauuucucuucaucagaagauauuguuccuuuguaugauacuuuacaguuaaugagguuuccacaugcauuaucacaucugauacucaaaacuaccuuauuuuaucuacagcuuuaucuaguuacauuuugauuuuaugcuuagguugauaaacaauuccuauaagaaauagcuaugugaaauucauuuuuguaucugcuguaaaaaacauugagggcaccuucuauuacucaaauucuaugugagaaauuuauauuuuaggguuaagaacucaaggcaauaugagguagaauaaagagggcuagacuaagaguaaggagauauguguucuauccauuuaauauucaauaaucucaggaacuuaauuuaacuucuuuugacuauauaaaguacuuggagccuuagguuuuuuuaugugauauaauggggguaccaauauugccuucucaauaaaguugcugggaugaucaaguaagauauauauacacaugcuaauagcauguguauaaacaagcauguguguacacaaacuuacagcacaguguggagaauuaaggaauucuaauaauuacuauauuaaacgugguguuucccuuuuugcccugacugccaggaagcucagagucaaaugugacacauuugaauuaauauaacuguguuaauuccaacaguugucacaaguguuuucuuuuuucuugauccugaauuugguggcuccuauuuauauucuuuuauugucauaugucgguggaaagaggagggauuagaaauauauguaauauuuuagaaauaauuaaaguaguauguggcagaacugguauugaaauuuaggucuucuuucucuaaaagugauauuuuuaccguagcuucauuuuaaauaauuggcaaaugauuuacauuguugcauugauuuuuuuguuuuuuaaauaaaaauuaaaaugaacuuccaucucauucauauuaauagaaaauugauuaaaauguuauuuuuacauguuagaaauacauuuuuaaaaucauauacuucaaaauacuguggucaguuugcaucaucucuguuauguuuuaaaauuguacaucuuuuuaacaaccuuaucuuguuuuaaauguaauauauauucauuuauuuuuggcuaauuauauuaacuuacuugaaugcagauaaaucauuagucuugaaagcuugaugcuagaaaauaaguaagaaacaaaauaugauaauugacuuuacuauccauaaaggacaguuuuuuucuagauagacuuacaguaggcaguauuucuucuaugagagaaacaugauauugauaagcuuuuauuuuaggguuugauauacaauaaauuuuaauuaagaucuuucagguaugcuaauuuucuggguuaucugcgagcuugguguaccuuugaaauauaaaucuuuauaaagauaucagaaugaaacuguguucauaauauucuaauagaagucagaagcuauaauacuuauacugaacuuucaugauauaucuauauauuucauagaauaacuuacauuuuuaaaaucuguggcuguuaaaguuggaagcucucuguuaacauuuaaugaucuugucggggaauaugauugacacaauuaaguugucuugcauuuuaguuacauaauugauaugggaugugaguaagauccuaauucagaacauaugauacucuuguuccauuccuuucgagaaugaaauuaaagcgacuuauaaauaaaucugguuuucauuaaaauauggaaaaaaacaucugcaugccaaagcauuugcaauacagcuaaggauuuauacucuauauuucauacuuggaacauuuuuaucauacaggauuaaauccacagaucaaacaaguucucuaggaaguauaaagguuuuuacucuaauucuuuuggcuuaaagagaauguauauuuagaucacaguaggaaaacaggaguucuguuagaucguucuuuauuccccccuuaggaaaaaauuaaaguuaguacauucuucugaaaugcuuauuuacaaaauaaauguauuuaauauguacuuuuugagauuucuuuuuacuaguuuguuuuucucaggcagcaguuuuauuuuguaaguuuaauaauuucuguucuuuagaaaauauccauugagaaacacaauucauuugucugugacacacaugugaaaucuaaacuaauuuuacugugcuuuacuguguugccuuuauuguuaaugaaugguaaagaaaagcacuguauuuaaaauuggcuuuauuaagaugaauuauuaaggauaagaaaugauuaacgauaaccaguagccaagacaaggauagagaaauuacauuuuacaguauaauuauuuuuauauuaagaauuuaaaguucaauccuaugaaaaggagaaugcaaagcaugaucuugaaauaaaugagguaguaucugaaaguauuuccauugcuacugucaccuuccuuuugcugauuuuacagacauauaaaaugaaguuguugagccagaugaucucuaaggucucuuccagcucuaacauuccauaacugugauucugaguuacugcugggaggagguaaaguuaucuucagucccacaguucagugcuuuggucaguuauaugacuuuuauggacauaaaugaauugugaucugaaauaguauaaaguaacugguguacagaauuucaaaaaguguuccuuuauuccugugcaagagaaaagaguccugguccuggggauuaaaugcucccuuuuguacaacuuuagcuucgugacauuuuuuuuucuuuuaaagagugaaauuggcuuauaauaauuuuuuguuuuauuuuauuacgguaagaacacuugacaugaaaucugcacucucaacagauuuucaaguguauaaugcgguauuguuaucuacgagagacagcaaaacuaacagauggaaucuccuuugguacuccuuugggcauuuuuccuccuggcacugcaacugucugggucuaacauugggucccagaaggaaacacauuucagacauagagcccugggccuuuugccagcuucagaaauuugguugccagguguuccucaaugaaagaucuuuugaaguuucuguuuugauucuuacucaagagugacuagaagauaaacacguugaguaucauuuuuguauuauugauauguguacucuuuuaguacuuccugcauaccaggaauugaggggcaugugcaaauggagagagcaaagcuucagguccacuaaagcuguaaauacuuaugcauagguuauaguuucuggcauauguauuuccuaaugauacaaauuaggguggagaagggaaaagugucaucauggugcuguuucugcagcugcuccuucucuuguucuguuaaagaggaaguugucagcacccaacaguaacaauuaaguucauguuagaagccacugguugaaauccauguagaagaccuuugccuaauuuaacauggcagugggagacugguaucuggcagagaaugaaagaggaugcguuauugcaaagugggaauuuugagauuaucuaccaaacaauuugaaaaagucccuauuggucuuugaugccccaagcucccauuuuugcauaaguuuuacuuuguuacuauugugcguguguauguauguguauacacuuaaguguaaauaucugacagcuacgauaaagaaaauugagaaaaaaaagcaaagaaaaaucaugcauaacaucucuaaccuagucacuguccuuuuaauucuuuugaauuuuucgcaaaagcuuucaaaacuauaguuaauaauuauauuuauaucaucaucauuuuccauuuuauucauuguguuuuuucuuaaagccacguaacauuccauugaguaugcuguucuaaauauuuucaaauguuggguauauagaguuuuccuccagcuucucaauauuauaauaauauauucaacagcuucacauacauagaauuuucucuauuuuauuuucuuagauugccacuacauuuuuauugcucuugcuacauauaaucauuguuuuuccaagagauaguacuaauuggcacgaucacuagcaauguaugaaguccaguugugccacauccuugaauauuuuuguuuacuaauuuugcuagauuaauugaaacagucucauuauuucuuuaauuagcaccagugauuggauuuucuucauguguauuuacuaguuguauuucuuucaugaauuguuucuccuuugcauacaaaucuauugaggucuugggaauuaacuuuaacuuuuaaaaaugucuacauauguaucucacauauugcucauauugcuaucacauaaaaauaucuacuuuuugguauuuuaaguauauccuucuggcuuuauaugugcauccaguuuuguuuuuuucaaugaacaaauacaaaaucacguuaaccuaccuuuuucucauucuguauucuaaugccuuuauaugaaaauuuuaauauuuuacaauuggugauuaaugcccuuuccugaaauuuggaaaaauguauauagaaaacuauaaagaagaaaaaugaccuauuauuuuaccacccagagauaauggcuaucaauauauuuuaguuccuuuccauuuuuaaugcauccauguuuuuccucaaaauuaucaugcuauauacacacaaauauaugauguuuacugaauauucaguauauuguuauuucaaaauuaucauggucuuggagguuuguuuucaauuuuuauuauuuuaaauguuuucaguaaacaucuuuuuauaaaagucuuuguucuucaggaacagaaaaccaaacaccgcauguucucacucguaagugagaguugagcaaugagagcacaugaacacagggaggggaacaucacagacuggggccuguuggugggugggggcaaggggagggggagcauuaggacaaauaccuaaugcaugcagggcuuaaaaccuagaugacggguugauaggugcagcauaccaccauggcacauguauaccuacguaacaagccugcacauucugcacauguucuacggaacuuaaauaaaauaaaaauuuacaaaaaguguauguucuuauuauuuuuaauagucuuuuauaaguguuuucaaguauauaauuauuugaaaauucuuuauaucuauugccaaauugcuuuccagaaagguaauuuauauaauuugcauuuucaccagcuuuuuacacaccucaucacuccucacuaauguugacuauuaucuuauuuuuaaauauuuauuaauucaguaguuggaaauggcaucucuuuguuuuuauucauuucuaaaugucaauucauuaauaagaaaaauaggaucccacaagaacauuuuaaugaaaggaaguaggcuuuuccuaauagcugguuguaaugguuauaacucugugugugugugugugugugugugugugugugugugugugugugugucagaacaaacacuggagucccaugccuaaaguagaacuuuuuuuauaauagauauugguaucuugauggacaaacacuacuaauaaucauauguguuggcauuguguucccucuugcacuucuucccaaaauagguaagucuuuauagagcacauuauuuguuuagaaaaaggaaagaagggagggagggaaagagagacaaauauuaaggggcuuuaaaauuucacaguaccacauuuuuggcagaaggauggugguuguguauaauuuuaaacuuggccuuauuuuagguuguucagccuucagcccugccuaguuaaccuauuacuugguuugcaguaguauuuugucugccccacuaaaauaaaaucuuuacagcggaacauuaaagagcagccuuuccuuacaguguaccauuagugguaagccaguuccaauucugcuguacagagcuacauaaaugaucugugacagauaguuggaauguuguuauucugagcccuaagccccagauaccaaccacuauaauagaaaacaugccuaagauguauagcuuuaguuguacguuaaaaucgcuuuccuuauaaauugcuuuuuauuuuacuguuauuuuacaggcuuucuuggcuacacaaguaguuuaucauuuuucuuuaugauguucuuugcucuugugguaaguuuaaaauauaauacauugcuuaucuccucacuaaaauuggacucauuguguuagucuuuuuuacuuuuaacuguuuuguguugggaaggguaucucauuuuauuucacuguguuauuaaaagcacuuuuguuccauuaaauuauuuccuucauuguaucuauuuugaagaggcuuagcuagaacagcauuucaaauucagcauuucuugugguuaacuagagaggagagcgugccaauucuguuaaaauccuagauggaguguaauucuuuguguagguguguaaauuuauuccuguaccauacuguaugaagaaucagucugguucuaaucuguaaaaucuguuugagacuagucaucuuaauuuugaaacuuuauuccauuaauaaaaaaacagagcuucugguacuacauugaggagaucuaguaagaacuggguugacugaauucuauuuugucugguuuauucagcauagauaaauucucauaaaaacacuacuacaaauauuuuucuucacaugugggauauauuccuuauuuuuuaauuagcucauuuuuauuauauaaaaauaucagaugguaaauuuaacuuauuuugauauuauaaaauaauauaaagauaagaauuuaaauuuauuuccuucuaauucuucuaaaacaucuuaacauucuaaagauaguaccuuugugugaaauuuuuuaagucuuuuuucuuuguauagcaguuuauuccauaaucaguaucuaaaugucaaaccuuaaguagaaauaaacauuuuuaacuuuccaagaauauacauguccaaaugagcuuuucauaagcuugguucaacucuuucuuguuuuugaaaaugcaugaaagaaacagccauauguaagagcagaacagcacaucaguaguuaagccauauuaaagauccagauuucaaagcugucaaaacaaccuagggugcauuuaacuuaggcuaagcuaucuucugagacacagggauaaaauaacuuuaaauuauuuaaacaaaguggaagugacucugauuuuaguauauauaagcauuuauucucuauugaaugcucuuaaaacuaaaaacauuuaacaguguuuacauuuaaucauuuguugaauuuaacaacauuaaaaucauuccucuucuucucuccccaguugucugacuuauaucuuacagauaagugaauugaacauacacuuuguaggcuccauauugaaaaagaaaaaaacuaaauauuuccaucaucauuugauuguugagaagugugguuagaaguggccuacauaugcaaaugaauguauggauauuaaagagaaucaguauagauaacauauugaauuuuucucucacagauaauuggcaaugcaaucauugcauagauaggaguaauuuaguuuucauagccaauagcuuaaagcagguuaaauguauugauaugauaugucuacuguaguuuuguuucugucaugacagauacucuuuaauucaaugcagauuucuaauguagcagccauauggaaauaauacccauauucuacauuuauuguaaugccuuauaaaccaucugcucagauuuuuaccugugagcacaguuuaaucuacaguggggcaaugaagaauacucuguaugcuuuuuuaaauacucuuuuuaauuggcauguuuauuuuauuauuuauuuauuuauuuauuuugagacagaguuuugcucugucacccaggguggagugcaguggcacgaucucaguucacugugacuuacaucuccuggguucaagcaauucuccugacucagccucccaaguagcugggauuucaggugcaugcuaauuuuuuuuuuuuuuuuuuguauuuuuaguagagaugguguuucaccauguuagccaggcaagucuugaacuccugaccucaagugauccacccaccucggccucccaaagugcugggauuacaggcgugagccaccgugcccagccaccauauuuauuuuagauucucugaauguuaucuuuuaaaauacauagugguuaggaaaaggaaacguauauauauuaacccagaauuuuggaaggauaccaguuuuucauuuauuauucuugucaauauguguuuguaaauauguauagcauuuauaucauauuuuuuaaaaaucaguucaggaacuauuauuuucuuauauucuuugaauaauauaaacuaaaaccuauauuuuaucuguucucccagaucuguauuuucauuaaaaaaauuuaaccuaaauuuuugcccccucuaaaauauuuugcaauuuuaaaaauaaauuauaucugucucagaaugauaccaucaagauggauuuaccuuuuuuugguaaauuuacuuuuuuuuugguguauuuuagagcacaagcggauuaccauucguucuaaaaguucuaucuuaaguacagauuaguauucuaagcaacguuuuaauacgucgguaauccaguuagacaacuuuuuuuuuuaagagacagaaucucacucucuccagucacccagacuggagugcaguggcaugaucauagcucacugcagacucaaacugccgggcuuaggugauucuucugccucagcuuccugaaucacuagaacuacagcugcauaccaccacgccuggauaauuuuuuuuuuuuuuuuuuugagauggagucucacucugucacccaggcuggagugcaguggcgccaucucggcucacugcaagcuccgccucccagguucacagcauucucuugccucagccucacgaguagcuggaaccauaggcacccgccaccacgccuggcuaauuuuuuguauuuuuaguagagacaggguuugaccguguuagccaggauggucucgaucuccagaccucaugauccgcccgccugggccucccaaagugcugggauuacaggugugagccaccgcgccuggccagauaaauuuuuuuuuaaauguugguagagacagagucccauuauguugcccaggcuagccuugaacuccuauguucaagugauccucccaccuuggccucccaaagugcugagauuauaggcgugagccacugcacuggccugaaauagagaauuauuuaaaugguuuuuagucagaagcuuugcuucuacugaacacuauguuaggcauuuuaggauguggaaauuuaaccuggacacuagucuuaaggaucugucaaucuaguaggggagauaaauuucuuuucaaacauggagaacagugugugcaauauauaaauaaguauugauauauuugcuucagaauaagagucucaagaguugagaggagagaaggcucacugagagcuagaguaaagaaggauuuuagaggaaauacaacuugaguugagccacaaaagaagcaaagggcuuagagcagagagaaggaagggaggccuuuugugcaagugaacaaauauuuuuaauacuuagucuccuuuuucccuuugucauuccaaccccaagacuuaccuucuuaccaaccuaagcaaggacuuccuguuaaucuuuccucucuguuguugggucucguuucacucccguucuguacuucugcuuugugggacaucaucucuauccaccccauaccaccauacaggcuuggaguugggauggaucuuugcagagaaauuagcuguaguaacugaacugucuauuaauauaaaaucaggcuacuucuuauuuuuuucaaauuaauaaaaauuaaugauaauauugcacuuuggagcauugcuuugaaauauuuugauuugaaagcuuaagaaauaacaacugauaaaugaggcagcucacauacagaguuuaucuagguaccuggugcacagcaaguccucaguaaaugauuuuuucugccaacacuaccacuguuaguuaggggaaaauauaagaaacugaauuugggccugugcaguggcucacgccuguaaucccacacuuugggagccugggacaggcggauuacuugagccuaggaguuugagaccagccugggcaacauggcaaaaucuauucucuacaaaaaacacaaaaauuagcugggugugauggccacacaccuguagucccaggcacucgggaggcugagguggaaggaugguuugagccugggagguggagguugcagugagcugagauuguguuacugcacuccaggcugggugacagagugagacccugucuuaaaaaaaacaagaaaagaaacugaauuuggagcaguuucacccucaccucauccucaucguuuuuuuuuguuguuguuguuuuucuuugaaaaccuauaaagauaaugauggugagauuauugcuuuugauuuuguuauuuccuuuugguaaguugaccguuucauuuuaugucauauugaaaacuuaccuagaaaugucaaagcagcuugucuaguuuauccuucuacaguaauuuuuuucuuggugagguuuuuaauuaagagugauucuuuaguucacucauuaacuuaauccuaaaaguauauguuuuccuuauauuuguuuuaucacuguguaaaauuuugauuaaauuagucaaaauccaaaacuagguaaauaccaaguaggaauagaaauuguguuuacauauuggucuccuacaaagaacaaauacuuccuuuauucuuucuuguccuuuugugcacugggauucacccuggagcaaacauuuacagaguaauuaugugcccugaaacaacagcaacaaugguaauauugacagagccacagcuauaggucugauaacaggauggccacaauuaagaguaaaaacaugaaacauuuucauugauuaauucugggaaacagcaucccucuggauuucuuuuaauguuuuuuuuguuuguuuguuuguuuuuaccagcuggaguucccuagcuauaugcuccuauuccagccagcuuucuccacauuaaccaaaaauaauucagaucuguaaaaguaaggaggggcagcacuuaauguguacaucagaaaucccugagcuccuucugaguauaaagucuguacuuauuucuuccuguggccuuuccauaaacugcuguuaaauguuucucuauucacuaauaccuacucuacaaauaaccauauuccugugugacagucacugaaaacaucauguuccuguuuugaguugcacuuaaaaaaaaaugccuugaugcuguuggaauuuugaaaguugacacaggaguacccuuagucuuuaaugggggagaucucuacuuaacacccugcagucuccaaccgccucccuaccacaggugaccauguuaaauguugaccccauucuaaccgggaaaagucacagaagcagagacucuucuauuagcaucuuauuuaauugaaaugauacugaccuauuucaauucaguuucuuauuaauuuuauaagaaaugaucugagugcugauucuguuuacuuuuuuagguaauaauuaaaaaaugguccaucccuuguccucugacauuaaauuauguagagaaagguuuccagguaauagcuuauauuuucuuuucaguuucuuccuuuuuauuuuaacuaaaaagaaaagaaagacuaaugauucuuuucugauugaugaaaaaguaauggcuauauugcauuuuagaacuuuguuuugaaauacuuucauuugaaagccuaguaauaauaaauucaucauuuuuauugauauauucugaaauuuaauggcuguugguuucucuuuuuccccucaaugcucuuaaacagauuucaaauguuacagaugauuguaagccaaagcucuuucauuucuccaaagagguguguaaguuauuaacagauacuuuuaguugauuuuucacauuucaaguuuuaagagguuuguguaacagggucucuuaggucuuuguaccugugacuaauuaauuuucaugaaagugcuaaguauaggauugccuaccagaagacuacuauuauuuaacacaggguggccuauuaugaaacagccaccuuuuuuuuuuuuuuuuuuuuuuuccugguaugccuuugaauggagccuguuuuaaaugggccucugccugaaagaacagauuuaccgaaugucuggucuggccaauaagguccucuguguauaccaacuuccuguugcccucugcacuuguaaagcuaaauagccaauuauaucaaaaacucuuccccugugaguagaaccuuggucuguagcuaaacagccucaucauuggacuagggauugagcacugccaauauaucuucuggccgacauuccaaaguugaaauucaugaugccaggaguagagacuaggagaccaagucccuuugccuucccuaaaagccauaggauacuggaaaugccuguaagagccccugagcaucagcagaggagacaagaacugugacauggauggucucugcuuuaccacucuagaagagcucaaagucuucccuguugcugcaggcuuauuugucuauacuuucugacucugcugaaaugcuauuuuguauaguucccagaugcuagaauccccccugcucauguaaaacucuauuaguguagaauguuagcuugguuacuccaccaugcagaauuuuccuuuuuaucucuaguuuuuaaaugagaaauaucucucuggucccaaaagggagauuaccacaucuuuuacaugguaaagaccuccaggugccguaaagaucuagguaggauaauugacaagccaggaaacugagcaauauaugaaauggagaauuugugaauuaaacucucauuuuccuaguccagccucaggaaacacuacagcuuccucucuccuaacccccuucagauauuuuaagacucuaggcauuaugucccaagauaggucuucauuucuggaauuucuuuuguuuaagagccugaaguuaguuaaguggaaauuuuuuuagagcagaaaggagaaaauagaucaccaucgucuauuugguaaagaugguauuuucacuuaaaugguaacuuuuuuugcuuuacucugacucuuaaguauucuaauaauaaaaacaaaacaaaaccuuauauuuguauauuacauuggaucucuuaagaguuuguaggucuagaauaaaugauauucauucccauugaaagagauccuaaucaaagaugcuggcaauauuaaaaugugauuaauauuuucaguauucccuuggauugaguucaugaaagcagguucaagagcauuaacuauuagugcugcuuagaguaauaagauacauuuaaauugugcguacauuuagaagacagagaauuaaaaaagagcauuucuaaaauguuauuuuuaucucauuuaaauauuauuuaucuuauguaauuuuuaaaaucuuauccagauaauguagaaguagugauuguaguaaaagcagcaugguaugggcagccaaauaaaaaauauucuggcuaguacaggcaagcccacuaucaaauaaaauauuugcuggaucacaaguguuuuucucuuuuaaaaaauucuuauuuuauaaagagaagacucauuaaagaugaaauaaauguaaucaaauugauuuuuuaaagaacugaguuuguugucaaaugaaauaaugguuucaguagaguggcauuuaauaauuuugucucuuuaaaauuuuuuucagagugcuuaugccuuaccaaccauggcuuuuucauuucucugccauaccucaauauugcccauauacugugaacuucaaagguacuguagaauccuggaauauuuuaaauauauuguguaucuuuuuaccucuaaggcuuucggauugaaugacauccucuuuuauuaauccuuuccucucaucaguggauccuaaguguuaguuuaaaacaaaacaaacaagaguuaguucuguccaaguuaagaauguuuccuagaaguguaaucuuugaggcuggccuguaaucccagcacuuugggaggccgaggcaggcgggucaccugaggucaggaguucaagaccagccuggccaacauggugaaaccccgucucuacuaaaaauacaaaaaaaauagccggacgugguggcgggcaccuguaaucccagcuacuugugaggcugaggcaggagaaucgcuugaacccaggagguggagguuacagugagccgagaucacacuacuguauuccagccugggcgacagagcaagacucugucucaaaaaaaaaaaaaggaagaaguguaaucuuuguguacuaauuucgaaugaggacuucuaguguauaguuauugauggaguuguucuugaaugaggaauucucucgaccagcuuaggacauacuuguuucuuuacauauaauucagaucacuuauucuaccuuugucauuuuugucuuuuaguccuucaaagaaaagaaugcagaauguuaccaauacagcaauugcuuuaaguuuucucauuuauuuuauaucugcacucuuuggguaccucacuuuuuaugguaaguacauuuuaaaauuauagaugacaaaauaauaguuacauagauggccucacgccaaucuauagacuuuaccuaugccuuuuauuacuaaguuaauuugcucagaucaccaaauuacaaugcaguacugugguggcucuugaggccuaaacaauuggauuaucuuucuuuuagaaagguaguucagguuuaagauuaaugacuucuuaugaaaauuuucuuaaacacuuaaguaaaacuucaggcuuagggacaugauucuuucuauaagaaaaaaugugcaauuuuaaugauucuguuuuucuuaaauuuugaauucaauauauuagucuaauucagaaguguggggguugggugagucagucaucuuaauugcaaaagaacaaguugagaaaggaaaggguuuuacacagaacuauaucuguauacuuagaugucagacaucucugccuucagaucuaauuaucacaggauucagcagaugugcauucuaugaugcaccaugaccuuccuccuuaauuauuuuuacagguucuuuuaaauuuaugcaacaaaaauaaaauuguguuuuauuucuuuugcaaaaacugucugcuuuguauguugacuuuuuuuccucuucugauaagaaccucaagaaaaaguaaaguucuguguacaccaucaggaaaagcauuauuuccaaugugagcauggugcccugcuagagacgcuacaaagaaaguuaaaacagauugucaagcuuuucugaucaucauuaauaaaacaaaauuacuuaaauauauaaacuuuauuuuuggauguuggguuuguuaguuuuuauacagacuugaacucaauaagacuuuucugugucaauaagauacuguaacagggucucuugggauccaaaaauauuuuguauaguggaauagcuauauauuucuuuuauuaaaauugcuaccuggcacaaacacuauuauauuuagggaucuucagcaauaagaaaaaguccaaaaaaacugaccuccuucuucucccuauggauaaauagaacuaucuggaagaaaccucagauggcuugccaauauccaggcuggcugagaaauuguuagaugaaucaccauuaggugcuuagaaacuguauuaaauuguagcuguauuagauugaaagggauguggaggaaggauggaagcuaauacauuuauugagcuaacauuuaagacagugucagguauuuuauauauacucccuaacuuaauccuuauaacaauucugcaagcucaguguagguucauuuagguugaguaauuagaccagauacuugaagccaguuaauaguggaauugggauuugaaucuaguuuugucucucuccaaagccaaugccuuuauuacuguguugucuacucagaaauugugcuauagaagccagauuuccuuuauuccaaguuuuuguuaaggugaucuuuuagaaaaauaugacucacuuaagcucuaggcaucuaucuauguauguaucuauguauaaucuaucuaucuaacauugcugcuugaacacaaaggcuaaagguuuucaucauguagauggcauguuuccuagacagggauuugucuaauaucaaguaaaaccauuauguugucucugauuuaaucucuucuccacuaaugcaaauucuucagaguaugcaaauuuuauauaauagagaaauacacaucuaagaaaaucacaugguagguagguauaugauugauuaauagguagguggguaggcagauagauggguggaugaauagaugauagauuagauagauagauagauagauacauacauacauacauacauacauacauacauacauacauacauacauacauaaauagaauaaaugauacaaaaguaguaaguucuucuccaaagacagaagaggcagauauugauuugcucuuggauugugaaucauaaccaagaaaaaccuuugaucauaucuuucuaccaggauaacaggagcuuugugucauaggaagaaauugcugguugaaccugagaucuuauaagggcuagccucaacuuaaggcuuccaauucauuuuacagaugaacaacuaaagcccagagaggugaagugaccugucacagaauuaaaggcagguuuccugaauacuaauccaguguuauuucugcuacuuugugauaaucuuuguaaacuuaauacccuguuugacaauguguauuaaacaggacagccuccugacuucaauggcauauauaacuugcagagaucaccauuaggcccuuucugagauuuguagagauuugucugaauccagggaagcaugcaccacucuaucccucacauauguuauggcucaguuaagaacacagagugacuggcucagaagaaguguuuucauccugggaaaguagaaaguggacaugugacaucuauuuugaauuuguaauaaaucuaguucuucaagauucaggagcugcuuuggauccuuuuauccagagcuccuaaaguuuaauuucuaaauuugucagauuaaagggacuuauagguauguaccuagauuaaugauacuugcucugauuacagcugugaaaggaagagaaaaggguuccucuggugagccaggccagugcccaaauguugcauaauaaccaggccauuuaaaaagucuaugagguuguuaagcaagaaguguuaauagcucauuuuaugauucagaaaauggaaauaaaauaguuugccauauuucuccaaagacucacaaguaucucacagauuuggaaauagaauccagauuuccuggcucuucuuagucuccuacuuaguccaaaucccacauuguguaaaguauguuuuugauacuuuggacaauucauuucucuccuguuuccauuaucacuagucuaguucagauucucuuuaccucucagugauuguaacaguagcuguuaugccuguuuggggucucuuuuucuuccaauccguacuccugcuuuaguucagaucauaauacacuguucuuuguaagucauuauugcauuucuguggccuaccagguugaggccacaucucaugcagaacuguauuacuaggucugaaaugcauuuccagcccuaucacccacacacuguuucauccacuguaguacuuacuagaccacuuauuuucucagaugcacauucccuuugcuuuguuugugcugcuccuugcuucuagagaaucucuucccccacaucuuugaacaucagcacacauucauugacucauguaauguucucaguaacccuauaguuuaguauauggccauccccauuuuaaagauguaggaacugagagacucaguguaaguugcuaguuacuggugggguuugaacauguucuaugucaucacaguuuagaaucuccauagcucuuguuuagaacucucuggccacuuacauguguauaucacacuuucuaucauagcuauguguauucaucucaucucuucuuaaaguucccugagaacagagguauguuuccuuuuguuuuugguuucccucaaaguauccuuucugaaacacucucaaauuaaaaggcaccauucuauuuuaaguacaaacugauauuuucccacaaaacacugauauccaguguuucugagcacccucagucuucuuuccccuugucuggguugagguuagggagacauugugagaaugcaagaacacuggagcaaagcuuggucggcauguauaaauccuauugcugaccaccacacacuggccuacuaaguaagacauuucccuaacacuucucuuuuuuucauaaaacaugaauccacagaugaaacguaacaugcaccaagcucugagauucuagaaaacguugugguauugaggaaaagaugcugucucuagcaccaaaaagaaguagguguauggcacugccccuuuguguuaugugaucuuaggcaaaucauuuaacacuuuuggaccuaccugcguauuaauauuguuaucauggggacuaaauucaacaacacgugugaaagcacuuuauaaacaaacagcacaaauguucaaacccuuagauuauggaaaaguuccaaagagauaauuuaguauacauauucauugucauaauuugagagguucugcuuauucugguuuuuauuaaaggaaaaaggguguuagguuucaagaagauauuuaauuaaugucucuguguuucauaggcuaggggaaaggccaggauuugguaaugggaaucuaaaaucuguuaucauccauuagugcaaaggaaaacaauuuuguuacuauugauaccuuaguacuuuauaaugugauccuuauuauuuuauuuacagacaaaguggagucagaauuacuaaaagguuauaguaaauacuuaucacaugauguuguugucaugacugugaaguuaugcauacuauuugcugugcuuuugacagucccucuaauccacuucccuguaaguacucuuaaaggguuuuguugccuaguauagacgcuuccuaauagggaaacacuaauucuuugcagaauagaauguuugaaucacaucuagucuuguauaucuuauucacuugucaaguaauugaucaaagacuucauacuugcauauggccccguaaaagcauaaaaauaacagugagccacuaagcuaauuugugcuuuuugagauuuaguuuagauuuacguucucccacagcauuguuuccaauuuagaaacuauaguucuucuaaaguuuuggguuuuuccccccuuuaauucuguauucuguuuucaaaaaaaugugcaugaagaggaaaaagucaagucaggaaaaauaagcuccuucuggguuuauuguaaauuuauuuucacauaagcauucuaguucaaucuuggugaaaauauuuuauuugcucuagaauuguaauuuaaggggcaaaacagauuuucauugcaucugguugcuauacuugagaaucuuaagaauuucugagaaaaagggaacaaaggcuuuggguauaaaugcaucugcauggaugucuugaaucucuaaugcugaguuuuguaagagcuggggcuucaagccuccucccugugugggcugcagugccaagauuacagcagggacuggauaaauuuuuuggcaugugaccgccugcugugcucuuagcaaugggaaguguagugaacuauuuuuucauauuuacaggcugugaaacauauaaaauaaaauaguaagugguauuucuuucccauggcaugauuucuuuuucuauuauaaauugucuguuuuuuuaaucuguugcauuuaaugaaaaucauucuuugagacuuuuuucauauuuuuauuguugguaauuuuaaaaauuaugcaaccuaaaaaaauugcaugugaaaacuuuuucuagcauuaaagcuaaguauuuuuaugaagcuuacacagaaaggguuaguauauaaacaguuuauguguauaaauacuuuauaauaauaguuuaugcuguauuuuugaaaucuaaaugauguaggaggcaaaaauaucaugguuguuguauauguuucucucagcaaauaucuggacuuugacauuuccucuucgcuauauguuuauuuuucuguaauacaggccagaaaagcuguaacaaugauguuuuucuccaauuuuccauucucauggauucgccauuuuuugaucacucuagcacucaauauuaucaucguuuuacuugcaauauauguuccugacauuagaaauguauuugguguaguugguaaguuuucuguuucaaaaaguucacauaauaaaauugauaaaauugcuacccagccucacaucugaauccagcaauauccucucuuuuuuuucccuccacuuuaaaggugccaguacaucaacauguuugauuuuuauauucccaggacuauuuuaucuuaaacuuagcagagaggauuuucugucauggaaaaagcuugggguagguuguuuuuguuucuuucuuucaagacuucuauuuuaagaaauaguuugucaguuuauauuauuuuaccugcaucaagaaagucaauauauuuuaaaauauagaauacauuauugcagagaguagagauuuaacaaauaauccaauuguauuuuuuuaucuuuuuucuuuuaucuuucuuaucuuuuaucuuuuuucuuauuuccacaggcauucguuuugcucaucuuuggaauuuugguugggaauuuuaguuuagcacucaucauuuuugauuggauuaauaaauaaaagaaauauuuuccuacuucuuacaagaauaauauaccccuaguugcaagaaugaauuauuccggaagacacccuggaugaaaaauaacauuuuaauaaaaauuauuaacagaaaagcagaacaaaauggcaguggguauggggaaguaagaguguggcaguuuuaaucaaaaaaagaaacaaacucgaaaugcucuuaaauauauuggguugaucuuuuguu

SEQ ID NO: 17064 - RNA, 9798 nt, Homo sapiens
auguuuauccccuuuguccauucccuuaucuggaccaaugaaaugaguuugcuuuccacuaaggacauggaaacauaccuugaauuucuucaucuugcaugagaauuauuuucagaaucuuucucuagccuucacucacaggggaacuggccccaggugcacguuuugagugcuuucccacaguuuaccucagcuguacucuccuacuaauaaugccuuccugaaacuaggcacuuagaauggucccaggccacagccagacauggccucccauguggcuucaggucagccagagccagucaauccgauauccuacuacucguacccucuucuucuguuuaugacauuauggauccaaauacagauaggugugcagcuacuuaaauaagucuaacuccaguaauaccaaaauaacccuaaaucugcaacagaugcaaggaugcccccugggggcaauuguuaagugugaugacagcugggcaucaauuaauacauuugucaccugcucaugagauaggaucaugggagguuuggcaaagggacagucuguugaacacugcacaaaacuuaguagcaagaaaaauuauuugugcagguauucauuuuuauuuuacuuuaauguucugccuuaucuaguugccuguuuugagucacaacuuucucugugcauuuagaugagguuaauaagauggcuggugagagcagugcccccuucagccaagauuaccaaaaaaaaccuuguucaaaugccccucagaauuuuuccugggaaauaugggccuucucauuaugggcuuaauguucauaauuuauuagguaauaacuauuuaaaauaaaacuaaguaaagcagaaaauauauacuuuucuaacauuuggagacuuguuugcuaaauuaaaagacgaagugccaagacuauaaauuacuuucguauguugagggugaauguuuaaauuguacuuuuuuauuuuuaacagaauguuuacucaugagcuuagcauuuaaaugguuaaaacaaggcuuugaaguuaacacuccauuaagaugaauggggguaauucacaccucugcuugugcuauauuauuucagucugguugcagagaaaacaagacagcaguagguugauuuacugugugaaggcccuuuaaacacccaaggucuggaaaucuuugggguguguguguguguguguaugcuuuuccaucuagaagcaggaucugaaauucaauacaaucuagguauagaaucgaggucuugaaaauacuaaagauucucugcuauccagcaauuccauaucuggcauuugacggguagcacguuacuggaucaacccaaccucucuggcuuuguuugcuacuguacuguaguguuucuuccuaccacagcauuuuuuaaacuucagcuuaguauacugguaaauccaucaguggaaaagcagaaacgaauuauccauuuuccggugaacuuuguaugugccuucagauggguuaugagcuaagcauuggucuucaugugcuccuuuuuaaaacauuuucaucuuugcaaaaucuccuguucuauauuuaccuacauauaaagcaucuaccuuuaagaacuuuacaauuuuuucucauaucccugggguagugaaguaagcagagaucaguugaaaaagagacauuucuuucucaauguguccuuuaaaccaguucuauauuguauuugaaauguguauuccacccauugguggaagugcuacagccauuugacccugaaaugauucauuuuagggccugggaauaagguuaucuuaacacaaaugaaauggcaaacacuguauaagauguuaaugaguuuggaagaucuaucuuuaagguaaacagauuuuucucuucucucuucucuguccugcauguuugcaggcucagguuacuggguaaucuguggguagcuagguguggagaguacuuccacucuggcuggcuguagugcugacacugccaauacaguauauacagagagaaaauagaugcuagaaacagagggacucaaacugaauuaauuuuaaccuguuuuucuuuuuggcauguuaacagcucucuguggcuguguuagaauuagcccuauguuaaacauacuuuacuuccugcaaauuuuucugccuagauuuuaggugucauaauuuuugaccuuagaacauuucagaaucuuuuuauuguacugagaaauuuguuuuuuaaaaaacucaaauacacaauuuauucuucugauaaucuuccuguauuuuuuccauaaggagguaggaaaaguaggaaacaaaauuuugauggaggaugaauaaagauauuguggacaugguuucuuuauugcaaucagaauccuuucuguuugucacccuuccuaaacaaucugauaaauguguuuauuaucacaguaaucuguuguccugcuuugccaagcugucagucaggacaagcaauuauaaggaacaggaagacucaucuuggcugauggccaggugggcaggugggaauaagagguuuauucaccugugguacaaaguaaauggguagaaaggaaaauugaguugccagggagaaaaaaaaaacacaaaaacagauggaugaaaagacauuguaauaugggaugcuauaaagaaaaagacuugcagagaaauguuucucacuuguuugaguguacagucaucccuugggggauugguuccaggaucucccucauauaucaaaauccaugcacauucaaguccugcugcagaaccacauauacaaaauaucaacccuguguaaacaugcgcagauuuugcauccugaaaauacuauauuuuuuauccguauuugauugaaaaaagucaacuguuagugaacccgugcaguugaaacccauguuguucaagagucaacuguguauauauuuuaucuaguguucaucaguggacagauacacaacacaagcaaaagggcuggcuaauucauucagcaaauucuuagcacauauuauguccuagaaguugagcuagucccaaggucaugaaacuauguaagacauacauacaucuugcuugaaaaaaguucagauacaacuuuuauuuuucugacugaacauuuucagaccaacuugauaagugaaauugcuuaaaugaaaaauuauacauguauuuuuaauauauacauauguuuuuaaaaaaagauuuuggagucaaaauuaccuguguucgaaucccagcuucugucucuuucuauaucuuucuaauuuuggacaaguuacuauucucugaacuugcugaagacucaauauuugacuggguuuucucucaaccagaggaaacucuccuucaagugagauuacauauuugggaaaaacucgaguaagccguuaagcauugaauauacguacacuuuuauuacuuuacugucccucaaaucacauaacuuccaaccauguugucucuucugccgucucugcuucagacauuuagucagcagccugacuagaaaacgguauucuagaaauauccugaccaaugcauuuauuuucacuacugauguauuuuuccccggaaaaaguaauucuuguaguuucauaguaaauauuauccacauauuuugacuuuacaucagcauuuuuagcaaugacauuacacuuuuggcuuauaaaguauguggucagaaaagcugcaggccuuuuuuagguaaauuacccugguuucuagaacccuguacuugugcuguugauuuacauuuuuuaaauaugagggaauauacaugcacacacacacacauauauauauauacacauauguauagguacacauauacauacauacauauguaucuguuaucuauguguuaaauuucauccuguuagcuucagugcaccacuuaagcaguugagaucuuuuuuuugaaucuugauucuagugcaucagucaccauucccgcuuuugugacauucuucaucauacuuacauuuuuucaucccauucacagauaaaaauguuaaaugagacaagacuaaccagagggcccugcagcccaccgcuaucaguauuucucuugaguuguuauuaaucuauacuuuggaugaaguuguuaauauuccuguagugucaucuaaccugcauuuccucacuucccuuggaagugacccccaaaucaguggguacagccuaaacuccuaucuguuuucuguauuucuaguugcuucagaacauuucugcuugggggcuccacaaucacuucaaacuuaacauguccaaauccauuccucacuacaguuuucucauaucugucagcagccccuguuuucauccaacaucccaacuggcuuucuugcuuccauuccugcuaccuacaguccacuuucauacugcaaaguaguuguuuaaaaauucaaaucagauuauauugcuacccugauuaauuuccuccaagggcuuuccaucucacuuagaaugaaauccaugccauggccuacaaggcucaauuuugucuguaccuacuuauuucucugaugucaauguaucuuucauucuccagccacacuggccuuucugccccuggaacacaccaagcuuguucccucacacuuacuguuuucccuacuuagagcauaauuuucaaagaccuuugcaagccgggcuucuuauuuaagccucgggucaacugucacccccucagagaggucugcccugccugucuuauggucaugaccgucuuauggcccccaacacaugguagugcuuuuaacuuuacccuguuauacaggucacugcuggaaaucuuguuuauguguugucuguguccacuagacugaaaguuucauaagaacugggacauaacugucuuauuuauaaccaaauccucagagcuuaggacagugccugguacuuuggaguggcuuaauauuuguugaaugaaugcauaaaggaaucuaacagacuguguccuucuacucuuuaccucuaaucugucacaaugucaguucuucuuugaaaugccuccuagauuugcuuuuaugcugacccagccuccugccagacuccuaucuaaaucucagccuucaucucuuugugccugaaguauugcagugauuaucacuucaggcuguucuuuggcaucacuugggcaacuuugcaaaaauuaccacaugcagguuccaccccaaccaguuaaauccaaaucucugaggguuacgacccaggcaucgauaaacuucuuagagcuucccagaugacuccaaugcacaacuacuggauugccauaucuaccugcuagcagauguaugucuuccagcccauuuugccuguuacuguucucuggucuccuuggaauccugcuuucauaguauuacucucuugcucaagaaccuauaauggcucacuacuacccccauuaaucccagauaauggcucacugcuacccccauuaaucccagauaauggcucgcuacuacccccauuaaucccagauucccuugccucauccacuaagcuauauuugagcccuuucuuacguauguucuacaauacccuuaaacuguuuuuucugucuagcacuugauuugccuuuuauuacccucuucuauauuguuacuccucucccuacucccacuuccagguacauacccagaaugugacuuauuuuccaccuauccaaaugcuucucauucuucaacacccagcucaaaucccacuucuguaaacacuuuauucuccacucuagucuaccccuuauuaucuguaugauuauuuugguauaccauuaguaccuuguaagauuuuucguauuuuuuucauaaacuacuuuuguaauuuuguauucaguuuuugaguggguaaugugcacaugguacagauuuuaaauuuacaaaaauacccucccauccaauucuauccccagcauccaguuuuccuccuuggaagcaaccacuuuuacaacuuucuguguucuucccaguauauucuaugccucucuuagagagagagagagagaauacacaaacacaaggagaauacacggauauacacccgcaaauguuggcauacaacaugaaauccuuugccccuuugacuucucuuuacuuaacauuaugacuuuuuuuaguugugcuaaaacaaaaaauaaacaacaccuaacaugaaaucugcccucuuaacaaacuuguaaguguacgauauaguguuguuaauuauaugcacauuguauaguagauaccuaaaacuuuuucauccggcaugacuaaaacucugugccuaauugaacagcaacucccuauuucccuguuccugcagucccuggcaacugccauuuuacuuuuugcuucuaugaguuugacugcucucgccaucuuguaccaaggaaucauguaguauuuuguccuuuugugacuggcuuguuucacuuagcauauuguccucaaguauuaugcauauugcagcacauggaagaauuuucuucauucuuuaaggcugaauaauauuccauuguauguguauaccacaauuucuuuauccaugaaucugccaauagacauuuagguuguuuucaccucuuggcuauuguggauaaugcagcaacaaacaugggagugcaaauaucucuuccaagauucuguuuucaaucauuuuguuuaaauauccagaagugagauugcuguaucauaugguaguucuauuuuaaauuuuuugaagaaucucuauacugguuuccuuaaugguugcacuauuuuauguuucuaucagcagugcacgaggguuccaauuucuccauauccuugccagcauuuguuuuuuguuauuuugauaaugaucauccuaacaggugugaggcaauaucucauugugguuuuguuuugcauuucccugauaaguagugauguugagcaucuucauauaaugucuggucguuuguaugucuuuggggaaauuucuuucauguccuuugcccauuuuaaaauuuaauuuuuuuguuacugaguuguuguaguuccuucuauauuuuguauauuaaccccuuaucagauaugcgguuugcaaauauuuucucucuccuuaagauuuuuauucuguugauuauuucuuuugcugugcagaaucucuucuguuggauguugucccacuugucuauuuuugauuuagcauuauguuuuggagauuauuuuguaucaguauacacaaaacucccuaaauauuuuaacagcugcauaguauucuguuaaugcauagaccauaauuuaauuagcuaguuuccuaucaaugcauauugagggauuuuuuauuuucaaauguugcaauuuuauauaaugcuucaaauguuaucuuuguauacauaugucauuuagcacauauauuaauauaucuguaguauauauuucuauccauuuaacuggaauucugggucaaagggcaugugcauuuuuaauuuugguagguauuacuacauugaccuucauuaaagauuuuauuggcugggcacaguggcucaugccuguaaucacaguacuuugggaggcugaggugaguggaucacucgagcccagaaauucaagaccagccugggcaacauggcaaaucccucucucuacaaaaaauacaaaaauuagccaggugugguggcguguggccauaguccgagcuacuugcgaggcugaggugggaggauuacaugaucccagggagguugaggcugcagugaguugugauugcucuacugcacuguagccugggugacagaguaaaauccugucucaaaaaaaaaaaaaggaaaaaagaagauauacugauuuauauucacaacaacuauguaggaauuacccuuucaauuuuguguuguuauuuagcuuuucacauuuaaauacuuuaccucucugacuccguuguaauuaacccaaagacaggaacuaugacauuacauauuagcaucucucacaguaguuggugcucaguaaauauuuguuaaaucuuguguauuuagggaguuuucccaugaguggcguuucugaugagucccaugugagaauuguccccuuugcauguuugcuguuuccaggaaagggugugauugugugugauauucuuaggcgagaugcuuagucuauuuuguguugcuggagccugggaaauccaauaucaagguaccaacacguuuggugucuggugagggccuugucuccacucccaagauggccuuugaauguuccacccucuggaggggaggaauacuguuccucaaaugacacauaagugaaaagagaaagcccgcuuccaaaggcacuuuuauuuuauuuuauuuuuauuauuuuuauuuuuaaucuuugugaguacauaguagguguauauauuuauggaguacaugacauguuucgauacagacaugcaaugugaaacagucacaccauggagaaugggguauccauccccucaagcauuuauccuuuguguuacaaacaauccaauuauacuuaguuauuuuuaaaugugcgauuaaguaauuauugacuauagucauccuguuaugcuaucaaauaguaggucuuacucauauuuucuauuuuuuugugcucauuuaccauuuucacccugccccuacuaccccacaacccuugucagccucugguaaccauccuucugcucuguauguccaugaauucaacuguuuugauuuuuagaucccacagauaagugagaacauuugauguuugucuuucugugucugguuuauuucacuuaacauaauggucuccaguuccauccauguuguugcaaaugaaaagaucucauuguuuuuauggcugaauagcacuccauuguguauauguuccacauuuucuuuauucauucaucuguugauggacacuuagguuacuuccaaaucuuggcuauuaugaacaguacugcaacaaacaugggagugcagauagcucuucaguauaccuauuuucuuucuuuuggguauacacucagcagugggauugcuggaccauaugguagcucuauuuuuaguuuuuugaggaaccuccaaacuguucucuacagugguuguacuaauuuacaucccccccaacagugcauaaagguccccuuuccccuuuucuccacauccucuccggcauuuauuauuaucuguauuuuuuauaaaagccauuuuuauuggggugagaugauauggcaauuuugauuugcauuucucugaugaucagugauguugagcaccuuuucauaugucuguuagccauuuguuuguccucuuuugagaaaugucuauucaaauauuuugcccauuuuuugauuggauuauuauauuuuuuccaauggaguuguuugaguuccucauauauucugauucuuaaucccacuucagauggguaguuugcagauauuuucuucugaaagcacuuuuauuaugauauuaaaccuacugaggaagguggagcccucauggccuaaucaccucuuaaaggcuccaucucccaauaccauuacauuggcaauuaaauuucaacgugaguuuuggggggaacaaacauuuaacccauagcagacaccauucauuuauauuuuucuuccaggauccuguauuaucauuaacucagaaaggccaacuaauccuuggaucuauuaucaaauuugguuuguuugaauaauuaaguauaaauuagcuaaauggaaaggcucuccucuguaaguucuuuaccaucuuuuuaugaugaaaaauuuuaaacaugaaugcaaguugaaauaauaugcccauauaccuaccacugaaacuuagcauuuggucguauuuauuuugugacucacau

SEQ ID NO: 17065 - RNA, 63291 nt, Homo sapiens
uccguaggaccaaaagaauuauggcacucucauuaaagggcaccucccugauuagacacgaacacacacacauaugauaagugaggcuacagaucaguuuuuauuaguaaaaaaguaucuaaaacaccucaacuacuuuugaaaaguguaccuuugcuuucuauaaaaugcuauuugaggaaaccacaaacaaugaauuuuccugaaggaaacaaaugaaaauaaaauguaaaauguagugagcuguggauaugcagaggcgaaguuauuuauucuaaauaccuggcuuuguacuuuauaauacauugugcaaucugaacauaccaauuauuacagagauuaaggcuccaagcuuuuuccguacucuauacacucaucucccuucuguccaacaagauuaucuucucccaaaggauucucaauagcuggcauacaauaaaaucaaaacaguaaaaagcccaaaaaaccaccccccacaaaaccaccaaaauaaaaacggcaccaagugggauaaaguuucgagauccuuaacuaggcauaucucaacgugcuuuauuuaaaauaaacgaacucuuugagugccuuaagaggaauauauuuaaauaaacauagaacuccucuauuuuugauuagaugucuaauuuuuuuuaaaaaaguauuauauaacuaaccacuauccaaucuguuagaacucaacuuuuucuauucuacaaagaaaaagcuucauaccccaaagcauuugcuugggaauuucgggaggcagcucuuccgcaauacaucaagucccauucgcccacgccccccccaucuaaaaaacaaaguuuggggaagcacuaggcuuccgacuuugacaagucccagaagacaaagcccagggcugaccccccacgccuggcgccgcccguucgcaggccaggagcggccagggccucccgcaugcgcucccacacguacgcgcagcgggcagcagccaccccacagcguacacgaaagucgccuugcgcggcuggagcccuggagcccacggccggggccgcgggcggggcccgggacugcggugcugcgcccgagcacguacugaggcguggccugccgcgcgccgggcggggcucgggaaguuucucggguuggcuuggguuucgcauccucaucauguagcgccagccacaccaggaacagaagggugccggguaccuuccgcaugcuugguauucuccccgcggggcucugaccgcugccgcucucaggcaccugucuuuccucuccgucccagaauggagccaagacaagggaauaaacgaaauucaauaguacacggagaucgggugucugggcagcgucuuggaaaaacuauccacuacagguaagaauaaaaauuauguccaaaccucugaaaggugugaacacaucaaagcuccagaaggcguucauaggaagguuuaugguaaaguauaacuuuuauccuacagggagacuauuuuuguaucgaauuccacuaauuucacuauuucucuguaaaauaaucugggacgacagguucaucucuauuuaaaggaacgaaaugugagcaaagugguuaguggaaaacuuaaaaaaaaaaaaguaaaaguuuuuuucuuuacauuuuuguugguuccagcuggcaacacguuugcaaagguuuuauuuaaccaaaucuuaauguugaaaaaaagaaaaaaagaggauucuuuacucugcaacuuguuuuagguauugcuacuuaaacauuuugaacuuuuagauuaaguuucuacaaagcgaguaauuuuaaguucaucuuuucuguacagaggcuucuaggaggaaaauaagauuuggaaugauaaucgugagguuauaaaaacuuaaacauaucuauuaugccauuaagucaaaacagcucugggaaaaaauaccauacauugauacagucuuuuauaguuugugcuuucccauucacuaccuuguuaauuugaguuaaugucuccauaacuggauaucucaaucucuaguucaaauucagaacccacuaaauggcacuugaaaacacuuuuauucauuucuauuuaugcccugccacuccucuuaggacauucccucaauguuaugugaucucauuacuuucaagugacaucggauccucaguuuuccacaccuccauugccgccuucuguuugcuauuuaaacaaacaguuaacaauggagaaaaggguauguucaacuggauuggcuagcacugcagggugguuagcuccauggacuuuggagucacucauggccaccucaaaagcuccgagccuuagaucacuucuucaagacuauauacuguauagauauacuccucccuuaucugguacugcuaugaaugaacuauauauagcauuuagaucucaaaugaagauuuacccaagcucuaaaaguaauagauggcagaccagaaauguaagcuuaagucuccugacucuaaagucaaacuuagaacaaacuugguuuguuuuuuaaugauacugcauuaaaaaaauuaaaauagcuuuauucuuuuucuccuguauuuuuauggaauagcuacauuucuuuuauacucagaacauacauucucauuuuucuggguuaugaguauaaaagaaauacagcuguuucauaaaguaaggauuauaguugccaggguuggguuauaagccuuggacaaaaccauuaugaagaaauuugugacggugcauaaaauugggaagggccaguucugcuauuccguagcuuaaagcacuccaaggagcuuguugucuuagugacugagcaguggguaaguacuugcuuccuuccagcuguacuguccuuuaacguggcuuucccuucucaaugcuuucagaagucauuuuccugaacuccuggucauuacauaaucugcuuuuacaaauaguuuucaacugaagcuaauuugcuauacaagaauaauuuuuuguuuugugaccugugaauacuaagcaaccacuuuauucuaaaauaccacuucuaguauacuacuaucuguaacuaaauguugaagcacuuugggucacaguguuugugcuuaaguauaccugugccccccccccccccaaauuuugcacugaaucuuaguauuaacuuuuguuccaaaauuuucauauaauuguaaucacuguccuccauuguaagauaaaaagagcuaccuaagagaucuguggcucaguuccuuuuguucaguauauauaccucaggguaaaggaccuaaggcucuggcacuuccuacauaauuuguucauaaaaauaauuuucuguaccuguaggugcagggauucauagugauuuuucuguuuuaaaaaauaucuuucuacacugucugauuuuuaaaaaugagauuaucaguauaaaagaaauacagcuauuuuguaaaagaaaaauacaggagaaaaaggauaaagcuacuuuguuuuaaaacgcaguaucauuaaaacaaaaacaaaccaaauuuguucuaaguuugacuuuagagucaggaaacuuaagcuuacauuuuuggucugccaucuauuacuuuuaaagcuugggcaaauuauucauuugaagucuaaauuuauuaaucuguuaaugggaacagauuagaaaucuucagagaagcucuagccuuuguaacauugugacuauaaugcugagaacugcuucacucaucccauucauauuuuaaaaauacuaauauuuuguguuugagcauuuuaauaggcucagaaacuuaaaaaugauguuucuuuucuaacaacauacucuuuucaaugggauauuaugguuguuauuauuuaacaugacauuuagggacucaacauacauuaaggugauggcacuaagauaaauguagaaauaaccaguaccauguaauuuucauaagugcuuaaauuguugguaaacaauuuuaugaguuggagguguugaagcaaauauuauuaauauuugaacauaaaagcugaucaaaggggccugguccacagaagauguuuauuugauguaacaaaacaauacaguuaguguuagauccaaccacaaagagcaaaaggaaugaaaaauuuguacaauguacauagaaaaaacaagauauuuacugugacaacuauauauuccuaaaauaaugcuucuaaaauuacucaauuauugaaaucuacaugaaaaaaaggauguuaauagcgacaaagugcauaaaaucaaacauuguauuuugagcaaauuaacauacuaggcaauuuugcuaagaaugcaugauuuuuuuuuucuuguuuacagucugcucaaaauaucuuuauaccaacaggguaggcagaacauuuagguuuaauaucaguuacacaauauuagcauaaacuuccacaacuacauaggguauuguuuucuuuugagcuggcaaagugacuauagaaacaucagaugauuucucugaauugagaauuuuauccaaauaaaugccacauaccuucuagauauaugcauaucuuucuauauuauguaaauggcuuuacccauuuaaauaauaaaccauacagcauuuaagaaucauuauuauaugauuaacaaugucauguuccagguuuaacaauuucauaggccaaaaaaaauuucuucuuaaaaacuaguuuuauaaacgcagaauauauuccaugaguaacugcugguauuuuuuaagaaaauauauugugcaauuguggcuaccacguacugcuggcaaagcauuauuauuuauguaaaaugugaaaaaaaagguguaaaaauuuuucaacugccuaugaucaugaugaaagguuacugccuucuuacaaaaauuauauuggcaucuucuuaaaaauaauucgaaaaagggauaaacucccuagccaaaaauaaauaaauaaaaaggugcauuuuuuaaaaugaugcuacugcaaugcaaugguuuaaauaccaaaaaacugagaaaaugagcugucugugauccagcauuaaagaacauacuaaaaaagagcauuaauguaaauuaaguagaaaggggaucaaaauugaacuaaccaaguuugugcaguauuguagccaggcuucuaaaauuagauguagaaaauauaaauagacugcuuuagguaaugagccaccaguguccaaaaaaaggaaugaaauuaagaaaaagcucaguuaacuugauccaaagcucugaguaauucuucacccugcaguagguuucugcugccuuguauaggagcauuaacuucacaaucauaacuggucagcugugguaauccacuuucauccauugauugccccagcagucuacaugcuaaaucugaaaaacaaaagagauaccuaaguauacauucaucuagucaaugaauauuuauuaaacacccacaauguguuagguaucauagaaaauaaagcaaaauucuggaaggguuuuuaguuuaccuggcaaaaccacaacuauguuaaaaaguaaguauaauccagugauacuguugcugugucagaaauguuuacaggauacaauaaaggcacaaagaaauaacaauuuggaaaaaggcauaaauauggugggcaucaaagcugaugccuguaauccuagcacaggcugaggcaggaggaucacuugaggccaggaguuugaaaccagccuaggcaacauagugagaccccaucucuacaaaaagcaaccggguguggugaggcaugucuguagugcgagcuacucaggaggcugagguaggaugauugcuugagcuugagcacaggaguuugagacugcagugagcuaugaucaugccacugcacuccaggccugggcaacagagcgagacccugucucaaaaaaaaaaaaaaaaaaaaaagaagucauaaaaguucacaaauuucagcuucuaucaauauugacagcacauggacauagagaaaucaaagaaaauuacuaaaaaugaaaagcuccaccuugaaauguuaaucucuguauuaagaccaucacaugaaauacaacuguacuuuuuuuuuuuuuuuuuuuugaggcagagucucacccuugucgcccaggcuggagugcaguggugccaucuuggcucacugcaaccucugccuuccggguucaagcaauucucaugccucagccucccaaguagcugggauuacaggcgcccgccaccacgcccagcuaauuuuuguauuuuuaguagagacgggguuucaccaugguggccaggcuggucuccaacuccugaccucagaugaucuggcugccucggccucccaaagugcugggauuacaggugugagccaccgcgcccagccacaacuuuacuuuuuaaucuugcuaaggaaccaaagucauucucacuuagauuaaagcuccuaaauaaaaauguuucauguauuuugucuuugugauguucaaggucaaaaagaauaaacuaaccagaggguauuaaaauaauugucuuuugcuccauuccauucuguucacuagauuugcauccuuuuacacguuuccaagaaagugauguaguagcugcaugaucgucuggcugcuguaauaauguucccuauaaacaguaaaguuauuucaaguuuaguuuguugaauuuuuuuuuuaaacaaccaaaaaccuugaaauugguguaaauuuaauaacauuauaggcaguuucuuaaauacuacccuaaauuauuuugaauucuuucuuaaguuauuugucauccauuaugaccauucugucuauaaauacuuuccaguuaauuuaguuugaaaauaucagaauguauuauaccaccauugacuuaccccaaaacauagcaguucuuuuuuaaauaugagauggacucucacucucuuacccaggcuggagugcaguggccugaucucagcucaucgcaaccuccaccucccggguucaagcuauucuccugccucagccuccagaguggcugggauuauaguugugcaccaacacgccuggcuaauuuuuguauuuuuaguagagacaggguuucaccaaguuggccaggcuggucucgaacuccugaccucaagugauccucaucuuggccucccaaagugcugggauuacaggcgugaggcacugugccuggccaauagcaguucuuuuaauaaggcaaaguaacuuaaagggaagagaaugagauugguggugauauucaggguggaguaaggggagaacuucacuuuuuaacucaaaauacacuggaauuguuuggaauuuuuauaccaagaauguauguauuaaacauuuguauuuuuaaaaaccagugcauacagaguaaaaaaacccaauguauaacuucugaaaauauaacuuuacuauuuggaagaaacguggaaacacacacacacacacacacacacacacacacacgaaauagcacauuagcuagaaaagcaaaaccuacuacucauacuuacaauuccuacugcuugaaaaagugaaccaucauguuccauuuuucgcuuucucugagcauucugcaaagcuaguaucuuuggauuuaguucuuccucaggaacuguaguucugaaaagaaaaaaauucuaaaugaaaauauagcguuuuuaaaaaaaauauccagugagcgcuuuuaaagaaaauacauaauucuuuaguucuccaauauuaaggaauauaauauacauaagauaacuuuccugaucacuaaaguuuaucaucuuaaaaguaaaagcuuaauuuuuuuuuuuuuuuuuuggugaaacacggucuuacucugucagccaggcuggagugcagagacgugaucucugcuuacugcaaccaagcccugccucuggaaucaagugauccucccaccucagccucucaaguagcugggauuaugacuaauuuauauauacauauuuuuguagagacaggauuucacuauguugcucaggcuggucucaaacuccugagcgcaagugaucugcccaccuuggccucccaaagugcugggauuacaggcgugagcaccuggccgucaaagcuuaauuuaacaggaaauuuucuacaguaugcguaucccuauuuuauaaaauagagcugaacacaacuaaauugacacuauuguagagucaaaacaguuaaauauuguccuuuuauuccaccuaauauaacaaugcagugauauuguugggacuauugaaauacaagaucaaucucacauucguauagcauuuucaguuuauaaaacauuucaaguucauuaguucauuuuaaccuuacuuaaguucccaagacagauaaggcaggcauaucauacccauuuuauaaauuagaacccugaggccuauuggguaacuuucucaaaguccuacugcucacuaguugcaauauggaaguacacucuaggucuccagaucccuaccuccccuccccugcucuucccacuaugcuauuuuucacucaguauugaucugguuaucaaacaugaacuauguauaucuaaaauuaauauuaaauugugaagaauuguucuaaugaguaaaguacaucagcuuuguuacauuauuuugacuuuucaagacaccccacaaaccaaaugcauaaucauaauggcuccuugcuguuccagacaguugagaaugccaaauagguaagugaucuuauuuugcaguuuucuuugguuuuuaaaaaauuucucuaaaacuucuauuauauagacagggaaguuuaaaaauucuuauacagauauauugucuuuaugaaauguaacucagucuauuauguaaauaucauuguaguaguaguaguacuuaguaauuacguuuuuaaugguuuaucuuaauuuuugaaauuccuuucauaaaaguuuucaguguacacuacauuggaacuaauguuuaaaaacaguugcuagcugggcacaguggcucacaacugucaucccagcacuuugggaggcugaggcagguggaucaccugaggucgggaguuugagaccagccugaucaaccuggagaaacacugucucuacuaaaaauacaaaauuagcugggugugguggugcaugccuguaaucccagcuacucgggaggcugaggcacgagauuugcuugaaccagcgaggcggcaguugcggugagccaagauccgagaucacgccauugcacuccagccugggcaacaagagcaaaacuccgucucaaaaauaaauugcuaaagugacuugauguguuguuacacuuuggcuuugacaaguacaagagaacaguuguucagaaaacuggauaucccauccucuguagcugauaguaaacuguaacuuauaagugauugucauuuuuacuacuguauucaugcaucugucaguccaacaacuuuuuuuuuuuuuuuuuuuuuugaaaccgaguuucacucuucucgcccaggcuggagugcaauggcacgaucucggcucacugcagccuccaccuccaggguucaagcaauucuccugccucaaccucccaaaguagcugggauuacaggcacgugccaccacgcccagcuaauuuuugcauuuuuaguagaccggguuucaccauguuggccaggcuggucugaaacucuuggccucaggugauccacccgcuucagccucccaaagugcugagauuacagugaugagccacugcgcccugccucaacaaccauuuauugaggaaguacuacacauuaggucaugagcuaaguauuaguaucacuaaaaugcccaagacacugugauugcccucguggagcucagagucaaaagugaguaagugacacaguaaauaaaguaauguaaaguacuucugaguucaucuaaagccccaaugucuuuuccaagcuuagggaaaagaccucucccagcacucuaggucaaggugggaauguuaggcagggaaaaaagcuauguguucuggcuacgacagugguucuuuccuauugcuauugauaucuggcuuagucuagacauaguagagaaggaaucauuucccuuuuccacacacuuauuagauaaaacuuaauuucuucuagcuauagccucaaacuuaaaauaugugaaauccccuuacaaauuauauacagaaaguauaacuuaaaaauugggucauguccauauguuuguuugaacuagcuccauagaaguaacaauucaugcuuagauuccuguuguacaguuugaaaaccuauguagccugcaauauauauauagcuaauguucuacaaauacguaaugaaaaauaaaagcaacuuuaauacaaguuaacuauaauaaaauuuuaaaagaggggccuguaaauaucuauauugaaugcugaagauggaaggcucaauuuggaaugugcaauuggaaauaacccuuaaauuggaagggcuuuucuucagauaagcuuaaaaaagagcucuaagaaauggaagcaucuaaguagugaggguaguuaacuagucugauuuaaacaacuguaagaacuuuaaacaaguucuguaaacacauuuacaguacugagcuggauuuuauuuuaaaggugucagaagacccuccuccauuuagauagguaauuuuagaauuuauaauuauuuuagaaaaaauaggagcgggcaugguggcucacaccuguaaucccagcucuuucggaggcugaggcaggcggaucaccugaagucgggaguuugagaccagccugaccaacguggagaaacccugucucuaugaaaaauaccaaaaaaaucagccgggcgugguggugcaugccuguaaucccagcuacucgggaggcugaggcaggagaaucucuugcacccaggaggcagagguugccgugagcugagauggugccaugccauugcacuccagccugggcgacaaagcgagacucugucucaaaaaaaaaaaaaagaaagaaaaagaaaaaauauaugagguuaauuuagaaaguuuuuugaguucucaagaauuugcguuagggcauauauaucagaaaguuugcuauaaguuuaaaaaucauguacuaucacauacauuuaucucaaaaauaauaaaagaacuauaacuugaauguuacauauaaauaccuuugacucaaagcgacagauaacacguuagggcuucuuggaugagauuuuucugucuguucuaugacuccuuuuccugcucuguuuggugaggcuguccgacuuugaguaucucuauauggugaugauguggcacuaguaguuucuuuauguauguggguaggagauggagaugcaaucaauauuuuaaugucuuccauacggucuuuugucacuguuuuuaauucaucagugguggcagugguagugguggcauuagcaguagguucuuguauuugagucugcuggaauacuguaacugugcuuugaggacuugcgcuuucagggcuugcggaacugcuuucuaauggugacaacugaucgaaggaacguaacuggaagucaucauccauugggauauagggagcuaacaucuccaagucuaaaucuguguccuuuaaaacagcaaauacaugaguuuuuacaauggccacaccuuauaaauaaaaaacaagugaaacucaaagucacuucagacuaaaaauuaaugaaauuuaauauaaaacaaauaaguucauauaccugaguagaaaauggguucuuugcuucugugucuucagcaaaaaguuuuucuaccaauuccaacuugaauucauugaccauaucacuauccacauaaaaacaauauucacugggacuauuaggcuguaaaaagaaauauguuuacuauuuccugaagaagcuuccauauacuuugcuaguugucagaauuuucaaacuagaucucagaaaaaccagaaaacacacaaccaaguccaucguguuuaucaaauuuuauuuaacuaggccgggcucaguggcucacgccuguaaucccagcacuuugggaagccaagguggagggauaaugaggucaagagaucgagaccauccuggccaacauggugaaaccucgucucuacuaaaaauacaaaaauuagcuaggcaugguggcaaacgccuguaaucccagcuacucaggaggcugaggcaggagaaucacuugaaccugggaggcagagguugcagugagccaagaucaugccacugcacuccagccuggcgacagagugagacuccaugucaaaaaaaaaaaaaaaaaaaaaaauuugugaaaauagugacauuuugaagcuuauacugguaacuaauuuugccaauauauauauuucugacuauguaauauaacaucauuuacaaaauugagaugaaaagaaacaccuuauucuaaagaauaaaaccuauuugguaauucacaucccacaaugguaccuaauugaccaauuaacuagaugcuacauucacuggaauuuaccuuugaacugagaaggcacacuccuguggugacugagcuaccuaaaaaucucacuguuacugucgggggugggaguagaaaccuaaguuauuuuaccugcauauaccugaacgaauguacauuauuacuauuuuaagaguucugggcaagaaguuuaacaaaaaacuauagcuguguauucuaaacaagaaauuuugcuuuccucauucuaacguuuuuguuagauuuacuuuuguuagauaaaaaccaagaugaaucaaacauuuuuuuuucuggguaaauuaagcaaccagagcauaggauauauauucauucaacacaaggcugugagaugucaaauccccuacucuuagcuugucaguuuuauucaacaaauaccuaauguagaauuauuuaccacuuauuaaagcuuauuuaugccucauuuaucaaguuauaauguucagaucuaaguugcccuacuccugagcauauuuuuagauguaggaagcccuaaaauggaaucauucuagauuuagaaauagagcccugugugauaucucuaagucuuggccagccuagccuuuaaagauuauuuuuguguucauaggacaauuaauaucaagacagauccagaauaaaaaagaccaguuacuaaguauuuauuuuauguaacacuuguuauuuucauauuauacuuacccaaaauuucaaaauagugauggaaauuagacuaaauugggcaaagaauuuauaagguccuuucccauuuaaacccucguaagucuauugcuaccagacaguucuccaacucaaagggguaaugggccaggcaugguagcucacgccuguaauccuaguacuuugggaggccaaggcaggaggaucgcuugagcccaggaguuuaaaaccagccugagcaacauagugagaaccccaacuccacacacacacacaaaaaaagguuaaaaaauuagccaggcauggugaugcaggccuguagucccagcuacuugggaggcugaggugggagaaucauuugagccugggagguugaggcugugauugcaccacugcacuccagccugggugauagugagacucuuucucaaaacaaaacaaaacacaauaaaacaaacuaaaagggguaacagguauaggcuguagcuaccuugagcacacuuaguacuauucucuuuaaauguccaaauucaagauguuuuuguccuacugauauaaauaauagagaaacaauguacguuucaccuuuugguuuauauuaagcuaguuucuucccauguuccugacuaucuuugagccuaaaacaugugcucaggucuagguuaggcaguagcucuugcaauaauuuuaaagugcuaaaauucaaacacacacacaaauguaauuugugguucaaauaaguguuugaaucaaacuuauaaauacauucuugaauguuaaaaucugaaaguugucccuuucugauuauaucaugacaccuaccucaggugaacuuugucuagugcuuccaucggaaggacuaggugucugauccugaaucuggggcaugguaaaagaaaguuccagugacucuggauuugguucuaauuuuaaugcaacuucuugauugagugcagggucagcacuacuucgaaguggcuuuggcguuucagcgguggguaauggagacauugccaaauuuauauucuguaauuuuucguugggugaggggagcauuacaucauuauauaaugguacuuccucaaguugcuggucaucaguuucugugucuguggggaaaaaauaugagucaaucuaaaguauagaaggauuuuuuuuuuuuuuuacccaagacagagucuugcucuguugcccaggcuggagugcaauggcgcaaucuuggcucacugcaaccucugccucccagguucaagcaauuccccugccucagccucccaaguagcugggauuacaggcgcacaccaccacgcccagcuaacuuuuguauuuuugguagagacgggguuucaccaugguggccaggcuggucucgaacuccuaaccucaagugauccacccgccucggccucccaaagugcugggauuacaggcgugagccacugcgcccggccacaaggauuuucacauauaaaaaauuuauguucuuuuucacaaaagguuugucuaauucaucaaacaacaaaaugucaccaaauuuuccuucaucagaaaguuuacauacaauaguauaguauaaccauaagucugaguuaccuuuacaauccacuauugauaccgcgucuuaaucucuauggcauaaaagacaaaaggcaauaccaaccuuuuuauacauuaaaauguucucuacuuuaaaauugcaguuuucaucuucaaugcuugauguuauaguaugacuacuuuuuuauccuuuaaugcaacaaugccuacuuccauauaacucugcuaaacuguggagaaaaucugacagcaggauacagaaauagaguagccaggaaaaauuuaugugggaagaagaaauaccuuaaggacacuuugaagcacaauuuccaacaguauaaaaaagcaagaaugguaagaaauuacgggggcaaaaauauuuaagcaaauacauuuaagaaaacuauaaacauauauuagcuuguaauguccaaaugauuaccaacaaaaaccguaaaguaauguuuaguugaaauggggcuuguagcaacagacacaauuuaggggauuaacaaaaauaacuacucaccguugcugccaaaaucuaaagauaugauugugucuccagcggcuggggccagcaaaguuaaagcaucagguuccuucuuaaguuugucaaagaggcuacuuguaucuucugauucaacuuuggugaauagcugagucauuuucauaucugaagauucaaccgguuuaaggacacauucuguuuguugaagggagaaaaucaagucgugcugaauaauaccacugucaaaacaagagaaauugguaauucacaaaugagcacuugauacagugaggggaagggagacugugaaauggucucuuaaaaaauucugcuuuauggacaggaacauuucaagauuucuugagaugcaugaucacucaugcguacugugucacauuuaggguuuuaaaaugcuaauacaaaauaaagacccaauaaaauccacaguaugcaaccauaaaaaagaaugaaauaauguccuuugcagcaacauggaugcauccagagaccauuauccuaagugagauaacccaggaacagaaaaccaaaugcugcauguucucacuuguaagugggagcuaaacacuggguuacuuguggacauaaagauggcaucaauagacacugaggacuacuaggggagaggggcaaggguugaacaacuguuggguauuaugcucacuaccugggugacaggaucaauuguaccccaaaccucagcaucacaugauauacccauguaacaaaccuaugcauguauccccugaaucaaaaauaaaaguugaaauuaaaaaaaaaauccccaguacaagauaauuugacuaauuucaguuaagaauuucagauauccaggcugggcgugguggcucaugccuguaaucccaggacuuugggaggcugaggcggguggaucgcuugagccugggaguucaagagccuggccaacauggcaaaacccugucucuacuaaaaauacaaaaaauuagcccggugugguggugcacaccuguagucccagcuacuugggaggcugaggcaugagaaucacuugagcucgggaaauggagugagccaagaucacgccacugcacuccagccugggugacagugagacuccaucucaaaaaaaaaaaagaaaaaaagaauuucagauauccuuugagaagaguaguaauggcaaggcaauuuguagucaaguacaugaaagacaccaacaaaucuucagaauuguugugcugacacacauuaugaaauuggcacaaaagaacucuuuggcaucaauaugugaggcaugaucuaaggauaguccuaaagauacacagauaaaugauuaagaucuuucuaagagaggggccauauuuucuuuggugguaagaauauaaggugauaccaccuacaggauacggcugaagagggaugaugagcaauaguuuaucuucacguuuggcuuaaauguaaauuauuccuuuaauuaacguauuaaauguucacuaucugaaaugaacugauaaugcaaagauuaaaauagccaacccuugaccuuaagaaauuuauaacccauugugaaaguagauauguaaacaauuaaaauacacugugauaacugcuaaaauagagaaggcuugcuucacugagaagcuaacaagcugauacuugggaucaaguggcauuugcuaggcagacuggggugugaggaagagaaagacauuccaaguggaagauucuuacauaaugguaaagucacaaaagaacucuguggcacuaauauuaaaacauuaaaggauggugucagaaguagcaaaaauaaaaacugcccaaagucuuccuaagaggagugacccuagauuuuaaagggaaggcuaaaucucuaaugcgugaguaugaugguaaacaaggaugcuguacaccuaggcaaguguuuaucuuggaaaugauaaaaagaucgcuaaaauucuaaggaaaauaagaugaugacauauccacacuagaaagcuuagccugguaguaaugggcaagauggacuagaaugugguaauaauguggacagguagacuagauggggcaggagucuaguaaaauagaucaaaugaaaaauuaaauuuugauguacauaauauucacaagccaaagagcuaagugaagaguucaugaauauacaagagccauguauuacaucauauagcuuauuaaucucauagaauuucuuuucuuuuuuaaauuauacuuuaaguucuagggugcaugugcacaacgugcagguuuguuacauauguauacaugugccauguuggugugcuacauccauuaacucaucauucacauuaaguauaucuccuaaugcuaucccuccccccucccuaaucucauagaauuucauuuaauuuucauuauaaccuucugaaggauuaucuacauagaugaaauucagaaaaaugaagagacuuccccaaggucagggagcuaaugagugguagagcuaugauacaaaucuaggccaggauucuuccuacaaaaagaacacagcugucuugagauaguauaugccgauaucuguauaauuagaccaaaccaaucaauggaucugguauuuuuuucauggucuuuuuaaaaauaggagugaagguauggggauagacaacuacugacaguguuuagcagcaucacuguggaauagcuggacuggaaaccuaggucagaguauagaaaauaauaauuugguagcgauguaaaagaauuaaaauuuaguuaauauuuauuaucuuaucuuccuauaaaugaacagaguauccaaaaagaauuacuauuuguuccccaaaaauguuuauuucucaaacuuacuuaccucacaacguaauucacacauacaaugcacugugguugagaauucuugguguuauauaugacaguugcuugaguuucaacccagacauauccaccucuuuuggcaagcauccuguacuguccuguggugacuuguccuuuaguaaacacuaggggggaaaagaaaaagaaucaugcagagaaaauauuuuaacuuugaauuuucaauuaaaugaacagaugcugaauguucaucauuguuuuggaaaacaaauguuuauuuaguggaaucaguuguaacugcuuacauucugacagugcgucccagaauagcugaaaauguacccauuuccuuuuucaaacccccuaaauaaaacuccuuugcugccagugagcuaagugaagaguucaugaauauacaaucuucaguaacuaaaauuccuuuaaugacuuagguuggugucagauuagagaauaaucaauagccuuuuucaagaaaauggugccacaauaacuuccuuaaauucugacuaugguuuccagagaaccaaagaugcuuuaaaaagcuauauguagcauauuuaaauauaaauugauaccacauuguaagucuuuuggcaauuuaaauuaaauacugauuugggagaaaguacuaaauaaaugcuaaugaugguauuauuuugaggauugggguguccugacugcagacuuggauuuacucuugaguucaaggcugaucagucacacaaacucagugauauucagguauccucaagcacagugggaagucaugcauagguacagauuaaacaggugagauaguccaaaguuuaacuuaucuuggggaucuuaacauucauuugaguaaaauucagaaucaaaucuuaugucaaagguacuuguuuugggugacuauaguaaaaaauaauuuaauuguacauuuuaaagaaacuaaaagaggccgggugccaaggcagguggauaaccugaggucaggaguucgagaccagccuggccaacauggcaaaacccugucuauacuaaaaauacaaaaauuagccaggcauggugguacaugcuuauaaucccagcuacuugggaggaugaggcaggagaaucucuugaacccgguaggcggggguugcagugagcugagauugcuccacugcacuccagccugggcgagagugagauccugucucaaaagaaaaaaauaaaauaaaauaaaauaaaaauaaccaaaagaguauaacuggauuguuugucacacaagauaaugcuugaggugauagguacuccauuuauccuuaugcacugcaugccuauaucaaaauauuucaugaacccauaaauauaaauaccuaacuaugcacuuauaagcauuuuuuaaaaugguacuuauuaccaaaggugauguucaccaccuucacauucauugauuguacaaauacuuucugagugccuuuuacauaccaaccacuguucugaguauuuaugugaauucugaaaauuaugcuauucaauacucuauaauauuuggauuuucaaaagucuuuguauuuaaaaugccaggaaguuuuuucuaugauuaaaugauucuauuuuuacugauauuuguugcaacacauacaaaacacaaaauggucaagaucucuacugaauaggccuguuaacacauuuagucuagaacuuuuaaccagagaauuagauggguagccaaacuguacagagguugcaacaguuaaguaauuagaauaucucugaguucuuccauuguacuuacuaucaugaugaguuuuggucagaugaucagaguccaaagcaugauaauauucauaaauugagcggccuaaaaguucuucuggcucauaucccaucaauucgguaauucuguuaguaaaaaauacaagauuuaagaaaaaaaagggagacacugauaaagaaaaauuuuucuccucccaaguuaacugauaggcauuaaucuuauggacaagugaauuuucaaaaaugagcauccuccuuugcuuagaauaaauuuacaccucaccuuuggcaacuacaguuauuaaauccaacaccacacauuucuuuaaguccucuagauuccuccuguuauuuaacucuuuaauccuguucacccaaacuuguuaccuggucuuuuuuuuugagacaagaguuucccucguguugcucaggcuggagagcacaaugaggugugaucuuggcucaccgcaaccuccaccuccuagguucaagcgauuccccugccucagccucccaaguagcugggauuacaggcaugugccaccaugcccagcuaauuuuguauuuuuaguagggaugggguuucuccauguuggucaggcucgucuugaacuccugaacucagguaauucacccgccuuggccucccaaaguacugggauuacaggcaugagccaacgugcccagccuacuuguuaccuauucuuauuacaucucauuauacauacuuuugguaacaaggcaggguauuaauaaacagauaagaaauacuacuaaacuacaugguaaaaguuauaaagguagucacuuacacuuauuuuaaaauauagauaaaaucuguaacauuucuucauaaagccaaauucuuuauguaguaacuuuuaagccccuaggcaacaccucacuuugagagaucaauagccauuacacaauucuaauaucaucaaccaaagagcaucuacacuaaaugggaacuaaaggaauuauguugguuuuugaagaugcucuuguacuuaguuuaguuuuuggcauuacaugaaauuaugggaguaauuucagauaaaacaauauuucaaaugaaaauagauuggaaaacaauccaauuacccuaucuagcucgcuggcagagaguagaccuuuauuuaagacagagacuagaucuuauucucuguaagcaguaugaaauggcaaccaugacaugaggaagagaaagcugucuucuuaguaccaugcugaacagaaauacucucuucucaagucuuucuaggagcaaaacaugaguuaagcuuuuagauucucagccuuuagauuucagaggacuuuccuaccgaggugcaagcaaaccuuauauaacaugcugugugucaaaaaaaaaacccuaccuaacuacaggaaggacauaggcaagauauucuauaaagguauaaaaguaacauugcuuguguucucacacuuaaaggcaagaucuuccauaguuuauuacaaaauaaauauacaaaggaaaagcugauuugccaaaaaccaaaccaaacucaacucaaacccucaauucuuuacaaagggacaucucuaaacacagcaacaccagguggcagcauuauaaaggaaaacauguuuuuaaacaaaaucagucauauuucuugaaauuaugcuuuaaaaauaauucuaauuggucuuauauuuuucuguuuaaauaaaauccccauggaauuaaaaacuuuuucacuauucaaaucuuaauaugccuaugugugcccggcauuauucuaggcaugaaaaugcaaagacaaaacucaauacguggcuaaucuuccaguagauguacuguacuacuuaggaaauaaugugauaaaugcagugaugagaaucuauuccauggaauccuauccaugcaaaggaaugguagaaugaggaacagccucuuauaggagacuuaugacuagagacaaaggaaaggcaaaaccgcuuucaggaaaaagguaugguauaaacaaaagauuuuuaaaaaugcuuaacauggugcagguaacaaagauucuauaauaugauuaguggagacagauaugagaugaugcugaagaaguagguagggggaucagauuaaugaagguauuguuuauauugucauaggaagcucugauuuaaucuaaugucaaucagugcuucucaaucugagguaugucuaucacuaaaagauaccaagaagucaaaaauauaaacuguauaugcuuuccuagaaggucaguuuuacacauauuagagcaagaaaagugagguuaauuuaacuuuagagaauuacauagguuauauucuauaccaaaagggucgggguguccagaaaauaugaccaaaaaguguuuuuaauggacuaggaaacccaugaucuaaagcaguauacuacucauuuauuuugaggcaggaacuguucaucuucauuucuacuuuagugccaugaacauaguagaugcucaaauaaaguguugaauaauuuuaaaugauuauuacucaguauaguaaauagcagcuauuuguggaauauuuuggaguugaggagcuugauauguuagauuuucuuaaaauugagcaaaauuuuuuccauagcuugguucucagggguuauagaugcaagaaguuccuggaaagagcucuaaaccagaaaauaacagucugcuggucaaacucaaaacugucuugguugauauaugagcuggcugucuuuacuguuaccuccugucaugaucauuuugcuaauuuucugcuauaacuagaggggaaugucacucccuuucucauuuuugcuccacuaccuuccuuucucccuggccuccucucuacuuuguuaccuuaaguuuucaaaaaaauaaaaaauaauuccucaaaauaggauggaaaucucugucccaucauacauuuacaugcuaguaguaaacaccuuaaaauaauucuuagcuuuucuauauucauuuucuuaaaguugacaccaguagugaagcauucacuaucuguacuaggcacucaauggacuccuuuaauccugacaacauccuucugaggucuuuuuuuuguuuuguuuuuguuuuuugagauggagucucacuccgucucccaggccggagugcaguggugcaagcuugguucacugcaaccuccgccuccuggauucaagcaauucuccuaccucagccucccaaguagcugggauuacggacaugugcccccauacccagcuaauuuuuguauuuuuaguagagaugggguuuuaccauguuggccaggcugguuucaaacuccugaccucaggugauccacccaccucggccucccacagugcuaggauuauaggcaugagccaccccacccagccaugauucuuauuuuauagauaaggaaugugaauuuuacaacaguuaaguaccaaggccaaggccacauuguaaguaucagagcugcaagccaugagugaaucuaacaucugauuccaaagacagaguuagggccagagcauaaauaucuuuguuugccaugcuaaguuuagauuguauuguguaggucuauuuuuuuucagucuucuaaaauacacaucuucuuuugauaaaugaaaaauuuacuucccucaucuaguauuuuuauaaacaaaauauuuuugugugcaaagauggagggaagcauuugaggcauuuucaacaacagaaugacaugaucugauuuucacauuaggacacccacuuucuggcaacuuagaugaaagauuauaaggguacaaaucuguuggcaaaaaggcagcuaugccaacaacucaagucaagaguaauaaugagcuaaugaauucaauggcaggagugcaaggauggaaaggaggaaauggaucaagagauauauguagauaguaaaucuguaagauuuagacaccaacuguauguagccaaugaauguaaaagaaaaguuacagaugacuuccaaaguuuugcuggagucauguguguauggugguguauuaaaccacaauaagcauuauaggaagaaaggcaguuuuugaugaugauguuguuugggggcaguaguaguacaguuguuacaguaauacuuaguuuacaauacagaagaauauccagauagaaauauuaaguuggcaauuaaauagaauuaguuacaggaagaaaugugggaaauaguaauagaaaccaugggcaagguugaagcuucucagggaaaauauguaggaugaagagauguacaaacacuuggcuuucuaguccccaaccuaagguaaucuaucuuugcucaaaauacacacugcauaucuuugaaauucucuaaguaaguagagccccuauuggggaaaaaaagacucaucuuaacuucuggauagcaccuaguaaaguaaguguucauaguacagaguaaauguucaauaaauguggcugaauuaauuuacaaaguuaaucuaauauuauaggauguaucauucuguucaauuuaguggaaaguauaguuuaacauugaguaauuuuuuuuuuuuuuuuugaaaugggagucuugcucugucauccaggcuugcagugugguggugugagcucagcucaccacaacauccaccucccagguucaagcgauucuccugccucagccuccugaguagugccugccaccacgucccacuaauuuuuguauuuuuuaguagagaugggguuucaccacauuggccaggcuggucucaaucuccugaccucagaugauccaccccccgcuugccucagccuuccaaagugcugggauuacaggugugagccaccaugcauggccagcgcugaaucuuugcuauggugaauauucaguaaugcuguagacuaauuaaaaauuucaaauucacauuuuagaucuaauuuaccuuucaucacaauaagaaaauuucauauccaggcugugucgacugaggaaagucuugcuaucuaaaggaauuucaauauuugaugggugaggaauggguucacaaaucagcaccaagcaggucauaggugguuucuuauacccacacugagguugguuacuguugguaucauauacgugaauguggccugugcagugcaauaccuguguaugaagaacaaagcaguuaaaaaaaauauuuacaaugcuagggaaaaaaaaagcagagauaaguaguugagucugacauggccaguaagcuuugauaaaauuuacugucacuaguggauuaaucacguuuuugaaaaucaaugaacauuuuuccuaugauaccaccuaugaccuacuuccugcccagggccuauacauuacucuuuaaaaaauuccccucguauaaagucuaggcugcuuuuucauucaucucaucaucauggcuguuugauaguuauuucuugcacugaugacuauguuucaacauugaacaaagauauaaaaccaugauuaauagaaaauuaagcccuaucaggauucaaauauuguguggcuggcaaagccaacugauuaagccuggaacaccagugccacaauucacguaauuuaaguuugugccucaaauuggcaaauuacuacacgguucugcauuuuggagaucacaugcaaaugaguugaagauauaaauguuacauaaccaaacaccauggaacuguaaaccuucccucacaauucuaaaguuaucuuaauacuacaaugucuauguauaaauaaaguguauaaucaaucacaaauaauuuucacuuaccuuccauguugcagacuuuauguucauaguucuuccucggcuaguuaggguacacuucauucugagaaaaaagcuucgcuguguguuuuguucuuuacccuuuuucacaaggccuaaugaaagcaugaaauaaaguuuuaaagcaacuaaauauacaaauuuguuacaauaaaaguaacaaagugcccaucaccuagaucaacugaauacccguucaauuaagucucagcaugaacacaguaauucauuccccuuuuacucacuccagcacacccaagagaucugacacacacuacucaguagcugugauucccugaguuggcugaaagauaauccauauuugggauaacaguuaaucauugaagccaguaagcuuagucaaauacacagaaauauaaaaaugguaugaguuugcucuuuaacugugcuaucgguacacaagaaucccuaaagaaagaacuucagcaaacucuuccuauccuuuccugaauguguuagcucaauuucuaauaagcacucuaugucuuuauagaaccuuuaaaauaacaacuuucuuuuuaauaacaaauaacauuuuuacguaucuuauuuuuuuccccuuaauuuaucuaguaaagcaggcagaaaauuacuucuacuuuguuacuaugagaaaacaacaacaacagaucaaaugacuuaucaaaaguuacagaaauaggcagggcacgguggcucaugccuguaaucccagcacuuugggaggcugaggcaagaggaucacuugaggucaggaguucgaaaccggccuggccaacauggugaaacccugucucuacuaaaaauacaaaaauuagcugggugugauagugggugccuguaaucccagcuacuugggagacugaggcaggggaaucacucgaacgugggaggcagagguugcagugagcugagacugugccacugcacuccaaccugggauauagagcgagaauccaucucaaaaaaaaaaagcuacagaaauaaagucagaauuaaguaaagucuauucacuccaauuucaaaccuucuauaacuaaaaaugagauuauauuuaggugacugagaaaagagcaucuugcugggcgcaguggcuuaugccucaugccuguaaucccagcacuuugggaggcugaggcaggaagaucacuugaggacagaaguuugagaccaugcuggccaucauggcaaaaccccaucucuacuaaaaauauaaauaucagcuaggugugguggcacaugccuauaaucccagcuacuugggagguugaggcgugagaaucacuugaacccgggaggcagagguuguagugaacugagauugugccacugcacuccagccugggugacaaagugagacacugucucaaaaaaaaaaauuaaaaaaaauaaggaacuagccucuugauuucuuaucuucauuggucagugugcuucagaacacauauaaaaauauuuauuauucagaaccuggacuagauauuguaggcaauacaaagaugaguaagauacgccaccuuuccugaagaaguuaaaaauguaguagauauaguaaggucaacaaaaacacaauguagaguugguacuugagacuuauaaaaaugcuuuaaagaaggauagggagagcuuagaagauaauuucuagucaagggaaaucaagaagucuugcuuagaaaaagagacauuagaaugucaguaaguagagauggguuagaaggguauuccaaggagaaguaagagaaugaaaagcacagagguaggaaaaauaggacauguuugaaaaacagcauauaguaguuuguccacaauguagaguacacguagaagaguaguaaggcaaagcuagaagggaagguuagggcuguaccacggagggcuguggauguccacauggaguccugccuaaauauucaacaaggggcuuuaaaaaagcacaaucaguaacuuaaggaaaauuaacuuagcagcaauauauauguuagaauuaggugacuguaaugagagggcugagccaguagaguaugagggaaaagaaugguggcaaaagacaaaugaagagguagaaucuuaauagacuugaaaacugauggaaauaagacaggagagaaaucaaaucuggaaacuguaaugcuaguauauugaaaaaacacuguaaaguagaaaagaaaugagaguaaguuuaaauguaggcaugguuaacuagaaaugcuggacucuugaggaacaagaugaauuccagccuauacucuaugaauaauggaacuaggaaagaugggcaguccuggugcugaugcaugccauuuggguuuacuuagauuaagaagugaauuugcccucccuggaaggauuuaagaguauauuuuuaaaagaugccaugagagcaaaggagggggaagggaaggagugcgggagggagggggagagagagagagagagagagagagagagagaaugugugugugucguguguguguagguguugaugguugugguaguggcaguaaagauccacaugcaaaauccuuuggguauguucaguccuucauaaacuaagcuugaauuauacugaccuuugaaaggaacccaaggccuuugaauggggaccugcagauuaauuuaaaaaucaagguaacugaaaaguacuaguguuuuccuaaugaggaaaaaaaaaacaaaaaacaaacaaacaaaaacaaaccauuaaaaaaaccuaaauuuuaaacucucuaaaaauaagucauauuuuguauaauuuauaaauucuaaagcauuuuucuagaauuuauuuggaaaauaggacuauuuguauaaacacaccacuggcucucaguguaucacuaaaaugugaugcuuugcaauagucccugauuucuaaaagagaaaaaucugcauuuuaguuucccaauggaacaucaauaauucauuaaccacauuaguaaugauuucaaaauguuugugugcuuuaaaaaagaacauuugguucgaaacauacauuuaaacuauauuaagacuaucugauuuagaauaaugcauuaacaucauuaccaaaucagaacaagacuuccuaauauccauccauuuauagucuagccccagggaagcacugagcagucaauauaaaccucaacucugcacauuagaacucauauauuaaacucauugacaacccacuuagguccuuguucacagcauauuuacuccuccuuuauacagaauucuaaaaaguaugcauuuguuuuccaaauuaacaguaaaaacacaauaugaaauuuaaaaacaggagucagguccugcugacagagugaaaaaagacagaaugugagaauucaagaauaugaaaagcgcuccaaaggacuaaugagcguggacucugaagccagucuacugaaguucagcccaagcucugccauuuacuaaccaaauaauguugggaaaguuacuuaguaacucuguaccucaguuuccuaguaaaauagaaauugucuaacaguuaacuucacaggguuguugugaggaauaaaggaguuaaaagcauauaaaauaggaagaacaguguccuggcacacagcauucucucaauggagguuagcuauuauuauaauaaaugagaugaaaaagaaaaccucaaaaauuauacaaaaaguaaauuugagguuuuauaauauagaagcaaacaaacguaugcacuuaaauuggagagcaacaaagaacagcagaacauaagaaauuuuccuugugguaacuuuccaucaugaagaaaaguucaauuaugaucaguauacacugcuuaagaaggcacaaauguggaaagacuuucuuguuuuuguaauucaagagguacuuuccaaaaaucuuagaacacaugauuuuuuaaauaauuaugaucaguauacacuguuuaacaagauaaaaauguagaaagacuuuaauuuuuuaauucaagagguaguuuccaaaaaaucuuggaacacuugauuauuuuuaacaauuaauuccuaagaauuagaggucuuacucucuauuuuuguuaauaugugggcauccacaauguaauacuuuauaaucuaacuacacggucucgaauuauugagaacauccaaagaagucaaauaagcaguuguuugucuuaaaauucuggugaacuuuuuuuauugggccuuagacucaaacuggcaccucaacuuuaaugacugucuaaaguccuauuaucugccauuuguauuauaauuucuccuugccuuaaugguguauuuuaauuuuuaacuccaccaggugugguggcgcaugccuauaauccuagcacuuugggaggcugagccaggaggaucacuugaguccaggaguuuaagaccagccugggcaauacagcaagaaccccuaucacaauuuaaaaagaaaaggaaaaaaaagguagccugggcgugguggcucaugccuguaaucccaacacuuugagaggccgaggugagaggauggcuuaagcccaguaguucaagaccagccugagcagcauagugagacuuugucucuacaaauaauuuuuaaaaauuuagcugggcaugguagcacgcgucuguggucccagcuaacuugggagacugaggugggaggaucgcuugagucccagcggucaaggcugcagucagcugauugugccacugcacuccagcaugggcaaaagagcgagaccccaucuuaaaaaaaaaaaaaaaaaguuauuuguaacucucuuggucaugauuuuacuuuuccauuuuauuucucacacccacacaauuauuuaugcaauuaggugggcuuucaaaaugaaauuccuaaaaacuaaaauaauaguuuuaacaaagaauagacauuuuauuaaacaugaaauaacauuuugccuuggguaaguacaauagcaaaguuuaauaauuagcaauaguaucuuauuauguaaaaccaccugucacauuaaaucaaacaacagacuuuucuuaccauuucuguguguaagcauuucucucauuuccucauggucacauggaugaguaaaaucaaacacacuguguccaguuaguucaaacuguaaacacauuuuuaaaaauuagggcuagaucauaaaaucauaaaaacauauagaagagcucuuaauaugugugcauuuuaccugaguuaaucccauguauuuguucacauuaucagaaauguaaaucaugucaccaucaucugugagaaccauaacaaaaccauccaaggcuuucaaauaaaagcaauucaucugugcuuucaugucaucuucaauauccaaaucaccuaaaaagggcacaagaagaggaaaauaauuaguuaaaaaguuguacuuaaaugauauaauauuuagauguuuuuacaaaguuuucucgcagacacuuuauuuaauauauacagccauuucaacacagaaaagugcaggccagaagcuagaaaaacuauaauuagaugugccagcugcuuuucaugauuaaaguaaugcagcaaagcaaaccauagaagaagaaagaagaguaauguuuuuuauuuauuuauuuauuuuauuauuuuugagauggagucucacucugccgcccaggcuggagugcaguggcuugaucucggcuuacugcaagcuccgcccucugaguuuaagcaauucuccugccucagccucccuaguagcugagauuacaggcaccuaccagcgugcccaucuaauuuuuuauauuuuugguauauaugggguuucaccaucuuggccaggcuggucuugaacuccugaccucaugauccacccgccucagcaucccaaaguucugggauuacaggcgugagccaccgcgcccggccugagucauguuuuuuaaaggaagaaagguagauggaacaggagaaaaaggggggaggggaaaagccaguaucuuauuccugacuaaagcuuuaaaagcagguaauaaaaaggauguuauauuagaaaagaauugagaguauguuuaagagaauaaagcaaaacaaauuaugugcauaaagaaugauuauuucaaagaauaacugaugagaaaaaaaugaagcuugauaaaaauagugagaauuacagaaaaauuuuuaaacguguacauaucacaauauaaagagguauacaaaaucaaaacauugcgaccaccuucuaaaaauaauuucuauuuacuucuaacuucuaauuuucaggccuauuuauacccuuguaaaauaacucaccagcauccagaaguuuccucacacgcaaauagcugaugguaagccucaucacagaggccuuaucaagaugcgaacucacauuauguggaaguggcaacugaugagcaagcucauaaaaaacuucagauucuuuacuucgccgagaucuggcugcaucucgagacuuuucuuuucgacguucagaacuuauccuacuuaacaacaacaagaaaaacacgagauggaaaguguauacaaguuaguuugccuuaacuugaauaaaacuuuacauuucugcuuaucacagaaggauuagaagaugccauguaauuaaguuacauggagauuugucuacuagauuaauguacuuuuauaaagggcaacuauacaaauuuuggauuacugcacacauaaggaacucucacaaaaaguccaaaaccaagcuuuaaaccugucggaagcagguguuuccuccccagcauauguaauuggagagaauguuuuuauuuuaggcaaaaauuuaaaguagccuguacaucuaaggcuguacuucauagaauucaaaaguagucucaauacagagaaaccacgauuaaggcuagagaaacuaccuaaaguuguacauaauaacuugaaaacaggaguuguuagcagguagaacgguaauagcuacaaacugauuucuacuuguuucuuuagacuccaguacuuucucacccuuuuaccacaugaauaacacugacgauaagcuauaggaacugacauuagcagcuauaagccagugcagguugccuccucccuuagcagccccuuaucuauuacuggcacaacaggugccaaauaaaugcaggaauauggaagaaaaaaagcuguggcacacacaauauccagaauuuagagggauagguuagcaaaaauaaaggugucaauacaaugacauaucuucagggaacucuuccaagaaggaaaucagaaagauuuucauugucacaccaagcaaaagcugucuuccuuugcuuaacugccuagugacaucuaauagcuuguugaauagcaacaguuuauuaaagguuaccaugugccaacauuacccuguacuaggugccuaguucucucacaaccuguaaauagguuaaauauugucccuauuuuacaaaugagggaacuggcguucaauagguuaaaaguagccauuauguagcaaauaggauuugaacccagguguuuuaaagucuuugcucuuccacaguauuucucuucuuaauggggaaugcugcuucuacuuuaaacacucacaugaucuccuaugccccucaacucacuccuguuaaauagauucuucaccaaauguuaaaaacagcuauuaugauuuagugagcauugggcaguaugcuaaauaaggacuuuuagccagcauuauuuuacuuaauccuccuuacauccugugaaugaaguaccgaauugucuccaccccaaaucucuccuccuuccaaaugaucugcaaaguugaaagguacaaccauagaagcaacauucuggaguaacaagcacaguucucagcaaaugcucuuguuacaauauaacauguuguauugugacaauacugauacuaguuuuaguacuuacucaaguuuguguguuuauaggacuuuuauacuuuaauaaggaauguaagcauguuauugaacuuugauagaaaaauuucaacucaagcaucuagaucaauuuaacuugaguaccuugaaauuuacggugagcuauuaaaaacuauuaucuucaucugguuagaugguggaggaaaaaaaggaagaaacuauuaucacuuaaaacuaguuauaugaaucuauaugaacuauaacuaguuauaugaacuaggauuuucucaaugcuguacaauaaaaaaaaauuagucacugaggcuacaugaaaaugcaaaugccagcagucuguaauuuuuucauuucacugcauuguucucuguaaauguuuucaauuuaaacuuaaaaauaaaacguaagacuugaucuguauaagcagaagaguaaaauaaaaaaacaaguaugaugauaauaacuccagcauacacuggaguuccauacaccauucccaggauggggggguaucuagcaggucccuauuggcccuaacagaaaaucucucacuuccuccccaacccccuuaaguuguaggugacaggcagugauagcugugggaaauagauuucuaucugguucaaauaaagccucuaaaauagagugauggucaauuaucucuuguuaaaccugaauauuaguucaaaugccacaaucauuccaggcguucuuuguuaccuaggcuggucuugaacgccuaagcucaagcaauucuccugccucagccucacaaagggcucaaauuacaggcuugagccauugugccuggccaaaguguucagaauuuuauaagcaacuuacuguauuuuuucugaaccacucaacugauguaaacuaccaauaaaugacuacccaaaugaaacacuuggugaaaaaauugaaaaccuuauaauaugugcuauauaugcuuuuuuuuuuuuuuaauggaguucugcucuugucacccaggcuggagugcaauggcaagaucuugguucacugcaaccuccacuucccagguucaagcaauucuccugccucagccuccugaguagcugggauuacaggcaugugguaccaugccaggcuaauuuuuguauuuuuaguacagacagguuucaccauguuggccaggcuugucucaaacuccagaccucaagugauccacccgccucggccucccaaagugcugggauuacaggcgcgaguauaugcuuuuaaaggguauccaaucaagcuaacuauggugauggaaugucuccaguuccucuguaauacacguaucguccagaacuucaaagauagcaaugacuaucuaaggaguggcaauaagugucuaagacaaauccauuagaaauuugagguuagauaaagcaucuaaaggacaguauauuuaaaagcuaguguagacugaaaauaagacugaauuuuggaagaaaaccagccuucaagaaaacaacuaauauagaguugacaaaccuauauuagaugaaggugauaaaaauuauuauguccuuuaucacacaaugagucuagacagaaaccaaucaagggaucuauaauaaagauuuaauggaaaaaucuucaugauauucuucauaugugacuacuggaggucuuauaacauuucuaaguaagcuuaaagcuuaaagcuaaagcuucugaaguucuugugaguuucagcauuuaaacugcccggcuucuugucuagucacaggaaggcuaauuuuaucaguuuuauaccacagaauuacaguacugaccaagaauuauuuguuagaccagggggucuaggucccacagagaugaauccuguacuauuuguuuuacugcuuacauugcacaacagaagauauguagaucagaaagaaguacauuuuccacaugcaaauaaggucacuauauuucucuaaauuuuauaaauugcaucuguuuuguuuuuaaguacaggucaagugaaguucuucugcugauauguucugcuacugcauaagguacuauauuucaguuaagaguacaguuaaaacaguuuguuuacccauuucuacaacuguucuagaacuaaaguuggaguauacuacuggcaaaauagcucaaucuuugugguauuguaguuuuuacaugcuuaccauuuuauuauuuaacauacaguauuagacacaaaaguaacaauuauaucuugaaauuauuuuguauaggaaauauauuuagaaaaauaauuuugagcccgucuuauuaagcuucuuguguacaaaguucaugaauaagcaagaguuguuuuauagagaaugucuauuguucuucagauuaagaacauaaaauauuuagugcuuuguaguaggucaguaaaaauuaaaaaaaaauaaaaggacacaaaauaauuguaggcauuuaaagucaucuuuucguauugcacaaaaagccuguuagcauuccuaauuguaaaaauaugugacuucaagaacugaaguuaaaccauaacuauuuaaaaugugagcagauuaucagauuuacuucuaauaaaguuaauguaccucaauuauguuauuuggugaaauaacucuuucuggccuugaagguacaaguugguuuuuguuguuuuugcacuugcgucaguauuucuacaggacugacauucugaagugaaauuucaugauauaaaaaaugugcuacugaaauuuuuuaaaauacacaauagcuuuccaaaugguucugugcccauuuuugucucugccaguucaugaauguguauaucaauucccccaugcacucugcaauauuauauauuacgcaucuuuuuaaucuuauuaauuucugcugagcugauaggugagaauuauaucucaucauuuuaacugcccugcacuucuuaaagucucaggcccaagaaaaaugcaaagaaaaguucauguucacucuucaguuggcauuuuugccugcaguuuuauuuucauuuuauuuuagagacagagucuugcucugucacccaagcuggaguacaguggcaugaucauaagcucacugcagccucgaaaucgugggcucaagcaauccucccccucccuaccucagccucccaaguagcuacaggcacacgcuaccaugcccaacuaauucuguuaaauuuuuugcagagacggaaucuauguugccucgacugguccugaacuccugggcuaaagcgauccuucugccuuggccucccaaagugcgaggauuauaggugugagccacccaaccuggccuuugccaguauuuuuaaauccaaacaccuaugcauggugcuuacuaauaacacagugguauucuaaacauuuuucaccuauuauuuaaucuuuauuauuaucaccauguuacagauaaggacccuggcuaaauagcuuacccaacauuacuccguuaauaaaugguagaaccuguauuucacucaagcagucugguguccacgcgauuaacacuagacuauguugucucucaaaaacucauccugauuaccaaggcaaguauuuguaagucuaggcuauuauuauaaaguucgaaauuugccuacuucacaugccaaagacauaaagaaggaauuauaggaguuggcuucagaauuuaggacuugaccuaagcuauucagagaaacucagaaccaggcucuuucuuggaguuugcuuauaaauccaaaauccuaacugaaaggcaccuacaaugguaauagaugcucucugcucuacuguccagcagcucuucaaagcaagguaaucccuuccgguaaugccaaucauuauggcgaaagagucaaaagaugguaauucagucuauacucccaguagacuuuauuuguacagagcagcuauuucaauaucuaaguucaacauuguugguguuuuacuugcucaacauuugucuagcagucacagaaacuguuuuuuuuuuuccugagacggcauuucacccuuguugcccagacuggagugcaauggcgcgaucucggcucacugcaaccucugccuccuggguucaagcaauucuccugccucagccucccgaguagcugggauuacaggcgugugccaccacgcccagcuaauuuuuguauucuuaguagagaugggguuucauuauguuggccaggcuggucuggaacuccugaccucaggugaucugcccaccuuggccucccaaaguguucggauuacaggcguugagccacugcgccuggcccuuccuuguuguuuguacucauuuuuaaaguuauucuaacuuguauuaggccaaauuaaugaagaaaggcuuaaguuuuuaaaauauuaaaaauauuuuagaucuauaccuaaagcuaacacacauacuauaaugaugcagucuccuaacaugaggugauuuucugaaacuaacugguuuuuaagugggaaggguuuuguccuccagaauuuuguauaaugguggcauaaacacuggaagguaacucucaaggucuaauccucaagguuuuuaauuccaucauuucccacaggaaaacaaauggaaaauccaccaaguucuugguuuguauuuugcagcauauuugaaggaauuuuaggaacugaaauaccagcaaacgaauaaacaaaaaguauaacaccaucaguacuuacuaaaacaacaucucacauuuccauaagagaauucaguuacuguucuuuuuccuuaaauggcuuugagcauugucuugcuguuugcauaagacuguuuacuaaccugaguguuuucacagauuugggaagcuuagauuuuugaacguuccagcaaacauucaauuuggugucagcuugacauuaagauauacuccuuacacacagcucuacucuauauuucacaaugugcucaguuaaucuacuuugauucuauuuuuauaaaucuaaauaaucuccuauuguuuuggaaaaaacucuccaacagcuuuuuuccccccucugcucccacaccacagcaaucaacaacacagaagacaacuucugcaacccuaucgggagaggagggguucucuccaccaccaggugagcaaucaguucugcagcggacaccaacuggguguccuucaauucaauucuaacacuaucuaccuggagacagugucagguugagggcucaguccccaagacugcccccucaacaggaguugcaagucuggccucaggaacuucugacugacaggcuucaaaaguugggauucucacaaacccaucuuugcuggagcagcucacagaacucagggaaacauguuuaccaguuuauaauagaggauauuaauaaggauacacaugaagagauguguagggcgagguaugggagaaaggaugcaucuaucaaguaccaugcacugugcuagguacuagaaauauagugagaaguagaauagccuuugagcuuaaauggccucccacuccuuagucuacugaaauagucaccuaaugcuuuauucccaaaugcuugucuagcugcaucgugaaggacauucaacauuucaaauuccuaggccucacugggaauuugaaucuguaaauucugauucaguagaucuaagucaggaucccaaaaucugaguuuuuaaaaacuuccaagaugcauaugauacguaaguuugggaaccacuagcugaucauuauugcuaaccacuguuacucugcuuuaauuucuuucugaaaccaucaccauaaagauccuuccgaaguaaagaaauuuggcauuauggccugauuaaaaucccauuaaauguacacaggacaaggucuaauuauuuaaaaggaagcccucccuuaccuaguucccuguccaccucuuuauccucaucauuuuccacauucuucagccacacugcaguuacucaaaagcaccauaguauuuccuuucuggcuugcuuacucuacuccuucugccugggguaccauucccaauauguggcuugguaaauuuauaagagaaacuuuuaaagauuuaauucaaacaucauuuuguuucuguuuuuuuuuuuuuuccucuggcuuccaaaacugguccucucugguagaacugaucacucuaguuauuuggcuauauuaaucuuccuucacaaugcuuaaagauucuugggggcaggaaacugucacacauucaucuuugucuucucaguagugaugugcguaaguuugacuuugacauauuugccccaaaucugcuaugacuuugauuucuggcacaggaaaagcugacugcccuuucaacauucuuuuugggaaucccugauuugugcuuuauuagugcuccuaaucauaauuaaccagcauaucaauguuaguacuauuaaauaaacauaauauuugaauuuacuacaauuaucuggauaugcauuuucaaguauaagcaagcauacuagauauaaguuacagugaaaaucuuauauucuuuugucucccuguuucuuugcaccccuguaaucuuuuucuguaacagcaacuagaauaauccuuuuaacaagaaaucaagucauaucacuccucucugcuuaaaaugguuuuugccucauuuagaguaaaagccaaagcccuuccaauaguccauaugggccuccacaauggccucauuaccucuuugaucucaccuucuaccacuuugcccccuuugcucauucuguucuaaccauacuagccuccuuacuguucuuaaaacacuucaaacacauugccuccuagagccuuugcacuaguuguuccccuugccuggacuacugcuacccuaaauacccacaaggcuugcuucuccaccuuuuucaagucuuugucgcagucucacccucauugagauucccugaucacugccuccaucuugguccucuugcccugcuguauuuuuaugaaagccuaaguacauaucuuacuugauuauuuuauuuucuaucccaccaauccacaccuucacuggaaaguaaguuccauagaggcggagacuuuugucuauuuuguucaaugaacaucccaagcaccuagaacaguuucugacacauaagaaguauucaauuaugugcuggcugaauguaugaauuaauaaguugagauucgaucacuaguugaaguauaaauauauauuuuugcaagaauaaaugcuacaguaacugauuaugacagcuaauucuguguacaaaaacaaccauuuauuuaucuagccaaguuccuggcacagaaaagcagcuuaguaaauguuaacaaaugaaucguggaauaaaugugaacacaggcaaacacaggcauuagccacaagguaaacaucagagccagcagagccagcagugucaucuuccugaaguagaaaaaaacagcuaucaauuaaaacaaucacccaccaguauaacaaugaagaguaucaccauaaaccaaggcaaauaaaugaucuugccaggaaagagauuuagagguguaaagagagagcugagaaacuagaaagccaauuugcugaaaagagguucaguguuuaagauuaguucccuuaucgcuuucaucuacacucaugucuuuuacuguuuuguccuaagcaaauguggucaggaaaaugugugaguuauaguuaauguucuuaaccaaucaaauuacuagccgaguguaauggugcacuccuguaguuccagauacucaggaggcugaggcaggaggauuauuugagcccaggaguucaaggcugcagugagcugugauugugccacugcacuccagacagagcaagacacugucucaaaaaaaaaaaaaaaaaaaaaaaggaauacuuaaacaucuuuaucaucuuuauguuuuccgaacccaggcagaaacaggaguuuacuaacuuugguuuccacagucuuuuucaagaaagugcugucacgaaguuuucauuaaguugauaccuaauccuauugccuuuuuuuuuuuuuuuuuuugagacagagucucgcacuguugcccaaggcugaaguacaguggugcgaucuccgcucacugcaaccuccgccucccagguucaagcgauuuuccugaguagcugggguuacaggcgccugccaccacacccggcuaauuuuuuguauuuuuacuagagaugggguuucacuauguuggccaggcuggucuugaacuccugaccucuugauccgccugccucagccucccaaagugcugggauuacaggcgugagccaccgcgccuggccagcuuuguuuuuuuaaggaggguuacuuuuagacaaguauuuuauauguauuauuggaaguauuauuaauaggaucuguuguuacauuuucuaucuaguaauuguugcaaaaccagaauacuuaaaacaucacauguaauuuuuaaaaacccuaucucuacuuaauggaaaaaauagcaaaaaccugacauuucaaauuaaauauaaauuacauuuucaagacagcuagcaaucuauuauuuuaucugggaaaauaucuucugaauucuaaucaauaaacuuuaaaaauaaaccuuuaggauacccacauguuagagaauguuauugauguauucaaaaaauauuucuugaucaucuucuaugagucuaacacucuucccagaacaggacacggugcaauaaacaaaacagaccaagucucuaccuucacggagguuaucuuauggaacaaauguauuuuuacauugcuuguuguuauccagcaauauuuuaccagggucaaucccuaacugacaaaacacgucacagaaauugucuuuccauuaaaccagcuaccacaaaauuucaggauaaaagcaaagucuacaaaaauuaaucuuugcuuauacuagaugcuacaauauaguauuauaugaacagagcaggcuauacaaaaaaaauugaguaugauuccacuccuguguguaauguauguguauaaauauaaacauauguagcuauacacacauauaacucauagaugcacagauaaaaccagaauacagugauauacaguguuagcaaaguuuacaaauauuaacuaguuucaagauaccaggaucacaaauuuuuuguaauuuauuuuaacaaaaauucaccaugaacugacacuaucacuguaccugcauuugucaaaaaacucugaaagaaguaguaaucuaacuugaacuaucauauuucuuuccuacuguauauccuaaagaaaaguauagacugaacaggcaauauaauucaguaucuucaguuucucaugcuaaccuaauuuucaaauuuugaaaauucuguauaauuaauuugaaauucaaaaaaacagaugaaaugguuuguuucuaaagaaaaauguucagaaugcauacacuuauuuuauuuuugaaagcaacuaaauuucuugguuuagaucauuauuaucuaaacggcacaacaacaucucucuuaaauauccauaauuaaagaaaagauggauuuauucaccuuccaaaccucaccaaaaugcuuacuuuaaaugugauuuucuaaugcaguaaaauaaacggggaaaagaaucacuguuuuacauuggaggguuccuucugaaaaugaaaucuauaucacaucugaaauagccauaauguguaaauuuuucauuuacauguuaauuuauuaaguagcuaauacuuuuccauguguuuacauuaauguguauugaaauauuacuuguaagaagaaugugcuuuuuguuuuuagauuauuccugacuagugauauaaauaaaaucuuuccugguccagaauugguguugagccucucaacaaaucuuugagcccugauuauauauaagguauugugccaggugcaguggcucacgccuguaaucccagcacuuugggaggcugaggugggcggaucaccugaggucgggaguucgagaccagccugaccaacauggagaaaccccgucucuacuaaaaauacaaaauuagcuaggcauguugccacgugccuguaaccccagcuacucgggaggcugaggcaggagaaucaacugaaccugggagauggagguuguggugagcugagauuacaccauugcacuccagccugggcaacaagagcaaaacuccauuucaaaaaaaagaaguauugugcuagauaaauaaaacaacaaaaauguguauguaaaguuuuuacucuaagaugaagguucucaaacgucaguuuucaucacaguccccuggaagaauucucaaaacacagaaugcuugccaagucaauccuaagccaaaagaacaaagcuggaggcaucacacuaccugacuucaaacuauacuacaaggaugcaguaaccaaaacagcaugguacugguaccaaaacagagauauagaccaauggaacagaacagagcccucagaaauaaugccgcuuaucuacaaccaucugaucuuugacaaaccugacaaaaacaagaaauggggaaaggauucccuauuuaauaaauggugcugggaaaacuggcuagccauaugcagaaagcugaaacuggaucccuuccuuacaccuuaugcuaaaauuaauucaagauggauuaaagacuuaaauguuagaccuaaaaccauaaaaaccguagaauaaaaccuaggcaauaccauucaggacauaggcaugggcaaggacuucauguuuaaaacaccaaaagccauggcaacagaagccaaaauugacaaauaggaucuaauuaaacuaaagagcuucugcacagcaaaagaaacuaccaucagagugaacaggcaaccuacagaaugggagaaaauuuuugcaaucuacucaucugacaaagggcuaguauccagaaucuacaaugaacucaaacaaauuuacaagaaaaaaacaaccccaucaaaaagugggcaaacgauaugaacagacacuucucaaaagacgacauuuaugcugccaaaagacacaugaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaacaggaacacuuuuacacuguuagugggacuguaaacuaguucaaccauuguggaagucaguguggcgauuccucagggaucuagaacuagaaauaccauuugacccagccaucccauuacuggguauauacccaaaggauuauaaaucaugcugcuauaaagacacaugcacacguauguuuauuguggcacuauucacaauagcaaagacuuggaaccaacccaaauguccaauaaugauagacuggauuaagaaaauguggcacauauacaccauggaauacuauucagccauaaaaaaggaugaguucauguccuuuguagggacauggaugaagccggaaaccaucauucucagcaaacuaucgcaaggacaaaaaaccaaacaccgcguguucucacucauagguaggaacugaacaaugagaacacauggacacaggaaggggaacaucacacgccggggccuguugugggguggggggagcggggagggauagcauuaggagauauaccuaauguuaaaugacgaguuacugggugcagcacaccaacauggcacauguauacauauguaacuaaccugcacguugugcacauguacccuaaaacuuaaaguauaauaaagaaaaaaaaaacacagaaugcugagccuuacuuccagaguuucugauuuaugaagucugaauggcgccugagaaugugcauuucuaacaaguuaguaaugcaccaacuagguguuaccaaugaugauaaucuggggaccacucugagccccucugcucuaagaagauacuuaacguguucuucaaaaaugcccaaagaaguaaaagagcaacgcucaaaacuaguuuguuacauacuuuucucuuuaaaaaaccuacccaaaugcuuuacaaauacaggaaauauauccaccuccuaagacauuaauacaccacauacuuagaacuuaguaauuauaaaauacacuaacuacacugacuagacuauucaaugguugaccugugguauauauccacaaucaucaauagaacuuuuuucccccaaauauagaaggccaaaucccaacccuggaaauucaaauuaaaggcuuggcacaucuguuuaaaaaauaauaucaacauaauccugaugagcacucuuagcuguuuaaagucuauguuucauuucugagugcuuguaaaauuuacagaucccugaguuccaucccaaaauuaccaaaucagaaucucuggcgaaugggucccugggaauccauagagcaacuagacacucaggugauuuaaccacagaaguuugagaaacauuagcaggucuuaaagcaaaagcuuaacagguaggccagcaaauuuugaaaaacgagaauaauuuauuuuuagcuauaacugaauacacauccuauaacauaccauguuugucaggcaaaacacugaauauagugaguuucacaauacuauguaaugugagguauaauugcuaagaauaagaagcuagcaguaaaagucaauaagccagcaagaacaagugugcguuuaguaaaacuuugccuuaaacacguaagugcaugaguagaguucaaagaugaccuaaggaagaauguggcaacugaauuuuuuuccaguucucugaaacaauuuuuuaaaagucagcuuuuaauaccuucaugaaugucacaaacauucaagagugaagaaucacuguucaugguuaagagcuguguaucacugacuuuccccaaauuaccuacucuaucacucuucuuucucugcauugcuuccuucucagcuuguaaauccuuuucuuucuguuucccuuauuuauaugcucuuagaugguaacagaucuaagacuagaaccuaagaaggucagugacccuaaacuuuguguguauguagaagaauguguccuugaaauaauuauuugcuuaacuuuaauagaagaugcauaaauaauaauaaaguacuuacauaacaggaaaaaacacauguauugaaauaaggguguacaauagaaagcauacccuaaagacuucuucuauuaaauauuuagcucuaaaccuugaccaugauuaagauucuggaaaugacaaaggagcagcucuccuaaagcaagagucucuguuuuccaacuauacuaauccauccuauccaauauuaccaaauaaauuuuccaaagugaccuucugauccuguuucuuugucuuuaaaaaggguuagguaacacuauuaguguguggcagaucucagauuccaccugagaaucuccacccuuuuccccauuuuaauaugaagccccauuuuuaauauggccuaugccuuuccacaaaucagaugcucaauauauaauuuuuaaauuaaaagauucaagaaauuugggacuauuuuuuaagaauagaaggaagaaacaugauagcuacccucagauauuugaaaaggauaucaaacaaaaggcggauuugguaauuuauacaacuccagagaguaauaaauaggaauuacaacauggcagugcuuuguuuaauagaguuaaagcaguguugaaguuacacucuaugagaauuuuuaaaaccguguuuucauuuugguggcauuguaaaaaaagaaaaggcauauucuacaucaucuaaaugaucucuccauaguucuguauacuugccucaagccuucuguguuugaggcugcauuuguuuaugaucaaacuguuaccaaaugaccacuaaaaggaacaagguuacauuuuuuaaugcaguauacauacucagacugaggucacuggguacaucucaaaaauucagaggauuauuuugcuccaaaagagaucugaacauuaauccuguguuaagaaacacaggaauaaaaaagaaaauaaguagauugucuugugagaauguuuuguguauguaugucugaaaauucuaaaagcagacuggccaaugcgccuguggugguugacauuaaauaacaaaacuuaaacccaaaagucuguacuucgcaagaaccucaaacuuuaaagugcaaugaacugaaaauuuaaaaauggaauaugcuaugaaugaaugaaugaacauaaaaaauggaauguucaacuguggccuaagccaucaacgauucaaugcuguacucaauaaauuagcugcacaaauaccuguugaauaaaugaaugcacaacaaucuguuacaggacauaguauaauaguuaggugccugagucaugguuaagcguugaagaaauuuuuugaaccacugaaauaagucaacuuaaauuauucaagaaaauaucccuucauccauucacagugaaggcuuugacuacugguuugacacuauaaccauuuaaauauuuuaacuauguuagcuacaaaggcaggcaauauccaacuuuccucugcuaacaaguuaaaagacauuuaaugagauucuggacacaaaggacauggaaauguaggcuuucuuaauuucccccuccuuuaacaucccaaauaaauagcuuugagaacauuuuucuuccuuuaguauuaccacuauggaaaauuauuuuagaauaacaugucuauacauaaaccaguauuuagucugcaaaggccagauguuuauggaaaaaaaaccaaguaaaggaaaagcaucaguaacuauucugccacuauuauuuacucacugguggugaauagccuucgucagauuaucacaaagaaggcuugagcgauucuaaacaauguugaaaacaacuuaaccaauacuauaauauuaugaauauauggauaguuucuacuuaauuaagcccuuacuuugugccaagagcuguucugaguguuucauaugaguugauguaucauuucauucucauaacaauccuauaaggcaauuauucuuaucaucccaauaaagcaauuuguguaagaucacacaguagagcuaaacgaucuagaaaaaugugugaucuuaacacauauuuaguagagaaaaggaucaucuuuuucuugagaugaaaacccuaacccauagaagaaauacucaacuucccaaaagucaugacaagaacagcuugcagaaugacuacacuugguagaaaacuauagaauaugaauucaaaugacuugcaacaaaaacucauggcccauuaauuacuggucaagaguucuguguauaguaagauaauauucuacaagaagaccaucaaauaugcuacaauaagacauauuugacucauguaaucagggaacuccauucacauggccaaguagggcaaaacguuuucuucuaggaaacugauauauagacacuagaagagagagggaguuuuuuuuacuuuuuuuuuuuuuauauuacaaacuguauggaugcagguauggggaugcuagccguccucuuccacaccauacagacagccugucaguggcagaguaaggccagcaugcaaauagagcaaagguauacaagccaaguaauaucaagacaaaagucagggauuauuacacucugagaucauuugagacucuagauuugucucuuaaaccaaaauuagauuguguuagccaaugacuacauuuuccccucuuaaacuagauugaguuguauuuugcuacuugcaauaagaagaauccuaauauacuuaucaaauugccaguguuccaaauuuaaaacuuuaaugaugauaaaguucaagaaaaugacacucuaaaauacaacuaggucaaacuuucuagaagauaaacaggcaauuacauugaaagcuuuaaaauggauacuuuuugacccuguaauucuacuucuucuaauuuauuauuaagaaagaaccaugaggccgggcaugguggcucacgccuguaaucucagcacuuuucucacuuuuuugagaauagguuugauaaaaaggcaguaaugguaaaacagacuauaucugaaaucuggagaguauuaagagccauauauuauguuaaguacccaacauuaauauuaucuaauuuaaccaucaccacaagccuacaaaauucugauacucuuccucacuauuuagaugggaaaaaauguagauguaaauuuuuuaaaagcagguuaaaaacaguacucagucccuaauccuacaguuauuaacauacagauguaacacagaauugagaaauaguagacaauggucucuacauagugaaaaagcaggugauuuuuauuucuuugugcaccuguguaguuuuuaaauuuuuuccuccaaaauuuuaaaauuucauuaacauuaaaauaguuuagccagaucaaaugauuguaaacacacucagggaacuccuauuuaaaugguauucuauuauaaagcaaagagaauaaucaaugcucuucuauuauaaagcaaagaaaauaaaccccaaccuuacuauaaaguaauagaauuuaaauaucuauaucaaaaaaagucaaaggagauucuuuaacuuucuucuuaccaaucagugaaucucagacagggaacuaaagaauuaaaacauucuuuuuaauuuuuuuuuuuuuuuuuuggagacagcaucucacacugucaucaggcuggagugcaguggcgcgaucuuggcucacugcaaccucugcuucccagguucaagcgauucuccugccucagccuccgaguagcugggauuacaggcaugugccaccacauccugcuauuuuuuuuuuuuuuuuuuuguauuuuuaguagagacgggguuucuccaaguuggucaggcuugucuugaacuccugaccucaggugauucaccugccccggccucccaaaauggugggauuacaggcaggagccaccgugccgggccgacaauauuucuaaagaaaccuuuuaaaaaccugcauucucuuuguucauccaauuauucaaucauugucucauuuguuaauucaaauacuuauuaagagcucacuguguacaccacguaccaguauucacaccacagauuucuuuuuuaauuuuuuugaaacacagucuugcucugucacccaggcuggagugcaauggggcgaucuuggcucaccgcaaccuccgccucccagguucaagcaauucuccugccucagccuccuaaguagcugggauuacaggcacccgccaccacgccuggcuaauuuugguauuuuuaguagagaugggguuucaccauguuggccaggcuggucucgaacuccugaccucaggugauccacccaccucggcaucccaaaguacugggauuacaagcaugagccaccgcgcccagcccacaaauuucaaauucagccuacuugggauuugguccacugaaacauauccaguuuuauaauggaaagggggaggguagaaaucauuuuaaagaaauuugcuuagcaucugaauuuacaagacucuuaagaacagaaacguaucccaacccucaaagacuucaacuuucgccuuuaaaccuuauuuuuaaccauaguauuuuucagcuggaaaaacaaauccucccaaacuacuuggaaaaaaaaaagggggaaacacgggggaccuguccuuaaugagugaaaauugcaauauuaaauacuagacacuuuuaaauuaauuugccuaaauauauugugacuuuucaaacaagugaagaacuacauacaguaaacuauguuccaucacuacauuuucccauuuacaagauaauaaauuuucaaaaucauauguugaaauaaucuuuaugguuaaaacuguaaccgguuaaggugaaauuuuaaaauaaagaaacacucauaaauaacaguugagaucaccagaacagcuaaaagcuaacaucuugggaacaguuuuuaauaaaaauacauuauuucaauuauuguuuuaaaucuuagagaacaaauuuccuaauuaaauugggcuuuaucaacaauagaacagguguacacuauuuuacccaaaaaguguuucugugaaaaaguacuggcauaacaaaucuaagucacuagaaaaauugaauucuccuuuuagagguacuuacucuccuuucaguuaaagcuuccacuggcaaacuguaguuagcuuucagcugguuaauuauccacaaacaagcccuuaaaaacaaucacuucaacauauuagauggcuaccacuuugccacauuagauggcuaagaaagaaagagaagagaaggaaggaaagaaagaaaacaaguguuuagaaggauguggagaaauaggaacccuugugcacuguuggugggaauguaaacuggugcaacugcuauagaaaacaauauggugguuccuugaaaauuaaaaaggguuaccauaugauccagcaucccucuucuggauauguauccaaaaaaagugaaagcuucaaagagagauuugcagacucauguucagagcagcacaauaaccaagauguggaagcaacccaaguguccguugcuggaugaauggagaaacaaaauauggaacauauaauggaauauugcucagacucaaaaaggaaggaaauucugacacaugcuacaacauggaugaaccuugaggacauuacacaaagugaaauaagcccaucacaaaaauauuaaaacccuauaauucuauuuauaugaggcaucuagaguaguuaaauuugcagaaacagaaaguaaaauggugguugccagaggcugaggagagggggaaauugggaguuguuuaauggguaagauuucagcuuugcaagaugaaaaaguucuggaaguuaguggcacaaugugaauauacuuaacacuacugaacaguacuuagaaaugguuaagaugguaaauuuuagguuaauguuuuugaacuacgauuuuaaaaaacaaucaaaagcuauaagaaaaaagccaugagguaaucacauuuuuguuuuuaugaaacaaaaauuuuaaauuuuguuuuaaaaauucagguuuuagauacuagauuucucuaaagggaucaugucuggcaaauaaauaaggguuuauaaauuucuacugcagaaaacaugaacauuaauacucaacgcauauacaaaacaguuaauucuugaugugucaagagaccaagagauauaauuauuuuuaaaauuccaaagccuauaguuaauuuaaacaaucugaccauauuuuuaccaaaaauacugagcaacaagaagcuuggcuugucuuaguuucaaauucucuuucuaaccuuccagaguuaagcagaaaacacauacacacacuggguaaaauccacccacuggauaacuagucacaaaguuuaaaaaaucaauuucuugauuggaaacucauccaacaucacauuuaaauuuagauuuuuuuauccugguuaagaaacagacuuauguuaaucuuagauaaagggauacaguauuuuaaguaucuaaauuuaaaaaauuauauacuaagagaaggcaucuaugaacacacaauuuaacccaaaucuuuaacauccaugcacaucaauuuuuauuucaccaccaaacauaauaaacugaguucuucagaaaaaaaaaaaaaaucagucaagagacuaaauaaucccccucagcuuucuauacaccacucuugacauacaagaauagaauguaaccacaaaaucuaaacccugagccgugacaccauuagagucacagacaauggcguuaaaaguaaagacaauggaaguuaacagguagaaaaguugacauucuccaaacugcacaaggugcucugcaguggaccguaggaaugaacuccaauacuuucucagucuaaaauaacucgauaguucaguaaauacacacguguggaagagugcauagacuucauacaaauugagccacaaaacagaccaguaagacaagcuugaagucuugccuucagauggaacccaauggucuuaacucuggagaaacucauaagcaaaggacaguuuuucuaccacguagcugcuuuacugagaauauuuuaucaacucauuaucuuuuacaaagguuaauuuuuauaaaauugucuaaacuuuggcaucaagacgaaaaauguuuuaacuuacugccaguacuaagaaugcagugucuugcacauaucuugcuuaaaugaacaguaagacuagaauacuguguauguuugacucuagaguccagaguaaacucaguauucuauuuggggagaaaacacaggggugagcaauugugaagcaggaggccuccacuagaguagagagcagaucagaugcucaagaaaaauaacugauacuaggugccaauauaacccaaggauguacucuuuugcccauuguaacaggaaaaaaacgcuuuucaagcucuggauccaauguuagucuuuucacuuucaggagauagaaaagaugcaugaagacacagaaaagaaacuaaaggaaacagcuggaaggacuagcaaaaaagaguuuuaagaguuguggaaguuuaaacaagaauuuuaacagguaacaucuauuuucaaguacacagugucaucaagacuccugcaaugggcuaagugcuucacaagcauuaucucauuuaaccuuuacaauaacugcucagauggcugcuauucuuaucaucauuucaaaaggaggaaagaggcucagaggcauucaguaacuugcucaagcucacaagugaagggcugggacccuuaacucagagguaucugccucuagauccuaugcucuuaaccaccauaugcugcuuccucaaacaaaaggacaaucaaaauagaaucauaaggagaaaaguuugcuaauaaaugagagagcuucuugacuuuuaauggccaaaguuaaugaaggaaauuaaggaauaucuauucucagaaauuuuacuuuaaugauucaguaauuauuuguuuuggaaaacucugaaggagucuggccugaagccugaaacagaaucauuacucucuugacauucccuuaaaaaucuaaaaaucaaaaugcacgugcuauuaaauaaguucagccccuauaacuaggaacaacaugaaauguccugcguuaaaucuacaguaucauaaccauacccauuuucuauucugauuucuuccaauucuucagguuuugaguuuccuagaccuucuuuuaaaaagacaaauuuguuuuccaaacuccgacauugggagcucauuuaaaaugaaaaaaaaaauugcuugaagaaaaucuccgucccucaaccucucaguuaucuuucaaaaaacuguaaauuaguuagaaaaggucaucuauuauaaacagcaucuaaaagugcugaguaaccaccacuuauuaaguguuuaacuuaauuuuucaguuauaucaagaacuucuauacuaagaaauaugaauccauccaauccaagguugccaaguuuucaaaugagaaaauuuugaaaguaacagaugggcugaggaaaaucuaagagcuuauuuagaauuggggcugaugaacaguagcuaauuuauuaauucguuucaaaacugcuucugauauucugaacggaugaauggcaaaacaaugaguucgauacuguauauaaaaaaagugguacauaauuuaaugcauuguauuaaguaugauucaauauauaauaaggauagaaaacuggcacuacacagagguaaucugccuuagguuuacaauauagcagcuuuaucauuucaucaaaagcacuguaaucaccuccgcaaaauaaacugcaauuaauuccugguaacucuuggaauuaaucuagaccuguuugcucacuuuuugaauuuuauaagugaccuucucugcuguauacaaacuaagaauuuaauauucuauugaagaaggaccaggagaagggaucuacaaaacagcaggaauauaaacaaguuuaucuucugcugauacugauuagggaaauuaaucucucugccagaagaguggaaggauuuaacagcaaagccagucuacuaaccaaaacucuuacucuaaaucuucaauuccuuaagugauuuccuuaaaaguuaaaaugccaaagugggcaaaauuguguguguguugggggaugggggaguccgcucuuaacaccacugguccaacucacaauucuuaaucucuaauguaccccuuagacucaaacuucaaggugauuuauaaaacuugcauuaaguucuaaccgagugauuacuuacuuuagauauauguugacgguuuuccuuuaauauacuucaauuucaggaaaaugagacagaguucgaaaauuuuugcaacauuuuagugccgcauuucauucacucaucauauacuuuuuucaguaucauuaaaacugccuaaauuuaaccagccccuacauuuucauuauuugaagaaugaaugaggcauauauucauuuauaauaucugcguucucgugacaggugauaugaacucaaguauccaauucugaaguucucuuuaaaauguugccauuucccuaaauucccauuacucugacucucagucuaggcaaguuuuucaaggcgauuaaaacgaaacaaaaccugcacgugcaaacuaaaaaguucgcaucuuaaggccaucgcggcaaaucccuaaugcacaaaggcaaagacacccgcgacggcuggacaacuacaggacaagaucgcauccgaccacgcgagucccucagucgggaacucaaggccccaaguccacuggaaagccaggaccagcgugcaggguccgccccagggccgaguuuucaauggaacuggagaggaugggggcgggaaggagcggaagcuccgggugcaaaccgcggcuaccgagcugcagcucauuucucuucccgggguuuucaggcuggguaaaguccccuccggauggggccacagagcaggcuggguuuuugaggcggguaggugggcggcgcgaggcccccacggccggcggggagggcaagcagggcucagaccccggccccugaaagcacuuucgaggcgucucccaccccccacgacaagauggcgacguggacagcgggggagcccggccggcgagguugggggaagagaggggaggggagcagcagcagaaacaaaaaggcugccccccccaaucccauuaacgccgaggccggcccaggagcccagggcgggcaggcgggcggggucgccgggggagaaggcggcgggccgagggaaugggcuuacuuuuucuugucguucgcgccgccggcgcccuccauggugaaucgguccccgcgaugucuucacggcgggcggcccccaggcucgcuccggccuaagcgcuggcucccuccacacgcggagaagagaaggaaaggcaaguccagaggugggggugcgaggcgggaaaccccucgugagacuagagagaagcgggcggcaaucgccgggguccgggcccggcuccgagccucuccucagguggcuugucagggcccagcccgacacacuggccgaagcgacgaagagggugauccuccuguccccucagacgaggcagcacugugcacugaggagcugaggcagcgucagggggcgggcaagggcggaggcgcgcucgggcgcgcggggaggggagagggggcgggagcgcgcccgcucgccugcccaggccggcgcgcgcucccgcaagcccgccucaccugagguggaggcggguuccucgagauccaauggcgagcgacgcaggcggcaaguccccaccccagcccacgccgcucucagccaaucaggaggcggucagcugaggcacagcugggacgggcugcgacgcucacgugcucgucuguguuuagcggcggaggaaagagaaaggagaugggggugcggcucagcccgagucuggggacucugcgccuucuccgaaggaaggcggugcccggcuuugggaggcgcugcugagaagggauuucgguugccuggucccaaacaugcaucauauuuuccuacucuuggugcaguaauguaaugcuccugcucucuuucuccucggccucagugcugggcacgauugccgcccaacucugcugggcucucuguucaaaaaagcagacuucgccucguggcagcaagcccuuccuuuggucucguugcucagauguguuacaacggggucuuuccuuaccagauuaccuaaccaugggucaaugucacccaccgcacucuuugccacggagcacaggggaacucaccuugucuacuaaguuuuucuguggcggaguuuacuuacugaauaaaugcaauuaaaaauaaaaaugaacuccuguugcuguaaacuucaagggaaauaaaguugcagggaaaucuuaaaaucugaaacuauguuaagcauuugcaaauagguauaaaugacuuuaauaagcauauaaaccaauuucagggaaagaguagaaaaaauggccuuuggcaacuuugcaagcuacuaaacaaaacauaaucacuuuugucuuuggaggcauaaacuucaagccugucagucuucuaaaagaaaaauauguuuugagcccaacaaaguagcauugcacauauaucuccacuuggcgcuaaauuauuuuacuucucaccuuugccuuaugaguuucuuguuaaaaccuagcuuuggguuguaaauauaaauaucuguaguggcuuucaauuguauuagcauguaaaaacaauggucuauauagaagcaucaaacucugacaagacaacaaccaauguauacagcaccucuuuuuaacuggucaguagaccuacaaagauacgauuaaacauugaccuuagcggacagggugguuccagcuacucagaggugugaggcuggagaagccuggguguuccagccuagggaacguagcgagacuccgucucuuuagaaaauuuuugaucuucacgcuacuuuuguuuuuucagaucuacaacacuaaaugauauguauuaugucuugaaaagaaccaugggaaaugccugaagagaagaaagaacuaaaaauaauuacucauaauuucuuuuuuaauuguggaaagaauacuguaaauuaaaaacuuuuuaguuuaacauucucaagauacuguguuaagaacacuggcuccagaaucaagcgugagcuuguacacaggcuuugaaucuuacuggcaagucguuuaaucucuccauaacucaguuuacuuauuuauaaaauggauauaaaagugucuauaccacaguauuauggaugguuaaaugagauaauaaauguauacuuagaacaauaucuggugcauaguaagcacucaguaaauguuagcucuuaguauuguugguggcguuauuauuauuaucauuauuauuauucugaggcggagucucgcucuggcccacaggcuggagcgcaguggcgcgauuucggcucacugcaacuccgccucccagguacaagugauucuccugccucagccucccaaguagcugggauuacaggcacgcaccaccacacucggauaauuuuucuauuuuuaguagagacgagguuucaccauguuggccaggcugcucucgaacuccugaccucaggugguccgcucgccucggguucccaaagugcugggauuacaggcaugagccacagugccuggccuaucaucauuauuauugcccucaaauuuauuccucuguuaacaguaauuacucgggcuucuccuacaguuuagccauuuuuaacuauccaagaauaccaauuauguuaauauaaauccacauauauucucuauuuucaacuuuggaacugcccaucguguucccacccucauuuaugaggauagcugcagagaucuuccaucauuucccuuuucauuauacuuauagcaauuaucucuggccagugauuauaguauauaauguuugugacaucaaaagacaagcauuuuguaacaguaaaucuaagucauuuaaaauuuuuuuggaucauuucaaaaguuuaaagcagaaugauaauuugaucagcaaaaaaauuuuugaauauucauuaaauaugcccuuaaguuaauuuuccuuuucaaaaauguauaaaauauauguuuauguauauguguauacacaaauauaaauaugaaaauggaaaggaaaguaguauauguguauauauauauaugucuauacaaauauaaauaugaacauggaaagcaguaauauucaaccaacuaauuuucauauaguuacaaaggcaccaaauaguauccccuaauucaaacaauccuauuaaauaacagacaccaaaaaggaaaauuucauauaggauaaaauuuuaaaucccucucucuacaaccacuuaacaaaugcauuuagguuauuacuauguaaguauaucuuaacaaacagucauuuaaucacuuucuaacuuugcagaacuuucugaguagacuacaagauuacuugcaaaugaccccauugacccuuagcccguauuuauuaggaaauugggcagugaaucaggagguuaaguaaaacuugaaauuuugauuacuacuaaauaauacagagcauugagccuuuugaaggugaaaugcaucagaugcacacaauuuauaggguaucaaacuauacaagaagaccuaguauucaguaagugauuccuggccuauuacuacccuuaguuguuucuuuuucuuuaagcuauucauaacgagaacaauggcagcaaaaggguauuguuuggaaggaaagugcguacaagauaagaggcauuaaaaaucuuuguuuuuuccuuucaagaaucaagacacaaaguaucugugauuccaacauuuugggaggcugaggcaggaggaucacuugaggccaagaguuugagaccagccugggcaacaaagugaaacucccaucucuacaaaaaauuuuaaaaauuagcugggcuuggugguuagugccuguagucguagcuacucugaaggcuaaagcgggaggaucacuuucucccaggaguucgaggcugcagagauguacgauugugccacugcacuccagccuugacagagcaagacccuauaucuuaaaaaaaaacacaaaaaacaaacaacaacaaaacccacacacacagacacacaaaauaaaauguauauuuaucugaguuuagggggaauauaaacagacugaaaauuugauauuagcacuuuucaauuaugauaaauauuuuuaagaugaauuuacaaaggaacaccaaggggcuuucaguuuccuguucaacauguaaagagcuuggaaguugucacucccauccucacaacaagaaaaaaaaaagcuaagcaaacugaaaucaguaacucuucuuagauccaccagagaauugaggucacaggaaaaaccacugcccuaaaaacuagagagacagacagauagauacagagaaucacagcuuuucagagaaucacaguuuaccaggagcagagcccaggcacagaagccagaagcugaagcuaguuucacagcuggagccaacaucaguaggaacacuaaacuguaauuggggaauugcuggaggcucagugcagacuagcuugagaguuaaaaaacuccaaggaggcucagucugagaggggccucaauacuuaccucaguuuuaccucugugaauccugucagauucucacuguaaagaucugagaaaaaucugcuuugcuuuugccagggagaagggguaaguaaccaucgugaaauacucucagggcucucuguucuucuuaacaagaccuggccucaagggaaacucucuaucagagccuaaccagaugaaucuaccaaaggcuaaccaaucuggaggaagggaaauuaccaacucuggucagcucuagccuuccacaggggagaagggaaauacucaacucaagcucacuaaaagacuugagcccuaaucauaggacugcagaaaguccuccucucccccucaccuuaucaccacaucagaagagcuccuguguaauaacggggcauuacagcuaaaagaacucaaaccucagacccuauuuuaagagucucuggggacagccaaagacaacauaggaagcaaaaacaaggacacaguaggaaauuuuagccucugacaccacgaacaguaacaaagccuaccucuuugccagauaaacaugaaaccucacacuuaaaggcgcaucuaccuaaguucuuuuuaacugauacagcaugucuggcuuucaacaaugacaacaaugauagaaaaauuacaaaauaugcuaaaagacagaaaacacagucugaagagacaaaccaaacaucagaaucagacucacauauggcagagauuuuugaauuugagaccaaaaauuuuaaauaaauaugauuaauaugccaaggauucuaaggaaacaguggacaacaugcaagaacacauggguaauguacgcagagauauggaagcucuaagaaagaauagaaaggaaaugcuagaaauaaaaaacaauagaacaaaugaaaaaaugccuuuaaugggcucaucaauagacuggauacagccaaggcaagaauaaguaagcuugaagauacgucaguacaaacuucuaaaacugaaaugcaaagcaaaaaaaaaaaaaaaaugaaaaauauggaacagaauacccacguacugugggugugagacaauuacaaaaguuauaaccuaacuguaaugaaaguaccaaaagagaagagagagguaaggaaagaagaaauaguuaaguaaugaccgagaaucuuccaaaauuaaugacaaauaccaaaccacugauccaggcaucucagagagcacugacaggauaaacacaaaaaaaucuacaccuggacuggccagggauggugacucgugccuguaaucccagcucuuuucaaggccaaaauggaaggaucacucaagcccaggaguuagagaguuagagaccaggcugggcaacacagggauacucugucucuauaaaaaauaaaaaauuagccugaguggguggcaugugccuguagucccaguuacuuggguggcugaggugggaggauugcuugagcccaggaguucaaggcugcaguaagcuaugauggcaccacugugcuccagccugggcagcagagugggacccugucauuugugugugugagugugacagucucacucugucgcccgggcuggagugcaguggcacaauuucagcccacugcaaccucugccucccaguuucaagggauucuucugccucagccucccgaguagcugggauuacaggcgccugccaccaugcccagccaauuuuuguauuuuuaguagagacggguuucaccauguucgccaggcuggucucgaacuccugaccucaggugauccgcccgccuuggaaucccaaagugcuggcauuacaggcgugagccaccgcgccuggccuaacccugucucuuaaagaaacaaauaaacaaaaucuucaaaaucuacaccuaggcauaguauuuucaaaacuguggaaaaucaaagacacagagaaaaucuugaaagaaggggcaagggaguaugggagugggagaaaacaccuuacuuauagagguggaacaauaagaguuacaucaaacuucuuuucaaaaaccaugcaagcaagaaaagugugagaugaaauacuuaaaguguuaaaagaaaaaacucacccaucuaaaauucuguacucagugaaauuaaccuucaaaaauguuggaguaaaaauuaaaggaguaaauuguccuuucuucaaaagaaagucugacuuucucagacguauaaaauggaggaaauuuguugccaguugaacugccuugcaagaaauguuaaaaagaaguuccucagaaagaagaaaaauaauauagaucagaaaauugaauccacauaaaggaagaacguuauaaaaggaauaaagguaaaauaaaguauuuucuuuuucuuaauugaucuaacacauaauaguuuguucagaaaaagaauaguaaaaauguauucuggauuauuuuauggaaaagggaaaugaaugacagcaauguuaaaagggaugggauggaggaauuaagaauacuguuauaagauacuuguacuaccagugaagcaguauaauauuauu

SEQ ID NO: 17066 - RNA, 5632 nt, Homo sapiens
aauaauugaaagcuuauguguuuacacagaucuucagauugauaugagaccaagcucucauggcuugacaacugaaggagacccagguuucuuuuuuuuaacuugaauuggcuacaauacauauuuuauuuccaauaaccuauuuugguuaugacaaaagauuuacacauguauauagagauaaaauaucuuuaauugcgguaucuuuaaaaaugagcuuuaugggcuggaaauuacuuucauuuugauguaaagagcccaggaaaauaagcauaauuacuaaugccuuccuaacuuacccuugauucuugaauucuaguuuaaagaaugcuugcuuuuuaaaugccauugagcaaacucugugggugcuuaaguauucacguuuucauuuugaacacguuuucauuucaucuuuugaacaacuauagaguaauuuucauugcacauuuuucuuauucccuuuaugaaaguaaaugucaaagccucgacuucggguuguauaauuuuuuuuaugugguauuuuuuaugccugacuuauuuauuuuaaugugcuguauauugcaggucugaauuuuucuuuuuaugaugaauucgggcugcguccuuuaaguuacaaggaacaaagucacauugacauuaucuuaaaugcuggaggcuuauuuuaauacuugaucagaggcacaacuucuuggagagcuggaaaaaaaauguagugaacaccagcagcuuagacggcugggcugaguccuugcuuuugaaguggaugucuauugcccuguaguuacaaugugcauccucuuauucaugugcucuccagcuucccugcccacuuuccccuuugcuacuucucuuguucucuauagucccugaaagaggaucagauugauucuauuaguuauaauccaaaauagagcucccugauagggugcagauuauucuggcuacuggccuccuuuuuuuuuuuuuuuuuuuuuuuugagauggaguuucguucuuucacccagucuggagugaagagccgcaaucuuggaucacugcaaccuccaccccccagguucaagugauucuccugccucagccucccaaguagcugggacuacagguaugugccaccacgcccggcuaauuuuuuuuuuuguauuuuuaauagagacgggguuucaccauguuggccaggcuggucccaaacucuugaccucaggaucuacuccucuuggccuccccaagugcuaggauuacaggugugagccaccacacccagccccgccucccucccccacuuuuuuugagacagagucuugcucuguggcccaggcuggagugcaguggugccaucucggcucacugcaaccuccaccuccugugcucaagcaauucuccugccucaaccuccugaauagcuaggauuacagaugcgcaccaccacaccuggcuaauuuuuguauuuuuaguagagaugggguuucaccauguuagccaggcuggucuugaacuccugaccucaagugauccgccugccuuggccucccaaagugcugggauuacaggugugagccaccacacccggccuggccucccuuauguccaacugaaaggaugaugccccuuaacuaggacauagaucccugauacaaucaauuguggacaguauagaagggucguauaccucaggacagggcaaauuauggggaaggacccaacucugucagcuuucugcagaagggguugugaguagggcaagccuguaacauuucauggauuugucauucuauucauggauuugauggaaaugauaaugauggcaaacacagucguaaauauuuuaacuucauaauguaaacaaguaauggcaaaaauguucacuuggcuggacaugguggcuaaugccuguaaucccagcacuuugggagucugaggcagguggaucaccugagguccggaguucaagaccagccuggccaacauggugaaacccuaucuguacuaaaaacacaaaaauuagccgugugugauggcacgugcauguagucccagcuacuugggaggcugaagugggagaaucacuugaaccaggagguggaggcugcagugagccaagauugcaccacugcacuccagccugggggacagagugagacuuuaucucaaaaaaaaaaagagaaaagaaaaaaaaaaguucaguugaugcagcauugcacaguggaagaguaucagacagcguggauuugcucugagauuacaaucugcauaugagacguaauaaaaucuaccuguaaguuagggauggauauaucccauuuuauccucuuccauccuuugagauauugucaucauauuuuacugcuaugauauaaaccccaucauacaguuauauucuuacuuuaaauaaaggaaaaaauaggagaaaaagcuguuacauuuacccacaugggaaccuuauccacugcucuucauuccuucaugcaaaucuaugcuuucaccugggacaauuuucccucagccuggagacauucuuuuaauuuauugaagcuuaguucuguuggagaucaauucuaucagauuuuguuuuucugagucuuuauuuaaccauuuuugaaggauauuuuuccuggauuugaauucuagguagacaccucuuuucuuucaucacguuaaggauuguugcaugucuucagccuucauuguuucugaugagaaguuuucauucuuacccauuuuuugguauauaacacgcccuuuuucucuggccacuuuuaaguuuuuuuuuuuuuuuuuuuuuacuuuauuuucagccauuugcaugaugugccuagugcaguuaauuuuuccaguauauuguauauguuuuucuguacuggucucacuugcuucucuuucuaggacuccaauuacaugucuguuaacugcuuaauacugucccaaauguuauuguggcuuccucccacacccccaguaauuuuucucuccgugcuucagauugaaugauuugacuugucuucaaguucaugaauuauuucuucuuuuguauucaaucugcuguuaaucccauucaauaacuuuaauuuuagauguaguauuuuucaguucuaacauuucuccuugguucuucuucaugguuuucauaucugcacugaaaugucccauuucuucaccaauuauaacauuuuuugcuguagguuuauacuauuuuauagauacuauaaauuuauacuguaggugcuauaaguuuagcaaauuuagcuaccuugaaguguuugcuaguuucaacauugggggcaucaguaugucuguuucccccaaagaguauaucuguuuuuauugaccgauuuauuuuuuuauugacugugguuuacauuuucauguuucuuucccugucuacuaauauuuuauuguaugauaauacauguuagggacucugaauucuaucaccuuccucuaaagaguguugaguuuuguucuauaaggcaguuaaguuaugacagagcaucuuauacuuaaaggggcuugauuguaggcuuugucaggguggaucuauucagcuugauccuuaguuuuagggcaaaucccuuaguccuggaaguggucccuaaaucuaaggugugggcuuuuugaaguuuaauggaaaccgugaaguguuugccacaucacucuauucuugcaagacuugaacuuugaacucaggagaccuuuggguggucagcugcugaaauacccacucgggacuuucagauuucuagcucuuugcccuagaaucauggggguuuuugccuugcuugcagccaaagaucugaggggauuuuauacacagauuuuggaguuucuaugauugcuccuuuuagggauuucccaucuugacuucuaaccacucugacagcccaaacuccauucucugacuccucagauagguaagacuaugacauucugccugaguccuaccugcccagugccauggacaggggagugcacucagguaaaguuguauaaacaugcauaucuccuuuacagcauugaaucccuuacaguugcuaucacggaaaguaaucauuaggugacaucccccuauuuacccugaaguuacugaaccaucuucccuggauuugugcagggugucuccuaauuuacgaagauuccaauuagauugggaguaugacuuaacucauuuaagucacccaaaugcuauuugaucauaauuuagugucuuguuaaccuaauggcuugaaauaaauugacgcacuucugaaaauaggguaaaaaucccugauuuuucaaggaggcuaaucuuccguaaaugcuaagcacuauagaaucaauuauguuauuaauuugcucuugguugcaagcuacaaagcuugaucaggcuaauuacagauuaugcucugaggaaaauauuuuuauaugcacuauuuuuuucuugcaggcacuuuaauaugagguuuuaaaaaaccuuacuuaagacaaauaaaaaagaaaaccuucauguaauuacuuuaccugcaggcuaauuuuuaaauacuucaacaccguaacaauuaaaugggcuauguuagcuucaguugacaacauuuauuuauuuauuuauuugcaaugagaccucauaauauccaccaggcuggucucgaacuccugggcucaagagauccucuugucuuagccucccaaauagcugggccuacaggugccagccauucugccuagcuaguugaucacuuuuagggaaggcaacacccacaagauuuguuggaccugaacuucuuauggugugucugauuuuaaaugaaaugaauuuugcuaaagucucacaaaugguuaacucuucugccuuuauuacauguuuuaaauaguugauuuaucucuuaguuucuugcagcauaauugguauauugcuucucuugcuaacaugucauuuuacuguaggugguuaacugaauguauucucucuguaaauuucaacaaguugcucauaaaauuuucccagcagaaacuuuuuguuucguauuuaaaaacugaauacacuguccuuuauuuagagaguguauguuuggaaaaucauccuguuuauuuguaaauaaagaugaaccagccagucacaagauauaguuugucuuguuaccacuuaaaaaaaucccuuauauuuacaaauauaauucauucacaaaacuacccuugauagaauuaggacuaaauugcuuuauaauguuucuggaucuccauaauugagacugaauuuccucagaaaagaaaaugaagaauauagagugacuccucaggguugucaagucagaaucaccuuguucuuugguggauuuaaauauguuuucugauauaaaguuuuaacaaaaugaggagacuaucucuagcaauuuguacaggcuagaugacuacaggaaaugaaaccaggcagguguagccuacuaggaaggccucguuuggccugaaacuuguggugccaagaggagauaaguccuggccuggucaauagcuccauccauuuaguuuuuaauuuuuacuuuuuuuguucuguaucugagaguuuauuuauaucugucuagauacguuuuauauuuucuuguucuuugauuagcuuuucaguuucauauuuuauuucuucaaauauuucaagcauaauuaauuu

SEQ ID NO: 17067 - RNA, 1100 nt, Homo sapiens
ugaaguaauuugaauuucugauccuuuuuuucagccuguacuugccucucuuccuaucacugcagaauccaaaauaaauucgaagcucucccucuucugcuguggacuaggaagagucagagaauguuagaaagauuuuugccaaccugcuguggacuaggaagagucagagaauguuagaaagauuuuugccaaccugcugugggagguacagaauuucuaaauagcaggggcuuggaguggcauucuaggcgcuauuaggggauuuaucuagaggcaaugucuauguagcaagcauacuuaguuuguaauguuuauauuuaggauaaugagaguguuggcucuaaacccccagacuucccuucagugcuaccacuguaagcuaugaauaaucuuuuauauacagaauuggauaucucuccccaacccuuuccugcuauuaauuuguguuuuuuuuuaagugugaguccauuucucuugauacacucaaugugccuguaaggaagagggccagccauaucccagcuuggaauacgaccaaagcagccaggacaacuguguuauuaauacuuuuucucuuuggcuuccauaaggauuuaaaaacaaaaacagaaaagugugccuuuucuugucucuccuacuugaccuucaaguuaauaaaaugagugacagagagauuacaacugugaagaaguaaggaugcccuuucagccaagggugcuugucauacuuucaucucugugcucuuggaaaauaguaagaucucaauaaacauucucucuuagcacuuuugacaagcaauucaccucucuggacugaagcucuaacauugcaugaucuaugauuuuaggacccagauaauaauauugccaaccccaguuuccaugggucccuugcucuuucaucaccaguaaacggcaccaucuucaacaucuucguuuuaagguaccugcucuccgacuccugucccacccuccuggcgggagcuucuaguguuaucaccccacagaccucuaauccauggccuaccacauuuucauugucuaugauccccuuucucucuuuuccuuuuuuacuaguuuagauuucacauuauauca

SEQ ID NO: 17068 - RNA, 172025 nt, Homo sapiens
cgggcgcugcuggccagaagguucgguugcgcgugugccauggacucagccgcccggugauauugacaauaggagagagaaaggggcauugacugggacccaccgcggguagcgaaagguggcucuggcagcggcggcuccagcuccugcggcuccuccuccuuauucuguccccuucucuugcugccgcugcagauccagucuuccucccucccuucccccccuccccacgucgucgccgccgccgccggguccggggcaacgagcugaggcgccgcccgccaggaaugugagcgaggagccaccggcggagccgcaacggggucggugccgauuugaugggacgggcccgcgggggaggaucgugaggccgccgccgccaccggaacgcugagguucggguccggccgugaggccuagaggcuccgccgccgcggaaccggagggaccccguaccggacagccgucgccccaggcuccccgcagcugcccggaccucccccugcacgucccggucccgccgcccgcccccgcugcggccaccucgcccgucucccgccccuccaagccacagaucaucuuuggauucuuccccagaagcuucaagguaacuuagucccuccagcaccgcggcucgcccgcuucccuucuuccucccgguccuccuggggaaccuauggggcaccggccuugggaaggccuggccgggcaggcgaggggugcggugggguggggugcgggagcgggagcgcccgucccacuugucugauuuaccuacaaaugcuucugaugauaccucucauucacucugcccccuccccccuuuuucuccaccuucugggauuggaggcguuuucuugccccccuuuauccacuggcgggggcggggaauaaagagggguuuggugugaggaggauucucuagcagcuuaucgucuccagggcuugggguguggguuaggagcaaagggaguauguaagcauccccacagacaaaccccuucccugucuuucccuacuuccccuuacccccuuuggauuauccugagccauggaaaugccccaugccugcugauuagaggaugauaaagcuucgggagcccuggcccagggcgaaaccuguuucccugggcuuugcacggacccgcuguuaccuuacguucaguuuugcagugcuucaggguugcgauccuugacguuuauucugggccucgggcauaagggguaaaugauuuuuuuaaaagcuaccuauauaucgucuguagagaugagagauaaggaauaaagaagagacgaaaagagugauggaggaagaggauuuacugaaauguuguaguguuagaguuagagugaagucuaaauaauucacauacccgaauggaaaaucggccccuaaauuuacaacguacaaauaagauguggagcuuuuggcugaugcagucauuuugauauuuuaaagugaucuuaacaucuauagucauucauaguuugugauucuauuuugaauccaucacauuauauuaaggcuaaauuagguagauuuuuaaaaacuuuuuuuuuuuuaaagaaaaccaaagaagacuuccaaauuccaaacgucaacaucauaugugugcauguguuuuaaaauguuuuuguuauuuuuacauugucaaaauccacguaauccagguaacuuuuuauucucacguguucaggaagaaauucccuuacuguuuuauuuagaaguuaaaaaccacuugucuugucuauuggaaugacaggugaguaauugcauuucagcauuucccccauaugcauucuuucuauccgagucugccauuagucuugcaugaagccucagugccauggaaaugauggcaucuguuuaauuuggugaaugaaauuaagcuuaacgcuuguuacuuucaggaaauagccuucauuuuaauaacucgagaggguuaaacaauucaaaagugcuauucaguuccguaaguuugauggaaugaaaauugguauuugaugaugaacuucaaggucuaaaccucaagggaacucaacuugguuguuucaguaggcugugaauuuauguuuucaguucaacuuuggugcuugauuuucucauaguuuuuauuaagcguuaauaacguaagguggcuucauucaaaaagaagacuuauuugaaauauuuuaauuaugccuuuuauguguuuuguuuaaaguaaucuagccuguccucauuugcagugugguauaguuuaucauagcuaacauagcacaucccauuaaaaguuaugccuagauaguuucaguaguaguaaauuucaccuugcugugauacauugguauagauucuugaaguacacuaaggguuuuucaacuccagaacccauucauaauauuaaguaucuugggaaaauguaucaauggaaguuuuccaguuacagaauagcuccaaaaauuacuugaagaugugaagagcuuugcaguuagaaaaugggcaggcagcauagauuucuuuaagccuagaugaguaucuuuaaugcuuauaauggaguggcacaauacauuagaguucucauauuguuuccgugauacuuaaauuauuuucacuaaauuuucauguuuuccuguuaacauaugacuuuucuuuucuuuguuuguuucuuuuuuuuuuuuuugagaaggaguuuuccucuugcugcccaggcuggagugcaauggcaugaucuuggcucaccacaacuccgccucccggguucaagugauucuccugccucagccucccgaguagcugggauuacaggcaugcgccaccaugccuggcuaauuuuuguauuuuuuuuuuuuuauuagagaugggguuucuccauguuggucaggcuggucucgaacucccaaccugaaguuaucugcccgccuugggauuacgggugugugccacugugccuggcuuuuuuuuuuuuuuuuuuugagauggacucuugcucuguugcccaggcuggagugcaguggugccaucuuggcucaccgcaaccuccgccucccagguucaagcgguucucccuucucagccucuugaguagcugagauuacaggugcaugccacugcgccuggcuaauuuuuguauuuuuaguagacacaggguuucaccauguuggccaggcuagucucgaacuccugaccucaagugauccacccaccucggccucccaaagugcugggauuacaggugugagccaccgggcccagcccuuuuuuuuuuuuuuuuuaaaggacggaaucucacucugucacucaggcuggauggagugcaauggcgggauccuggcccacugcaaccuccaccucccagguucaagcgauucuuucaccucagccucccggguagcugagauuacaagcaccugccaucaugcccggcuaauuuuuguaauuuuguagagacugaauuucaccauguuguccagguuggucuugaacuccugaccucaagugauccacccaucucagccucccaaagugcugggauuacaggcgugagccauugcaccuggccaagauaagacuuuucuuaacugauuuuauuuucuuuagcacauauucccauuuucaugaauauuguauaugggaauuuuagaauuuguauaacucacauguaugcuuccaccuugggaauguauggguuuaugauacuucuuucucuucaguagggauauguccucagcaccaacuacuccuccaucaguggauaaaguagacggauuuucucggaaguccgucagaaaagccagacagaagaggucgcaaaguuccucacaguuuaggucucaaggcaagccuauugaguuaacaccucugccgcugcuaaaagguaaggcucaugaccaggugaugcauucuuuuucaauugaucuuucuacaucuauauauaauuuccuuuuuguagaguuuuauauguguugcaaauugaagggaugggauacuucacauacauugaaguuacuaaugugugaccaaauauacccacucuccuuuuuaaaggcucaauuuagucugucuuugggcaaguuaaaagaaacauuaucaggagaauaucucacauugaugaguagguaaacuaaguacuagagaaacuuuaagaugucuggguuuguguuuuucauuuuuucuucuguugacguuuagggauacauuauauacaaugacaacuacagauuauggucuuaggaaguagacccuaguagaggagaugguaccauucauuaauuuacauauagaaaaugguauuuggaagaauucguuuuuaaaaaucaagaaaaaaaugguccauuuauaguuguuuacaugcacucuuguuuucacauaguacaaguagaaaagauauaccuuucuauguacaaguaugaugaucauacuuguuuaguaugaucuuuucuuugaaauuuguuaauuuuuuaauuuuaauuuuuaucuuuugagauagagucucccucuguugcucaggcugguucacagcaaccuccaccuccuggguucaagugauuuuccugccucagcuucccgaguagcugggagcacaggugcccgccaccaugcccagcuaauuuuuguauuuuuaauagagacaggguuucaccauguuggucaggcuggucuugaacuccugaccccaagugaucugcccaccuugaccucccaaagugcugggauuacaggugugagccaccgugccuggccugaaauuuguuaaaaacaaguuuuuugguuuuuuaaauuuucuuuugagacaaucucaugcugucacucuggcuagaguucaguggggacagagugaaagugcagguugaggccgggcgugguggcucacgccuguaaucccagcacuuugggagcccgaggcaggcagaucacgaggucaggaguuugagaccagccuggccaacauggugaaacccugucucuucuaaaaauacaaaaauuaggcgcggugguggcaccuguaaucccagcuacucgggaagccgaggcaggagaauugcuugaaccgggaggcagagguugaagugagcccagaucgugccauugcauucuagccugggugacagagcaagacucugucucgggggaaaaaaaaaaaagaaagugcagguuggggcucacuguggccucuauuuccuaggcucaagugauccucccuuucccgaguagccgggaucaacuucccgaguagcugggacuacagaagcaugccaucacgcccagcuaauuuuuccauuuuuuuguagagauggaguuuugccauguugcacaggcuggucucgaauugccaugguguucccaugccaggauuuaggcgugagccaccaugcccggcccaacacguuuuuaauaugaagaauuuuuucuaaauuaggcauuucaacuuuuguuuggguaugugguuacuuuuugucccuuuuaauuuucaucauguuugcuucauguuuaugaacagguguuguuugaaaaauaucagaacauagcuuuuauaguguggaaacuaucagaauuuaccuuugagguggauguuuaugugcugaauacugaagaaugggagaaaggggauaugaacaacacaaugagcuuuaguguggcuuggaggaaaccaggcaaccugguuugcuaguucauuauugcagacuuauuucuguaacaguuugugaaaucagaagguauuauaagaaaaacuggaauguaaccggaaaagauccucaaaauuuagcuuaggauauuucaagcuucuauuuuuuccauaugaauacuuuuuuuaaaaaagagagagagauucauaaauaagauuccaauguuuauacaaaauuuuuggaaacugaauacugauuacuguaaagaugauauaucuaccagucaguaaagaugagcuccugugagcuuugggggagaaaauuuugacuagagauuuugcugguaaaaaugaaaauagucauuaugaggcuuuggaaagaaaauguaggaaacacuguagauugaacuaugcuugaaauacaaaguugggagacacugguuuuuaguaaucuauuuaaucugaaguagauauguaauggguguuaacuucuguaucuguaaaggacuucauucugaggaagccaguuaaauuuuuuuuuuuagaauuagaaggaauuuaaaaacuuacacuaauuucuuggaucuuaugguaaacaauuaaauuaggacuucacugaccacucauagucaggguauugguuuuguggguagugaaagaagcaugcaugagaagaauuuggacacaugcuuuaauguauuuuuucuuuaaugcuuucaugucuuuuuucucauuuuaaaaaauuaugguaaaauauacauaacaugaaauuuaccaucuuaaccauguuuaaaugugcauuaagugccuugacauugucaugcaacugucccuaccauccaucuccagaaccuuuucaucuuccccaacugaagcucuguaccuguuaaacacugacucccuguuucccccaccagcccuuggcaaccgccauucuguuuuuuguuucuaugaauuugacuacucuagguaccuccuauaagugaugccaugcaauauuugucuuuuugugacuggcuuauuucacuuagucaagugucuucaguguucaucucuguuguagcaggugucagaauuucauucuuuuuuaaggcugaauaauuucaguguauauacauaccauauacuuuuuaauccauuaauucauugguggacacuuggguugcuuccaccuucaggcuauugugaauaaugcugcugugaccaugauguacagauaccuguuuaaguucuggcuuucauuucuuuuggguauguacccagacguguaauugcuggaucauauguugaauuuuucaggaauugccauacauauugccacagcaacuggaccauuuuucauucccauuagcaaugcaugaggguuccaguuuucuauauccucaccaucacucauuuucugcuuuuuaauuuuuugauaguagucauuauaauagguaugaagugguauuucagugugauuuuuauuugcauugcccuaaugauuagugauguugagcaucuuuuccugugcuuuuuggccauuucuguauccuuuuucucacuuuuaaaagugaagucugcuaguguugccaguuuuccaagaacucugcuuuccaagaaugugauuuuuugaacuuguauauuuugccaguaugagagaauuggagaguaacaggacuauauacucacaaaccuaauuccagagugacuaacagugauuguuauguaguaagcacauucuggguaaauacucuggaaaguauucuauaaauuagaaauccaucucugucuguagaauaacauaaggaaguauaaucagaaauagacuucaguaauguguauuugcucuugauuuucuaggaaguaauuuauggaauauaaagaaaauguaggaggaauuucuuuucuaggauuuuauuuuuuuuggccauugccuuaagagaaaccaggauaaacacuauaugcaugcuaaggguaguuauugauuuaauuuucuauaguauugcuuugacuaaauuggguuaauuuuauuuggaguacaauauaaaauaugguugaauuuugugaguuguuuuaaauaaugaagucaaagagguguccuuaaggucuuuaauuucaggggaguuugaauacgauaauuauacaaacagugauuauguaacucaucuuuuaauaugucauuuuugaaugcucagauaugcauuaauaaccacucguuuugugcaugcauuaucagaauguuuauuauaugcaucauaaucuuugauuuauaaauaauacugcauuaauucuuagcguuuuaaagucuguucacuugcaaaacugcaacauaaugugaagggaaaguuuuuguuuugcccuauuucuuuuuuuuuugagauggaguuuugcucuuguugcccaggcuggaguacaguggugcgaucucagcucacugcaaccucugccucuugguucaagugauucucuugccucaggcuccugaguagcugggauugcaggugcccaccaccacaccaagcuaauuuuuuuguauuuuuaguagagacguguugagaccagccaggcuggucucaaacuccugaccucaggugauccaccugccuuggccucccaaagugcugggauuacaggcgucagucacugcgcccagccuauuuugcccuaugucuaauaggugggguuuugaaaucuguaucacugauguuauuuccuguagaaagcaacaccaccuguaauucuguauaaaucuaccugguuuuuccguaucuguguguuaggaaauuauaggaugaacuuugcaaagauagacauuuacauuuucuccaucuuuauaugcuuuugugaaaguguucuuggagagccuuaacauuuuugaggcuggguaugguggcucacaccuauaaucccagcacauagggagacagaguugggaggcucgcuuaagcccaagaguuugagaccagccuacgcaacauagugagaccucaucuguacaaauaauuuaaaaaauuagccaggguggugguguacaccuguggucccagcuacuugggaggcugaggcagaaggauugcccgagcccaggaggcugaggcugcagugagcugugauuguuccacuguguccaguguggcugacagagugagaccuuugucucaaaauaaaaacauuuuuuucuuugagucuaaaagauucuuacucauucacugauagggaaaaccuaguagagguuuagugccuuacuuacuugauaagaaaguaaaaucuugggggaggccgacagggggcgggucauuugaggucaagaguuugagaccagccuggccaacaggguaaaaccccaucucugcuaaaaauccaaaaauucguggauguaguggugugcaucuauaaucccagcuacucaggaggcugaggcaggagaaucacuugaccccgggagguggagguugcagugagcucauauugugccacuauaaacucugucuuaaaaaaaaaaagaaagucaagacuuggauacuuuccuuacacuuacacagcaggacaugaagcaagccuugacuguuaucuagguaaguuguugaguaagacagucaaacuaaacaguuaggcaaacacacaaacacacacacaaauuuauguuaauaauaaucagugguaguagcaccuggcugggugauuuauguucucuccucaccccagccuccugugccucauuuccuugcguugacuuuaagcaauucuguaaguuuagauuugggugaacguuuucugaagaauacugccucuuugaagauggaauuauagugaaaguagcauuguuauuucuuuuguuuguuuguuuuucugagacagagucucgcucugucacccaggcuggagugcaguggcgcaaucucggcucacugcaaccucugccucccagguucaagugauucuccugccucagccugcggagaguagcugggauuacaggugucugccaccacauccggcugauuuuuauauuuuuaguagagacgggguuucuccauguuggccaggcuggucucgaacuccugaccacaggugcguccgccugccuaggccucccaaagugcugggauucuuggcaugagccaccgcgcccggccgccauuguuauuucuugucucacaauucauuauacauuuccgaggcauuuugcagauaguuuguacauucacuuuuagauauucuuacaacuaugaugacuagacggaguuuagcucuuguugcccaggcuggaguguaauggugcgaucucggcucaccacagccucugccuuccggguucaagccauuuuccugccucagccucccaaguagcugggauuacaggcaugcgccuccaugcccggcuaauuuuguauuuuuaguagagaugggguuucuccauguuggucaggcuggucaugaacuccugaccucaggugaucugccugccucggcuucccaaagugcugggauuacaggcgugagccaccgugcccggccguuuucgugccuuuuuaaugauugccuuuuucgucuauaucugcuuuguguauaguaaaguaggcacaugcaauauaauaccagauuuuuauaacgagugaaugugcuaaaaccuauuagaauaagaauagucucuuaagaggccagguacaguaaauaacucacaccuuuaaucccagcacuuuggcaggucgaggugggaggauuacuugagcccaggaguucaaggccagccugugcaacauagcaggccugucucuaaaaaaaaauacaauaaaaaauuagcuggguguggugguacacaccuguaguccuagguacuuggaaggcugagggaggauaguucgagcccaggagaucgacgcugcagugagcugugauugugccacugcacuugagccugggcaacagagugaaaugcugucucaaaaaagaauagucuuuuaaggaauaaugucaucuauuuuagugguuacuacacuccaugucgugauacauugucgcauggguuuuguugguccucaagaguccuagcuuaccacuagcuggguugccuuggacaaaugcguuaacugcugaaagcuuugguuuuccuugucuguaaaaugaugaugacguuaauagucaauagaugugacagugccacauucaguaaauacuagcuguuguuauuuaauggggguuucaaaaguuagaauaugaauaauaugaaauuuuuaugacauauuuuacuaguaaaaagguggaaauuggaaauuucucugaaaauuaugaagagcauaauuuugcagccacaaacguuuuucaaccaaaaauuucaaagaagcaguuuuuaaauauggugaauuuaauauaauagcuauucuaaacaucuucaccuggagaguugcaucuacugcauuaguaucuugccauguuauuuaguguaaugcuuuuuauuuuuaauuuauucauuuuuugaauagauaauacagccauaugguucaaauuccaaagguuacaaaaggaaguguagugaaaaaucuuccuuccaucccuucuccuaguuucccuucccagaagcaaccagucauuauacucuuguauaguagguauagagauucuuaaauccuugguuggauuuaaaaugcaaugagcagccuaaaauuaugugaacauuuuguauguguguaucuauuuuaaaaauggggaaucaauagggauuuuucagauucucaaagggauaucugacuuaaaacggguuaagaucuauugaucuaguuuguaccuuugacuaaugauguguguucuucaggcaucuaagauuuguguguguguguguguuuugagauggagguucgcucuuguugcccaggcuggagugcaguggccccaucucggcucagugcaaccucugccucccagguucaagcaauucuccugccucagccucccaaguagcugggauuacaggugugcgccaccacacccaguuaauuuuguauuuuuaauagagaugggguuucaccauguuggucaggcuggucuugaacucuugaccucaagugacccucccacuuuggccucccaaagugcugggauuacaggcaugagccaccgcacccggccguguguguguguguuuaaaaaauaaccauaagcuuuacuuucgaacugaaagaacaucuauauguuaauagauguuaaaguucaguuuuagaaccuuugaaaaagugugguaauaauuuuuuuggggggaagcaauuuuaagaucuugcacaaaagcaagugccaaacuauguuauuuuuuuuuuucuuuuuaauuuuauuauuauuauacuuuaaguuuuaggguacaugugcacaacgugcagguuuguuacauauguauacaucgcaaggacaaaaaaccaaacaccgcauguucucacucauaggugggaauugaacaaugagaacacauggacacuggaaggggaacaucauauaccagggacuguuguggggucggggggaugggggacggauagcauuaggagauauaccuaauguuaaaugacgaguuaaugggugcagcacaccaacauggcacauguauacauauguuauuuuuuucuuucuuucuuuuuuugugaugggaguuucgcucuuguugcccaggcuggagcgcaauggcgcuaucuuggcucucugcaaccuccgccucccgaguucaggaaauucuccuguauuuuuauuuaugaaagauuguacccaguuguaaugaagagauaauuucauucacuuuuaggaaggaauauacauuuuuuaauauauccuaauaguuugcuucuguagcauagguaaaauuauuguacagaguuuuaugugggccaaaagaaauuggccaggcgcgguggcucacaccuguaaucccagcacuuugggaggcugaggcggguggaucacuugaggucaggaauuugauaccagccaggccaacauggugaaaccccaucucuacuaaaaauacaaaaaaauuagucaggcguggugaugcgcaccuguaaucccagcuacuugggagacugaggagaaucacuugaacugggaggcagagguugcaucacugcacuccagccugggugacagagugagagugucucaaaaaaaaaaaaaaaaaaaaaaaaagaaauugagagucaguguaccugauauauucaucacuuaaaaguaggauagaagcuugcauucauauucaucccauuaagaacuaauugcuuaauccuggccagguguugugacuuaugccuguaauccuagcacuuugggaggccaaggcgggcagaucaccugaggucagaaguuugagaccagccuggccaacauugugaaaccucgucucuauuaaaaauacaaaaauuagccaggcaugguggcacgcgccuguagucccagcuacucgggaggcugaggcaggagaaucgcuugaauccgggaggcagagguugcagugagcugagaucacaccauugcacuugagccugggcaacaagagcaaaacuccgucucaaaaaaaaaaaaaaaaaaaaaaacggaaaaauuucuuaacuuaggguucguggauuucugguugggacaguguauaucuggaugggcuucaggguuucuagacccuccuaaaauuauauguaaaguuucuguguaugugcauucuuuuuuggaggagagaauugauugcuuucaucagauucucaaagauucaucccuuccauucacguucucucucuauaguuaagaguuuuuggcuuagacuaaaugggaauuguguuguuacuauuuucugaguaucguguuagcugcucugugugcacauaugcaucuacccuuaccauaaaacacuguaagccauaaacagcauucaucauaaugugcguccguccaggauguaaccuggauauuuauaugcaauauuuauaugcaagacagggcauauaaauauugaagugccaaaugaauguucucauaagaugaagugguccuuuucuaccuagaauuuucuuccccaacuucuuaucauucaaguuuuagcuccagugggaccuccuuggggacuuccuugaugacuuuagaaaacagucuuucggcugggcacaguggcucacgccuguaaucccagcacuuugggaggcugagguugguggaucaugaggucaggagaucgagaccauccuggcuaacacggugaaaacccgugucuacuaaaaauacaagaaaaaaacaacaaaaaaaaacuagccgggcgugguagcaggugccuguagucccagcuacucggaaggcugaggcaggagaauggcgugacccugggagguggugcuugcagugagccaagauugcgccacugcacuccagccugggcgacagagugagacucugucucaaaaaaaaaaaaaaaaagucuuugggcugggugcgguggcucacgccuguaaucccagcacuuugggaggcugaggugggcggaucuaucucaaaaagaaaagaaaaaaaaauagucuuuggcuaggcaagguggcucaugccuguaaucccagcacuuugggaggacgcaggaggaucuccugaggccagguguucaagaucaaccugggcaacauagugagaccccuguuccuacuagaaaauuaaaaaauuagcuggaaaugguagcaugcaccugugucuuggcuacuugggaggccgagacaggaaggaggauugcuugcucuaggugacagcaagacccuugucucuuggaaaaaaaaguguuugaaguuucuauuacucuguuguuucuuauaaucuuuaauuauuuuaucuuuguuuguucacuugucugauauaucuccccucccccauuaaaauaugaucuucuguguagaaaucuuguuuuucuuaucucuagggcuucgaacagugccuuguacguaauuggcauucaauaaauauuucuuaguaaaugaacgaacauuuuuauuucacauuuagguugacuuaguugacuaauaaguaauaaaggcauuuauuuuuccuucauaaauauuuaaacaguuuauuuuuuuuuugcaaaacccaggccaauuuuaguuuaaaaaaauaaaauuuuaaugccaauuuuauuuuaacuuauaauuuacacaaaauauaaacuuguuuaaugaaaacuuuuuauuuuaaaaggaucacauugcugaguguucaauuaaaauccugaguggguuugugcuuugguaauucugcauguuucagguuaaaaacauaagugguauauuauauagagagaauggaguggauuuuauagacgaaaaacuuagagugauuccuuuuacuuugcaaauucaucacuuucauuucacaaaaguuaagacguuaaguccagugaaaucccucuguucugcguauuugaggacugauuauagccuaaucagaucaccagacuuuauauaguuuaagagagaauagcauaucugaauauuauaauggacuuucagagcagaguuuuaugggcaaauguucucugauuuguaaaacuuacauuuuauaauauuggcucauaauaguaauuagauuuuguagugcuugaaaaagaucaguaaaguuucuagauauuucgaauaggcuaaaguaguucuuuuguuugcaagugaugacauccucuuuuaauacuuaaaaaugguuucuaccuuuuguauuugaagguuuuuuuuuugaaaacuuauauggaaucuuauuuuuauguuacaguagaauuaagcauaguuucccucaguaagaauguaggcccuggggucacacauaccugaguuugaauucugaguccaccauuagaagccauuugacuuuuuuuuuuuuuuucuuacauugucgccugggcuggagugcagugacgcgaucucugcucauugcaaccuccaccucccggguucaagcaauucuucugccucagccuccugaguagcugagauuacaggcacccaccaccacgcccagcuaaguuuuuguauuuuuaguauagaugggguuuugccauguuggccaggcuggucuugaacuccugaccgugugauucgcccgccuuggccucucaaagugcugggauuacaggcauugagccaccacaccuggccaggagcugacuucuaagccuugguuuucuucucucuaaaacugggagaguaauagaagccauaucauagagucagauuaaauuccagaaggcagguaaaacauuuagccuagugcuagauacacuguaugaguugaagaauauuaacuacuauaauuauaggaaaaaguacacaauggcaaauguuuacuaacgucuuuuaguugauuuuuguuccuuuaacacguuacauggauucuuugcauuuaaggaagaaaaauauggaguauauacagcugugagaauuauacuuuuaaagcaaaaaggagaaacuaguucuuauggaacaaucucagcauuacuguuuaguuaaugucaguuugagacagauuucuuguuucuggaaucagaauuuaaaguggcuaauguaauuauuuucaagggaaauuccauuuauggagcauuaccagguaaaauuauuauuagauaaacuuucuuuuuuuuugagacggaguuucccucuuguuguccaggcuggagagcaacggcuugaucuugacucacugcaacccccaccuccuggguucaagugauucuccugccucagccucccgaguagcugggauuacaggcaugugccaccacaacugacuaauuuuguauuuuuaguagaaaugggguuucacuguguuggucaggcuggucuugagcugccaaccucaggugauccgcccgccuuggccucccagagugcugggauuacaggcgugagccacugugcccggccuagguaaacuuaauuuggaaguuguuaggcugggcgcaguagcucacaccuguaauccuaccuagcacuuugggaggcugaggugggaggaucgcuugagcccaggaguucaagaccagccugggaagcauggcaaaacucugucucuacaaaaaauagaaaaauuagccagguguggaggcaugcuccugucgucccagcuacucugcaggccaaggugagagaaucaccugauuccgggaggucaaggcugcagcagugagccaagaucaugcugcugcacuccagcuugggugacagagugagacccugucucaaaaagaaaaagagaaagagagaaagauugagagagagagagagaaagagaaagagagacagagagacagaaagagagaaaguuguuucccaggacaggaucuucaaauguuuuuguaauugcuuacuucuaucagagaauauaacuucagcacucuuguauuuguccuguuacacaacauuaaaacauauacaaacauagagauguuuaaaaaggaugauauugaaaaauaagauauagaguucuaauacuuucgugccuccauuucgcuugcccauuccccagcacacacacuggucuggaacacagcuuuguuuugauauuuagauucaaagagagaacuuucucuuuggguuuugagccauguuaguuuugcagcauuuuauuuugaaccagcgaaggacaugaagagggccaggcaugguggcucacuccuguaaucccagcacuuugggaggcugaggcaggcagaucacuugaagucaggaguucgagaccagccuggccaacaugguguaaccccaucucuacuaaaaauacaaaaaaaauuagccagguguggugguaggugccuguaaucucagcuacuugggaggcugaggcaggagaaucucuugaacccaugcggcggagguugcagugagcugagauugcaccacugcacuccauccuggguacagagcaaaacuccaucucaaaaaaaagacaggaagaacugaaugagaaacuucuuucuuaguguaccuucuugaggucuuugcauaggcuuuuaaguuuauugcaccuuaaggaaacaaaaucugaauugaggauuuuaccaguuuaaagaguaucacagauggcucuuuguugauggcucuuaucuuguggucagugggugaguuuuagagggcccuugacccucuugaaauuccagggaguauuuugugucucugugcagacugacacuuuuccggacaaagguagagcuuucaucagauucucaaaggaguuucuccaaaggcuaggaacaguugcuuugggugguuggcauguuuucucacucagaguggagacagaauuugucaucucucucuguagaagggagcucucaugacuagagguuucuucuccuguaugucuuuccugauuuuugauucuuuuugauaccaaauagaauuuuaaaagguauuugaagggagaaguuacuacaugacuguagugugugguuggcuggaaaauuuugaucugcaucauuugaaaaauuaagcugggugaauaggaauaccagugauaaaauugagugugccuguaaagaaacauuuuucuggaauggcuguggaccugggagaauuugggaggagaaagucagguuguuucugcugguaaagaaauagguuagcaaucaguuaagaagagaugucuguugguuuuucggugugccaggcaauguaccacauggcgucucauuuaagcugcacgcccaauaccaagaacaagcgauguuugcuuuuaacugagggcaaaguaacuugcccacucgugcagagagagccaggggugggacccuaggccggucuggcucuaaagcugguaacuuccuuguuguggccguuagucauaaaugugugcaggugagaacagcuaaccgcaaucuuggucauacugugcuggggugauuuacuaagacguuuuugcaaguacucuaaaaauuacgaggagacugaagguggugagaaagcaaagcagagaagagaagaaugaggggagcagccaggccugcagcagcacuguggguggugauggggagagguguggcaggccgugggcucugggcuccucaagaaggcuggccaggccggggagcugggcacaagacgugucccugggccccugugcaacucaugcuguguccuggugaaggcaugucagucaugucagucauggaauaguaaggaacaguucaguaaacugguagcauucuggcugugguguccuugaacacucaucccuccaucuuuggggaacucacuuauuguaggaaagggucuggguucaagucuaggugauaaucuuagcuuuaugaacugaggugaguuauuuaaacgucuuuggaacuucagucucccuuuugguaaaacgagauucaugcugcccaaggugguugugaagaguaagugaggcauuguggguaaacugucugaauagugguuggcugcuuaauaaauaugcguucccucaucucucuguuugccauuuaucuuucuugaagucagcccuguggaccuggaucuuguuucagaauaugcaguguugugagagaagcaaucuggcaaaaguucauccguuauguaggcaccaugaaagacuuuugucucacagugacguuaaauuuuaauuuaauuaauucagggcugcuugugccuggaacacuguucaaaguaaaauguuaaaacauuaaaaagaacauguagcaaauugagacuuggcaccauuucaggaaaaauacugucuucuaauaagggagauacagacuugaauuaaccuuuuacugaagugcccccaggaaacaauaucuggcaauaguagggcauacuccuccaccauaucuuaugaggaaauauagugagaauucagaguagguucaggcuccuaagggcugucuucuacuagcaguguaggaaucacagcuguugugugccuuacacauuauaagcacacaacacuguuuuugauugaaugaguacuuugaaugcaagaauauuuauagcaaaggugaagaguuuuuuugaggguaagaaggcuacuuuugaucuuuaucucaucaaauuaauuuuuuuuuuuuuuuuagcguguaaccuuuguuuuuuuuuuuaauuuauuuauuuuugaucauucuuggguguuucucacagagggggauuuggcagggucacgggacaauaguggagggaaggucagcagauaaacaagugaacaaaggucucugguuuuccuaggcggaggacccugcggccuuccgcaguguuugugucccuggguacuugagauuagggaguggugaugacucuuaacgagcaugcugccuucaagcaucuguuuaacaaagcacaucuugcaccgcccuuaauccauuuaaccuugaguggacacagcacauguuucagagagcacaggguuggggguaaggucacagaucaacaggaucccaaggcagaagaauuuuucuuaguacagaacaaaaugaaaagucucccaugucuaccuccuacuacacaaacacggcaaccauccgauuucucacucuuuuccccaccucucaccacuuucuacuccacaaaaccgccauugucaucauggcccguucucaaugagcugccgggcacaccucccagauggggugguggccgggcagaggggcuccucaccucccaguaggggcggccgggcagaggcgccccccacuucccggaaggggcugcuggccgggcggggggcugacccccccaccucccucccggacggggcggcuggccgggcagaggggcuccuuacuucccaguaggggcggccgggcagaggcgccccucaccucccggacggggcggcuggccgggcagggggcugacccccccaccucccucccggacggggcggcuggccggguagagggcugaccccccgaccucccucccggacggggcggcuggccgggcggggggcugaccccccccaccucccuccuggacggggcggcuggccuggcggugggugacccccaccuccuuccuggacgggguggcugccgggcggugacgcuccucacuucucagacggggcggcuuccgggcggaggggcuccucacuucucagacggggcggccgggcagagacgcuccucuccucccagacggggucgcggccgggcagagacgcuccucuccucccagacggggucgcggacggguagaggcgcuccucacaucccagacggggcggcggggcagaggcgcuccccacaucucagacgaugggcggccgggcagagacgcuccucacuuccuagaugggauggcggccgggaagaggcguuucucacuuccuagaugggauggcggccgggcagagacgcuccucacuuuccagacugggcagccaggcagaggggcuccucacgucccagaugaugggcggccaggcagagacgcuccucacuucccagacgggguggcggccgggcagaggcugcaaucucggcacuuugggaggccaaggcaggcggcugggagguggagguuguagcgagccgagaucacgccacugcacuccagccugggcaacauugagcacugagugaaccagacuccgucugcaaucccggcaccucgggaggccgaggcugguggaucacucgcgguuaggagcuggagaccagcccggccaacacagcgaaaccccgucuccaccaaaaaaauacgaaaaccagucaggcguggcggcgcgugccugcaaucgcaggcacucggcaagcugaggcaggagaaucaggcagggagguugcagugagccgagauggcagcaguacaguccagcuucggcucgguaucagagggagaccguggggagagggggagggggagggggagggggagggcagcguguaaccuuuguaacuucacuucagccucugguugcacaaccucaucaaauuaauuuuucaggaagauagccaugcaucagaaggagugguguuuucccccaguuugugagcaaaaaucaaaaggacuggaaagcagauugaaacaggggacuuuuuaaaguagaagaaaguuucaguauucccuguucugugagguguucuauacauccaucugcacuugucucuccaacuccaccuacaacugauacaacuaacugggcucuuuuuuuugagacugagucuugcucuauucaccagacuggagugcaguggcgugaucucagcucacugcaaccucugccuccuggguucaagcgauucuccugccucagccuccugagugggauuaccggcaugugccaccaugccuggcuaauuuuuguauuuuuaguagagacgggauuucuccauguuggucaggcuggucuugaacuccugaccuuguggucugcccgccuccgccucccaaagugcugggauuacaggcaugagccacugcgcccggccaacuaacugguguuuuuaauaguaacccgucuucuagaaauaaugcucauuucacuuuaagaaaguuuaaagauauuuuaaucaaaaacaguuuagaugaaguucuaaaacuuauguugaauagagcuauauuguauuauauuuagauuuaugucuuaacauuuuaaaaggcaguucaaguaacugggauuuauuuuaacuguacugguuuagugagauguucuagaaaugguauaugcuuuagauacucuugggcuuaggagugguagacuguauucauacucuugaauuauggcaagauuugaauaaaauacauuauaugcauguguuuuucuuuuucuuuuuuuugagacagagucucacucuguugcccaggcuggagugcaguggcgcgaucuuggcucacugcaagcucuaccucccugguucacgccauucuccugucucagccucccaagcagcuggaaccacaggcaccugcuaccaugcccggcuaauuguuuuuuuuuuuuuuuuuuuuuuuuuuuguauuuuuaguagagaugagguuucaccauguuagccaggauggucucaaucugcugaccucgugauccacccgccucggccucccaaagugcugggauuacagaugugagccacugcaccuggccacgcauguguuuuucuaaauguauaugaagcaaacagcuaugaaaggaguccgccuaggaccuggcuaacucagucuccuccaagggccuuaaauucucauuuuuaugauuguuacagugggcuaugcaguucaguccauuuauucauucauucaacacauuucuguugagccauaugauacaccagacacuguucugggaauacagugaugagcauaacaggauuggucucugauauuuggagagauagauauuaaucaccugaacagacaaagauagaauuccaacaauggcaagugcuuuuggagaaauaggguggccauucagggaagguuucucagaggaagcgauuaugcugagagaagaagacagggcaggcagguugauaagguucuucuuggcugggcgcgguggcucacaccuguaaucccagcacuuugggaggccgaggcgggcggaucaugaggucagaagaucgagaccauccuggcuagcacggugaaaccccaucucuacuaaaaaugcaaaaaauuagccgggcgugguggcgggcgccaguagucccagcuacuccagaggcugaggcgggagaauggcgugaacccgggaggcggaguuugcagugagcugagauugcgccacugcacuccagccugcgcgacagagcgagacuccguuucaaaaaauguuguagcuagagaucagagacuggaugggcuauuaagguuuucuggggccaaauccucaagacugaauuaagaguuuguccguaggagcuaggcgugguggcucacaccuguaaucccagcacuuugggaggccgaggcgggcggaucacgaggucaggaguucgagaccagccugaucaacauggugaaaccccaucuuuacuaaaaauacaaaaauuagccggacaugguggcacaugccuguaaucccagcuacucgggaggcugaggcaggagaauugcuugaauccaggaagcggaaguugcaguaagccgagauugcgccgcugcacuccagccucgguaacagagcaacucugucucaaaaaaaaaaaaagagaguuuguccuuaggccaggcacgguggcucaugccugucaucccagcacuuugagaggccgagguggguagaucaccugaggucaggaguucgagaccccccuggccaacacggugaaacccugucuccacuaaaaauacaaaaaaaaaaaaaaaaaauuagcugggcaugguggugugugccuguaaucgcagcuacucggggggagaaucacuugaacccgggaggcagagguugcauugagcagagaucguaccacugcacuccagccugggugacagaacaagacucugucucaagagaaaaaaaaagaguuuguccuugaucccaagaacauuuauacacccucaaauauacaaccacagaauauauaaaucaccucuagauccccuacccagucauaaggaauaauauuuuccccucauguuuacguauuuuuuucuuuuuuuuugagacggagucucgcucuuguugcccagccuggagugcaauggcacgaucuuggcucacugcaaccucugccucccagguucaagcgauucuccugccccacccucccaaguagcugggacuacaggcaugugccaccacgccuggcuaauuuuguauuuuuaguagagacgggguuucuccauguuaggcuggucucgaacucccgaccucagaugaucugccugucuuggccucccaaaguguugggauuacaggcaugagccacugcgcccggccucuuuuauuuuuuuuauuuuuuuauuuuuaauuuuuuuaagugaaagcaaguuuauuaagaaaguaaaggaauaaaagaauggcuacucuguaggcagagcagccugcauauucuuauauuauacuuuuauuuuuccaugugauuauuuauaauaacauuaugauggaagauuacuuugagguagucuuauuguuggaguuggaauuuuaaaaaguucucuugucaugguaacauugugcuuauuguauuuuaugauauugugguuuccaugcaaacaagucacuucauugcuugccuuuuaaaaauauugcuaauuuacuuuuagaccauaaaaaugaaauauacaacaaaaaaacaucaagucucuuaaagaaaaacuguaaauaaaaucugugugggcacuguggcucaccccuguaauuacagugauuugggaggcugagacgggaggaucucuugaggccaggagcuugagaccaaccugggcagcagagugagaucccugucucuacagaagaaaaaaaaaauuagccuggcauggugauguauaccuguagucccagcuacuccagaggcuaaggcaggaggaucccuugaacccaggaguuugaggcugcaguuaaccaugauugcaccacugcacuccagacugggugacagagugagaccaauaaauaaacaaacaaaaaaaucugggccaggaauguuggcuuaugcuuguaaucccagugcuuugggagacugaggcaggaggauugcuuaaggccaggaguucgaggcugcagugagcugugauugcaucgcugcaacacagccugggugacagagugagauccugucucuaaaaaauaaaauuaauaaaauaaaaucuaucuguaggcucagcuauauguucuauggaugccacuguguuauuaaaguacacaaucuuaaguuuuuauguguuuuaauucccuauuuuaugaacuacugcuuggaauaguggggaacauaaugcaauagaauuaauucauuaagagaauaaaaguuuagaagauuagaucuagaauuauugucaguaccaacugaaguucauuaaaugagaaugcaagcaacaguaaaaccgcaguuaggugaagcaauuaacaucggugguguuaugguuacugugaagacuggaaaaauaaauaauugaaaguauuucaaauuugacaaauggaaugaaguuaaaaauugaauccaccuccuugucacuuucuaauuuuaaauuuuccugagcuauuauaauuuaaauuauugagaauuaucugcacugcauuuuguggguggugaaaauugaguggagugagugcuuuucaguaccagugcuugaagcgaaacuggauuugugaugguuuacguaaggaagaaagcaucauccaugauuaugucagacucugaccugacagggucuaacaaaauaaauaaaggacuguggaguuugggguuuuugauagugcuuaaaugaccacucuuguaccuaaauaguuaauaaauuucaaaguguuuuuagucauuucauggcuagucaagacagugugcauuccugugggcccaaaucuauauuuaauaucaaaauauucuuggugaaauuauguuucuucacaguuuuacuuaauggaauauucuuuuucauuuguguguuaauguagggcacuacaccuacauuacuugacuaggaggauauccuauuuuuauuuuuuauuuuuuuuaagcaaggcugguaauaauuauguacugucauaacauaauuucaccaccucagggugucauaguuaacaauugauacucauuugugcccacagaugcaaggauaguugaccaguucucugccucuuaaauaauacauauuuuuugagucauaagacuuggguuucaaguggauccuauaaaguugaucucuuuguaugcuacguuuagggaagugaguguuuguuuuuaaaaaucuauuuaguucauccauagacuaaauuguuuaagcaaaacaauauaucacuauauauuauauauuagguuugcuauugagcucuaaaaagcauucagaaagaauuuuugagugaaguaauauuuggaagcugucaaaguuaguacauuacugaaccgaaggauuagccuagccaaauaugagcugcuuugcucuaugacagaugugaaagcauuguguucaccugucuucccagcugguguguguugagauggggagguuggagauuggggaauuggaugugugugaugaucuugguaucuugccugugaaacaucgggauugguggugguugccaaauguaggaaauacguugaugauacguggacagauaggaaaucgcuauuaaccuaacaccuuucauucagugggagcaucuaaaagucuucuaaacaagauccaaagaaguugcuaggaguuuugugaaaguaucuuugcagcagguggcuuagaauaugaauuucauguuguguuaaacauuuuuucuucaucugugaacuuuuacuuaaagcuauuuuuaugaacugaaauuauggauuuguugcacgcaugcaauuuugauuagcaaugaaaccuauauuuagucuuuauucuuagauuuuuuucuuuuucuuccucaugggaaguugugguuauuacaguguccaaaacacucauuucucauucuuuucucaagauaaugagggucgucauugacaugucuucaguuucuguugagauaagaaaauguauucacccuuguggaauuuuccuuucauaaguaauuuaaauaaaauaaguggcuaugccgggugugguggcucaugccuguaaucccagcacuuuaggaggcggaggugggcggaucacaaggucaggagaucgagaccauccuggcuaacauggugaaagcccaucucuacuaaaaauacaaaaaacuagccaggcgugguggcgggcgcuuauagucccagcuacuugggaggcugaggcaggaggauggcgugaaccuaggaggcagagcuugcagugagccaagauugcaccacugcacuccagccugggcgacagagcaagacucugucucaaaaaaaaaaaaaaaaguaaaauaaaaauaaaagaaaauaagugacuaugacuggguacaguggcucacaccuguaaucccagcacuuugggaggcugaggcagguggaucacaaggucaggaguucgagaccagccuggccaacauggugaaaccccauuucuacuaaaaauacaaaaauuagccaggcaugguggcaggcaccuguaaucccagcuacucgggaggcugaggcaggagaauuguuugaauccgggaggcggagguugcagugagccaagaucacaccagucugggcuacagagugagacucugacucaaaaaaaaaaaaagugucugugaaugauaauguucacaaaaacaacauuauguguauuugaaguagguauauaaugagggaaaccaaggcuccaagaaaucacugacagugcagaauucauuaagugugauuaaauuggaaugucagucagaauuguuuuccaaguuaucuucuugacuugguagaugcugaaguuucuauucuaccucgaguucuuacuuuuuauucuaaauaauuugaauaauucucaaagacucugaagcgaaagcuucaaucagaggaggguauuucaguuguguauacuguuugacuucaacuuuauugaagcuugagauagugucccguauaguuguuuauuuucucccaucuguuaacauuuuugacauuuauuuuuuucuucuuuuuuccccucucuaaguaguuuugcaggugggcuugcuuaggguuguacggagguauggccaggucagaaauacagaagugacaugggaagcuagggagacugaagauaaagacacagagauauugcauguucagcaggguagaguuaugaaaagagggauagguuugggagcuaggcagaaaucuuagaauuuuagugaauuuuccuugugagcugagugacuuuggacagaugaccucacagccucuguuugcuugucuguaaaguggugauaauaucgucuaccuugcaggauucauuuuagaggugauauaugugaaaugccuagaguagcagcuaacacaugauaggcgcuugguaauugacaguugucaugauauuuccaucuuugaggucagggaaauggucaauauuccauguccauuuacgauuguauucuugcugucuaggauagugcccccucucaucuucgcugcuuagaguaccugcugagggaaacccuccuuucaggcaggaaaggaauucuuuguguauuuaaaacagugcugauucuuacuauaguaucgcuucuuacucauuacuuuuucuuuucugguuugcaucuuaaauauucuucuagagagucucucucucucuuuuuuuuuuaaugaagagaguuuuuguguaauguaguauaauaaacauaguuuuaaagguagagauuuaugauuauggcuugcucugguuagcaggaaagguguugcuuuggacagagcauagucugugaaagacccaugaguaucaaagguggccaaaugcuuugaaagacucugggcauaagguuccuuuucugguuuuauuaucaaucuuuucaguugugacugagagcuggcagugucuggcauguaggagguguggaauaaguguuuauugaaugaauaaauaugauauucagauauaaagauuuaguggggucuaaauuuauuggguaguauuuauuugauuagauuuggagagcggaaauaguauacaaacauuaagugacuuuuggugcagucuugacaauaaaacaaacucaguuuccugucauaucuggggcuuagacuggacagacauuugcugguucacaagaauugcugcuggcauuaaccugacacuuugcagcucuccuugaaauaugccguagaaaacauugggcuggagcccaggaccuaaagagcauaguaccuuugugucugggggaugugcaaguggaagagugagcugcgggagagagugugauauucuaguccuuucucuuacccuggccccucuugccuuauagggauucauaucagcucagaggccccaguucuggcucaucacaauuaaugaaagaugagcgcuauauaaguuucuccucuggucuucuguguaguuucccuuccacucagauggacacccaggcucucuuuauuuuuguuugauguguguucaggaaauauaaaaagcuuauuuuaauucuaacuuuaaguaaacaauuagaaaggaaaauuucuguuuguuguugcaggaaccccuccccaccucuauccccugccucccaagcucuacaaucuguucauuuguuuuuaauaugcaggaagugaauuuuagguucuccauguuuuuaucccuucauuaguguguauaauuaagagguaacaggauuugaugugguuuuccaaaguuuuauguaacaugagaagcacacuuagugagugguucauauuuuugaaagauuguacaguauuugaggggagauuuucuuuuaccggaaccucauuuuccaaguucuucauuuugcugggcauaauuugauaagacuuagucuauccuuguccuuuuuacuugagggcgaugcaguguguauuuugaauacaccagugcaugauccugaggggccuuucuuuggugaguguaucuucagaaacagagauaaucaguauccaucuucaggaauuuucuuucuuccugaagacucauuuccacaugucaaguauaaacuaggccuauaaacucuagugagugguuucauuuaaccauccaaacaguuucuauuucaguuccaaaaaagguaauuuuucccccccagccauuaaauagcugggguuuuuugguuguuguuguuguuguuuucuuggugggggguagggggguggagaaugggguuuuccacugcugcuguugguucucuuuggugauaggugaugagauguuucagaaaucaagccaucuucauacuaguuguuuaaaacucaauauauaauacuaauguuagguuuuuacagaguuuggaaagcuugugacagaacauuuauagguagggaggauucuacuuaauuuauagagguagcuuggaagauauguuuuaguuuucaaaauuacaguaugugacaauuaacuuuguuuuaaaaaauuuuuuauuuuuuauauuacauuaguuauuauaaguaacaacaaguaauuuggaaaagagaaauggccuagaaggagauacgaggaaacuuaacacuggucaucuuuggggaauaggaguggaaguuuucacuuucuaucuuaacauuaaaaaaauuaauuaaaaacagaaggguaguuaugugucucaaaucugccuuuccaauuaauagaaaguaacaacuacugagaagaaaaaugauaucuauaaacauuggugaucaucacauuaagccuuuguaugaucacuuacagagucuaccagagacuuucaauacagcauaaaugcuuuuacucuuaaguauuauuugugguauguauguuuguccuucuauccuuccauccacccaucaucuaucucuacccaucuaucuguaucugcuaaggaagagaagugcagcuugguuucuuuucuauaaggaaagagcguaacuguuccucuaucuagaugaucuugaaagagcauauuauuuuugauguuuggcaagaggguaaaguacuuaguaauuuucaaaaauggugugugggacauugaaaagauacauuguauuggugugaaaucuuuuauuuucaguguucugagauucuuuuuuuuuuuuuuuuuuuuuuuuuuaccgcagagucucgcucugucguccaggcuggagugcaguggcacaaucucagcucacugcaaccucugccuuccagguucaggugauucuucugccucagccuccugacuagcugggauuacaggggugcaccaccacgcccggcuaauuuuuuguaucuuaguagagaugggguuucaccauguuggccaggcuggucucaaacuccuaaccucaugugauccacucaccucggccucccaaagugcugggauuacagacgugagccaucacacccagcugagauucuuaucuugguaauuuuuugcacagagaacucagcucucuaucauacuacauuuuaaugagcuacacggugauuuaugacuugugcucuuuccuuuucuaaucagcucaucaacaccauacccauucuaugucaguuuacuuuagaauugaaauuuugccuuuuauauaaugcuguuagguggcuugcauucgauuugggggauaaauagauuuugaaucagcuuuugcugcucaacaaaccacuccaaaacuugguggcuuaaaacaacaggcauuuauuuaguucaccauuuugugguuuggcaauuuaagcugggcucagcuaugugaugguucucuucuccucugagcucacucaugaacaucccgucagauggauagucucacucacauacaugacgguuggcaagggcuacagggaugccugggcuuugugagucucaucauccagcagguuagccugggcuucuccacaugguggcuugugggguucucuaaagccugggguucuccacuugguggcuucugggguucucuaaagcaguaagagagggcaaaugcaaaugcuuaacaacuuuugaaaucucugcaucauguuugcuauugucccauuggccaaagugaguuacaaguccagcuaaaauuccaaggauggagaaagacuaccucuuugugggaggagcuauaaaauuauacugcaguggcaugaacacaaggagggaaagaauuuguggccauuucugcaaucugccauaaauguacuugggacuucucaccuugguucaauggauacugucuuuauuuugaaauaugucuagaauccaaccacuucucacuaucuucucugccuccuuugcuacuuccuaguccaaaccacuaucaucuuuugccucccaacagguucccugcugcuuccaccuuuucacguguguucuacacagcagccagagcaagcuuuuaaaaacagaagucggauuaugucacuccucuguucaaaaccuuccacuggcuucucauuucauucagaauaaaauuuagauuacuuucugagguuacaaaacuuuacaugauguggcucuuucuuugaccucaucuuaacucacugcuuuuagccacacucccuccuugcuguuucucaaacacacuaacaggccguagggcuuugcauuugugguuuucucuaccggauacucagcgugucuccuuucuuuacuucuuuaaggucucuguuuauaugucaccuucucagagaggcugucaaugauacacuacauaaaauaacauucuugcuuaccagucucuggcuugcuguauuuuauuccuuagcacuuaucaccacuugacaguuguuuauuuucuauccccuucaguuagacugcaugcuccaugagggcagugaccuugaguauuuuguuugcuguuuauccccagugccuagaacagugccuggugcaggguguaugccaccuaagccucagcagaaucacuguccagugacauucaucaccuggucuuagugguggcucuucccuagaagugaggugaggucugugucccauuguuguugggcuggaggcagcugguuuucuccuauucguugaugcucagcuggaccgguguugugauauuuaaggaaaguuucauccuaucccuuuuugccaacagaauuuuaauuugaugacuuuauggucauuuuucuuuauaaauacccaucuucauggauuuaaauauauaaucauuguaugcuuaugguuuacauaaauaugaguauucauauguuuguuuuuuugaagaggguggcacauggagcaaacacuuuuuacuuaggcauggaugcucagguagugguguugaugccuucuuuguguacucuugaaauuccugcaagcucccaaaccuuauuauacucagaucuacguaccaaauugcuuaggucccagugggccagacuucugcugagcguuagcuaacucagggauagaguugcuguccuucaaguauaauuugucucucagauggcuuucccauagcugauucucaggcuuugaauauggguucuguuaguccacaggcauugacuccauuugcagguguguguuuguaacauauagucaaaccucuaacauuuggaauaaugagaugagaugagaaugaguaggaggaggggcagucugguuuagugaaauaucugaugcacagaauauuuaaaauuaggccuggcacagcgacucacgaggccuguaaucccagcacuuugggaggccaaggcggguggaucacuugaggucaggaguucgaaaccagccuggccaacauggcaaaaccccuucucuacuaaaaauacaaaaauuagcugggugugguggugcguaucuguaaucccagcuacuugggaggccaaggcacgagaaucgcuugaaccuggaggcagaaguugcagugagcugagaucgcgccacugcacuccagccugggugauagagcaagacccuguuucaaaaaaaaaaaaaaaaaaaaaaaaaggauauuuuaaaauaaagguaauucuaugauuuuuaaauuauagcgcaugucauagacuaagauacaacugggguaugagucccaaaagcaacuguaauggaaauauuugcagucuacacaggccuagagaagaagugaaggauuuuaagcagcaaagucuguguaagaguuauuugacucagacuuugaaggcuaaagaaccagauaaaucuaauuucuugaaaccuuugauuugaaaaaguuacugauuuuauauuaauggaccugaagauguucaggugcagauuaacuuguacuugauuagaaucauauucuucaaguauaaaauagaaauuuugcaguggaaaagcugagacaugugauuucucugccuggcuucuucuggaccuuaagguaacuuucacuggagaugucucccauuccagaaguggaaauuuauguuuugcugccccaaagcugguugaauuagaaagcuggaaagcaaagcaagagagagcuuuaaauauuuaguggaaagagggugcugauaaugacagucaggauugugggucucuucuggacucuggcuucuuacgagaggaaggguuaagaacauccccuuuuggggaagacaagcuaggacuucaguccaguuuugccauuuacuguuggagugaucuuagauuaaguuauuuaaucucucuaugccucaguuuccuuggugguaaaaaggggaauauugagagggcucauaccuuagaguuguaaggauucaaugcagugauauauggaaaaggcuuauuguagaugcucaggaaauguuagcuaauauauauagaaggcauauuuucugaagaauucaggaaaaugauaccagaagggcuuaaaugggcacccaggacacaguuuuaugugccauuguggucccuaugaaacuagcgaauauaugcaguuguuuugugagagugacagaacaaagagugacaggcagagggaggggguugccauagcauugggguaaacaagugagccgcgugguuuagagaggaaagcauuugugugcauaguggcuccaaagaggugugugaggugugcgaggagggaagagcacacacuugguaaugaaggccugagagcugcaggggcuggaagagaacacucguguguguagaagugugugugggggugggaaggaggguggagugaggguuuaugggcuuggaucaggcuauuacauuggaucccaaaggcauuaggugccacucaagcuggaucucuacaaaggggacucauacaaacugaggcuccggaagaaaagaguucuguggguuuaugauaaaucccuagggucaggcuucucaaacuuaucuaaucaagugccccuaggcauaagagaauuacccuugcuggggccgguugcgguggcucacgccuguaaucccagcacuuugggaggccgaggugggcggaucacaaggucaggagauggagaccauccuggcuaacauggugaaaccccgucucuacuaaaaaauacaaaaaauuggccgagugguggcgggcgccuguagucccagcuacuuggcaggcugaggcaggagaauggugugaaccugggaggcggagcuugcagugagcugagaucacaccacugcacuccagccugggcgacagaacaagacuccgucucaaaaaaaaaaaaaaaaaaaaaagagaauuacccuugcugcaguuauuuuuaagucuuguuuuuuuuuuuuacuuuaaaaauucagagauuuuugcauuucauaaucuauuuguuucuuuucguucuaaacgcugguauuuuuaguaaaguuaaucguaccaagggagaagugccauguuuaucucauggcuucuaaaaggaacccacacugcccuucugagauuaauccaggagcaagguaauuaacaguuaugguaguuggaugccaggaaagagagaggucuuuagaaggggccuuguacucacagcagguaggcaguugguauucccucacugcugcuucuaggccuuuaaggccccauauccuuucuguaaggcaacuugugaguuuuugaaggcccacugaugguccuuuagugcucacuacuuacccaggcuacugagauccucccuugugcccccugcagcaguggccugggauaggagguaaugggugcauuuaauacucuugucccaggcugggcaccguggcucacaccuguaaccucagcacuuugggaggcugagguaggggaucacuugaggccagauucucaagguuccuccauguugucgcaugugucagcacuucauuccuuuuuguggcugaauaauauuccauugugccacauuuuaaaaauccauuuaucaguugaugaacauuuggguuguuucugcuuuuuggcuauuauggauaaugcuguuaugaacauucauguacaauuuuaguggacauacuuucaguuaccuuggguaaauauuauaccugggagugggauugcugggucauuugguaacucuguuuuaacuuucugagauauugccaaacuguuuuccacagcagcuccaccauuuuauauccccaccaggaagguaugagggauuuaauuucucuacaucuuugccaacacguauuauuuucucucuuuuugaugauagucaucuuauugggugugauuugcauuuccuggauggcugaugauguugaacaucuuugcauguucuuacuggccauuuguguaucuucuuuggagaaaugucuauucaaauccuuugccuacuuuuggauuaucuuuuuguuauuauuauuauuacuuuuuucuuuuuugagacggagucuugcucugucgcccaggcuggagugcaguggcgcagucucggcucacugcaagguccgccucccggguucacgccauucuccugccucagccuccugaguagcugggacuacaggcgcccgccaccaugcccggcuaauuuuuuuguauuuuuaguagagacgggguuucagcauguuagccaggauggucuccaucuccugaccuugugauccacccgccgcggccucccaaagugcuaggauuacaggcuugagccacugcgcccggccaaucuuuuuguuauuaaggugaagaauucuuuuuauauucuggguauaagucccuuaucaaauauaugauuugcaaauauuuucucccauuuaguggguugccuuuucuugauggugcccuuugaagcaugcaaauauuuacaugcucagaaaauauuugucaaagaaugaaugaaagaaacacuaccuuuuauugaaagccuugccugacuuuacacaacguugugauuuugucucuuggauaccuaggguguauauauuuuuucauauugauuauaauacuccccacauugcuuuguaauuuauuuguaguauuuucucccucacccagugauaccuugggaggcaggugcugugucuacuauguuccuaacugaguuucugguguggguaauaggguaguaugugacggucacugaauguugccugaaugaaugcauggauuucucuguggaacucugucaagugagaggggaugcagcugguccagauuguuggucuucaauuuuuaugaaccagcuuagauucagauuguagagugugugcagaaggcugugauucuccagcuugcaguccauacuuuaucaaggacugcuuggaggcagacgagcuugaagaacucagccuccuugcaugggcuucuuaguguggagaagggguggggagagcagagugaauggcgaaguguucagugugugagcagguugucauuauuaauguaucguaaugaccaugguguuuaugggauuucuucaauuuuaaaguggucauuaccaagguuaauuaucuucuuaaccuuagagguguaaagcugcuuuuggcaucuuuggaaacuucuuuuggagcuaccagauuagauggucuuaguauuuauuuauuuauuugacagagucucacucuuuccuccaggcuggagugcaguggcaugaucuugggucauugcagccucggcugcugggguucaagcaaacauguccggcuaauuuuuguauuuuuaguagaggcaggguuucaccauguuggccaggcuggucuggaacuccugaccucaaaugauccgccugucucggccucccaaaguacugggauuacagacaugagccaccacgcccggccggucuuaguaauacuuuaagauuucuuucagcucuaagauuucauaacucaaaacuuugucuucccaaugaaaucuuucuugauuacuuuaguccuuaaugauccccaucuucuuaaccuaagucaugcaagacauauuuaugugaacagcaugguaucauucauucauucagcaaacauugcauuaggaacuuggcuagaugcuggagugacaaagaugaccaagacagcauuuuuuuuuuaacaguguuuacugaacacauauuuuaugcuaugcccuggggguaaagggugacuaagacguguaaggcacuugcauucuacaggccauugcuuuucauggguauagguuuucucuccccaguuagacuguaagccuuguuuuuuguaucucauucccccaaacaucuaauacgaugaguaaauaguuucucaagcaguacuugauugacuucuuuuuccucuuuuuuugagguggagucucacucugucgccgaggcuggaguacaguggugagaucucagcucacugcaaccuccgccuccuagguucaagccauuuuccugccucagccucccaaguagcugggacuauaggcgugagccaccacgccuggcuaauauuuguauuuuuaguagagaugggguuuugccauguuugccaggcuggucuugaacuccugaccugaagugauccuccugccuuggccucccaaagugcugggauuacaggugugagccaccgugccuggccaauugacuucuuggguggguuuuuuuuguuuuuguuuuugcuuuuuuuuugauugccaagaaaaguuuugcuugccaagaaaaugugagagguauuuggaacuuugaaauuuauaaucuauacaauacguacaggucuugggcaaguggcuacucagguguuacgguggaaauaaucuauaccugugccugauucuugauugggaagaaaaauuuggaaguaguuuagagagugauucaaaacuucucauauucccuagcucuuuuaaucuauuucauuucugaauaaugaagugauguauucaaauuuugcacucagaggacacuggcgugugauuuugggacugcaugcuuaaucagaacuugaaagaguuuuuguuuuguuugcuuugcuuuuaaaaccaggguucugcccuucuuaguaaagcauauuuuggggcagggaggcauacugauugggauuuuuuccaaaugguuuuccucacaucuugccaucggaaccucuuaaauaagggcuuucaaggcccccaugcaauucugguaguuucaguauaccuaagagaagacagguuauuaaugauuuucagaugugaaauucauuaaacuauauaguaaauuaaagugcuuuuggggaaggauaauaguagggaguauugaaacagaacaucuaaaacaacugucuuccuugcaguguuaacaugugauauaaaugugguguuuuuugcccuuacugcuugccuuauguuaccuccuuugcucuggaacaguuguuuucagacuucagugggcauaggaaucaccugagaaauugguuggaguuguugauuugcuaucuuuuaccugggggauaugcaguccaggugguucaaaugcuuuuugagcagacuggauauugcuuuggcagugucauagugcuuguuucuaaccucuacauagaggccuguuccugccugucacuccacaccccacguucuucaauggccucagugccuuugcucuauucauuccuccuaagauggaaauucgucuucugucuccuuagggcucagcucaagaggaggccuucccaagaagcuuugucuagucuagcucacucugaugaugccuuucccaaaaucccucuguacauacaguaguuaaaaaaaaaauggcuaacuuucccuguuuggcucuuauaguauguaauuuuuuauuuauggucuguauugcucauuggaccauuccuguauauugcacugcuuuacugguuaucuuucaagguucccaugugcaacuucagagguugugcagugcauaauauuaaugugcuaguccucugucuuuguauuuuuguuucugagaugagguuucuugcuauguugcccaggcuggucucaaacuccugggcacaagugauuuuccugccuuggccucgcaaagugcugggauuacaaguguaagccauugcacccggccuaguuauugacuauuacuauauuucaugagcuuucagacaccuuuuucugauaguuuucuacugguagauuugcuuuuauaaaauuuuauaaaauuucaacaugguaauauuuauccuuccuauagauggcauuuggguauuguggugggaguguuuucuuuuucuuuuuuauuuuuuugagauggagucuugcucugucacccagacuugagugcaguggcaugaucucagcucacugcaaccucugcuucccagguucaagcaauucuccugccucagucucccgaguagcugggauuagaggcacacaccaccaugccuggcuaauuuuuguauuuuuaauagagaugggguuucaccaggcuggugucgaacuccugaccucaugauuugccugccucggccuccuaaaguucugggauuacaggcgugagccacugcauccuggcaagugggaguguuuucauuaugccaccuucugugggguccucauggcaagugagguguugagcaggaugaaucuugucacccucaggacuucgagaagggaaguuaggggugucaggaggccgggcagcaccuccugccucuaagucuggugcccucugcuucaugcuauguagaugguuccauuuaaaaaaacaacuuccagcugggugcaguggcucacaucuguaaucccaccacuuugggagaccagggcagguggaucacuugaggccagaaauuugagaccagcuuggccuacauggugaaaccgcaucucaacuaaaaauacaaaaauuagcugggcgugauggugcgugccuauaaucccagcuacucgggaggccgagacagaagaauugcuugaaccuuggagguggaggcugcagugagcugagaucucgccacugcacuccagccaggcugacagaauaaaaccgugucucaaaaaaauaaaaaauuaacaaaacucuaauuuuuauuuggaaauaauuuuagacaaaguagcaaaaauagagaacucagauugcuuccccuaauacuggcaacuaacugucuuuuccacuuuuuauugcugaguaugguuccguuuugaauauaugucaccaccauauuuuuuaacagcuuuauugagacauaauucacguacuauacaguucacucaucuaaagugugcaauucauuaguuuuuaguauguucacagaguuguauaaccaucaccacaaucuauuuuuagaacauuuuuaucaccucagaaugaaauucugugcccauuagcagucacuccucauuccucucgcuaccuucucucuccagcugcaggcaaucacuaaucuacuuuaaucacuaaucuacuuuauguauguaucucuggauuugccuauucuggacauuugauguaaaauuuccaccaucauuauaucuuauuaacauuuucuuuuuuuuuuuuuuuugagacggagucuugcucugucgcccaggcuggagugcaguggcacuguaucggcucacugcaagcuccgccucccggguucacgccauucuccugccucagccucuugaguagcugggacuacaggcgcucgccaccacgcccggcuaauuuuuuuuuguauuucuuuuaguagagauggaguuucacuguguuagccaggauagucucgaucuccugaccuggugaucugcccgccucggccucccaaagugcugggauuacaggcaugagccacugcgcccggcccuuauuaacauuuucuaugcagauccuggcucucccucuuacaagugucugacuguggacuugucauuuaauuugucucuaccuuggucuccugauuuguaaagugggagauaauaauaguauguagauguagaguuguaagaauuaaaugaguuaacauguggaaagcacuuggcuccaauuuguacucuauaaauuuuagcugcuguuacgcuaggaugucauaguuuuucuuuuucuuuuuuuuuuuagagaugcggucucacucugucacccaggcugauuguguaguggugcaaucauagcuugcugccaccuuaaaaucccaggcucgagagauccuccugccucagccuccugaguaguugggaccacagaugcaccaccaugccuggcaauuuuuaaaaauuuucuuguagagacggcagucuugcuauauugccuaucuauguugcucuauugucucaaacucuuggccucaagagauccucuugccguggccucccaaagcccgcugugcccacccagggaucugucauauuucuaauugguucauuuauggucuuccauauugguauuuacuguuucugugucauuaccaguuaaccauacaaguauguaacaauuauucauaucaguuuuauuauuuuguccuaaauccugaguuuagaauuuagucaauguaaacgauuuccugucacaaagacuuagcugguaaaaagaacugcagcauuuggcauuguaaguaugcaucuucauuuggcaccuugguguauuuauuugaaugagaggugauguacccaucugauuuaguuaaagucaaaauaaaucuagggcgucgguuucugaaaaccaaguuuuacuuucauuaaagugaauuucaagaaaaguugcuuuugaaacuaauuuuuuaaaaacacauuuauuucucauagacuuucaauaucaaaggggagacaauauguuccuauaagaaaaauucauagugcccaaaacauacccaucaccacccccucuauagaugggaaaacugcugagguuuaauuugagugaugugcaggauaguuaaaugaagcuugagaaauaccuguuuacaauaguuacacauuguccaaauaauuuucagcauaaauaaugagucaaauccagauuaggauguggcagagggauugugaaauaccagacaaaaaacuggagauauugggcuaggaaccagaagaucugggaucaggacuugcuaccagucagcugaaugacccggagcaagccacuuaaguucuuugggccaguuuccucaucuguaaaaugagacaacuggacuagaauagauggucucuuggggcuuauccagagcaaaaauuccuugguuucuuucuuuuuuuuuuuuuucugagauagaaucccagucucucuuccaggcuggagugcaguggugcgaucucagcucaguacaaccucugccucccagguccaagugauucuccugcuucagccucccgaguagccgugauuacaggcacgcagugccaccacgccuggcuaauuuuugcauuuuuaguagagacggguuuugccguguuggccaggcuggucucgaacuccugacuucaggugauccacccaccucggccucccaaagugcugggauuacaggugugagccccugcacccagccuuauuucucauaauaacaagauacuaccaaauauugauuaauuuagagaaaucucuaaauuuguguuuuugcugcucuuuuucucauccuuauuacugccauagcccuucuaguuucacagugagguggcuauuuuaugauuuguauuuuuacauuucugcugucauauauauuuuucucucuuuuaggcagcucugaccugugauauguucaaaauuguauuaagguuuuaguuacagauacucugguuggguaguggagcucaaaccaaaaccaaccuucucucuuuggugguggaaauggaagcuggcacauucuguguuccaguauguccuggggccuuuuuaugaguagcugcauuucuuaaaaauugccugugaugaaguaaacgugcauauauaaaugauuuucaugacuaauuuugauuuuaaauuuggaaauacaguuuuauagugggaaaacauugguaccugacacacaauaaauuuucacuuacgauuccuaauauuuacuuuaaagagccauucugcuuguaacuaggcaguuuuauauuucauagucucugccagugguuucuaauuuugggccacgaaugcuggagagguauaugaaguuguuauaagggauuugauuauccaaaugaaccccuaucugcagacugauuuguacugguguuuucagauguauauagggauuugugacuaaugaagaauuauuuaaggcuggaucagugguucaugccugugauccuagcacuuuguuaagccaaggugggaggauuacuugagcuuggggaagucgcggcugcaguaagccauguuugugccaucucgcuccagccugggugacagagugagacccugucugggaaaaaaaaaaauuacuuaaaaguacuuccugaauucauaaaaauguuuuguuauuguauuuucuuuagugauauuaaugaagauccaagacacuuaaaaacauuccaaagguucauacacacaaaacuugaaaaacauccuuuucuaaaaccaugucaagcaaagcaugauguagacuuaaaaagaaaaaaagaaaagaaaagaaaugaugucaagagguuagugaaguggacagagaggucaaccugauaguauacauuuguuuaaaagcaugcauauauuuuguaguuucuuuuguaaguagaacuuagagaauuuaagcaaucuuugcuuuuucacugaauaaaaaccacacuguuugucuuuaggaccuuaagucucaagaaaaaaacaaacauuuuaaaaaucccucaagacuugguugauacuaccugaaaaagcucucuaaauuacaaagaagagauauuaaguucauuucugauaagaugguuaguuuuguugacugaauugacaucaugcucaaaauaagacauaagcuguaggaacuaaauucaguuauugccagaaguucaccacauaccaaauguauuauucuaagugaauaagaaaaugagauuuauugauauuauaauagaaauauugaacaguagagaagugugaugccaggugaugccacuaacgugaguaugcuucuggccauuaaaggaggauguuguaugacaucuugcauuaaucauugauuuaccuuuccacuuucugcauaaaccuugagcagguucauguguuuuuuguguuuguuuuuuuuuguuuguuuguuuguuuuuuugagauggagucucccucugucgcccaggcuggagcacacugguacagucuuggcucacugcaaccucugccucccaguuucaagcgauucuccugccucagccuccugaauagcugggauuacaggcaugugccaccauguccggcuaauuuuuguguuuuuuguagagacggguuucaccauguugaccaggcuggucucgaacuccugaccucaggugauccaccucugccucccaaagugcuagaauuacaggggggagccacugcaccuggccagguucauguguuuuuauacucauuuaguuacccuguauuuuuuuaguuaucuuuggagauggaagagguguggauaauccagagaugaugcuuguagucaagaaagaguaauuguggccuuuugauggggagccaaguuuuaugaaaucccacggagucagucuucagauccaggguucuuaauuggcuagagaucuugcaaguuauuuugccauguuguuuuuugaagggaaaggaaauacugucauacguuuaugcaucuguauauaaaaugguuagaaaugguaucauauagguauugcauguuugugaucauaacugccugaauaaagguuaaaaugucaugggaaaaugggaaaacuuaagcaggaggaaauagagauaguuuauuuuuagcaauuuagaauguuccauuuaaaagcaguuaaacuggcuagagcugugggcagggggagggguacuggggugguuuaaaggccauagcuauuauggugagugccugacauuuugauuugaagugugucucugccuguguauuuuagaaccagaaaaauucuuggaaaacuaccuuuuuuuuuuuuuaaacuguguacccagauaaaauaguuuguuauuccaaaucuagaauugagauuuuaauuuuuauuaauuuuuauuucugucagucuuucaggcauuuggcuucuuugcuuauucuuuuaagauuuaagucggagaagaaaaaucacauccauuaguuuugauuacucagaucaauaaauugaaaaggaaaauuagaaucauuuaaauuugacugcauaugaugagauucugcuaaauuaaacuauaaauuacauguuuauuaagcacuuuguaaacacuuauuaaaacaauguucuaaauugaacuauuucccucuguauauguucuuaguuauugauggguuaugguucaagaggcgagcuggaugagguuucuuaacucuuugagguugguuuggcaaauuuaauuaagccuuaaguggcucacucuuuuuuuuuuuuuuuugagacagagucuuacucuguugccugggcuggaguguaguggcgugaucuuggcucauugcaaucuccgccucccagguucaagcgauucuugugccucagccuguagagacaggguuuuacuauguuggccaggcuggucucuaacugcugaccucaggugaucugccugccuuggccucccaaagugcugggauuacaggcaugagccacugugccuggccaaguggcucacucuugagggcucaagcaguguuggaauaauguugcuggauaaacggugaacaccaauacaucccaguguaugaugcagaauaauccacaaagcaugauuuauagaaguagugauauuuaacaaaaaaaaucuucaacacuuaauauguaaaaugaacagugcaaauuguuuuuaagucuuggucuugaaaaauacuguagauggcuuaaccauaugcuuggcugggcaugguggcucacgccuguaaucccagcgcuuaugaaaggcugaggcgggaggaucgcuugagcccaggaguugggaccagcucgggcaacauagggaaaccuugucucuacaaaaaucaaagaaacuagcugggcaaggugguacaugccuguuuucucaguuacuugggaggcugaggcaggaggaucauuugcacgcaggagguugaggcugcaaugagccaugauugcaccacugcacuccagccuggguuacagagagagauccucucuugaaaaaaugaacaaaaaaaccccaaaaaugcuugccaaaaaaaaagaaaagaaauuaguauauauucuuuuagacuuuuuugucuacauauacauauauguagacauguuuauuuuacuuuauuuuuuuaaauggagccuugcacugucacccaggcugaagugcaguggcacaauuucagcucacugcaaccucugccucccggguucaagcaguucuccugccucagccucccuaguugcugggauuacaggucaccacauugcccagcuaauuuuuuuuuuuuuuuuuguauuuuuaguagagaugggguuuugccauguuggccaggcuggucuuuaacuccugaccucaaguggucugcccgucucagccucccaaagugcugggauuucaggcgugaaccaccgugccuggccagacauguuuauuuuuauaaaaauaguacuguacucuuucucucucacuauauauauuuuuaugaauuuuuuugugugugugucuuugagacagagucucacucugucacccaggcuggagugcaguggcgcguucuuggcucacugcaaccuccuccucccggguucaagugauuguccugccucagccucccaaguagcugggauuacuggugcaugccucugggccagcuaauuuuuguauuuuuaguagauacgggguuucaccauguuagccaggcuggucuccaacuccugacauccagugauccgccugccucagccuuccaaaaugcugggauuacaggcaugagccaccaugccuggccuuuuuguuuuugcuuuuuguuuuuugagauaaggucuggcucuauugcucagccuggugugcaguggcgugaucuuggcucauugcagccuccgcccccugggcucaagccauccucccaucucagccucccaaguagcuagguaacuacaggcacgcaccaccaugcuuggcuaguuuuuguauuuuuuguagagaugggauuuugucauguuguccaggcaugucuugaacuggugagcucaaguaauccacccaccucagccucccaaaaugcugggauuacaggcaugauccaccauguuggccucugugaauguuucauuuccuacugaaaaguuugucauuuuuuuuugguugucuuuuuuuuuuuuuuaaauggcuguacagccgggcgcgguggcucacgcuuguaaucccagcacuuugggaggcuaauaggggcagaucaccugaagucaggaguucaagaccaggcuggccaaccugguaagacucugucucuacuaaaaauacaaaaaauuagccgaguguggugguacacaccuguaaucccagcuacucaggaggcugaggcaggagaauugcuuaaacccaggagguagagguuguagugagcugagaaugugucacugcccuccagccugggcaacagagugagacucugucucauaaauaaauaaauaaauaaauggcgguacagucuucuaagguaugaauaaguaguuacuuacuuaagaccacuuucuuauugauaacaucuggagcauuuuuauuuuacugcuguuguaaacaacgcugguggggagcuacuuaagacauaucucuguguucacauaggggaguaugucuauaggauacauucuuaaaaguggaauucuggguaaaaaauaaaagccuugguaggugcugcuaaauugcuuuagacguugcguuuuacauuucuaguagaguauuugagaauaccuucuuccuacaguuuaaacaguuaaaauuuaaagcuauaauuuuaaaaagaacaaguaacccgacuuuaggaguuggaacaucaucugaauacuugaccaucauuacugguuaaucuuauuuuuaaaaguuuacaagcuaaauuaguuagugaggcagauagcaucacuuccacagugauuuaagaauccugugucauuugaagcucaccuguuuaauauuccuagaguacuucauuauauuguuauccuucauguuuaguaauaucagaaauuuugucagaaauaugucuugccacaugugcaaaacuaacagcuugaguacaguuugucacacuggauacaguguaagcagccuuuauuuagcugcugucacaacuguuucugguguuuuugcucucuaccaaugauucucaccuagggguucuuuugcuccccucccccuccccccaccacacacacgcacacacacacgcgcgcgcgguaauuuggcaaugucuggagagaccugguugugacacuugagagaggauugaagcgggaaagaguaaggacuugcuacuggcaucuaguggcagacaggccagggaugcugcuaaauauucuauaguucacagaagagcugcucacaauaaauaguuaucugauuagcuuggcuugguggcaagugccuguagucccagcuacacaggaggcagaggcaggaggaucacuugagcccaggaguuugggguuaaaaaaaaaaaacaacccaccaaaccaaaaaagaguuaucugggccugacuaucaacagugcuuuacacaaaggaguuagggugcucuaucauacaacuaucugaugauucuuuugcuuaaacugauucuaccccauuucuuauggcugcgugccacacucaccuuuaguagaucagaauuccuugccuagagcggcuggcugcucuugacuuuguguugcuguuucuagcuuuuucauguuuugcucagugguagggacaggcaggccaauuuaguagagcuugacaaagugaagccugguaucuucuaugaggcuauaaacguugucuaaagacgcaauuucugguucugauaaggcuccugguaauuccuggacuggaagacuuggcugucauuguuuugcuguuaaguaccccuuccacucaaaugcaaaaguaaaacacacacaugccaccauccuucccaaccaaaccaaaacaaaaaaauucaacaaacaaaaacaaaacacuugaugaucaaggagaaccuaugauaacucuucuuauuccacauuucaaguuuguacuugaucugugccaucauacaagaaacccaacugguaugacuguccugagugcauuuccagugaagaggcugggagaguccaaaagaauguuuugagucaucagauccuuuuaaaaugucagauucuuuccaugggauuaauuuaaaccuguuaugacccuuuaaaaauuuuuauaagaggccucagagccauaauaacauggaauacugcuuguuuaguagaagccuuucuaaaggccaccuuuauauuugguuuaauuuuuuacauugucaaccaucauguaagagagaaacaggaauuuuugaguccuuaacugggaagaacagcugcuuggugcagaaagucucaugaaguaagucuccuuuugaauaaaaaggaagaucuccuauuagaaaauaaagcauuauuauuuuuucuuccuuuuucaugacaauuuagguuuaggcuaagcauauuagguauauauaaagauguaaaaaaucagugugcuuuuaagauaaaccuguaauucuuguucagagguaguaagcuguaggucggguuauugaagaacagagaauuauuagguuucuuuugugaacacagaaaguuucugggcucuuccagggccuagggaguggaaaguuuuccccuuuguuucuugauguguuucuuuguccccuuuguuuccuuuauugucuuacuuuagugcuccccaauaaaaauaugauaccacaaauguaggacacauauguaauuuuaaauuuucuaguagccagauuuuaaaaaagugaaaaacagaagaaauugauuaauuaauuaauuuuuuugagauggaguuucauucuugucacccagacuggagugcaauggugcaaucucugcucacugcaaccucugccucccagguuuaagcgauucuccugccuuagccuccugaguagcugggacuacaggugcaugccaccaugccuggcuaauuuuguauuuuuagcagagacgggguuuucccauguuggccaggcuggugucgaucuccugaccucaggugaucugcccaccuuggccucccaaaguguugccauuauaggcaugagccaccgugcccagucugaaauuaauuuuaauaauauacuuucuuuaacucaguauaucuaaaauauuaucauuucaacauguaaccaauauaaaaaugagcuauuuuuagauucuuuuuuucacacuacaucuuugaagucucauguguauuuuauauuuacagcauaucucaauaaggacuggucauacugcuuuuuuuuuaaaauuauagauucagggaguccacguacagguuuguuacaugaauauaucacucuaugcugagguuugguuucgaauugaacuuguuauccaaauagugaacauaguauccaguggguaguuuuucaacccuugccaccuggcuucccccuucuaaaguccccaguguuuauuguucguaucuuuauguucauguguacccaauguuuagcuccuacuuuuaagugaaaauaugcagcauuuggcuuucuguuccuguguuaauucaguuaggauaaugaccuccagcuguauucacguugcaaaggacgugauuucauucuucuuaugcugcauaguauuccaugguguauauguuccacauuuuuuuuuuuuauccaguccacuguugaagguugauuccauaucuuuccuauugugaauagugcuaugaugaacaugagagugcaggugucuuuuugguugaacaaccauuuauuuuucuuuggguauauauccgguaauggaauugcugggucaaaugguaauucuauuuuuaguucuuugagaaaucuccaaacugcuuaacauaggggcugaacuaauuuacaaucccaucaucaguguaugagcguuccuuuuucucugcaaccuugccaacauguuauuuuuugacuuuuuaauaguacucauuccgacuggugugcgaugguaucucguugugauuuugauuugcauuucccugaugauuagugauagugagcauuuuuucauaggcuuguugacugcuuguauguccucuuuugagaaguguuugcucauguccuuugcccgcuuuuuaaugggguuguuuuuuucuuguugauuuguuugaguuucuucuagauucuggauauuaguccuucaucagauguguaguuugcagauauuuucucccauucuguagguugucuguuuacucuguugauaauuucuuucacugugcggaagugcuuuaguuuaauuagguuccacuugucaacuuuugauuuuauugcauuccagaaugauauuuccuacguuuuauucuagaauuuuuauaguuuugagaucuuacauuuaaguccuuaauccauuuugaguuaauuuuuguauauggugaaagguguaggggucgaguuucguucugcauaugguuagccaguuuucccagcaccauuuauugacuagguaggacuagucauauuucccaagugcucaguaguuauauguggcuaguggcugcuauauugguuagcacaauuuuauucggccuaguucuucuacucugcaagaauuuuacuacuuauuagcuagaggucauucagacuuagguauucauauacuaacauauacauaaaauuuaaggaaaaaaauauguuuauaguugcuuaccucagcuacuuguuuuuaagauacucaaaauauaucauguuucagcauuguagguaaugauauaaauuggccuggacuucauuggauuuguggcugugcgugugccaguuuucuaguuccauguauucuuuaaacauagauaauguagcugagaaaggcaucacucagagaaaaggaagaugacuuguacuugaauucugacauaccaugauagaaacguucuaaaucuuggugucaucaggaagcuuguugauaccuaaaauuaagaauuuugguauuggcugggcgcagcagcucaugccuguaauuccugcauuuuggaaggccagagggcagauugcuugaacuuaggaguucaagaccagccugggcaauguggcaaaaccccaucucuacaaaaaauacaaaaauuggcuggacaugguggucugcaccgguagucccagcuacuugggaggcugaggugggaggaucacuugagccugggaggucaaggcugcagugagccaugaucgggccacugcacuccagccugggugagagugagacucugucucaaaaaaaaaaaaagaaaacaacaacaacaacaacaaaaauuaugguauuuggugaccaacauugaguauggggcuauauaaauccaugaagaagaguuuugggacaaauaguuuguguugagugaggguaugugagaggcagugguacuugaaaagugaauuagcaguuuucuauguucauuuuuuacuuuccaaaucuucuuuggugagccuauacuauuuuuaaaaucagaaauaaacuacccccccaaauuaaugcaaaaaguaauuaaaucaaagcaagaacaaaaccaaaaauccaauaccaccaauaguacacaaaaguaaagagguucgaagaccuggauucuaauucugguucugucguuaaccaucugugugauuuuggauaagucaguuaacgccucuggguuuccauuucuucaucuguaaaaccagaaauuaaaguugcuuagauucuuuaggucuuuuuggucauguaguuggguaacacaguuccaugauagcuuucaugaaagucuuuuugggaauuuuuaaauuuauauuuauauuuauauuuaauuaaauuaauuuauuuauuuaagauggagucuugcucugucgcccagucuggaguacaguggugcgaucuuggcucucuguaaccucugccuccuggguucaagcaauucccuugccucagccuuccgaguagcugggacuacagguaugcgccaccacgccaggcuaauuuuuguauuuuuaguagagaugggguuuugccauguuggccacgcuggucucaaauuccugacuucaagugaucugcccaacucagccucccaaagugcugggauuacaggcaugacccacaaugcuuggcccuuuuuugggaauuuuuuagaaggaauuauagagucuaggggauucucuuaaaaucauucacacggcuggguacaguggcucacaccugcaaucucagcacuuugggaggccaaagugggaggauugcuugaucucaggaguuugagacuagucugggcaacauagcaagacccugucucuacaaaaagaauaaaacaaaaauuagguaggcaugguggugugcgccucuagucuuagcuauuugggaggcugaggugggaggauugcuuggaccaaggauuuugaggcugcagugagcaaugauugugccacugcacuccacccugggcaacagagcaaggcccugucucaaaaaaaaaaaaucauucacugaaagaauauuuauuaaaugccugcuaaguagcaagcagugcccuuuagcaggaaagcguuuggaagaaauuguccuaaguaggugugugggugagaugggguggaaagaagcaaaaacaugagagcgaauaauagaaauaaaauauuuauguaauacaguauaauguaaaaggugcuucccaguuuugugucucauuucaugucauuuuuuauuuuggagacaugagggagaauauaaggaagcaguugagaccaugugaaagacaaauaaagaagaggaaguuacuaaaaccuugaugguacuguaauaaagcaguuggagucaccugagaaaagaauauuuggacugaaucugagaggaaaauuaagaaaaagugauuauguugagaugaucaaugugaggauggaauccugaaauuaaguguuguugaguuguagaaauaagaggaaguauucuuugacagaggaaauacauagagcauacacgauugagauuauuacuggguuuaaagauguuuugaaaggugaaacacuaauuuguauagaaaggacuaaaauuacaaauuuguuaagacccucaaaacauagauauaccucucaggcuuauauagcagucucugaaugcuuuucagaaaucauuagauugauuucgaaaugccuacaucguuggcauugaccccauccauuuauccacacuuuucacuucccuucuuuuuaaccauucucaagcuucuccucuccaaacuauucaccugaagaagcaaaacaucuguugguguuacuagcaacaauguuuaggagcauuggagaaaaagacaagaggaauuuaagaggggggggugguaaauuauaauaguucuaauuccaaaucugauuuccuacuggacuauaucacauuucucuuauuuuaugucuuaacaacuugagcuaauguuuauuuucacuuucaaguaauaugacauuauggaaauugaggcaauguguuaaaauacuaggauacugguuuuguguuacuuuucucgacaaauaacuuucucagauucuuccuaagguaggaaauauucuuguuagagggccugaguauagauguggguuuauggacagcuguauuggaaauacauuauuuguuacagaagcauguggguuugagacaguucagcuguauucauguuaugugcuggucucauaggacuacagggaugcaaauauaauuguauauaauucaagagggcagauaugauugcaucaugcagucaaauuaagugcuguaagagagaugugaaugaggggccccugcagcucaaaggaugggagagaucacaucagguucagggaaucagccaggaaagucuucaugaaagaagugucauuugagagaacccucuaagggugguuggagagaaaggcuggaguggaaaggggccuucagaguuaacagaccagggguuagacaugggauuagcugagccacagacugggacuuaaaguuuaugcgggaugguggggaaaaaggaggcaggaaagcaggaacaggauaggaaaggaaaugggagggugggaaacaguggaguacuguggaccacauguguuuugcagcuuuauauucugguauaacccaaaugaugguauugguaaacacuugugaugggauuuuguaucuaguguguauauaauuuaguauacauuucaaaguaagaauacuggccuauauacauaauagauauuuauguaugaauguguguguaacuuauaccagaaaagagugcuccuuuugggauuuguuagggaaccuaccauuugugcaaauguuucuacuugugagcaucaugaagaaaaauugcucccugguagaaauguuuaaaggauguguguguguguguguguguguguguguguguguaauggggaaagaaagauggguggggucgggggaggagaaaucaggagaggggaggagagaagugggaauugggaaaagaggaccuagaacuuuaaaaugggauuaggguacauuuuuuagaggaaaugccuuuaggggacuucgccaucaaaaacguuuguugucggccagugcaguggcucaugccuauaaucccagcacuuugggaggccgaggugggcagaucaccugaaaucaggaguuugggaccagccuggccaacauggugaaacccugucucuacuaaaaauacaaaaauuagcugggcguaguagcgcaugccuguaaucccaacuacuugggagguggaggcaggaaaaucacuugaaccugggagguagagguuacagugagcugaggucguaccacugcacuccagcccugggugacagagggagacucaguaucaaaaaaaaaaaaaaaaaaaaaguuugucaguauauguacaaugacaaagauaauaguguuaauucuuaugaauuacuagaagugaaaacacuugcagacuuuuauuuuucucuaccuuaaaaaaaucauggcuggcugggcgcggugucucaugccuguaaucucagcacuuugggaggccgaggcggguggaucaccugagguugggaguucgagaccagccugaccaacauggagaaaccccgucucuacuaaaaauacaaaauuagccggacgugguggcacaugccuguaaucccagcuacucgggaggccgaggcaggaaaaucgcuugaaccugggaggcagagguuguggugagccgagaucgugcuguugcacuccagccugggcaacaagagugaaacuccgucucaaaaaaaccccccaaaaaacgaacaaaaaaaacaaaccauggcuuagugccuguagucccaguuacucuggaggcugaggcaggaaaauugcuuaaggccaagaguucgagaccugcuugagcaacauagugagaccucugucucuaaaauacauaaaauaaaauaaaauggaagaggguauucacauaucuuaauucauauuguugccaguauguuuuuuuuuuuuuuuuuuuuaaaugaguauagcaguagcaguucuuuugugaauuagauaacaggcuaaacuucuguaaaagaaauugauguuucuuuuggauagaacauuuacuuuugugaaaacaauacaaguaaaaaagcuguugaaagaaaugacuguugaauuugaauauauuaauugcuucagagguguuuauuuuucuuuucuuaaagugcugaaaaacuauuuaauuuuaaaauaagagugcuguugcauuguuccuuaauacagaaguauuguugaaagugcaaccucucaggaaagaugagcaaacuuguuuuuuguggguaguucuuugcugcuuaggauuccuguaaauuuacaagauacuauuggcuuauguguuuuuauugugaauuacuaaaauauuaggccauaaaaaucaaacuuuguggugcccugauaguguuuuugaaccucuccauaucuuuugcuagcuuaaggaaagugugaaggacuuugaaaauauaccuggccuagacuuagaacuuacugugucuggccuucccaauuuuuucaguagguucagaauacuucucuuugguuugaauuauaauuuuguuucuugugguuccaaaaguuaucuguaauagccucguucuugucauugccucauucuuaagaaguugcuuuuuuugcuuuugaauauuuguggguguuugacacaguguaugcuuaagacagaugaaaaaaauacuaauaauaguguucaugugagcaaguucauucugaaaaaggaaaugcuuagaaguccuugguguucuucuuuacacuugauacgauucuuugugugugugugugugugugugugugugugugugugugugagagagagagagaaagagaaagaaagagaucgaucauauccauucugaugccuucaguuuccccucucaggcuuuuuagucuguaucuccaggcuagaaaauuuucuccaguccagacuuguauuuccagcuacuccuugguccggucccuuucacagguuuccugccuuuagggaguggccccaucaucucuguuguggccugagcuucauugcuuugggcccuuuaucuuucugcuucuaacuccuugggaguuuuuuuuuuuuugguggagucucacucugucaccaggcuggagugcaguggugugaucucggcuuacugcaaccuccgccucaccaguucaagcgauucuccugccucagccccccugaguagcugggacuauaggcgcgcgccaccagucccgucuacuuuuuguauuuuuaguagagacaggguuucaccauauuggccaggcuggugucgaacuccugaccucgugauccacccgccucggccucccaaagugcugggauuacaggugugaaccaccaugccuggccucgggagcuuuuugagucugugcugcucucuccuucccccaucucggcucugcucuuuccuuucuuccuauugugggaaugucaauacgucucugucucuagcguggccccuguggacccaccuuucauggagcugccugcaggagcugguagugugcucccuuggaccccacagcagaaaauggaagcucucggaucugaaccugcccagcuuuucucuaguggcgcccucuuuccuccucccaguucauggggagcugccugccgugaaugcgcuguguacgugcaccucucugugcccuuucugcacgggcuauuuauucucuuggcugggagagcccuucuuccucuugugauucuggccaaccccuucuuuuugcucucucaagaguuggcucagauaucacuacuucuuugagggagaacuagguaucuccuccucauucccacugacagccuuaaucuccuauaguacuuaccacacugaugucauaauuaggcaaauaucuaucuucuuuaugucugcgagugcauucuguuuaaaacugugacccccccuccccauguuccuuuccuugcucugcuuauuuuuucucuugcacuugucuguuuucaacauacuguaugauuuuuuaaaaaaaauuuuauuuauauuuuuaaaguacagaugagaucuugcuauguugcccaggcuggucuugaacuccugggcucaagcaaucugccugccucagcuucccaaaguccuaggaugacaggugugagccacugggccuggccuauauuauguucuuauuucuaauguuuauuaucugugcauccugcuagaguguaaacuccagcaggacagaaaucuuugucacuuuuguucacugcgguauugucgguaccuagaacagugucugagcccuagaaaaugcucaaaauuauuuguucaaggaauguguacuuguauguugagggcccagcucacaguaggccuuggguaaauuaaacugaugaugaacagguuauucuguuagauuuucuaggggcugucugacuaugccuuguuuugguacuuaaaaguaaauauaauuaaacacuuuuuaagauuuuuaugcauucagauaaaauguuuuguuaacagucugguuuacuguauuuauuaguuucagaugucggagucagccagauguguuucaugccuucucauauuacuccccuuucuugcguaaaccaaaccccaacaacuaaauaaauaaagauuucaccaaaggucauguuuucagaauaccaucuaaauagaggcuaaaaucacgcgugacucauggcaacaguuuuuuuuuguuguuguuguuuuccaagacggagucccacucugucacccaggcuggaaugcaguggugcgaucuuggcucacugcaaccucugccuccuggguucaagcaauucuugugccucagccuccugaguagcugagauuacaagcacgcgccaccaugcccggcuaauuuuguauuuuuaguagagacgggguuucaccauguuggccaggcucgaacuccugaccucaggugaucugcccaccucagccucucaaagugcugggauuacagacaugagucacugugcucggccuccaugccaacaguuuucaaacauuuuugcucauauaggcuugaaagaauuuuguaaaacaauguauuuuuuguauugauucugaaaaguuuuuuuccuacauguuuacauaguugcauaacguguaauuucuaggauauuuuaaaauguugacauuuaauaauuaaacuguugcauuacuuuuauauauguauuuaaagguacugguggacagcaauuuguuuccuaccaucaucuucuaaaaaauugaaugaauucuuuaacuguuuguugaaguuguauuuccauuguacucacuccagaauuuugucagaauaaaaaauauuuuuagacucgaaagucuuauuaaccgauaacccucucauacuucucauacuuuaaaaauauaucauuuuaaaauaaagaaaguuaaaaugucuugugaccaugaggcuguguuaauucaauucagaaguaaacagaauuugucauugccauuaucacauaauucaaacuaauauaaagguauuacauuuugauaaaugauuguuaaaacuauuaaauaguuauuggaaauguaucucaaugaaaugcauaggacuguggcuuuuuuuaaauuaaauaaaugagcucuucauacaugggugaauauugauuauugccagaauggggauuuagcaucaauuuuuuuuuuuuuuuuuuuuuuuugagauggagucuugcucuaucgcccaggcuggagugcaguggugcgaucucggcucacugcaaccuccgcccccuggauucaagcaauuccccugccucacccucccuaguagcugggauuacaggugcacgcuaccacgcccagcuaauuuuuaaauuuuaaguagagacggaguuucagcauguuggccagcuggucucgaacuccugaccucaggugauucacccgccucggccucccaaaguguugggauuacaggugugagccaccacacccggccaauucuauuucauacuuuucuuuuuuauugugauagagcacugacaaauccuaauuauauaaauaagagauaggaaugggaaguguucuguuauugcagcaucacucagucccuugaacuguuucugaguuaugugucaaaaaucaaucuaccaccaaaaauuauuuuugaugacaauugguuagauccuccuucaguauuguugaaagcagauaaacuacuagauuugcaaaagaauuuguuuuccaguugcuauuuucuuaacacucaaaccgacccuuuguuuggugacagggagggaagugagcugugcuaagguuugggaucagugagcagguguguuucuccuuuuaaugugagagaaggaagauuuugaaagggaagcugaaaaagaagaauuugcagugucauugcagacaagauuucaggcuggugguuuuaggaugaaauacauaaaaaaauggagucuggccaggcacaguggcucaugccuguaaucccggcacuuugagaggcugagaaaggaggaucgcuugagacuaggaguucgagaccagccugugcaagaaagugagucccuaugucuaccaaaaauugaaaaaauagcagggcaugguggcuugugccuguagucccagcuucuugggagguugaggugggagguuuccuugagcccaggaguuggaggcugcauugaacuaugaucacucuacugcacuucagccuggguaacagaguaagaccccaacuguuuuuuuugagacagggucucgcucuguugccuagacuggagugcaguggugugaucucgguucacugcagccucugccucccagauucaagcaauucucccaccucagccucccgaguagcugggauuacaggcacaccaacacaccuggcuaauuuuuguauuuuuaguagagacagaguuucaccauguuggccaggcugguccugaacuccuggccucccaugaucuacccuccuuggccucccaaagugcugggauuacaggcaugagccaccacaccuggccgagaccccaacucuuaagaaaaagaaaauugaggcuguggaaaugaauuuccuuaaaauuaucuguggaguaagauugguaaaagguugguaauuuuugauccugggugaugaguaugugaagguuuauuauacuguccuuucuacuuuugaguauauuuuaauauuuauauuacaaaaaggaaaaacaaagcaaaaauucuuuguggaaaguuuuacuauguaugcauucaaauuugaguagcgaccuuuggugccuuaacacuguuagucugaguguuaacaaaauaaggcauucuuuuagguugaaccagaugaaauuuccaauauuugaccaucuugauguauaaaacuggcacuugcauaugguuuaaccuaaucuuuuauugcauauauuaguucuucccucuccaucaguuucauuucacuaacugggauucagugagaauuuuuuuuuagguucucccauucucagagaucauccuuuucaguuaagauuuguugaaaagaauuuuaguuuguugucaguaugguguuaggugcuacauagacugaguuaaacaggcagccacuucuuaccuuuauuguacuaaagacuuaaguuauguuuuguucagugucuguucuaaguguagacaaacaaaccagucaguucauuuagcaaggugccaagugaacggagcuagaauauuuagggacaggcaggugaagcuuucaccugaauaguaccugagaaguuggcuuuauuuauuuuuuuuacuguaaaugugugagguagaaaaacaaggcuguccagcacguggcaguucugaggaugauccuugaggggugaugucugccuccagucuucgcugaggagaaaagcaccccuccucccccacccacagcaccaugggagagaggcccuggaaguugacuuuauauagaaguuaaucuuccagagagcucagaguguaucucuguguguuuucaucuuuauuaugaaaucugggaauaacagacuggagauagguauuguucuuaaugauuuuuuucuuucuuucuuuuuuugaaacagucucacucugucacccauguuggagugcaguggcaugaucucagcucacugcaaccuccuucuccuggguucaagcauuucucaugccucagacuccugaguagcugggacuacaggcguccaccaccauaccuggcuaauuuuuuuuuggauuuuuaguacaagauggggguuucaccauauuggccaggcuggucucgaacuccuggccucaagugaucugccugccucaggcucccaaagugcugggauuacaggcaugagccaccguacccggccaaugauuucuuuauugagaaggagauuggcaucuagagaaguuaagugacuuaaucuccucucaggguaagucagcauuggagccagguucucaugguuucucaguguguacuucauauccuagauuagugguucucagagcaugcuuuggggauccccaaagguuccugagaccuuuucaggggucugugaggucaaaacuaauuuuauaguaauacuuaagacauuauauguuuuucccucucccaugaccguguuuuccagaaucugcauuaccuguacuguugcaggaaauugaagcaaaaguggguuuugagaauccaguugcuuucuauuaagccagauguuaaagagauguauaaaaguguaaaauggugccacuuuucucacucauuuuuuugaggaaaaugugguuuaaaguaguuuaaaaaauauuuacaauuguauugaaaugaauuaauaaauauuaaaaauuuucccauuuuuaauuuuaaugugguaaauauugguagauauaauccauauuuuuaaaaagcucuuugagauccugaguaauugugaaaccaaaaguuucacugagaccucuggguuucaguuucaccguucucaaaaagaggccagauguuagguugcagaggaccacaaguugucauucgaugugucccaagucauuugaaaauagucuguuuucaguucuacaggauagauauccacaucauaaaaaccuuuauucaauuugcccuuccuugguuucuuauauguaguuuaagcaggugaccaaguauuaacugaagcuaugucauuuuuauuuccccauuugaaguagaaaagcagccucaagugaauauuugaaggaucuccaagcugaauuguuuguccauguuuuguguaagagcaauaucaguuggacuucauuguuucucucguggauuuuuggauuuguaguuucaguauacauuuaaaaauuuuauauauauauauuuaaauuuuuuucucuuaaaagaggucaugcuaaucuucucuguaucauuccaguuuuaguauauaugcugcugaagugauagcacuucaguguacauuuuuauuaagagcuuuuucaguaagauccuguauuguauagauaagagaaccuuaaccuuauggcugccuuauacuuuucuuugaaaagguuuaaggaccuuccuuaaaaugaguauuugcauuuauuuggcaauuaaguuuuauaggcaauauaucuaauuuguuuuucccuuuuuuuucuuauucccucuucuccucuccuucccaucuccuuucuccauuacugcuuuuuuucucuucuccccuccccucuuuuaauugccauuaugaccuugggugaaauacuuagucucuauguaucuuggauucuccauuuguaaugugugauguugugaaauaauuucuguaaaccacauagaacauugccuggcugacuaucaaggaucaauaaauguuagcugcaauuuuuguuguuguuaucauuaaagcagguuggcaguuccuggaauguauugaguacucaauaaauggugguuauuuauauuauuuaauauuacuacauugcacauuugcuuuuagauggucuauugaguuuggcugaggcagauguauaguagguguaguaguaguauuauaugcugucuuaauuuuuuaaugagaaugguuuucuuuuuuuacgaaaugaugcagaugcugauacucuauggcuguaauccaaauauuuaguagguauuguggccuuuauaagccuacuccugagaacagcccacuaauuaaaugggagguguggagauuugguccuuguaaaucaccauuuagaaauggagauguauuggauucauauuuuguguguguguacguuuguaguaaagucauaaaacagacucuacuacucuacagucuaagugcuuccucuuguucuuaguuuucagcuguuaguggacacuagucagguauaauaaaguagcuucuuauucaguuaaguuuguguuaaauaugugauccuaucugugaaugucaugaauaaguaauuuauagaugauuuuaugauuacuaauuguuaauggaucuaaaggccuuaaaaaucuaaggauagaagaacagugaucaccagcaguauaggguucucugugcugguaauacauccauauaguagggcauugaaugccuaaaaacuacuaaucauugauugauuaauaaaacuauuaguuggguggacaguagagucugauuuagaagucagaguaugguaugugauauuugaacugauugagcagggauuugaagccuccuuauuaaaggauauguuauuaauaauauaaacuuuagcggaaggaggaguggucuuuuuguagccuauaagauauguacuugaauauaaucucuguuacugaaauauacuuuugagcaaagcauuuaucuuuggugaauuuggguuuuucaauugcaaagugaguaucaaaccuagccagcuuagcucacuggguugguaggaucauuaaaugaaauaacucauuuugauccaguguugugccuuccaugagaacaacaacaacaacaaaaagcaaaagggggggaaaaagaagaagaaauaauacauuuugagaaagcuugaaaaacucgagcauuauacagguuuaaguuagcauucuuccuacuuucaaaugugagggcauuguuuguggaauauucugacuccagcuuguguuaaugcuuuuacuuuuuuuguuguuguuuagguuuaucaaugacagauagaagauuuaaguaucauaauccucuauuuuuauggccaugaauugaaaugaagaauguauguauucauguuugaauauauagacaugcauacaauagcagugcuguucaugacacuguaguuaagcauuugucagaguuuccacuguaaacuucccuuugaauguuuuuucauuuuagcuuggcuuuccuguggguuaaaauuauagggccugaauauuuuuggauggaaacuuuuuccuucuuuuuaauagggcaugaaugcaugcuauuuaaaaaaacuaucuuauguuuuuuaauauuuuaucauaaaaguuuuaaaagccacuucuaggcaguguuuuucuguaaaucauuaaguguguuaaauguugugacuucauaccuauaaacaguucuucuuugccuuuguaguuuuuccuccaaaaauuguuagucuucaauguauuaucuaaaugaaagauuauaaauaauuuuuguaaacuaauuguaauauauaaaaaaacagugauauauugaacaucuggauauccaucccaaguuaagaaaaaguaaacugccuagaauuuauaagcuuccuuagacuuucaucacuaaaaguguucauuggucuuugauuuaaguauuuguaaaguguguuggaaacaggccaggacuuagacugccccuuuauauccagacacccccuucuaauggaugucaugugguacguguguucugguuucacgugacggauugggugacuccgugacccaagaucaucccaucuauaggcaagauauaauguggcccagagcuucuacccaacagagaagagagugaaaugcuguuccagcagaaccuuucucuagggaaguuugaauuugauaaagaguugacgaaggcaggaauagaugcugaaagacccaagaaaaagaagcaaagaagugauaagccauguugauagggcagggagggugagguguggguugaucugccuugaucaucgcuucacugaaauuacucuugucagggccaccugcaugucacaugucucucagcaacguuggacacuuguccacauuuuccuuguagaaacauacucuucuuuggcuucugugacccugcucagguuuuccuuuugccucuggcuguuucuucucauucucuuagcuggcucuuccuccucuacucaacuuguaaguguuggguuucuucagagcuccuucugcuucacuuucugcacucuugccguaggugaguucauccggccuauuggcuuuaagaccacuuauauauuaccauuuauauguuguugguguccacauuucuuuucuuccuuuuuuucccccaaauaugacauuucuuuugcuuuucuucuucuuguuuuuuuuuuuuuuuuuuuuuuuuuuugagaugggguaucacucuauugcccaggcuggaguacaguggugcaguugugguucacugcagccucgaccucccugggcucaagccauccucccaucucagccucccgaguagcugggauuauaggagcacaccacugcgcccagcugaggugcccacauuucuaucuccaccucacucuuuucagacuuuggucuuguauauacaauacauuuccauguauaugucuuauaaacaucucuaauguaacacauugucaguguaacacuugauuucccccaccaaacuauuucuucccucuuuuacuugcugacuccucuguucacccaggugcucaaaccagacaacccggcucccacccacugaacguggagaaguggggcaagugccaagagucaccuuugaucccucucugucuguuagucacuuuucaccucuguauucuccccccagaguaguuucuaucagcaagcacaauugauucuaccaauucuucuuccaguaaauuaucucuaauuuguccacuuugucuccaauccuucccacgauucuguaacaguugccuccuauguagcuguagucuccuaacuggugucccuguuucuuaucuugccucuuuuccauucauucaacucauugugaccagagugaucuuuuuaacaauacaaaucauaugaaugucucucccucagguuuuaauaauacaaaccaugugcucacuccaacuuuaauacugucaugauucuuuacugaauccggaauuaaauccagguuccuucucuuuaccuuucacuauuuucuuuucaccuuggcuuuucuauugcaauuuuucugacaucacuaauuagaauuuaauguuaaagucaaaugcauguggguuaaaacucccaaguuucuaaaaacuuuaagagacuugauuuucucucuccaugucauccccuuuuccuguuacucuucuucauuuaauaaaauccacaccaaaaccaaauuacaauuagcccugucucagccucuugagucugauugcaucagacauuucucagacuuccuagagagcuguuuugguuguuucauuagcauuuagaggcauuucuuuaaaauuacggaagguuuuacucuuguauaucuuuaguacacuguuagcacugggaaaugucucagagcuuuacuucuuguuuuugcgggcacuucaucaucuugguucucugucccuuccuauccugaguuuucugccucauuguugaguuuucuuuagcuugucucuagcugccccaugguuccauuuuuaaccuucuguucuucguuuuccccuuacucagucauugagcuuaucuguuccuuugauuucaacuuucaccuuuaugggaaaacucuggaaucucuaccguuuaauuuauagccccuuguuuccaguccuauuucgagucuuuuucucccuuggaguuaccucacauucuguuguugccacuacaguucaugaacuuccuugacuaacuucucugucugauuguuucauuuuuaccaacaguaucaucauucuuccaaccuggaaacauuaguaaucuuugacuaucuuuccuuucuguuauaucuaauguaauuuaaaaaaucccuuuguuucuuaccuucugguaucucagcuucuuuuucuucuauucuuccacggccaucaacuucguauaagcccucauaacucuucauacuugguucugaugacauuguuuuuggcuaauuugauugccucccuucagcccccgcuaaaacacuucucauuauguuugcuccugucccacauuucuguguugucagccacaugaaacccagguuacccugcaguuuguaaaguccuuucuggccagguauguccucauuccucccucucauuucccacucuuucuagucaccugucuuccaugcccuagacaugcauaucuucuuauaauuucucccauaaugugcucacucucaccucugugcuguucuugucuaaaauaucuuccaccuuuccuuuguuuauuccuuguucuauucaugcuuccuuucugucccaucacuagcugaaagcaauucaaccuaacuggcuuucuaauugaccuuaggcugugcuggugauaauacagguuugaacucucaguuagacuccaaaucauaugcaaguucaacaaaugucagguguucaaaacaaaaugaaacaaccaaacuucugugucauuacauuuuccugaacaguaaauuaaauccaaacaagguugaagucuugaaguaagccagcuuuagugcaaaggagaaggcuggaagguuagagaagacuuugaaucaucuuuugagagacuuaacacuaauguaaagggguccuuuauuuuauuuuuuuuugagauggagauucacucuugucacccaggcuggagugaaauggcgugaucucagcucauuucaaccuccgccuccuggguucagccgauucuccugccucagccuccugaguagcugggauuacaggcgccugucaccaugcccgauuaauuuuuguauuuuugguagagaugggguuuugccauguuggccagguuggccuugaacaucugacucaggugauccaccugccuuggccuccaacagugcugggaugacaggcaugagucacugugcccagccuaagggggcuuuuaaauauuaacagaaauaacaggccagcuggagaaucuuucuaacccuugguaguugcauuuugcuugguacaaagaggagauagaugacagaaugcuugucuuccucaaucuauguuaaagagucuguuaggaagauuaggaagauuaacccuuccagauggucccuccaguguacguuguagauauuagaugaaaacaaaaaugaucaguagugauaagccagcucucauuagucuuuagcagaggugggauaguguacaggugccagauuguggaggucugaagcucagcagggcccccuuuccagcugugugauggugggcaaguugcuaaauaucuuugggccaauuuuuauauguaaaaauaagguugguaauaccuaccucacagcauuguagaaaggauuaaaggaguuaauacauguaaacuccuuauaauagugacugccacagaguaagugcuuacuaaguuuuuacuauuauuauguauacaugauaugacugggaagggaugacucauucaagauuuucagaaacuauuuauugugaaacaggaaauggcucuuuagaaugcguaucuuuuucuaauaccugaccugucuucagugacucuuguuuauuuuggguuauucauucauuaauuaacaaguguauuuugacauugcuuauagucaagauccugaaagaguguauugucuguaggagaucaugauauuuucaauagaggauagauucugaaaacuugugagaguuguaugaaugagguucuucuggcccaucugggucuaugaacaaucuauacauaagacaucugguuuuaucagaaauuugaaacuuacgcauuuuuauguguacucuccauucucaaagagagccuggugcguguuuuugcagauuuauguaauaugagaguuucuggaaucuagaugaaugucauucagaguggucucucuugaacuugccccacuuggcuuuuuucaaagaaauguugucaucugcaugcuaugcuugcuuuggacuucagggugggguaaaaaauggcucagaagcuauugcuuggucaccuuuguaauaucagggugcauuaaugguacaagcaagcaauguagauugucaaaauuucagaauuagacauuuuaucuuuuuauuaggaugcuguaauuuuuuuuuuuuuuuuguagagacggaggucuuucuguguugaucuucccaccucaaccuccaaaaguguugggauuauaggugugagccauugugcucagccacguuuuuuuuuuuuuuuaaucuguugauaaaggcuuguuuuuaugauccugugaaaguagauuaggugucaauagagucuucagauaauuugcuuguuuuaugcuggaaauuccuauuaaaauuaugcaauuggaugaagccauuuuguuauugucacuaugaaguauuuuuuaauaauauaaauauguucuuccuagagauaaccccuuaacccuuuaguagacaggauaaucaaucaccacauuaucagagggcaagucgguuuuuuuuuuuuuuuaaacuuauggaaagguuaugagugcagagugugauuguggaauacugugugccuugggguuggaacugggcuauaaguagggagguaggaggcuggaugcaggggcucacacuuguaaucccagcacuuugggagguccaggcggcaaggaucccuugagccuaggaguucaagaccacccuggguaacauagugaagcacugucuuuacaaaaacuacaaaaauuagcuaggugugguggugcaugccuguaaucccagccacuugggaggcugaaaugggaggauugcuucagccagggaggucgaggcuacagugugcugugacugugccacugcacucuagcgugggugacagagugagaccuugucucaaaaaaagugggggguguggggagguaggagaugaggaggacaaaaaucauuguuuauucuuuauaauccuacugccacauuuaucuguccaaauaaauggagaggaggaaguauuucauuuugguguaaaauuaucccuucugguucuuuguagugaaguuguuuuuacacguuagccauugacccagaauaauaaaacugaauaucuugcagccuugguucucuuacagguaaaaugggaauauuaacauguauuaggcaggaauuuuguaagauuuuaaugggaggauauaaugaaggaccuaagcuggagguccauuuccuugucaggugcuuuuuucuuuucugucucucaacuugguccaugaaauucagauacuuuacuugauuuuuuugaaacggagucuugcucugucgcccaggcuggagugcaguggcacgaucucggcucacugccagcuccgccucccggguucacgccauucuccugccucagccuccugaguagcugggacuacaggcgcucgccaccacgccuggcuacuuuuuuguauuuuuuuaguagagauggguuuucaccguguuagccaggauggucuugaucuccugaccucgugaucagcccgccucggccucccaaagugcugggauuacaggcgugagccaccgcgcccggccacuuuaauuguauuuuuugccauuauuaauaggugcaaaucuugcuucccccuggacuguacuuuuuuugagaguagauccauuuguuuucauucuuuacaacauaugcccuuauaauaucuucuuguaccuuuuuuuguaauguaaaauguuuuaacuuuuauauuuaucuauauggucauuuaauuaggguuucucuccauuuggucuguaagcuucaugaaggcuaagaacaugaaguuugguuuugcuuaauaguguauauuuauagccuagacuagugccuggcauguaaaaaguguucuguaaauauuuguggaaugaaugaaugaaugauuaaguuaaacaugguagauucuaaacaaauucguguugugggaagguugaaaccaccuaucauaucccuuccagacuuagucugaacccuucuaggaggcaauuaaaaguuugcaaaauuuuaguuaaguccuuagaucucuaaauaacagaguguguggggaaaagaaagguuuagagauacuuugaagugguuuaguauuuuauguuauuuuagugggagguuaauacuguuuguuuugaauauguuguaaagaacucuaaguguaaguuacuauuauuacuuuuaguuaguauauauaaguauuaauauuugugaguaugauacuaauuuaaaauuuuggcuccaaggacaaagcugucgaacauugcuuguuuauuuauuuccuuugcacauuuugcauaaaccugauuauaucagaagaagccuugaugugugagacccaagugguauccuuguuuuggcagugcucauccagauuguugcagucuucauaaauucuagcuucucugucccagaugcucuguuugucauucauucuuccauccaaaugcuaacucucuucacccuucaggaguuugacacguugcugaugcauguacugauagcugacucaucucaccuauugagucagcaucuuaccuuuccucuaaucaaguuacaacuuuauuuugaaguuauuucacuggguauuauauuaguaggucaaggucaauauuauuuucuucaaauaugcuuacacaaccagacauaccaaaaagggaggggagaucuauauguaucaacaauuuauauuguucauuuuugaaaaaaaagacuggcauuguguuucacacaaugccuagaauauggaaaauauucaguaaacauucugugucuuaaacgcucgugcuaucacugugacaaagcuacuguuuuuaggcucauuuuguaaaagauacuaaggcucagcagugcuuuuuaacaacaacauuaauuuagcaguuaaaguuuauugagcaccaaaugugucccagauacucuucuauguguuuuuauuuuuauguacucacuuaauucuuaaguaaacucugugggguaggugcuguuauuauacccucauuuauagaugaggaaacuaagggcuagagacucaccuaagcuuuuccagcuaggaaguggcaaagcugaccuuggacuccaggcagucuaacucuguagcccaucgucuuagcugucacacuauacugcccaaaauugcccagcuggagccugauuggaacccagguccccugauuucaaagucugugugugugugaccccaaggacaaccucagccaucuggaagaaugcagaaugggcuuacauuucuuuuucaaguucccaauuaugcugaaagaaaucgaauucauuugacaucuuaaacguuucugugauguuuuuccagaauuauaacugacagacuuuugagauaguggaccuaguugccgagcuuaguuuuaacuuuauuauacuuauuaaggucaacucuuauuucucauauguggucuggcuccuuaaguggaagauagaguuauauaauauguuuucugaaagggaaagucauuuucaguacaaucugaagagaaaauguuuguacuaccccauggcauguuuagcuaaacucuggguuacaguauuagacauagaaugcugaauuauaucaaaauucagaaaaaggcugugcuuagaauugcacuguaagcaugcauaucuuuagguuucagugacugucuuacccuuggagacggauguuuuguggcuaggaaaccagcagcauagaaggaacauguuguaaauaguguuuuuuuuguuuguuuguuuguuuuuuuugagacggagucuugcucugucacccaggcuggacaguggcaagaucucggcucacugcaagcuccgccucccagguccaugccauucuccugccucagccucccgaguagcugggacuacaggcgccugccaccacgcccggcuaauuuuuuguauuuuuaguagagacgggguuucaccguguuagccaggauggucucgaucuccugaccucgugauuugccugccuuggccucccaaagugcugggauuacaggcgugagccacugcacccggccaauaauguuuuuaaauacuuuucuguucugaaaguguuaagcuucccagacacguucgcuguccuuuuuaaacucucugcauuacuguucuccaaguuuugauuuuggagucauauacucaaaacuguucauacacacauacauacauacacauauguauguauacacauauguauacacacauacauacguaaguacacacuuguaaguuucuccgucuuuauuguuuuaugcuugaauaauucugcuuuuauacacacgaggaaauaaagcuuugaaauggguuucuugucucuuggcaugguauuucagauuugaauuuuggauuuccucaacuguucuauguggacuuacauuuguauuuaacuauauuaauuaaguaguaucuuuuguaugaagcaugggagagcuucacaauuaggggacuguguacuacaugccuguguacuacaugccaucccuggauuuuacugcugagauuaugacuuuaauuauaaauuuacacucuuuauuacucuugggauuagaagcuauuccacuguucucaguccugugucagucucaggagcuuaagcucucauacuuuaaaaucccaacagagguucaaaaauagcaucucuaagcuggcauugcaacauuggauugacucuuguuguuguuuuuuuuuuuuuguauuuuuaaaacuuuuuuuuuuuaaguuucaugaugucuuugaucaacuauaaauuaugaauuaacagauaagugggcuguuaaaauagcugcagguucauuuuauucugaaacaauugguguugauguuaaucuucaaaacaaauggaaaauacauaggccauuuuauccccuuuagaaguaaucucuuggggaaggacccucaauuaacugaaaugcuugaaaauaaugucuccuuuuauugccguuuuuuuggccggguuguggggagggagggucaauugaauguuacaugcuugcugaaaaucuuuaauuccauuaacuuauuuccuuaccuuauaagcauggcguaaauaaaaaauaaucuuuuuucuugaagauuuuuguuucucauacuucugaaccugacugaaaauugggcuucagugaugcugacucucaggcacauccuggaaauuuguuccguaauuccuuuuuaucaaauuaggauuuuaugauuugcuccuugucuuaaaagacaagugcagaagagaaguuaugguuauuugagaguucuaaauagauggccuuuguuuaauucaaguuugguauuacuagaauaaaauuuuaacaaaaaauuaauguuucuuuaaaaaaaauuuuuuuuugaaacagggucuuaccgugucaccgaggcuggagcgcaguggugcaaucacggcucacggcagcuucugccucuugggcucaagccauccucugaccucagccuccuaaguagcugagacuacaggccuggcuaaucuuuuguuaguuguuguuuuuuuuuuuuuuuuuuuuuuuguagagguggaguuuuaccauguugcccaggcuggucucgaacucuuggacuccagugauccuccugccucagccuuccaaagugcugggauuacgggcgugagccaccaugcccggucaaaaauuuaauguuucuagaaauacuucagaauaaaauuaaaaaauuguuuaaaacuaauuuugaaggugugccagaaauagcaaauauaaguauuucugcacagaagauaguuuuaauaaguuaugaaauaggaaauugauuccauacaguauuuauagauacuugauaaauauuugucaaacgaaugaugacuuuuuuguggaaagcacuuuccacccuagaaaugauuuuucauuuaaucuuuacucaacccugugaaguacauuuucuuuuucuuuucuugucuuuuuuuuuuuuucuucuucuugagacagagucucacuaugucacccaggcuggagugcaguggcacaauuucggcucguugcaaccucugccuccuggguuugagcgauucuccugccucagccucccaaauagcuggaacuacagacacaugccaccacaccuggcuaauuuuuauauuuuuaguaaagacgggguuucaccauguuggccaggcugguuuugaacuccugaccucagguaauccgcucaccucggccuccccgaggugcugggauuacaggcaugagccaccgugccuggccagaguauauuuucuuaauuuuacaugcaaggaaacuaaugcucagagaaguaaguggcuuguccauugucaguaaacaguaaaagugugauucuaauucagaaccagauuccaggccaaaguccucaccguguuucacaagacccaagaugaucuucugcagccacuuguccuuucuucuucuguccuuuucuuccccacuuuccacuccagcuccagccacauucacuucuuugcugaucaucagauucaccagcaugcuccuucuuccugccacaguaccuugcacuugccauuucucuccuugggacacucuuccccagacagccuuggcugacuaccccacuuccuucaaguauuugcucaaaugucaucuuccaggugaaugcucuguuuaacauuguacccuucaaccccagcgugccuagucccccuugcccugcacacuauuauuccccauagcauacaccguauaacauguuuauuauuuuuaguuucuauuauuugucucuuccugcuagaauguaaagcucaggacuuuugucuccucuucauuauguuaucacaguagucccuggcuguugguggguguucaaugaauauuuggcggaucagugaaugauagagugagugaaugaauagaggagcccauucccuuugcacuagaccuucucauuuuucauuuauaaauaauaaaugacaaaauuuucggguuauuuugcuauagagggcauuuccaaauuaugcuacuuaauguuguauacucaucuucauuuugaauuuuuucccuauuuuucucuuauccuugaauauaaaccauucuguuuauuuuaaaaagucaauucggccgggcgcgauggcucacgccuguaaucccagcacuuugggaggccgaggcaggcggaucacgaggucaggagauccagaccauccuggcgaacacggugaaaccccgucucuacuaaaaauacaaaaaaguagccgggcaugguggcgggcgccuguauucccagcuacucgggaggcugaggcaggagaauggcaugaacccgggaggcggagcuugcagugagccgagaucgugccacugcacugcagccugggugacagagcuagacuccguaucaaaaaaaaaaaaaagcgaauucgaguuuuaaauaaguuguuaaaauaaggcauuaccuuacuggauauuaauaagggaacauaguucagggaacugaggaacuaaugcauuuuuuuuugguuagguucuuucagauaagcuggcucuuuucacuccuucuuauauuuauacauauugggucauuaaaaacugucuugccuguaaucccagcacuuugggaggccgaggugggcgaucacgaggccaggaguucgauaccauccuggccaacauggugaaaccccgucucuacuaaaagauacaaaaaauuagcugggcgugguggugcgugccuguaaucccagcuacucgggaggcugaggcaggagaaucacuugaacccaguaggcggagguugcagugagcagagauugugccauugccuccagccugggugacagggcgagacucugccuaaaaacaaaaacaaaaacaaaaacaaaaaaaccaucuuaguuuuuuuuuuuuuuuuugagauggaguuuugcucuuguugcccaggcuggagugcaauggcgccaucucagcucaccacaaccuccgccucccagguuccagcgauucuccugccucagccucccggguagcugggauuacaggcaugcgccaccacaccuggcuaauuuuguauuuuuaguagagauagaguuucucuauguuggucaggcuggucucgaacucccgaccucaggugaucugcccaccucggccucccaaagugcugggauuacaggcaugagccacugugcccagccauaaaaccaucuuacuuuuaaaauuugcauuucaugacuugauauuauuaauauacuaggaaauaauuuauuuuauuaaauacauuauaucaagccuuuuccucuauucuuuagucuaauuuuauuucuggaggaauaaaguuauaauuuaaaaaugaaaacauggggaaauaagaugcaaauauguagaauuuacuuacucaacuaacauuacguaccuacuauauucuaaaacuucugauacgaacaguuuauuaaaacgugcaaggcagguguagugcugguuaaaaaaaaaguugcaguauaauguagcaagugcuugaauggagguaugugcaguuucaugggaauuuuguguuaagaauuuuaaggacugacauggcugcucuuccuuuacaauugcagaacguaugauuuaucuucucagcuuuuaugaugaucuacaguugaaggcugggugcacuggcucacaccuguaauccuagcacuuugggaggccgaggugggcggaucaugaagucaggagauugagaccauccuggcuaacacggugaaacuccaucucuacuaaaaauacaaaaaauuagccgggcaagguggcaggugccuguagucccagcuacucgggaagcugaagcaggagaauggcgugaacccaggaggcggagcuugcagugagccgagauugcaccacugcacuucagcgugggcaacagagcgagacuccgucuaaaaaaaaaaaaaaaauacaguugaaaucgguacugucauuacagcuagaauucuguuguccgugcuucuagaaaaguauuggaagaaaggaauaauauggcucagagauccccaaauacaggcccuuggaaaaguuguuggcaguacugggaaaagugaaaaauaagaagagaaaggaaggucgagagagaauauaccacucuauguguguaugugugcacaugcauguguguguguguguaugugugagggguaauugcuaacccuccuuuuuauuuuuauuuauaucuuuuugagacaaggucucacacuauuaucuaggguggaguacaguagcacgcuuauagcucacugcagccugggcugaagugauccucccaccucagccucccaaguaccugggacuacaggcacacgccaccaagcccagcaauuuuuuuuuuuuuuuaaauuuuguagagacgcgaucucgcuguguugccuaggcuagucucaaacaccuggcuuuuaaacgauccucccaccuuggccucccaaagugcugggauuuugggugggagccaacgugcccagcaccaacccuccuuuugaaaggaaguauugucuuuuauucuaugaucguucuuuaucuucuuuuguuauuauaaaggugcuuuauuuuuaugaaauuauagugaaaauaaaugguggcuauguuuuuaaugccuuuaccugaagaaaaauugacaaacugcuuuuuuuuuuucuguaauuuuacuggcacguaacauccucaaaagagggaaccacugaaaugcaaacuguagaauacuguauauaauucuugcagcucuuuuuuaguauagccugucaagcucuaggaauuccucauauucaaaaggccucgguucuuucccuccuggcauuacugcccuggaaauaagcccuuaggaaaugaauuacuaauaaagacauugacuuugucagaaccuuugguggcaucuguccuguggugaguuugguggcaggaaaauaauuaaaccucuaaugaggaguugaucaguuuuaaaauauuuuuucauguguugacaaguuucaguaaccaacuuggcauuagaagauaaagcaugagggauaacaugcaguguuggaaacacugugucauuuaucacugugugcauuuaucacugugugucauuuaucagugugcauguguguaugugugcgugugaguauauuuucuauuucuucugauuagaucauagugucaaaauaacacgaaagcccugaaucauguaauuuugcugcuugaagccauacuaguuuguacuagugguggugaccuuugguuuuuauuuguaaauuggagagcauauuguuagcuuuugggaaagggaaacuggagagcuucaugacacaauaauaauaaauacauguucguugucucauuugggaagaauaauuaauauguuauuauuaucuaaaacuuaaaccuaccugccuaaacuuguucacuagcuuaaggcugauuuuauacuguuguaaguuuuaaaacgugaauauuuguauuuaauagaaaagucaaccaauuuuucuuuuagacugcaacuucucuuaaacaaauaacuaaccauagcaauggaaguauauguacaacucuaauggggguuaguugcuguuauuuagcaugaucaucaccauuaucaucauuguuauugguaugccccuucccuccuccgcagcaagacuguuggggcaguaagacuacugggguucagauacuagcugcagcccuuccagugugucauguuggacaaaugacuuagccuuucugggugucaguuuccucauuugaaaaacugggauauuaauaguggcuacaccuaagauauucugaggauuaaaagggauaaugugugucaggagcuuaguacagugcuuuaugguuguaaguguucaugauuguuauugucucuauucuuuuuaccuggaaauuucagucaauacccacaccuucaucucauccuuuugacaguauucuaucugugcuagucauucuaugacacguuuugaaccuuuaaaaaacguguaugcuaauaaucagcaaaguguuucucaagcucucuaacagauuggcaagauuucuaaaagcagccaacucgacauucaccuauuauagccaaggccaagaaagaacgcuuucacuguuguaaauguuuccagggaccuuccuuagcuuggaaacuaaaaguuuucacugcuagcuuuaaauaauggagagaaagaauuucaaaggaggaggggaugaaagaaggauuuuagagugcuuacuuuaaaaacggugguuuuuaaccguagugacauacugaaaucacuggagucacuuuuauaaaauacaaaugcuuagcagugaaauaucacaucaccaccaccaccaccaucaccaccaucaucaacaacaaacaucuuugaacucacuucuuugaauacaauaauaaaguaauuggauuggucaaguauuuaaugcuuauuuuaguuaacagauugguucuggguuaguuuuuuauuugcuuaugugcauugaaauauccuguguaaucaacauguuauauuuggcuccaguucauaggacaugaagucuauuauuugauuuauuauaaaggcuuauaguugucuccucguuuugaggaaauauuguugguuauaucugugauuuacuggugucaaaagcaauuccuguaauggaagcuuaguucuacuaauaaaauaggauuauuucuagguuucuugaaauaugugcuaugaaaagguagagguaaaauugauagcaaugauuuggacagacuacaugggcagguaauuaggcauuuuaccgcauaugcuaguguaccuagcuucagucuaucacggcucaaucugcuuaauaauguuuuauuuauguuaauguuuuaguauuaagcaucuccuuagaacuaugagacacuuaguuuucuguaaauauagacucguaugucuuaugcaaguaaaauucucagugauuuuguugaaguuuauggagaguugcccgugaaggacagaguauacauggaugaggauuuguacaucuuaagagaaaguucugugggaucagaggccauacuuacuauucucauugugugcugguccuauuauuuuuugugaaaguuggagaaauagaaguaaaagggcuaagugaguaauaccuuaggacauuuucagguaaaaaguauuguuaauuuagaagaauuuuauuuuagaucuuuugaauggaaauauaaauauaauuuauagauauucauugaaugauauuauaaauauuguucauuaggagcucaagcaauguuauaguuuagcuuccaaugcaaacauaugaacauuuuauagaaauacuuauucacucuauuuccacauacauuucaauaguuuauguguaaauaauuugccaguccacauuuucuuuauuaacuuauuuuuuaaaagcaauuuaccuuauuuuuaugauaugauggguaauaaauauaaugauguaggccuccuuuauuuacuuggcuggcauauuugcaaaugugaauuuaacguucugauuuuuaacaacuuuuguugaucggagucccagaguaccaaacucaagagacugggcacauauuuuauuucuucuacccuuguuacuuuuugcuuugcaaagugcugaaugaggcaggccugaagaaaaugugaggugauauuggauccaugauuaugugccccaaacauuagauaggguggaaugauggaaguggacuaguagggaagaaugagcuacuucugcaaauuguaaacaaccuucccuuuaaaucaugauuagggugaggggagugccccccagcaagagcuaaacuguauauagauccuguugacuucuuuagauacaaagagaaucuuugucuuaaucugagauugcauccucacucuguguugaguuuuauguccauuuucccauugcaugucacacucguaaauuuaaaaaauauucagauguaaugaacaccuuggagguaggcguagucauuuuccccugcuuauugaugaaaauugauagguggauacuggaagacggugauauaaagacauaagggggagaaugacuacugcuaaaaaguaaagagaaguacagugcagugagaaguacaguuuagcuggucauugcauucuuuucuugguggagaaacauauucuggaaaccaacuuaaaauuuuaagaauucuucuagagcaguggaaucugaccuuaugggaucuuaccaagcugugauaaugggaucaauuauucucucuuuugaacacauacaaccuuggauggaggagucauugugccagugaccuucacgguauuacauaaccgcuuauugauugcucauuauuuauggccgugcuucugugggaucccuuuccugggagcagggauggccucugcuggccagagguuuucacuggaagauaggugacggaagcauccacugccuggucugcuuugggauucuaagaugaccuuuaauuuuccuaauucacauuuauuucuuaaugacuguaauuuguuuuuuucuucagucuugacuucugaaguuuuuagauuuccaggugacuuggauuuuggagguggguagcuuugaguuguuaaaaucuaguguuacuguauuguggucagaauucauugccuuuaugauauguuuuuguuuuuuaugagauucucuuuauggcuucuuaagugauccuuuuaauaaauguuuauuuaaaaagaauauuuggaucuacuucagggacugcuuacauagacacuaaacuuuucuuauauaguggaaaccuucuggacuacucagagauuguuccuucucugaucucuggccuguccugccuucucacauucuaccuuuucacauccaccugggacuagguagaugagagaggagauugggagcaguauuagcuauaugggacagucugaggcccagacauuauaugaagaaccucuuguuuggacuggucauccuucaacauguauaaaacuuuccuaaauuguuaccauaaagggauugucucuuuaagaacccccuuuugguucaucuugacugugcaaguuuuuuaauuuaaugaagguaggucauuuuagaaagaauuuaguuuaugauaaaggacaaaucgcagcuuuugcuguguuaauucuuggugcaugggcuagaggggagauagagaagggguuuagcaugaugcuuuaugaauggagagucauuuguucauuuugucugcuuucuuccuccucuucuguguuugcacacacccuguguucuggaauaggguaucacucuggucuuucacuguguuucguguugcauugcacaguggugaaggguccaggcuuuggagccaauccacuuggguuugaauccugucuccacugcuuauuaacugugugacuaugggcaagucacugacucuguguuuugguuuacucauuuguuaaguuagaaauaguaccuacugcagaaggccauugaagggauuaaaggagauauaauauguauaagugcuuagauaaagugcccaauaaauguacccaauauauucaauaaauguaaguuauuauccuuauuccacuggacagguggauagccuguuucacauuugucuaugacauuauaucacuuugcacaaauaaaggauaaauuucaacugccuaacauuaaaaaauaggacuaaguguuaacugccuaaauuuuuugaacugcuaaguauaugaaucucuugaguacuauugcagugaccacaaauguuaauuguuguugucacugcuuaaaugaugauguacuuuaggaggaaagacuacaauucaucgaugcuuuuauaaguuauauaugcuauguuaaggaguucaacauguagauagucugauuuuuagacuuuauuaaaaucacuauaucaaauauugaauuaauuaaaauuucccuaaagauuuugaccuguaacgaauguuauauuaauaagcuuuuucuuggccagggcgguggcucaugccuguaaucccaacacuuugggaggccgaggugggcagaucaccugaggucaggaguuugagaccagccuggccaacauggcaaaacccugucuuuacuaaaaauacaaaaauuagcuggguguggugguggaugccuguaagcccagcuacucagaaggcugaggcaggagaauugcuugaacaagacuucaucucaaacuaaaaaaaaaaaagcuuuuucuugcccccuuugcagcaucaguauucccauucggcugcuaggucuggggucugauuucgaucucgaaagauuuuaguaauuaacugugaugguccugugcaugaauuagucauugguuaaggauauagucaugcucauaagcagccuuauuucauuuuuauuuauuuauuuuaaacgcccaaagcagguagcacuuagagaguuuggucugacugaauuuaguucuuguagucuaaggcuaaauauuguaaaaccgauuaaauccaggggggcauaggauaagaccuauaucaugacugcaagacacauugugcuuuuggggaccuaggagugaugggggaagggaaacucacugguuaauaauuucuaaauucaauacuuguuuuugcugagaguaggagugaugcuauacauucaaagauauggacugcuucuuguucucuaaugucugguagagaaagccuauguauuuagguguccuauccacucucaucuagguuuacuuaacuggcaguguuuugccagaauugccugugagguccgagguagcuaugcuggcauuuggguugugggguguaaggugggguagaagguuguagagaggagccugguggguccugugaaaaugaggcuggccuucacuuccugcugcugguggcuguaaggggggugcuguaugcuguugcccuccucuccagggagcaggcagcccaagccaggaggccauuguaaagcauuuaccagaaggcuggcaacugaggaugacugcaagugacuacacacuguuaagguccuucuugcuuaguacaaaaggaacaugggagugugguuagagaccugggcacuuugcccagcucuguaacccauucccugugggaccucaaugauugucucuauuuugugugugugugaaaaauggagaagaauaaugccaccugcuucuuucuaaggauguucugaggauuaaugagcuaaucaccuuggaugaaggcaguagagccuacccugguuauaauuuucauugcuucuccagggaagcuccaguuugggggaaugaaauauuggaaagaagauaggaggggauaggcugucuacagcuuagucgguauauuugaaguccaacuguagaucaggcuccuuucuagcugaggaauuucaacuaaccuaaaauuucuacauauuuuuuagaaacaacgccaagccaaaugucugaccugcuguuugcgggaaaagagcagauguccauucugggaacauauuaauauaagauguuagugguuuucucucacaguacaagaagauggguaaaaagagaauguagauuuauauggcauuuacucuuauuuucuuauugcuggugugcucuuuuugagagaguugguauuguuucauuuaguagauuuuucagguuucuuucagaaagaaacuucauacagaucaagccaaaacaaaacaaaaaaauauaaacacacaacaauagcuuuaaauaccaaggaugucagcaugaaauuaaaauaaaucaacugacauuucugcuuugaaauuuuuuaguaaaacuaauuuaaaccacagcgaaagcuuucuuauaagggaaaguuugaccuuuuucaguguuuuuaauuuaaagguauugacauugggguguuuuugguuaaaauuugcuucaaccuucuaaagucuuuugggauuuuggucaauccuugguuguggaauagcaaauacagucaauuuuguugguacaauguaguuuucaaagacaaggucucugaaguaguagauacgguauccccucccacccauguguaacugugaaaaagaacacuguugucaugugaauucuuauuuuuuuuuagcuugccuuugaaguaacuuucacagagaauuccuguuaccuggaaauugaugacagacuuacaccauuuccuuuuuuuuucuuagacguuccauccucagagcagccugaacuguuccuaaagaaacuucagcagugcugugucauuuuugacuucauggacacgcuaucugaucuuaaaaugaaagaauacaagcgcuccacucuuaaugaacugguggacuacauuacaauaagcagaggcuguuugacagagcagacuuacccugaaguaguuagaauggugaguuucuuuuuuucuccgcggacacuuuuaagcaucuuccauagugacucacagguguauauauugcaagagugaggucauuggaggucaacuccacaaaugagagccaaccuuuggagagcuaagcaaauguagucggcacagugcuagaauuugaagagcaugauuucaugagaacgaaauccagaacuuuaacuacgacagugcugaagcaauaaaugacuucaaaauaugaagccaagauugccaggguauuacuggauuucuagcuuuggcaaaagaaaagacacaggaaaauaacaaaagucuuagauccguguuugaaaaauauucaagccuguuggaugucuuuuuuuuuuuuaaucuuauucauugugguauauuagaaauggcuuaaugcuuaauaaaauugugauuuguagaauguaguuaaggccucucuugggcuuuauaacuaacgcuucucuuuauaaucuccuugaagucaggguugauaccuuuuaugauuuuugaauagugucuuagauuuuguguggucauuaggaguuaugaggaaaaacauuauuaacauaaugugaguaauuacauucuuacugugugaacaauuauuuuaguuuuucaaaagcugagccaaaaugugguuuucugauagauuucugugggagaguugccuuucuuggcaucccagaagaucuuggagcuggagagugcacgcuauuuggggaugggcuuugcaggguggggaagcuggucuacugacuggugaaauagccucagagauccuuaaggucagugcaucguugaggaguccauugcaggaucuggcacacucucuguguacugcggaacaucugccuggcuuuuguauuuaguucuuuaucauuuguauucaaccaaugcagaaaagagacuuuugugauggaguagauauguuuaaaaaugauaguucagauuugcaaaggcacuugaaugaucucagcgugagacugugacugaaauaaugaaggucaucugaaaacgaugcccaauauauuccucaguucuauaucugaauguauauuggauuuguuguuaauuuacaggaauguagcacuagaauguuuuguagguuaaagaugaccguguggcucuugagcagugcuucucaaccaggugugauuuuaccuuacaggggacauuugucagugucuagagacauuuuugguagucacaacuagaugugagaggagaguacuaccagcaucuagugggagaggccagagauacugcuaaacauuuuacaauguaccggguggcccccacaauaaagaauuaucuggccccagauaucacaagugccacuguugagaaaccuugcucuugaguuugcaugcuaucuaaaccucuuaaugugaugcagaggaucuucucuagucuaccugccuucugcagagcacagucccugguuuuagccuaccuguaucaucagccaacagagguaucgguuaugacuuucuucuguaucuucccauggauaguucaugaauauauaaguauaugcaaacauauguauaaauauuuuuuuuuguaagcacacaaaugguggcacacuauguauuuucuguaccuugcuuuuuucacuuagcaauauauauuucaguacauauaaaguugccauauucuuuuuauagcugcauaauauuuauugugugaauguaccauauuuaagcaguacucuaugaauauccuuauacacacaucaguuugccuuuguaugaggacaucuguauacuuauuuauuuuuaaaaauuuaauuuuuuaagagcaguuuuagguucacagcacaauugagaggaaaguacagagauuucucauaugccccugucccugcacaagcacagccucccccauuaucaacaccuccccccucacucccaccagagcaguacauuuguuacaauugaugauccuacauugacgcaucauuaucacccagaauucagaguucacguuagggcucauucuugguguuggacauucugaguuuagacaaauguguaaugacauguauccaccauuauaguaccauacauaccauacaucacugcccugaaaauccucugugcuccacuucuucaucacccaccaccuucaacucccuggcaaccacugaucuuuuuacuguguccauaauuuugcuuuuuccagacugucauauaguuggaaucauacagcauguacucuuuucagaugggcuucuuugacuuaguuauaugcacuuaaguuuccuucaugucuuuucaagacuugauagcucauuuauuuuaguguugaauaacauuuuauugguuggauguaccauaguuuauccauucaccuacugaaggacauuuuaguugcuuccuaauuuuggcaauuaugaauaaagcuaauauaaauaucuguguacaaguuuuuuuuaugaacauaagauuucagcuccuuuggguaaauaccaaggaguguaauugcuguauguauuguaugguaagaguauguuuaguuuuuuuuuaauuugcauuuacuuuuauuacuuguuauaaguaacgaguauguuuaguuuuauaagaaacugccaaacugucuuccaggguagugguacuauuuugcauuccuaccaggagugaaugagaauuucugcugcuccacauccucaccagcauuugguauugauuugauuuaaauagccuuuauuuccuuguuucuggacuuucacguauuccccacucccucaccucuaguucuaauucucauuuucccuucaagggcugacuuaaagugcuacuauuguuuuccugaaaaaacacagugcuuuuuccuuccuucaguuccucugcuucuuggcaacucaccauuuugggaauuuguucauuugcuccuuuuuuuuuuuuuugucuuuucacauauuuaucugauuuuucuaauuagguguaagcacaccuaagaaggaacuguguccugcacauaucuguggcauccauaauaccuccuaccuaguccaggucuucuugaaauuuguugaaugaaugaauuccuccuuaaaauguaggcauuucagucucucaaauuaugauuaagauauuggaugucauuggauuauacccagauuuuaaacugaguguuuagcauaauccaaaaauucugucauccauauggaccagcuugguguuaaaccagcuuuggucuccuaagggagaccguuuucucccucuuuuccuccccauucuccagccaaaaaaagagacuccuaucauuuguauguguuuuaaaauacacuggagcuuuaucuuaggaggcauugagucuguuaguguacaugcuguucuagggcauuagaaaauucuagaugguaguuucggcuucuuagaaguauaacuuauuuuucauauuuggugauuucugaaauuguuagcuacuaauuauauacgguacuuagacacucuggagcauuuacagaaaggggauauuaugauagaguagaaagagacaaggcgcugggcgcgguggcucacgccuguaauccuagcacuuugggaggcugaggcgcguggaucacuugaggccaggaguuugagacuagccuguccaacauggugaaagcccaucuguacuaaaaauacaaaaauuagccuggcaugguggcacaugccuguaaucccagcuacuugggaggcugaggcaagagaaucgcuugaaccugggugguggagguugcggugagcugagauugugccacuguacuccugccugggugacagaacaagacuucaucucaaaaaaaaaaaaaaaaaaaaauaggaaaagaaaagaaaaggcaaggcuuuggaaccauacagaccuggguucaaaugccagcucuggccauacuuucuacaucaaugugagcaaguuacuuuaacuuagggguucuccauuuuuguguggugcuaagagguacauaggguggggggaggguagccauaguuuucccagucccuccuuaaauauuccaccuagguaacaugcuugugcuuuuguuugcauaucaggguacucaacaccauacauacauauacaguccauagaacgugugcuuacuguucuguaaggaaaacuggaaccacgucccacuuggugcccucauucccucuaagcccauuguauauauacauccuggugcuggucacuuuccuaauuuguguaauaccugucuuugggggguuuugugaggacuagcgacaauauuuauaaaaguuuuagaacagucucuaacauguggcaaguauucaguaaauacuauuuuuacauuucaaugauuuuauuagauacuugauuuuacgaucauugguggaacccacuguuacuucuuuguacuuaaaauacuccgucacugagauguguuuuauuccauugccacagugguucuuaaguucucuaauuccaagaugauccugccuguuggguaaucacuguccccgcugauuucucuuucguguuacuguaaaacaaaaucacuucaccagaauuagugagggaaaugauaguguuuuuuaugaaauacuaaugaagugauagauggguuuugcaaaccaggaugaguaaugauguauaauggcauguuacaguaucagcauuaguaccgagagcuuuugauccaacuugaugggacuuguacuuugagaacugguauuccuguuaggggaagaaaagaguaagagauaaaaguaaucuauguguuguggaaaccauuuuuaacaauuaaaugaagucuggauaccaccuacagacuucuagaauuaggaaagcaaagcagcucuuauggguauaaacaaaucacaugcacaccucguuuuauugcacuucauagauauuggggguugcuuuuuuuuuuuuuuuuuuuugacgaagucuuguucugucacccaggcuggagugcaauggcacgaucuuggcucacugcaaccucccgccuccgggguuuaagcaauucuccugccucagccuccugaguagcuggcauuauacacgggagccaccacgccuggcuaauuuuuguauuuuuaguagagacaggguuucaccauguuggucaggcuagucucgaacuccugaccucaugaucuacccaccucagccucccaaagugcugggauuacaggcgugagccacugugcccaaacaaauugaagguuuguggcaaccuuguguggaacaaaacuguugguaccauuuuuuccaacagcauaugccccuuucauaucuuugugucacauauugauaauucuugcaauauugcaaaccuuugcauuguuacuauaucuguuauagugaucugugaugagagaucuuugaaguuacuuuuuaaaaauuauuuauuuauuuauuuauuuuugagauggagucccgcucugucgcccaggcuggagugcaguggcucugucucggcucauugcaagcucugccuccgggguucacaccagucuccugccucagccuccugaguagcugggacuacaggcgcccgccaccacgccuggcuaauuuuuuguauuuuuaguagagacaggguuucaccauguuagccaggauggucucuaucuccugaccuugugauccacccaccuuggccucccaaagugcugggauuacaggcgugagccaccgcgcccgaccugaaguuacuauuuuaauugcuuugggacaccaugaaaugugccccuacagcaaacuuaaucgauaaauguuguauguguugugacugcucugcugagcgguuguuccucagccucugucccucuucucaggccucccuauuccccgagacacaacaguauugaaauuaggccaauuaauaacccuauaauggccuuuaaguguuccaaugaaaggaagagucacaugucucucauuuuaaaucaaaagcuagaagugauuuagcuuagugaggaaggcaugucaaaagcugaaacagaccaaaagcuaggccucuugcaucagacaauuagacaaguugugaauuuaaagguaaaguucuugaaggaaauuaaaacuacuacuccaguaaacaugugaaugauaagaaaguaaaacaaccuuauugcugauaauugagaaaguuucaguggucuggauagaauaucaaaccagccacaacguuccuuaugccaaagccuaacccagagcaaggccuuggcucucuucaguuguauaaaggcugagagaguugaggaagcugcagaagaaaaguuggacaguaacagagguugguuggcuuaugagguuuaaggaaaauagccaucucucuaacauaaaagugcaaggugaagcacuaaaugcuguuguagaagcuaaagcugccgcaaguuguccagaagacuuagcugagacauugaugaagguggcuacaccaaacaacagaguuucaauguggaugaaacaaccaucuauuagaagauguuaccaucucugacuuuuacagcugcagaggagaaaucagugccaaagcuugggccaggcugacucucuuguuaggaacuaaugccacuggugacuuaaguugaagccagugcucauuuaccauucugaaaaucuuagggcgucuaacaaccaugcuaaaucuacccugccuaugcucuguaaauggaacagcaaagccuagaugacaacacuucuguuuacacaugguccaccaaauauucugaauucacuguugaggcccacugcuuagaaaaacguuuuguuuuucuuuucccccaaaguauuacuacucauugacuauccaccuuguuacccaagagcucuaauggagauauacaaggagaugaauguuguuuucuuuuucuuuuuuuuuuuuuuuuuuugagauggagucucacucugucccccaggcuggagugcaguggcuuuaucucagcucacugcaagcucugccuccuggguucacgccauucuucugccucagccucccgaguagcugagacuacaggcgccugccacugcgcccagauaauuuuuuguauuuuuaguagagacgggguuucaccauguuagccaggaugaucuugaucuccugaucucgugguccacccgccucggccucccaaagugcuggaauuacaggcgugagccaccgugcccggccgaauguuguuuucaugccugcugacauaccauccaaucuucagcucaugggucaaggaguaauuuugauuuucaagucuuauuauuuaagaaauucauuucuuaaggcuguagcugccauagauaguaauuccucugauggaucugggcaaaacaaaucgaaaaccuucugaaaaggauucaccauucuagaugccauuuagaacauuugugauucacaggaggaagucgaaauaucagcauuaacaggaguuuggaagggguugauuccaacccucauggaugaccuugagagcuucgacuucaauagagagaguagcugcagugcagaugugaugggaauagcaagauaacuagaaugagaaguagagccugaagauuugacugaauugcugcaaucucaugaucaaacuucaacaaaugaggaguugcuucuuauggaugagcaaagaaagugguuucuugagagggaaucaacuccugaaaauguugugaacauuguugaaaugacaacaaaggauuuagaacauuauguaaacuuaguugaucaagcaguggcaggguuugggaggauugacuccaauuugaaaagaaguuccauuguggauaaaaugcuaucagacagcaucacaugcuacagagaaauuuuucaugaaaggaagagucaaucgaagccacaaacuucauugucauuuuuuuuuuuuuuugagacggagucucacucuauugcccaggcuggagugcaauggcacaaucuccgcucacugcaaccuccgccuccuggguucaagugauucuucugccucagccucccgaguagcugggauuacaggcgcucaccaccacgcuuagcuaauuuuuguauuuuaguagagaugggguuucaccauguuggccaggcuggucuugaacuccugacccugugaucugcccgccucagcuucccaaagugcugggauuacaggcgugagaccaccacaccuggccucauugucaucuuauuuuaagaacgugccacaaccaccucagccuucagcuaccaccgcuaugaugaguuagcagccaucaacaugaaggcaagacccuccaccagcaaaaaagauuacaacucgcuaaaggcucagaugauuguuagcauuuuuuagcaauaaaguauuuuuaagguauauccauuuuuguuuuuuuagacauaaagcuauugugcacuuuauagacuacgguguauuguaaacacaacuuuuacaugcaccaggaaaccaaaaaugugugugacuacuuuauugagauauuugcuuuauugugauggccuggaacugauccuauaauguaugugaggugugccuguaaagcaaaauagcccauaaagagucccagacagagaacauggaagccacugucuucauuucucaucuuccacuuaacuagugguaagaacuuggguaaguaguuuucucucuaagccucaguuucuucuguuauaaauagagggaguugaugaugaaucccuuacaucuuuccauuucugaaaacuaacaccucuuuugaucaacacagucuaagaaauuuugaauggauuaugccuuucuuaaaguuuacaggccauugugcaaaguaguuccuucagaaagugguuugugucauguauuucucuuggggucuccuggagucauagcugaugaaaaaaugagaaucaggacuuccagcuccuuuaggcuuugcuccauucugcuucacaucaucucaagugucaggugucugucccugaggcauauuuuuuuuaaccacauuaugcuaaugccuuuuugguuuuguuguuauguauccauuugaaagauuucuuggaauuucuggcuuuccaaaucaccuuguguaaauuuuuauuuaccugagcuugaacucuguguauuuuauauuguuuauauuugcacaucuuuuuuuuuucucgaaaauguuuuuuuuggggauacuucaaauaugagaugaaaucucaugggugaagacauuguuuuaguuaauucuuaauguuuauuuaaaugacucaguguuacacuuuuacauuuugcuaauaaaaaagacagggcuucacuuugccagugagcucacaaucugguagagggaauacucacgugaacaguaacaagauaaugucauauauauaguaguaaagucuguacaaggcaaggaaggaguaaagggacgugaagguagauagaagggugguuaaggaaggcuugacagaaugauuauagccucaguaggguauuaaaagaugaauguggcugaacuuaaagagaauuaugugaugcaaaggaauucccaaaccacauguuauauacagggaaacacagucaugcuacguuguuacaguguuauguguauauguguguuggagagugggaggaggugaaugguggcagcugaagauguggaugugggccagucugaaagaaccugacagacaauggauggauaaguguugaaagguucuguguggcggagugacauggucagauuuguauuucagugacagugggacagagagauuggaggaggcugagauugaaggcagagaggaaucaauuaggagacuguuuuauuggagaaauuguggagggccuaagcgaacugcaggcauggaaguagagaaggagaggaaaggaacauuugagauucaccuaggagguaaaauugaugcugcuuguuagcauuuaugugaacuuuuggagugugagagaggaaggagucucggauagcuuuggcaguuggguaguuugugguguggugcugcuguuggggaguagggagagcaggcuuuggauggaagcugaggaguugguuuucgaugaguuaauguugagguucuuaugggagaccuagauguggaaaguaggagguggaaauugguaguuaucagaaugggaguagggcaggggaggaaaagaacaaugauggaacucuagaugauaccagugaaucauuguuucagugcagugguacaggugggagcuaguggguugaagaguagauuaaaaaaucaagagguugagaugacggcuguagauaauugcucgcaccuuggguguacugucuucauuagaguaaaauccugucacuucucuccuacaaaaaguguucaaccuugucacacugaucauuugcuguuauuauuuuuauuuugucucuaggacuuggcuuuucuugguuucaaagucugcuucaauucucaaucucugcuuauaccucaaaugguagaauauguaauuuuccaaaguuaauuuaguuuuaagauaaaauauauucacugguuuuuccuuccuugcuguugaggucuuucuuugaguucguuacguuguuucuuggccacuauuagcuuuguuuuuuccuacucucaaauuauaaccugucacuugguuaucuaagugcuuuauuuuuuuuuauacauucuuugauuuaacuggaaaccagagcucugguuagccucuuaauacaauaauaugacauuguagaaaauuaugaaguugcaauuaaaucucucagagucugccgacauguacucuuaguagugcuugguuaaccucgcuacauuauuagcugaagggcagagaguuucuuuuaauaaaagaacaacuaucuaaaaguagcuuuggaaugauaacugccggggggaaauaugaaauuuccauuuuucaucuuccugcaucugauaaagaauauaaccaugauaguccccccuuaaccauggggauauguuacaagaccccagggaugccugaaacuguggauaguacugaaucccauacguauauccuauguuuuccccuauacauauauaccuaugauaaaguuuaauuuauaaauuagucacaguaagagauuaacaauaacaguaaaauagaauagcuauaacaauauacuguaguaaaaguuacguaaauguggucucccucuuccuucucucucugugucucucucucugucucucucucaaaaugucuuauuguacuuauuccaugggugacugaaaccaugggaagucaaaccacagauaggacggggacuacuguauacauccuggccagaauuugccuuggaggugacucuuuagauccaaaggagauaagauuuguagauaugcauuaauagcaaaagagccauugggggugggugggugaggguggacuguuuauaauauuagaauuauacauaauggaagagaaaugagugauaucugagaagcacacuuaauaacugaagcuggugggaaauuugaaggauaggauaagcguaaaagaagaccugagaauuagauuagaaauuaaagaauuccuugguacaaaggaaaaaauuuaaggauaugauaaugagaucucccaaagacauuuguagaaugaaaucaggaggaacuuacugcucaagguuaggaacaguuuguuagcauucguaauuuuucaaaggguagggaaacuggucuguacuuccucaauucccacaauuuaacugugcuaauccaguuaaagcucauuuaacaguauugauuuagcagcuuggggugcccauagauggauuucuuggggucacugaacccucuuagguuaacugcaaaauuuuguguauucuguguauuuuuuuuuuuuuuuuuuagacggagucuugcucuguggcccaggcuggagugcaguggcgcgaucuuggcucacggcaagcuccaccucccagguucauggcguucuccugccucagccucccgaguagcugggacuacaggugcccgccaccacacccgaguaauuuuuuguguuuuaguagagacgguguuucaccauguuagccaggauggucucaaucuccugaccucaugaucugcccgccucggccucccaaagugcugggauuacaggcgugaaccaccgcgcccugcuguguucuauguauuuuuauaggagaaaauaacuugcuuuugcuuaaauuuucaaagguacaugugacucaaaaaugguuuaagcgcgauuuuacccugugugcacuaaauaucuaugcuggaugcugcucacuuggagaguacaagauuggaaaggaacgggguccccccauuucuggcaguaacuaaagaugaaaaaugaaguuguuagaaugauuucaccagugaaaccauuugggcuagaguuucucugugggaaggcuuuugguagugaacucaguaucuuaaauacaugucugacuguucagauuuuuuguuuuauauggugugaauuuagguagguuguuguaaaguuacacgauuuagacuuguggccauauacuuaauccuuagagucucuucacaaagguguguacuaaugaaagaagauggccagcacccguaugccuucuauuguuaccugcauaaaaaucugcaggaacaauauaugaguuaauucaaucuucacauugaaugagaaccaccugugacauagguaguaucuaauagauaccauuuuguagauaagguaaaggaagagagagguuaagaaacuuguccaaagccacucaccugggugauugagauuugaaccuuggugaucugguuccagaacccauacucuuuuuuuuuuuuuuuuuuugagauggagucucgcucuguugcccaggcuggagugcaguggcgcgaucucggcucacugcaagcuccgccucccgggcucacgccauucuccugccucagccucccgaguagcugggacuacaggugccugccaccacgcccagcuaauuuuuuuuuuuuuuuuguauuuuuuaguagagacggaguuucacuguguuagccaggauggucucgauucccugagcucaugaugcgccugccucggccucccaaagugcugggauuacgggcgugagccacugcacccggcccagaacccaugcucuuagaugcuaagccauaaugcuuuccuggaauuauucuuuccaauaggaaugaggucuaaaaccccuaaaaguuggagucuugccucugugcuauguuuguuucuugagcucuucuaaaaaaguaaaaaagccuuugauuuaagcccuucccuguauuuugcugcuucugacaaggccagaccacauaguaugcucugggguuaaauguucauuuuuuuuuuuuuugcuuaagaacaguuucuucuucacucccucucuccuaccacuucugcugcccuauauaguagcuuuacacucccuuuguguuauucuugaauuguuaacgcugcuucucaauuuuucucucuacccuaccacuuauucccagucuggaaaaguaaauagugauugaggaggugaggaggagcccaggaggaaggccguguauuucagaacaccccucucucucuuccacccagauagcaguccccugaguucaugugcuuucccacuccacuucucucucugccccacccuuagaaguuccaaaaaucaggcuccucugcccguuggugcuccuuaugugguaacauuggcguggcgauaccuuaccugugcaucauagaggggccccaccuugcagcccuguuuguguugaauugguaggacccacagaaaacguauauggaaauugaaagugccaguguaugaauucagagugagaagggcacugcucaguggauagcuguuuguguguauuugaacugugccuucucucccugcaggcaagcuaugcgagcugccaaggaauccuuagguugguugguuagccugaauucagagcaaggggaguuaauuagaugauucaaacaucccuccaucuccaugauggacauccuaauccuuggaagcacuuauguguguacagccugcuuuuccuuuuuacuguccuuccugggucaguggcauagacaaacagaccagaacccggcugggcgcgguggcucacgccuguaaucccagcacuuugggaggccgaggaggguggaucaccugagguccggaguucgagaccagccugaccaacacggagaaaccccgucucuacuaaaaauacaaaauuagccaggccugguggcgcaugccuguaaucccagcuacuguggaggcugaggcaggagaauggcuugaaccugggagguggagguuguugugagccgagaucgugccauugcacucuagccugggcaacaagagcaaaacuccgucucaaaaaacagaaacaaaaacaaaaacaaaaaaaaaaaacagaccaggacccagucuggccacuuacugaacuaugugaucccaggugagucucaucccucuaagcuuguuauuauacuauaacucuauaagguuguuuugaaaauuaauuuaugaacagugcuuagcacugugguaagcauuguuaaagucaccauaucauuauuaucauuauucaugguaccaucucuagcaccccaguagacuuaaccugucuauauugguuaauacauuuuucugguuacaaugaagucuugcuaaccugaaagcuuuuuuuugucuuuuucagaugacuuuccauaucuuuugucugacuauugauuucaaacucucuaugaaguuuuauuuucauaccuuuuuuuuuugggagaacugccugugaaacugcauaugccccuguguuuauaguuauauauacauuuauauauauacugcccuaaguucaucuaaaugaauuccugauauacuugcauauucacguccccaacucuaguaauaauuuagcauuucucuccgcaaucauucucucuuaaggaaucugacaaggauuuuaaaguguuuaguuuuaauuuaaaugugcuaaagagaggguuuuuacucaggaagccacugagcuacucgagauugcuauuugcuucauuuacaagcuguaguccuucuggcuuaacugcuuuaaagguuguucagaguuuuuaauauacuuaaaauuguuugacagcugugacuugucuagcacugauauauccaauaauaucucacuguaaugaguauacucccccugucucuaccccuccccccaguggcuggcagcagaauuuugcaggauaaguuacaguacugcauucaaguuuugguuucucuuuucucccaccuuuuaauuuaaccuugaagcugaaaaugugguuuaaagguauaagcaaugcuucugggaaaucuauuaagcacauggaugacaaagugugaaaucuugcuuguggcaugugcaagugggucuuggauaaucccagcucuugguguuaguuuguaugauuuggcugucucucuacugaggagacacagaaaugaaagagagggauuuauuggcugauuguuuggaggaagcugguuacaccacaguggugcaugaugagcaggaaaaagcugagaaaaugaguguccucaauguggaauucacagagacaggagugccugaggcaagaaucuggcaagcagacaaugagcaggucauuuccaggaggcaguuggcugcugaccaguauuuaaagccaaacuugaucuguaggaaaacaagaagaaauaugcuauucagugacuucucaggagcaaguugccucugaaaaauggugcaaagacacuagacuauagaguagaaaugccauuucugugaugaguagagagaggugaggguuggccaaguaguggagagggacagcugguggggucauggugaggagggucaggaguggcacacacaaggaaagacauuucucaguaaaaaucaggcugguuauaauuauuugcuaaguuggagagcaaguguauuuuuuugacaaaauggacaaggaaguucuauuggaaaauaugauguuucuauacuuuucagaaagguagggaguggggucuugggaggauaauguuaggugcuaaaugggcuacuuugaaauacuguggaauuggccuuccugcagaagguaagggcuuuaugagaauaggauagaccacucucuggaauaaggcaggccacuucauuuucagagauuucuggcuuuuuucucuuagacagauuaaaaaaaaauuguagacaauagagaaacuguuggaaaauuaaguuuuguauuugugcugcccuuaauaacaaagugcaaaauguguuauauccuauucuguaaagugagaguaguuguguuaccggaaagggguccugacccagaccccaagagaggguucuuggaucucauguaagaaagaauuuggggugaguccauagaguaaagugaaagcaaguuuauuaagaaagcaaaggaauaaaagaagggcuaguccauaggcauaaaaauagucauccauuuuuaugguuacuucuugauuauauucuaaauaagggguggauuauucaugaguuuucugggaaagagauagguaguucccgaacugaggguuccucucccuuuuagaccauauaggguaacuucuugacauugccauggcauuuguaaacugccauggcguugguaugugguaccauguaguaccaugguguagcggugaggacgaccagaggucacucuccuugccaucuugguuuugguggguuuugguugccuucuuuaugcauccuguuuuaucaguaaggucuuuaugaccuguaucuugugcugacuuccuauuucauccugugacuaaaaauaccuuaacuuacugggaaugcagcccagcaggucucagccuuauuuuacccagccccuguucaagauggaguugcucagguucaaaugccucugacaguuguuucagcaauaaaauaaucagaaggcagugguguuuaaagcacauuuaaaauguaagcuuacaggguugguggucaguuccugccccuagauccuucucuugguuuccuucagaggaacuaagaugaagccagcuaugugucacugucaacggggagggcuggcuguccugucuuccccuggaguggcauaucacacuuaauucauuaugaagcaguaguuuugggauaaggaggaauguuaguuuauggacagaaccuaugguuauaugugcuaaauaugguuauaugguuaugguuauauguaggucagguguguuuuaauuacucaccaacuagcucagggcuuuguuuugcuaaugaaaggucacagacacacacagagacgugcacauagacacagaguauaagagacagugacaguuaguuuuggcuguguuucuuguuuauuuuuugugauuucaauuaauaacacauaccuaguagucagaaacacacaucaggagccucaaauguuuuguguaugcuuuuuuaaaaauucgcaauucaagaggcuuaauuuuuguuugagcauuagcugauuuggaaccaugaaguccucauagcagauguuuagaauuuguguucucaaaaaagccuuauguugguauuguuuuaucaacuugugcacuguggcuuuuacagaaaacacucaauucaguuuuaguaaccuucuaggacuuaggacccacaguccccagauggugaaaugcagcaaagccuugguaucacaugguuagccuguguggggcgggagugcuugaggccaacccaggcgguacgagggccugcacugauuuauacacaguaagcacuaugacuauugcaauguuuacacgucuauuuuuggauucuaagauuuaauaucaacaauguucacuuuuggacucacugcuacauuuccaauuuuggagcgaguacaauacagucaucucugugugaaauaucauuucccugugaugguuuugugugaggauaacagacucuagagauaauuauuuuaacauugcugucaccauuucagcagguaaaaaguugccuccuauuuugagcaaaguuugaucuugaaauaggagccgaauggaagcggaggguucauggucagaauuugugggcaguaagguggagagaggcagggaugaguuuagauuagagaggguguggcaaauuaagcagaggagguuagacuuaaucuuguagauggcgagcagggaguuguaaggauuuuugaacaggaggugaaaugaaacuauauucuuacuuuucuuucuccagacccuaugaagaaagucugugcuccuuuaaggaagauuaggcuggcagauauaacccaggauggccuguggcagagggcuguugucuuagguuugucagaugauugcagaggaagaggaaauuaagaauauguaaagaacucaccaucuuccguuuuuuuucuccacccuuaucaaaaaaaagaaucacccauaguuucgguauuuaaauucaaucauuacccacauuuuggccagucugcuccuagucugcuuuuuuuuuaauaugacuuuuuucccuuuaaaaaauuuagauauacuuaacuuguaauaaaauuugaagaacagaucuuaggcaaugaacguucaaugaauuuagcaauuauauauacuuguauagucaucaccccaaaugagaucuggaacauugucaucuccccagaaaauuccccuuuugcucuuuccuguuuuuccuuguuaaaccuuuuuuucuaaucuuacuauauauacauuaucauuaugauguaaacauacucuccuguaauuaaauaaucuuuuaaaagcauaauucugaugguuccuaacacuccauuauguggauguaccauuguuuacuuaacugauuuuccaauuugggauauuuaaacaguuuccaaauuuccacuauuaaaaguaauaccaucaugagcaccaaagagacauuuugaaguaauaaauaaaaugacuuguugacaaauuguauauagcagauaaaggagaagaguuaacaaaaacuccaaaggguuaaaaaaauagugaacuucuugaaagaauggggaggugggaggagaauucucuuugagagauaaauggaguccaaugagagugaaauugguuuugaccagccugaauuugagaugauagugagaugucaaaacugcucuauauguaacuggaaguaaagaaauuaaggauauccaugugcccuggacacagaggucguaguggaaaaggugauaggggacugaguauugagaggagagcagcauacuaagggcugggacuuguucuaccucuagugcugaccuuuauuuuucuuuuuggggagguuguguacuucuucacuggaugaaaucaugacuuggaggcguucauuugaauuuugcauucaguauucccagauccugaacaugcuuuauuuuucuauuuuauuuuauacuaagacccacuaauguaguuggugcuaauucugagaaagaaacucuugugaagaucucucaguuuauuuuggcuaagauuagaguaucugccauuuuuuguuuguuuguuuguuuuuuugcuguuauacuggacucuuccccacuaaaaagagacugauuuuuuuugcauaagcaaauuaaauuacuugaauuagcagaaguuacuggagaauggaagaaauaacuuaauaggaaauaaucacuaacuuuugaguaaauaggguauauugaacccaugcauauguuuacuuuuauucccuaaaaucuccccacaauuacugaaaugaaaaaguuauuacugaaaggaaauaaaacccacaagaacaaagcaaaauagagagaucucaaaauuaacauuuuggaagcuagaaagcaaaugaacagugguuacuaccuugguccaucagagaaagcugaacccaaagcagcagcaaggaaagucaagacagggcaagucacaugcacaacuccgaggaacuucagaaagauaaccucucaaaggaagggugcaugggggcgaaacaggagauucgcuggaaagucuguauaagaaguagccagaauuccuuuucucccauucucccaaaaccagguagcuauguaacugcucucucaaaucccagcagaacacugaagcuuuacucucuggagaggcuaaacuagagggaaucuggacuuggggacauuacgcacagcugagagcagcgcgcaccuuucugaaaguaggacacuauguugaauugagacuaaacccacucaguucccagauaccuuaugcacucuagccaggagauuagaugauucuucucugcagaaucaggcaagcccaagagaaaagaccuaaagacaaaacuuaaaagggaguucuggagggaggggcaugaacaggugguaaggaauuagcccagccagucucacuauaggcaagcccacuagucaacuggugccauguuguacccacagagccccuauuuuaaauaugacuguagacaguggcucacuccuguagucccaaugcuaugggaggccgaggcagguggauugccugugcucaggaguuugagaucagccugagcaacauggugaaaucccaucucuacuaaaaauauaaaaauuagcagggugugguggcacaugccuguagucccagcuacuugcggggcugaggugggaggaucacuuguguccaggagguugaggcuguggugagcuguaaucgcaccacugcacuccagccugggugacacagugagacccugucucaaaaaaaaaaaaaaaaaaaaaaacaaaacaaaacaaaaaacaaaacuguauguggcgcugugguuaagacuuuuuagguuugaguccucucuccugacauuaauacuuaaugaaaacuuaguuugacuuaguuuggucuaauuuagaacuuuauaugaaaggaauuaaacagcuuauauauguuugggggguuugguuaugacugcuuauccuuuuuacuguuugaugaacguuuagguuguuucuaguuugcagcuauuauaaauucugcuucuauuaacuugauuauacuaguuuggcauuagugaucacugcauagagggggccagcucaaaugucuuucuuuuucccuugaaucuuucuuucuuucuucccuccccuucccccagucucuucucuuuuccugucuuuguggcaccucugucuucugaugaacaugccacaggucaaggagaguggaaacaaaagacaaaauccuuucuuucacucaguuuuucccuguuguccccuucuaacgaaguguugacauagucuuccaaaccaugccuauauuuacauuugaucuguauucaaauucuauuguuucucuauucuugauaucucauggacagauuccuuucuuucauacaguuggcagugcuccgaucuucuagagacuccgugucuaaggggaccaaauuauuuguagaagcaaucaccguauguuaaaucuaguuauaccaauucaucauaacaauuaucagcuaaauacuccgacugcuucuaacagcaguaagcagcaauaacaaugaaaacaguguuuguuuuuuggucuguguaaaucuguaguguauacccaguagaguaaaaaauaaauacuugaugcaggaaauauaaauaaaaaugaugucuuccuuguguguuaugaaaauaguacauggccaagacuucuauuaauuuaauacugccuuuugaauauuggcuauauuuaaaaauucuaauuggguauuauaaguuuuaagcuuuuuuuuuuuuuugauauucccuuucuucaauugccuguuaaacuucugaucauuuuaauauguucuuucugccucauuucaggaaucauauuuaauagaauaguuguuauguccuagaaagcccugcuaauacagauuuaaguaugacauuaaauguguaacaauaauuacuaauuauuccuaaaguauauuugaauaauuacuaauuauuucuaaauguguaacaauaauuacuaauuauuucuaaaguaauuacucgcuuuagaaaucuccuuuuaaauccucuuccggauuucuagauguuguaaaacaaaccucacaacugucacaagugcauguuucuuagucacauguaaacaaugcacccugucauugguucagugaaugucuucacaaaaguauagagcuuuguccgcaaaugcaguuuuaugauaaagauauggacaggcuugcuggaguggcuugaucauaccuacuuguuacaguauuucagauaguucuuaucaugcaacugagaucuacauuugugauaaacaaggauauugaggagauuguuuugacucaaggaaucauauguaacucaaauaaacauguuuggaauaauaaugucugaaaauuauaauuauugaugacauuacauagcaaauacaguuaaauauuuaauguguuaggcaauaaagcuagaccugcaguggauggcuuauucuaggaaauugucaaacugacuuaaauuuaaauuucugauccuuagaauuagguguuaaggacaugcuuuuuuuuuuuuuuugauagagucuagcucugucgccaggcuggagugcaguggcgugaucuuggcucacugcaaccgcugccuccuggguucaagcaauucuccugccucagucucccgaguagcugggacuacaggcaugcgccccuaugcccagcuaauuuuuguauuuuuaguacagaugggguuucaccauguuggccaggauggucucgauuucuugaucuugugaucugccugccuuggccucccaaagugcugggauuacaggggugagccaccaugccuggccaggacaugccuuuauacuauaauaacagauuugaaugguuucuuaaauucagauaacuuuuaaguagcuguguuaauucauauagaugacaagguuuaaaaaaagacuuuauaccuagucugaaguggaaacuacaguagauuuauugugguaauuaagauacauaguuuggcuuuagaaacaaauuauuugauugaacaaauuaccagugaauuaaauuaagcgguaauugaaagcuuacagauuuugccauuuguuuccuaauuaaaguaucggcuuaaaagauauuugucugcucugauucuaagucccucaggcauaauuacaaaugcuuugagaucuuucuauguuuauuuaucaauaauuaucuauaauuaauuuaaaggagcugacauuuaaaaaugucagauuugagagguucuuuauuauugagaccauuaacaacucuuaaauuugguguuaccaaaaguaacuugacguuauauauguuauuauuuauuauuuuuauguuagaaaauuugguuagaauuuuaguucuuauucuuacaguugaauauguauguaugcauguauguauguauguaugcauguauguauguauguauguaugcaugcauguauguauguauguauguauguauacauggguuuucuccauuguggccacucuggucuccaacuccuagccacaagugauccucccgccucggccucccaaagugcugggauuacaggcgugagccacugugccugguguuaggguugaauauuuaauauaaauucuaaucuguuugaaaauagucuuagguguuuaaaugucugauuuagagauuuaaaguaagucuugcuuauauucauauuuuuguuucagauuuaauuguuuuuuaaaaaaugacauucaugguaaauauugaugauuugccuauuuucuuucaagguucaauuucaccguaucuacuuagauucaucuuuugugcuaacauaaaauauuaugaaaauaauacggccgggugcaggggcucacgccuguaaucccggcacuuugggaggccaaggcggguggaucgccugaggucaggaguucaagacuagccugaccaacauagugaaaccccaucucuacuaaaaauacaaaaaauuagcuggacgugguggcggguaccucuaauccagcuucuaggaaagcugaggcaggagaaucacuugaaucggggagguggagguugcagugagccaagauggugccauugcacuccagccugggcaacaagcaugaaaaucugucucaaaaaaaaaaacaaaaaacaaaaaacaaaaacaaacaaacaaaaaaccaugaugaccuaagugacagcauugcauuuacuagccccuccugguuguaaaugauuaaaucauuuugguuucuuucuaaugcauaaugaauuauugaaugaaugaauacauaaacuggaugagaaaacucagggauaccauugaaauuguuacuugcaugaugaggucuuaaugugaauagugcuggagaaauaguggcaacuuuaaauuuccuggaauguuuucuguuuaucaucauucauauagucuuuuugguuagaaaauuuaccuuuuagauguaaucuuaaaauucacuuuauagccaugauaacauucuuuuuguauuuauaguugauaugcuugcaauauuguauaauuguaugaacuuacaguuucacagaugaaagggggaaaauaucuuugaggucagcuaguucaucugcuuuuauucaagaaagaugauacucaaccaucuagaaaauacauucuaaaucacaaagaugauuuaaauugacuuguuauacugugguacaagugguccccugaucacauuacaugcccaguguaccagagccucaaaucuuaacaaaaauauaacuacaggaaauucaaaguauucaugaauuuuaaaaaagcacucauuguauuguccuuaucuuucguguguauuuuuuuguuaauauuggcagauauuuaaugaguagcuauuaggugcuagccacacucuguucuauuauaauauuuuccuuaacaacaaaaugccaaucaaaaucauaguguaaaauuaguaauuucuauggaaauggauuaggaauggugauuuuuuuucugcaguaauuuaaauaacuauuuagaaauauaacaguuguauuuugcucuugcaagucaaaaaguaguaaguuuaauaaaaaacugauaaaaauaugccuaaaugcuucuuccucuuuuguuuaugaggucaugaacuuggaaacuuuguagucucuucuuucacauuuggccaagaauuugacuuuuuuuguuuuuguugcagcaccauacuuaacaauagucagcaguaaacuaauguacugaaaaauaauagagcagccgggcccugaaagcaagcaguuaugagguccuugaccuugccccuucaguagagguucuuaauauuaguguuauuuuaggguugucagauuuaguaaauaaaaauacaaggcaucuaauuaaauuugaauuucagauaaauagugaauaauuuuuuaguauaagacagucccaaauauugcaugggacgaacuuauacugaaaaauuauuugucguuuaucugaaagucagauuucaccaguguccugaguucuauuuggcaccucuaguuauuuucauuuauuguauauuaggugccagacauucugagaugaauagaguccuugagugcuucaaaaucuaacugggggagacaaaaagaagggaugugaggaagagaguaccggaaaggaaacugugcaguaaucaagauguuugcugcuggaggucugaaccggcaguggggaugagagaucguuauaguucuuuguuaaugcugagcgaagucauccuuugaguggcacuggcaggcaaaaaaacucggaaggagcugaugagaaaggagagaugagaaaaugagaguaguaaaaauguuaaaaagaaaugggaguagggaagaugagaggaaaaagagagaaauaaagaagucagguccauccacggucuucaggggucaggguggaagugauguaucagaaggaacccugggaacuuucucuguguuucaugguaauuuguuacccugaaaaacuugcaagcucuuugcaccacaguuuccuaagaugaaggggcuggauaagauaauuucuaaccugaucugauucuaaaagcucguuaguggagguuuucugucuuugaagagggguuguccagguuuugacauccuuuccucccaucccuucagccuugcuuuguccuuauagccacuuuuuggaggccaggccagugacuucaagccuccuuuuuuucuuucuuucuuuuuuuaauagagagaugggggucuugcuaugucaccagggcuggucuuaaacuccuggccucaagugauccuccugccuuagccucccaggcaugagucacugcucccagccccuucaagccuuuaguuugauccuaacauccgauguguauucuaauaucuuugguaugaaaaggaauuagacuaccucagaggcauuuauuucuuaaacuuuuuuuuuuuacuuugcacugacaccaguguaguuuaaaauacaauauuugaaaaauaaauguaucuaauauacuguaaaauuuccuuuuguucauuuuugauaguccacuuuugaaugaauaaaauaggagguguagggcuagaaccucauauauuuuaauauaauagagaccguuugugacuuuggaaauaccugaaugcauuuuaaucuagccgcauaggcucuucacaaaacuguugcaugguggggagugauguuggugcuuacucauggcugugauacauuugcauaagcaugcaagugcccuauuuaauaauccauuuaaccguaaacuauaaauuaaaagugacugccagugauaaaggaagauuuaauggaagcaaauuuacuauuuaggaccuugguuuuuaaccauuuuuagaucuuggaagucuuuugaaaaucugaugaaggcaacuggccuuuucccaaauuggacuaacauacaaacuguugcagauaaaucaggggauuuagagacacgccuccccgcuuccucccccgugccccaauggaagcccauccauggaugaccugauuuuaaauuuaugauuuuggagcucaacuguacaguuaaacugguucauucauuuaauucuuaaaucauucauucaugagccaagcucucugguauugugggaggcugugauuuuuuuuuuuuuuuuuuuuuuuugauaagccuuuggcacuccuggaggcugugauucuuaacucucgcuugacagcaguagucuuauauaaacaaguucaagacccauuuucaucuugcaauggaagguguaacucacaguguauaucuuuaacguaugcuuuaggacuguguuuaucauucauaguccucuugcuuuaauacagcuuuuaauuuccauuuaguggaccauuuacauucuuauccuuauaaucacacaauuuucaauugccuuuccguccaaaucuuuauuuauaaacuuuuuuuuuuuuggugcucccauauagccaucaucuuuaaugcugcacaauauuccacugaguugauaaaccucucugaugccggacauaaagguuauuuccaguuuuacauuuuuuggagaauguugcaagugacagcuuuaaguagcuuuuucacucuugucuuggauuaguuucucagggcaaauucucaaggaugggaguaauggcucauuuauaacauuuuuauuaaguaccuaguauauuccaggcugggucagagguuuggccauuucuaugacacuugauaugcuuugccauucuuucccauugugguagagaacuacuucaccaauccagucaacucugaauuguccaacccagcagacaugugcuuucucauuccucauuuggugaauguugagaaguaaacuaaauaaagcaugacaggaagauaaaucugaagaaaugacaguguguagcuaaaugaaauguauauacuuauagaacuaccugccuuuuggauuauuuacccaacuuggccuucuuuugcuguaacugagagaugaaguuuugacuaagucagaagauuagaacacaauauagggauaaacauccuuagaaauaacuuaaauuuauucaagucaccaagaaaauguugaaguuuguuuaaagcaaaaccacaauacccagcuuuauuaauauauccaaacuucuauuuugugaauauuuauuaaaugcuuaguauaugcugggaagacaaauguguuguauauuccuaauuaguuauuaguagggagagacaaauaccuaaacagauaguugcugcagcgugcaguggacacuguaagagaguuuauaugcccaggaguacaaaggaagagaaguuucuguuucuuuacccagauuuuuuacuauagagaagcccccuuuuccccccuuucaugguuuacuuucaugucuugggagaggaaaaacacuuguuaaaaaguguaguacguauaaaugacucaguugggaugaagacucaguuuuugaauuacauguauaguuuaaugaagauucaaaguugaguaauuaaagaaccuuugcccugucaauuacauuauagcuggcugguugaagggaagucguagguugauaguuaucugaaaagucauuuauuucuucauaaaaauaauuucuaguaaucacuggaagggacaaaaauaaaacaauagaacugugugugcugucauuagcgauagcaaaagcauauucucacaugaucauuuuuuucugucaucuaggcuaacgaauaagaaaguuggucuaccuuuucuucuagaaagaacacuggggauccugacagccuggguccaguuauaacucugcugguuacuaauuguaaccuuagagcuuaauaacacccaugcuucuauuuccucaaugguaaaucagggaucguaauaguguacacuucauaggaccaccaaguccaauagauacggcucuaugcucaucuuagucaaugcucugaacagcauuugcugcucuugaccucuuccuuaaaacacuauucucucuuagcuucugagaccccaaacucuaguucuuuucuauuauccccugcuucuuuucauuugcucuucuuuuucuacccaauuucuaaauacugggugcccaaggacccuuucugucuuuuuuuuuuuuuuugagauggagccuggcucuguugcccaggcuggagugcgguggugagaucucggcucacugcaagcuccgccucccggguucacgccauucuccugccucagccucccgaguagcugggacuacaggcgcccgccaccacacccggcuaauuuuuuguauuuuuaguagagacgggguuucaccguguuagccaggauggucucaaucuccuaaccucgugauccgcccgccucggccucucaaagugcugggauuacaggcgugagccaccgcgcccggccgacccuuucucuucuuuuuguuuacuccuuuccaaggugaucccuuuggucugguggcuuuaaguauuaucuauaugcugcugagucuuauaugucucugguucugaccuguccagcucagagguccaacuucauauuucuaauugccuccuagauacugcucccuuaauaugucucuaacuagaucccugaaucucuccgcuaaaauaagcaaguaaagaaauaaacuuuucccuuuuccaguaaucuccaucuucgguuaauggccucagaucuaugucuuguccuuaauuaguucuuucacaucauauauccaagccagcagcaaagcacuaccuuuuugaaucagucuauuucugucuucccuaccauccuugccaagccagcgucauuccuugucacauucacagccuucuaacuuguccucuuccugccuauucuauacauagcuguuggagugauuuuuuuuuuuaagcaaaaaucagaucaugccacuucucuguuuuaagauccacuaauggccucucauugcacuaaaauaaaauugaaucuccuucccguagcuuacccaucugagcucaguuuccauagcuaggaaauggggauaauuguggcuuuaacuagaauauaguaaguuccaugagggcauggguuuuuaucugcuuuguucacuacuguuuuccuagugccuagaacaguguguacacguaauaggcacuuaauaauuauuuacuggaugaauaaacacauucagauuauguggauaccccaaagccuuucuucuuuccucuuucagagcaguauauuauguagcucaguauuuucugcauuacauaggaaggccagcuaaggcuucugaugcaauaucuccuuucuuuuucccuucucacuuuuuacgcauguucuccugucccucccugucuuauguuugggucauuaggaggauauguuugggucauuaggagaaagaugagugggugaguggggcaagaaacagaaaccagaaaggaauccugagacuaguaccaacaacauuuaaaacauaaacauuuuacuauagaaaucuuguaauaggccagguguggugucucacgccuguaaucccugcacuuugggaggcugaagugggcaggucacuugaggucaggaguucgagacuagccugaccaacauggugaaaccugguuucuacuuaaaaauacaaaaauuagccgggugugguggcaugcgccuguaaucccagcugcuugggaggcugaggcaggagagucacuugaaccugggaggcaggagguugcagugagccaagauugcgucacugcacuccagcgugggugacagagcgagacuccgucucaaaaaaacaaaaggaaauauuguaacauauacagaaguaauagauaguauaaugaauccuuaucucuucaucacccaguuucaacaguuaucaacucauggccauguuuugaacaaccauuguuuaauuuggaucuugccuauaguuaaggaaugccuaguuuauagagguuuauaucacagauaggauuuuacucuggguaucauuacuauuuuguaaaccaacuuguugaggacagauaaggaauauuuuuaagguuauuagaaaagccugaaauuucacuguuauuucaaccauaaguuugcaaauagugaauaagccugauaagggaagcacaugaagcccauuaccaguuuuuuuuuuuuuuuuuuuuuuuuuuuuuuaaauagacggagucucgcucuuucauccaggcuggagugcagugccgcgaucucggcuuacugcaggcuccguccuccgggguucacgccauucuccugccucagccucccgcauagcugggacuacaggugccugccaccucgcccggcuaauuuuuuguguuuuuaguagcgacgggguuucacuguguuagccaggauggucucgaucuccugaccucgugauccccccaccuuggccucccaaagugcugggauuacaggcgugagccacugcgcccggccagcaguuauuuauuucuuaugucaguugguuaaucagaaacaugcuugacugguaaguaaccaagagcaggcuuugaugggagguaugaaaucauggggaccuagggagggaaggguuaaauaaggacgauuaauaguguucaagagaguaggauggugcugcuuugcuacuuuccagcuugccuggaggugguccccaccucagagccuauagaaagagguccuuauucuaguuuggugauguuccuugugcauuguuaucuggguuccccucagcuuggcuccaaggaccuuguguaaaacugugcagaaggugcuucccguuaacucugcugcuuguuuauuuuuagguaucuugcaauauauucagaacucucccuccuagugacagcaaugaauuugauccagaagaagaugaaccuacccuugaggcaucguggccacacuuacagguacuuugaaauaccauuuguuauaaaagaaaacuccauuaacucauuagcugauuagcaugggaauuccuugaagggcuuuauucaccaagaaaucaaauuagaguacacuaauggaaaguuagagaauguuuuuuauguuucuuauucuugauaauuagaaugccaaaagaauaaaauagugucagugugaugcuuuagugucccccaaccccacguugcagguacagccagcaguucuuauuucucuauuagagcuucuuuaugauccugcccucuagagccuccaacaaagcacagaauuauuuucacauuagcauuaguuggaugugauuagcucacagaguauauaucucauuuuuagugguauguacccugggaacuuuguaugucugucaucacauuaacuacaaauguguuucuuuaguuagaaggacaaaaccaaacuguaauagcuauuucguucacaguacuguaaggaagaguaacagcugagagaaagcuuggguaaaggccaauucuguucucuugcacugagaaggccauguuuuccaaucacacuuaugugccaggauggaucaggggcaucacugcaucucuguuuccagcauuagagccaucuguauuguauuaacuuguauaauacauacugguaauuuuccagcucguuccuuccuugugcugccuucucugaaggccaaaauuucucaaaagaauagagcaaggaaauuuguacauguugaaccccaaagucacccuuccauugagucagaauauccuuagguugcucgacaaauagcaagggggaagggguggaagaaaaugaauaauaccuuguacaucuucaccccuaggcagaagcugcugcauuuucguagaaauguauucaugguucagguugacuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguuuuagccgggauggucucgaucucuugaccucgugauccgcccgccucggccucccaaagugcugggauuacaggcgugagccaccgcgcccggccucagguugacuuuuugaagagcaaacaaacugugcagcagagagagaaggccuagagauauucuaagaguuuuuccccccuacuucagaauuucugacacaaauuugcaagucugucuguccugcuuugacaacucaaaguuucugcaaguacacacgugugcuauuucccguuguuacguagagagcuuuugggggcucuguuuucucagcucuuacucaggcguguuaugcauauguauuccugccuccaaugcuaagacuggguaaauuaguuaaaacacgguaauugauuuacuaucuuagauguuugauuuuuuuuuuaaggucccagacauauugucugcaaucuaagaaacuuguaaaacuauuugugcuuuucauagguauaucccagauugugacacaauccaaaaaagaauuacuuuuuugaaugggugaauugucaugucuuacucuuaauguuuggugacaguucauugaauuacaguuuagucuggaagaaacuuaacaacaacaaaaagacgaucuccucaguagucucacaucuuaugguggaaaagacaaggaaagagaugucuucaaagccucagcauauugucuucucuguauucgaaagaagacauugggaccacucuugccauuugcaagagcuuuuugaauauucuaugucaugauaaccauagacauaaauuuccccuaaaguacaauaaacuuuuacucauuauuacaguuaauccuucccauacuuaaugacucuguaaaauacaggaccaaauuaauuucugaaacucuuuaauucugccacaaaaaaccacucuagcuuacacugucauuacugcaggaauauuaaccauuaguuaaucugaaauccuaaaaccaaagaaacagugaagaaugguaaugagaccugugcccuuuuggauauaaaggcagaaacgguauuauaauaugggcugguuucauguguguugacauccuguucaagguuauuauccuuugguccuuucuuuagcucaaggggaaauaugaccuacuaaugcuggaucaggugaaggaaccuuuuaaaauucguaaaucaaccuucauucauaguaaaguuuaggucacuaggcacacuguugccuucaccaucuguugcuuuuggaccaaggcuccugacuuggucucaagaauccuguguuuccuuuguauauucuuauagcacaaauuagccaccuuuccauuuucaguguuaggugguuuuagcacuaaugagggcagucacugaauguauaagaagucucuuuuucuuuucaugauaggucauucaugucauagucaccuaucaugaaguuuaacauuuuacuuuuuaguugauccaacugucuauuuuucugaccaaaacacagcauaguuuuagaccuuuucacuuuuuauuaacuucauaauuagcaguacgcuuccuuuucuggaacacauuuugcaaggaagaaaguauaaauaccugacgggaggaggucaaaacaacaaaaugacauugagaugugguuguugagugguuggcugugcucauugcccagcuaauugacugcuccugcauaccuuuuugauuuaaauuuguggcauacacaaaauuacccauuggccggacguaguggcccauaccuguaauacuaacacuuuggaaggccaaggcggguggaucacuugaagccaggaguuugagagcagccuggcuaacauagugaaaccucgccucuaugaaaaauacaaaaauuagacaggcguggcagcacacgccuguaaucccagcuacuugggaggcugaggcacgagaauugcuugaaccugggaggcggaggcugcagugagccaagauugcgccacugcacuccugccugggcaacagagcgagaccaucucaccaaaaaaaaaaaaaaaaaaaaaaguaaaaaaauuacugauuauaacaaauuguggaucuuuugggaucuuuaaaaauagacaaaagaauaauuuuuaguucaaauaugucaaaggggucuacucuguauguuauucaaccuuuucaguuauccaaaauaguaucuuguuuauguauuuucugaaauuaggugugucuucaguagaauacaauuuuauaggacuuucauuuacaauuaagaauuuguuuuuagugcuuuccguuugagacugacaaacaggaaugcuagucuucuuacuaaaguuccuuggagaauucauuuauguaaccuugaaaaguaauuuguccuccccagcccccagucuuucucuuuagaaacuuaagggagauuuuugauuuugacguagaaucuuucucuuaagugcagagaacacuuaugcuuauuaauaaauaugucugaaguguuuccaccaaacauuuuagaccauaacugcuuucaagugaccagagaggagagagcacuuugccagucuugcuggaaagccuugccaguccacaggccagcuuagaagaugagaaucuccccucuuuguggcaaucgaaagagggcuaaaacccacuugauggggucauuugaauaaggcugacauucuguauguaaaacugagaguugacagaugaguguauuagaaaaggaacaauucucugaggucuuaggacuugggcauuauuuugacuagcaaaauaacaugugaaauuuggcaacguccggaucauuaggaaagaaauuuuucugaauucagagaguuccaaggagaaaaacauaguuuuauaaggaaguaaaaugcuaacgugaaucccuaauuuaagucuuaaauuagagucugacgugagaagaaacauuuaaaucagugguaucuguggacccuuagaggggcucugagaccugauuuuccauguccugcaaggucaaaacuaccuuuauaacagugcuguauauaugauuuguccuuucacuguguugacguuuguacuauucauugcaaaaguggcggugguuaaaauugcugcuaccuuaacgagaaucaaggcacuugugucaaacugguugaguauucuucacugccacguacuuguaauuaaaaauguaaaaaagccgauuucacuugagaacaucuuugaagaaacagugaaaauuaauaauuuuauuacauuuugacccucaagcacacauuuaaaaauauucuacaugauacaaugggaaguaugcauaguaacauccacugcauacugaaauauaaugguuaucuuauggaaaagcauuuguguaauaguuuuugagcuguaacccaaacuagccuuuuuuuuuuuuuuuuccuccucaugaaacaucauuuuuacuugaaggaaugacuaacaaacuaugauuauucaggcuuggguauuuggcggauauuuugucugaaacaaacaagaaaaccauuugacaauauuuguuaccacugacaaaauuagagcauuaaugcagaauuuagaauuagaauuuuagaaaacuuguaucugucuugcaucugucaccuugagcuugcagcuucccaaagcuuaaagacuuuuuaaaaauaaaauugagauaauaaagaaugugauuuuuuagauacuguauaauaaaacaugucaacauuuaaaagagcugcguaacucaaugaaccaauauuuuccaguuggcaaaugauguuaggaaagcaugcauggauaaagauccauucaaagugcaagacagaugauuggauuuuaguguaacaaaguaugaaaaguucauugauaucauuucagauucuguguugcaacuaaucuuuaagaaaugacaauuuguugaauuuaguguagcaucaaagaagaauaucuacaauuaugugggagaaaaagaaacuaguaaaauacucucccuuuuuugauggagaucucccuggaucuccgucagccuugauuuucuuuguauacuuaaaccaaaaugacauaucacaacagauuggauauagaagcagaugaaaaucugucuuacauuaagccacauauuaaagagauuuauaaaacuauaaaacaauggcuuucuucucaauucuuuuggaaaguaaaguuuuuuuuuucuuuuuuuuucaggaacauaauuauguuaacauauaaugcaccuuguuuuuaaaugaaacagugaaauuuuaaaguuuuuuucacuuuuuauuucugauuagauauuauauauaucauauauaucucauauaaacaaaagcuuugggguccuuguuaauuuuuaaguguaaaggagugagaccaaaaaguuagcaaauguuauuuuaggaauagugaugaugauacauguuagucauugugcagagggcuuuauguguguauuuucacauuuaaucuuagagacuauccaucuccauuauaaaaucgaagagacaaaguuucagagaaguuaacuugcucaggguuacacaguuaguaaggaaaagaguuaggcauucaacccaguauucaugguuuaaaaaguucuggauuauauauguauuuuuuagagaaacagagucuuguucucuugcccaggcuugacucaaacuccugggcugaagcaguccucccuccucagccuucugaguagcugagacugcaggcgcaggcaguuguaccaguuaaagguucugguuuugauauacuguugcauaccucgucaggaucugauguagccuuugacauaggcuuauuaugcaaagagaauacgcagugauuccccacuguuuaucagaacaauuauuugaggcugacuuuuugcagauggguauauugugccacaccaucuuaugauccgaugaguagaaauugccauaaacuuucugaaaagaaauuugucagugaguaucaaaaauucugaauguuuggauaucuugugaucuagcaauuccacauuuagaaauauuuccucaugacauaauugaacaaguacauacugauguauguuaugugaugcacguugucgcagaaugauggagaaauaauucagaaacuacuuaaaugucuaagccugggagguugguuaaauuaauuaugaauaauggaauuauucauuauaaauuauaauggacuacuuacagcuacuaagaaugauaguugagauauuauugauguaaauuguucauaauacauuguuuaaaugguaaaaguagucugugaaacuguaaaaauauauuuauaugguauguuaaaugaaguauauacauaauauauuguuuaaaugguacaaguaguuugcaaaacuggaagaauauauuuauaguacauuaguauguuguagaaggaaauauauacauugaaauguuaacagugguugucucugaauggcaagauuaugggaaauuuuucuuugcuuuguuuaguuguauuuucuaauuuaaaauuuuaaaaguugaaagcauaacagcaacugugagccacaagaaaggcuggccugguuuguugauugauauuaaaaucaauuuucuaagcccugucacuuuuaguguuacaggcuuuuggugguuuuuaguacuguucucagugagucauaauuugaaauuaauuauaaucuguuuguugcagcuuguauaugaauuuuucauacgauuuuuggaaagccaagaauuccaacccagcauugccaaaaaauauauagaucagaaauuuguauuacagguaagcaaauuauugugguuguguguauuugucauccaguuaacacuuuaucucauuuucucuucauguuuguuaaaaaaguuuugcaaugacaguuauaucacccacaaaauauauauauauauauaaacauaaguuaauuuccauuacugccuauuaaaaguaauagguacauuuaaguuuauuuaugguagaaaucaauuacauuuuaaauagccaggaaugcuaaugccuaaaucccuacaguuuucucuaaaaauuuaauuauaaaggaauuucauuuauauaaccuugguuugugggaaucguuauauagcuuaaagacuuacauuugcguaaggauucuuaaagaagugugguguagaucuguuaaaacugaguaggcaagcucagacuucaaagcauaaguaaccuguaauaaauaaucaaagucaggguacugaugagauuucacugcuagaaaauagcauagcuuaacauucuaaaauuucccuaaagggauuaacucucaugucuccauuuggaacaucuccgggaacacuuuuuuccugacuccucauugugcauguuauaacaauggaucuuccuuuuuaccuggaacuugggugcuuucauggcacugaaguuuuagguaacacuuccuugcuccuguuguugauauauucgucucuaaaaaugggugcuugagccaaacugguguagcucucuucugagugacauguggggcaucuaauguaggaaagaauaaauguuuaucuccuaguaagccgguaagaagaauuucaaauuuaaaacauuaauuugaucuagccugggcaaaagagcaagacccugucucuaaaaauaaaauaaaaaguaaaacauuaauuuggcaggaaauuggucuccugugccuuacugggauggggcugauaaccuuugugaucucauuucccuccuuaauuaaauuaauacauuuggaauuuaggauauauagguugaaccauagccaauuuuuugacuguuuuugacacucaaaacagcaguuucauaggguucaauccaacagggucaggcaagcuuccagagagcugaggggcauggaggccucucuacauccuaaguaaggcuaaguggaauuaaacccaaaguucagaugucagcucagagcugaaaggagcuuuggugccuugccugugcggcucauuaguaccuguacacccuauuccccuagguacauggggcggauccuugagcaauacuucacauuuagaguacuuugguaccacacuggugaauccuggcucacacuuuaacaugagaggguuuggaaaagugaggucugaaauagagauggaaagguagguaaauagauggauacguggaucacgggguaaauagguaaauugguauggauuguuaugccagggaagcauaacuuauuucaaaaaaaauguaagugauacauaguagaucuacauuuuguauuggaaagccuugcauguauauagugcugucuaauugucagagcaccuuugccugcguuaguugauuuguacaacagucuuguaaaguagucaugacuaaauuuuuaugcccucccucacccuccgccccauuuuauagaugcauaaacugaggucuagaaagauuaucaaguuugcucaagcacauuuccuauucuggauuucuguccaucaugccgugaugccuucuugugauucccucacuguaacuuggagugacuucaagggagaaguagcccucacaucugaagacuaaugaaauaauaggguucuccuauuuuuugugaauuaaugugccuaagaggaucagauaguaauucucuauuagagccuguauuuaguugacauggaaucaguaaauccuauggucuuacuaugaagccagugcuuuucuuacacaaaaacauccagggcucagcccagugugcuguccaugguagacaguacugaagauaaugaaacuuauaauacgaaaacaucagagaaacccagauuuggaaaggacauuuuggguuauguauucuaguucuuuagcaaauuagucuccuuugagacccuuuuucagugaagaaaagccauauacacagguagcuuguuccauuuuuguuaggaaguucuuuuuuuauguugaaccucucuaugccuuguacccuuugucuuuauucuccccagaauaauuucuuaguauaucuguagcccagacauaaccuuucaggucuuagaacacagcuuuuguguucacccuuugacucuuuuucucuauaacagugguugcaauucaaaugcucauagccucauacauaguaagucugaaagccaggggucagacaauaggauguagacugguuccuauuaaauggggcuuuggcuaccccucuucauucaguuauccccagacuuuucuccucgccaauccccaagauaaauagaaauccagauucuucugugaaguuuucugguauuacuaaaaucuuguacagaaugaacuagcccauuugccuucuggaucuagccuaccagcugucaguaugcauuuucuccucuagaccgaguucuucguucugucaaccuucucucauuuguuaguuuugaagccuucaguauccugguuguguccauuuguccucuaauaugacaucuauauuugaacagaaugcccugagccuggucagcccagugcggcuuagaguuggcuuuuucauucccuugucgugacuuuagguuucuuaaaggaaaagucucaugagcauuucuugcuguagcaugacauugccaacuuauguuaagcuucugguuauagcuggcuucuaauugagcuuucugcauauugcugcauguuucucuucuuuucccuuuuuuaaacaaacagggucuugcuauguugcccagauugggcucaagugauccaucucagucuuccaaguagcugaaacuacaggugugcaccaccaugccuggcuuauuguugguuguuacacaguuggcuuuuuuaucuaaguguaguacuuggcauauguuccuguggaaucauuuaucccuuauucauaucuaccuuauucacugugucuuccaucuuuaugacaucuguaaccuaaauaugcuaucggccucaucuaagucauugauuaaaauuguuuaacuaggauaaaacacuaccuauuggguacagugcacacuauuauauauggguacgcuaaaagcccagacuucacugccaugcuucuaguagucuauuuuguguugcuguaaaggaauucuuguggcuggguaauuuaugaagaaaagagguguauuugguucauuguucuucggacuguacacgaagcauggcacuagcaucugcuucuggugagggccucaggaagcuuauaaucaugguggaaagcaaaaggggagcaugugugucacguggugagagaggagcaagacagagggggcagaggugucaggcuuuuuuuuuuuuuuuuuuuuuuuuuaaacaaccacaucucacgguagcuaauagagugagaacucacucauuacuucaaggacagcaccaagccauucaugagggacccaccuccauaccuccaugauccagauaccucucacuaggccccaccuccaacacuggggaucacauuucaacacgagauuuggagggaacaaaaaccaaacuauaucaaugcaauauauccauguaacacaacugcacuuguacucccaaaacuauaaaaauaaaaauaauuuuaaaaaaaagaaaaaguuguuaaacuagccaggguugagauaggagccuuuagaaauucccuauauuacacagcuucaucauuaaucaguaaucuuugaguuuuauccuugauccagaaauuuacuaguauauuaucauccuuccugcauuucuuaauuuugguuguauggagaacauagagacuauuagaugcuaugguaaaagccaggacucuguguuuauagcauuacugucaucuauaggccuuguaacuuuaucauaaaaaggaaugccauuuaucugccaugugguauuagugaacgucuagagcuagugcuguuuacugaugauccugcccuaagugcuugcaaaccauggguuuguucaucuguccuaaaauuuugccagagacaagaaauaaagugucaguggugaaguucauuuauauacuuuauguuuucagccccuuccucauuuuuccaauuguugccuucuuuacuuuccaucugcuggaucuguuauaaauuugaccuucacaccagggcucaccccaguuccugaaugaauugugaaaguggcaagcagggguauuggcagaaucagcaccaccauugagagcuugaaugaaaucaucugacuaaucagugcauuaacugccauguugggaauaagcccugggcaccuguuagcucccauuuuccagaauacccugcucauucauguugguaaucuguaaguuggccuccuguccuuuuccuuacccuuuagucugcugaugacuuaccuucgcucccggugccuucuaagagggggccuuaauuucuuaacugguucuccugagaucccuuccuggccaguuugguucugcuggggagugggugggccuuuggggcuugagggauugaugcugauauuuuaccccauuaucccccgucucacucauuccuccuccucuuucccacugugacuuaacuguccuugaauugacagguccuucuaaccucugcacucgguagucaggucuuuuucacacccccgcuuguccuugcauuuuucugaacuccaucgucucccauggugccaccuguuccuaguguguuucucuuaugacauggaaaccuacauccuuuuccuuuugacaaaucaggaugacguuuacccuguuucuuuucuuugggcagauuucuauuuucuguggguuuucaguggucucaaaaaagaaucuugguaaucucagcuuaaaauuucuuucuucaguuagacagaauuuauuguauccaugagauuucaacuuauuuucuguagcagcugaauauguucuuugcagucagucuucugacugucauuccucugucagugaauacaaaagcaaaauaggaauugagcuauuuuacuaugacguaguggaaaguuaggaagcuuuggguuugaaucuugacuucccuauauauuguaaguauauuuuaggagcugagaaugugaacuuuggggucagaagaaacugcauacaaacucuggcuucucugccuacuugcaguaugacuuucagcaaguuuguauaccuguuguccaagccugaauuuccugauucaugacaugggauaacaggauaaaugagauacuguuaaguaaaacaggagacacgucaaaaucgacaguugucaaaucugcuuaguucacuuggcaguguggauacaaagacaggaucccugccuucaaucuuaaacaggugacugaaaaccuugggcagauuauugaccacucggagccucagugucguuuuuuauaaaaugacauuaagaucaccuaucacaacaagucacagcaaguaggcuuguuaugagauaaaaugagaugacuuguaaaaaugucuacugguaucaccuauggggcauaguaguugcucauuaaauauuaauucaucuuuucacaacccccucauauguuaucugcccgcauugauagaauguauuauuuuucuugauuccaauaauuuuaguuuuauuuauuuauuuugagacagagucuugcucuguugcccaggcuggagugcagagguguaauuucagcucacugcaaccuccaccucccggguucaagugauuuucaugccucagccaccugaguagcugggauuacagacgugcaccaccaaacucagcuauuuuuuguuuauuugauuguuuuuuugagacagagucuugcucugucacccaggcuggagugcagugguacagucucagcucacugcaaccuccgccuccuggguucaagcaauucuccugccucggccuccugaguagcugggauuacaggcacucgccacuacggcuggcuaauuuuuuguauuuuuaguaguaacgggguuucuccauguuggucaggcuggucuuaaacucccaaccucaggugauccaccugccucggccucccaaagugcuggaauuacaggcaugagccaccaagcccggcccuaauuuuuguauuuuugguagagacgugguuucaccauguuggccaggcugcucuugaacuccuggacucaagugaucugcccaccuuggccucccaaagugcuggcaauacaggcgagucacugugccuggcuuccaguauuaauuuuaaaaucuucauuuuuugaaauagaauuuuaaaaauauauaugaaaguugaagaaggcuugaauaaaugcagaaauguagcauauugcuagauggaaagacucaccaucagaaagaugucuauauaaucuccaaauuauuuauacauuagugcaguucuaauuaaaauuaguuuuuuaaaaacuugaaacguuuagaguuaugaaauaaauuuuugaaaaagaugacuaaugauaugguacuuauuaaauaauauacuacaaaggaaaagguaaguuaauuaaaacaguauggcuuuggaacaguagaauggaacauaauagcgccuuagguggagaugacccugcugagcgugccauaaaacccauaagaagauguaccaaauaaacgaaugaauaaauauaugaauagauggcuauauacacauauacguuaaauuggcauaauuguccugaagagaaaaccgauaguauucuaucaacuuaaauuuagacccaacaauucugugagaaauaaucagauauguacaaaagauauauauacaaagguuauugaaugcaccauugcuaauaauuauuagaaaauuggaaaauaacuucaaaguuccuuaguaggagguaauuguacuguggacauucauauagugaaauauucaucaguuuguaaaaagaaugugauagaccuacucaaugaucuauuuuaggugaaacaugcauuguuauagaacaguauaauuuuugagccuguaucuguuauuuuagggaaaaauaauguuaguauuuuugucuuaguucuuuugugcugcuuuaacaaaaugccucagacuggguaauuuauaaagaacagaaguuuauuucuuacaguucuggaggcugggaaguucaagaucgaggugcuggcaucuaacgagugucaucuuacugggugugcccucacaugguggaaggcagaaggaugagagagagugaacccaugucccaaauccccuuucauaguggcauuaaucuauuuaugagggcagagcccuuaugaccucaacaccaaaaggccuuacuucccaacacuguuucauuggagauuaaauuuuuaucacacgaauuuugggggacacauucagacuauagcaauaugcauuaacaauuuugaaaggaguucuaccaaauuguuguuaauuggcuggaagggggugauuaugugugaugaucuucacuuccuauuuuuuagauaucucuauuuuuuauauaaaaaaaauaagcauauauguuguaaucaauaagaauaaaaaauuucaucugcaaguacauucucauuuuauugccuugcauuuuucauaaaccucagcugauuuugugcauuagccuuccuaagacuauuuuuguaugauagcaccauucuuuuaugcccaguauucguugcuuccuuccuuucaccauuuguaucugcccuuugaaaaucuaaagcucaaaugaaagcuuccuguguugccucaagugccuuuuucaauaccuugaauuuuucuuccuuaucaggaagcaguauagauuggugguuaaguguacagacugauuugaauucgggcucugccauuuuuuuuguauucgaccuuggacaagugacauaacuacugugugccucaguuuccucaucuagaaaguagaugcaaaauaucauaaucacauuguaagguuguuguggagauuuaacaacuaaauaccuauacaaacucucagaaguauucccaacacaugguucauauucaguaaacguuaugcugguggugucacuaauauuuuuauuaggauucuuguuuugagaacuuucuuaagcucuguuuucuuuaauagcuucaguccaugaaaucauauaguguuagccugucaugucuuaccuagcauguuaugaauuauuugaaauccaacucuuauucuaaaaaucauugguauccauucaacucuacguauaugguucuucacaggcuguuggguucucuuaagauguuacauggguuuccugugucucuggauucucuucaguuccacuuugccaacugauuuccuccaaucaguguugaacauaaauguuuauuagugccaggaacguauaauuuauaaugugugaaaaccagggauagcccauuuaaaucuuuacagaggacagacaaaugguacaugauuaaguaguguugguaugaccaaaggagugauggaaacuguggcgauuuagagagcuuggauccugcugccaauccgcucccaguaacgguuggucucuagguaagugagccaaguauugcuagaucuuuuggcuuuucaagagaagcuggaaagccauauuuugguagagccagacaaaacagucuguuguuuuucuuuuucuuuuuuuuuuuuuuuugagaugaagucuagcucugucacccaggcuggauugcaguggcucgaucucggcucacggcaaccuccgccucccggguucaagugauucuucugucucagucuccugaauaggugggacuacaagcaugcaccaguaugccuggcuaauuuuuuguauuuuuaguagagaugagguuucaccauguugggcaggcuggucuugaacuccugaccucgugaucugcccgccucggccucccaaagugcugggauuacaggcgugagucacugcgccuggccaacagucugucguuuuucauucaaggguuuugaauguuuuuguuugaaggguuuuguuguuuuuuauucuagaauaguaugacuggcucacuugaauuucagugugauuuuuauuaaaucuagauuuacauaaccuguagcauuuuuuguguacucacuuaaguguuuggacaagaaagcuguuagagauuuaucaaagauaguccauucauugcauagugcacuuuugucugugguaauguugauuucagacuuaaguaacuugguuaacugccuucuagagcuaugacuauguagacuugccuaggcuuuauggaacaauuuugucuauucuuaauaaagauaauuuucaucuguauugggaugguugggaaaaugguuucuuuaugaucccccaaccccuucuuuagaccuaaaugaauuagcaauacuucgauuauuucauuggguggauuauuguggcaagaguuuagcaacauauuucuaaagauuacuuucaacuacucugcaaaucugaaaaacagucagugguugcugagagacauacuauucaaguauccccguaaacauauguacugcuggagauugcuauuuaguaauuuguacuucacauuugcuguuauauuuagcugaaagguacuguaauuaucauguaaauuaugcagaucaugcaaaucauucagccuguccuuaaaagugaccuuuuguuauuguguuuuuaaaaacucaagacaaauuggacaugacacaaaccaaccuauuaaaaaaauuuuaguucuaaacugaaauaaauuccacaaggccuugaaucucagcuccaauacaaagaacuauuuuccaaacgaguuccuugaauaugucaaaauguuuacauuucucucucacagccuauagcaaguaaguguugggagcauuuauuucuaccuggaauuuuaugagauagccauugccaauuaccaguuaacaucacuucauccuguccuguccaguguauaacucaaaaaucuuguaaaaagggcuuuauugcucugacuccugcauucagagccagcuuccugguuguauaauuugugcaguugugcugggcccugugcuuagaagggcccugugcuugguuuagugcucugcucuugcugucuugaaacucuuaauacuuuuugagcagggaccaccgcauguuuauuuugcacuaggccccacaaauuauguagcuagucccugccugcuucccacuaagugcaucauuauuuagcacaauagcucuuucuugaauugcugaccaaauagguugucuuaaaaauuuaaaucacaagguugucuugaaauagauaguaugcucaaggggaaaaaaauggacuucuuugguuuguggaaagaaugcuugaaauuaaauggaggaaaauaaaagcgugugacuugguggaguuguucauauuuguacgccuuacacuuucgaaaguuuuguauugaauuuccauaggagucuuggagucagaauugccagaagcuugugaucgcaaccuuuugaugccuuguccccauuguccuuucucaguauuugccccauagguugcuucauuuuauacagugcaucccuugagucguucugauucacuggagucagacuaccuuuggcucugguuucuuuguucugggcuguuuucucuguauuuggccaaggugaaaguaugaggaagauaguuuucagguaguaggagaaaguugcaaacaaagccagaaauguggacaucugauuuuagugcucuguggcacuuuggaugaaaacauuuagaauaccaauuuuaucgguuaucuauuugaagaauucugauguucucuaaaaucuuacuuuacauggaauagggcaggguaauucuuuauuauagcagagagcaacuggguuguuuugcucgaaaccuuuugcucuuaaugacuuuuaaaaauaguuuugauaaugccuacuuuuaaaauuccaauauguuuauaugauuuuuaaugaaaaauagcagucucuugccucaucuuucuccaaaccagaguccuauuuccuagaaguaaccacacuuaagucuuccaguuguuucuguauauuuauuuccauauuucuaaacagcaugcuuauacugcuauuuuuuaacuugugauuuuagauuuuauuuaugucuauugacuuccuacuguaagccauuauguaucucccacuauaacucccucucuacauuuguuauaucacaaaauuugaaugaaucacaugauagaugaguacuauuguauacauguuguucauuccaaggcacauaauuacauuuguuuucuuguagagcuuuuuuuuuucuuuuuuuaacccuggaaaauaggugccuuauuuuuuuacuugcuuuccuguguauucaucacuagugugugcuuuaauucucugagaguaaccauacagcccuucucaguauggcccacauaucaacuagucuaucaguuacuuuuuuuuuuuuuuucuuggagaccuucuuccuggagcccuggucauccugcucuaauuggcacucugggccauccacacagucaucccagcacuucccuuuggugcccuucuagacugugucuuugcuuguuuaacuucuucuuugguggagcauaucuucuagauucuuccuaagaaagcaugaaugggauguaaguguucugagaucacuugucugaaaacgucuuuauucugccuacauuuuuuuuuuuuuuuuuuuuuuugagacagacucucgcuuugucgcccaggcuggaguguaguggcacgaucuuggcucacugcaacuuccagcugcugggauuacagguguaugccaccacgccagacuaauuuuuguauuuucaguagagacaggguuucaccauguuagcccauguuggucucaaauuucugaccucaagugaucagcccgccuucgucuuccaaagugcugggauuacaggcgugagccacugugcccugccugccuacauacuuuauugacauuuuggcuaaguguaaauuuggaacuuucccagauguuuuaaggaauugauccauuguuuuccagcuuccaguguggguauuaagaaggccugcaccaggugaaugccuuauccuuuauaaugaccugucuucuuuguaucuucuuugagaucuucucuuugucuccacauccagaaagugaugugcuuugguguggaucuuuguucauuuauugugcagaacacuuaauggaccauaucuauauugacauugaugacuuuuuuuuuguuggaaauugaauugaauuauucuucagauaauuuccuucucuucauuuucuguuuuucugucuccaugucuuucuggauugcuauuauguauuggaucuucugguuuuuaaaaucuucuucuauauauuaucucuguuuuuugguuauaugcucugggguagaguugcucauuuuaauguucuagugcuucugcuaaaauuuuuauuuauuauauguugaacuucuaaaagcuuuuaaaaaauuuccugaauauccaccugaauaauagcacuguuuuauuucaaggauccagcauauuuguuuaucuuugaagauguuaauaguuuccuucuugcaauuuuuuuugguacuccuagcauugugccuguuuccucugaguuccuuauaauuguuuguuguggucuuuuauguuaaaauaucuggugaucuuugacuucauagucauaauuacauguuagucuaccgaaaaguugcuuagaacuuguguauguuaccgugugcacauguguguuuauauuugcauggugacacuuggcaacuggugacuuugaauggcauaacuggucagggaccuugccauuucauuaggaaacccucagcuguuagcauaucuguaggucuuuccucuugaggcugucaguuucuuccaaaagggacuuucugaucuucugacuuauacagaauugggagccuggucagggaagaaagcuggcaaauaugucacuuuuagguaugcagaguuuuauuucaucccauuauuuccaauaagugcuuuacuuaacguguaugaugucuccaagauuagauacuuacucauucucuccagacuuacauuguaaaucaucaauacaccacaugggauagggaucuggggggucuucuacagacuuucaaccaguccuccuguuuuuagcuauuucucacacccuuaccaucaaauauaucuggugccuuuaguuuuuaagccuuguaaggguuccguggugugaacuggccugcuucucguuggcuuucuucccugcuugcagaauggaaaaacacuuagcagacuggagaaagaggaaacuuaagauaguuaccucuugucauccacuuccaucuuugagaagucuacaaauaagucuaaauuuucucuccaguccugucuaugccaaggcuuucuucuauucuuauucuuucacugucauuuuagggaggauucaagaggagagagguucaaucccccugccuagcuggaagacccuuacagcccuuuuucauuucacucuucucauuucauuguagauuuaugaaguucaaagaaagguuauuuggcuaaaucacuauguaguuuaacccuauuugugagcuucaagaaggcugguuuuuguaaaccuggaguuaguauguugacaggucugucuuugcucuguaaucaccuuggaaacgcuccagcuucuuaacuucuuuucuuugacuacaagcuaccuguuauauuagggauggcacaguccacuuaggcauuuacaggugugggauuauauuucuuuuuugugugggagugauugggacuauagauaugacuaagcacacucauauuauuuuguuuuggaaaucagagcucaucagaguucauccuacccccccuuguuuuggccugugcacuauuauauuucucucucauacaucauaaaaucaucaaaagcauguucucuacagagaagcagaaaaauaguuuaauacugcaauucaucuuucucauagaauaugauacauuuaauauuuguggcuuuguaaauaucuaaaguuaggcacucggcaaugcauuuuguugagagccuaaugaaaacaucaaacauuucuugcuuaauuauuguguauucauuaaacucaagauuaacaguauacaaggaagguugauucaaguuuugcuaauacuacacacccucaaaccuucucuuauguugguuacaaguuauucauuaaagccuuuugaaacacuuaaaaguagaaacgaaauuuaaaaaauaaaacuuacaagguuaauuauuucuauuaaccuuggaaugggaauggguggauggguggauuggguagguggauuagaggucuuaugucauuuggaacauguuauagauaaagagauacugagucuauauggggccuuuuuuuuuuggcugguuggggccacaugccuuucuuuccuagauagaauguuuuccuguggaaauguauuaacuugcccauuaccuccccugaugggcuccaaaauuguucaacaauguguauguccagcaaugaggaccaucgcuggcacauagaaagaacucaguacguauguauuuauuguauugcugaaugggcagagagcuguaguuaacaacaucuucuguuuggauaggcugcuaggaaaagcauguacuauugaaccugugaggagcacucauaucccacuucuaacuccucauuucuucaucggucagccuggaugucucuuccuuuagaagccuuugcugaucacuccacuucuuccaaauacaguagaugugucugcuguguauuuauacaacauccugaacuacuuaacaugcuguuuauuuacuuguuuguauuccccauuagaauaggcucugagaaagcaaagacuguaucugucuugcuuaucauuguaucccugacagcucgcccacuggcuggcuuuuaauaagcacaccauaaauauuuacuugaaauacucauuuuuaaaaugaacagaugaaugaaugauagauggaugguggauggcauuauguagcuaaaaauuguguccugucucuaccuauuuuugaagaccauccuuuaguuugcguuuccugccauguuugaggggccuuuuuuugguccauaacucuugucuuuuauucaaauuaaaacaccgaacaaaagcacauucgauuauugaccaugagguuuuuauucugcugucagugucaaccucaugucuaaaucaccugaggucaaacuuacauauaucuggauagccuuuuugaugacgaugguagucuaauuuguguguuaugugcucuugaaauguuuugcuguaaagacacuagaacugaauuuugcuuuauugcaaugaugaugaauguuaaaaaaaacaacucaguaacauucaaaccaauuuccaaguuuguucuucagccagaggaacuugcacacugacuuuuuguaaagguagcagauuuauuguguuguaauucauacaccauaaaauucaccauuuuaaaguuuccaauuuagugguuuuuaguauguuuacagagucaugcaaccaucaccacaguaucauugcaggauguuuuuaucaucccucaaagaaauccagacccacaggaggcugaagcaggagaaucgcuugaacccggaaggcggagguuucaguaagccgagauagcgccacugcacuccagccuagugacagagcaagacucugucucaaaaaaaaaaaaaaaaaaaaaaaaaaaaaaaagaaagaaauccagaccuauuaguagccacuccccauucuacuuucugucacuauggauuugccuauucugcuuauuucacauaaauggagucauacauuguauggccuucugugucugguuucuuuuacuuacuuagcaugauguuugaaagauucauugauguuguaacauguaucaguuacuuuguuccuuuuuauggcugaauaauauuccauggcaucccauuuuguuuaucaguugacggauauuuggguuguuucaguuuuuagcuauuaugaauauugcucccaugaacaucuguguacaaguuuuuguguggacauguguuuucgguucugcuggauauauacaugaaaguggaaucgcuuagucauauaguaacucugugggagauuuaaggaacugccaaacuguuuucugaaauagcugcaccauuuuacauucuuaccaacaauguaugaggguuccaguuucuccauauccucgccaacacuuuuuauuaucccucuuuuucauuauagccauccaaugaguaucucuuuguugguuggguuuucuuuucuuuucuuuuuuucugagauggagucuuccucuguugccuaggcuguagugcagcagcgcgaucucggcucacugcaaacuccaccucccagguucaagcaauucuucugccucagccucccgaauaccugggauuacaggcaugugccagcacgccuggcuaauuuuuguauuuuuaguggagacaggauuucaccauguuggccaggcugaucucaaaccccugaccucgugaucuacccccucggccuccaaaagugcuaggauuacaggcgugagccaggguuugcuuuucuguaaugaucaauaaaauagagcacuuuucaugguuuauugaccauucuuguugaaaaucaguugaccauaaaugugagggcuuacuuuugggcucuuaauucuauuccauuaaucuguaugucugucuuuaugccaguaccacacugucuugguauuuuggacuaaguuuugaaauagagaagugugaaucuuucaaguuuuguuucccucaagaguauuuuggcucuucugguucucuugcauuuccauaugaauuuuaggaucaacuugucaaugauacaaaaacaaagcagcuagaacuuuugauagagauugaguugaaucuguugugcucacuggcauuuggcugaaacuuuagcuuguuaccucuuuuggacuaguugcguggaccucauuuugagcauguagaugugauguuaucaggauuugguuauuaacuuuagauuacaaauguuugggaacuuaaacauguuauucacagccaggcaugguggcucacaccucuaaucccagcacuuugggaggcugagguggguggaucaccugaguucuggaguuugagacuagccugaccaauauggugaaacccugucucugcuaaaaauacaaaaaauuagcugggcacggugguaggugccuuuagucccagcuacucaggaggcugagacaggagaauugcuugcuugaacacaggaggcggagguugcagugagcugagaucgugccacugcacuccagccugggcaacagagcaauacuccaucucaaaaaaaaaaaaaaaaaguuauucacauauaacauacaacagaaauaaucaauguucacuucguugacuauuuacagagugagcacaccuacauaacaagagucuggaucuaaaaaggaccauugccaguaucauugagacauuuugauguuuguuuugauucagguuuuuucauuuuccuagauguucuaguagagcugaaggcuuauccuuuuuuuuuuuuuuuuuuuuuuuuuuuuaaagaccgaaucuugcucuauggcccaggcuggagugcaauggcgcgaucgcagcucacuguaaccucugccuccuggguucaggugauucuccugccucagccuucugaguagcugggauuacaggugcccgccaccacaccuggcuaauuuuuguauuuuuacuagagacgggguuucaccauguuggccaggcuggucuuaaacuccugaccucaggugaugcgccugccuuggccuccccaggugcugggauuacaggcaugagucaccacaggcagucagcuuauuuuaacugcauauuuggaauaucaguagguagcauagugcagugguugagcuacggacuuuuggccucaacugcugggguucaaauucuagcuuuaccaccuauuagcugugagaccgugggcacguuacuuaacccuaugugccccaguuuccucuucuguaaaagggggacaaaacuaucucauugggaggauuaauauguagauugcuuggaaaauugccugaugaucacaguaagugccauauguguauuagcuauuauucauauuauuacuuuuauuguuguuauuuuguauuuguauuucuuuaguggaauauaagcuccuugucugacuuguuuaucaugauaugcccaaagacuagcacugugcuuggcacauaauagauauucaacacauuuuuugaggaaggaagaaggggauuuuaaauaauagaauuccuaaauccuuuucugaaaccgccuuugacagcuauaaugucuuucauuuacaacagcuucuggagcuauuugacagcgaagacccucgggaacgggacuacuuaaaaacagucuuacacagaauuuauggcaaguuucuuggucuuagagcauuuauccgaaaacagauuaacaauauuuuucuaagguaaguggagugugaugggggaagaaggagaagcaaaguugguguuuuuaugaguauuaaguaaaucucaaauaucugaaaacgguguacugacuucucuuucucccuuucugccugccuuccuucauucuacugacucuccugccucuuccucuacccccucccccuccucuccucccccaucuucuccucuccucccccaucuucuccucuccucccccaucuucuccucccacccuccucuuccuccucuuuuccucuuccucucccuccuccccccacugcuucuucucuaucccuccucucccccuacuuucccccuccucuucccucuccccugcuuuucuccucccccuucuccuccucccccaucuccuccuccucuccucuuuuccucuccucucuccuccuccuccucuauccccuguccuccuccuuucucccucccucuccuccucuccuccccgcucuccuccucuccugcccccucccccuucuccucuuuuccucccucuccuccucucuucccccaccucucccucccccaucuucccccuccccucucuuccccccuucuccucuccucccccgucucuucccuccuuuucucccccucccccuucuccuccucuucuccucccuguccuccucucuucccccaccucucccucccccaucuucccgcuccccuccucucuuccccccuucuccucuccuccccgacuccucucuucccuccuuuucucccccucccccuccuccuccucuccuccucccucuccuccucucuuccccccaucucucccccgucuccuccucucuuccccccuccuccucccuuuucccucugcuccuccucccuuccacccucuccuccccccucuucuccccucucuccuccgcucuucccuccucuccucccccucucuccccaucuucuccucccucuccucucuucccccaucucucccccaucuccucucuuccccucucuccuccucucuucccuccucuccuccucucuucccuccucuccuccucucuucccuccucuccuccuccucucuucccuccucuccuccuccucucuuccccccuccucuccuccuccucucuuccccccuccuccuccuccuucucucuucccccuuguccucccucuccuccucucuuccccgcucuccuccuccuccuccucuucuccuccuccucccccuucuccuccuccuccuccucuuuuuaucccuuccuucuccuccuccucuccuccuuucuccucccuuuucuccucuucucucagguuuguuuaugaaacagaacacuucaaugguguagcugaacugcuggaaauauuaggaaggugagcacgguuuuucuaauugcuaaucucagaugaauauuauuuuaaaaauuagguucagguggcaccaagagaugcucaccuaguucucuugcuguauguacauugggucucucucauuugugccuauuagcauauuuuccagcugacucuacaagacacaauuuccuguuccccuuguuccacaaguaugcauugccauuuccacuggaaugacugaaagagcugacaguucauucauuacuagaaagaugguacaucuaauuguggucaggcuaguuacuccaaaacaucuuauucucauuaguuuuuaggcuaucugguccuuugccuuaucuguugaaagcaaguuuauaauaaauuggaaagauugccauuuucaaaggaguuguguauccagguauaguccuugaacagcugcagccuggaguaguggaaugaauuggaaagagcugugguguaaguuucuacacacaagggaggauaauguagcuggacaauaugauuacuuaaucuuuucuccuaauaugaagagaaaaagaagguggagucacauggcuuucucucagugauuucccuaggcugggcagagguuucaggaaugagaaggaaugaugucuggaaauggaaaaggucauauuuaaggcggaagcaagcaaggcgggccauuauuuggagaaggaaaagggagggaaaauaaaggguuuugauaaagagcuuuuggaaaccaucugacuaauuuuaggagcacaggagccuuuguugggugaccagaagcaaauuuucuucucuuaaauuuccuuccaacuuuuuguauuccuugaagucauuaagaaauccuggcugggugugguggcucacgccuauuaucccagcacuuugggaggccaaggugggcagaucauuugcaguuaagaguucuagaccagucuggacaauauggugaaacuccuucucuacuaaaaauacaaaaaaauuagccaggcaugguggugggugccuguaaucccagcuacuugggaggccugaggcauaggaauagcuugaaucccggaggcgaagguugcagugagcugagauugggccacugcacuccagccugggcaauagagcaagaugacucugucucaaaaaaaaaaaaaaaaaaaaaaaaaaggaaauucugaaugccacugggguggguauuauguuguuuuguacaaacaaacugauuaaguuuaauuaauaucacaagaacaguuugucucaguucaacuugugguaacauugcuaauuugugucucuuuuuucucccuaguauuaucaauggcuuugcuuuaccucuuaaggcagaacacaaacaguuucuggugaaaguauugaucccuuuacacacugucaggagcuuaucacucuuccaugcacagguaggaggauuuuguacaacuacuuuuagaagcaaaauaaaaaguuugcaaacucguuuuuuugauauugauauaaccuucauuuuguuuuuuugguuuuuguuuuuugagacggagucuugcucugccgcccaggcuggagugcagugggacagucuuggcucacugcagccuccaccucccggguucaagcaauucuucugccucagccucccgaguagcugugacuacaagcgcacgccaccaugcccagcuaauuuuuguauuuuuaguagagacgggguuuuaccauguuggccaagauggucugggucuucugaccucaugauccgcccaccuuggccucccaaagugcugggauuacagaggugugagccacggcgccgggccuaucgccuucauucccaaaggaaagagacuuacuuaaguuuaaaauacuccccgagggaaauaaaaauguaugcauuuuuuuucuaugcacaguagaaucauggaaauauuuuuaaagugggaggaacccuuguuuggucauuuuauuuuacagagaacuuauaugacuuucccaagugcacacaauaacauacugaaccuauuacauauaauaaaaugcacaggagcuuagcagauguagaucuuuggacuauguaaucauguuuuaauguucuugaauauuuuguuccauccuacuuugcguuagucuaucaguugcccuuuuugccuccuguucuaggucacucaccaugucuuuaucacuuucuacacacaagcacucucacaaguaaacaaaucaaucaguauuuucacauuuuuuuuuuccuuuaagccuucaucacuuuaaaaagcauacccugucuuguccccauucuaauuuuugugcuaacacugccuugcauggucaccaugucacuggggguagauaaguuauuggguaguauuuuaaauuuuggauaggaagauuuuaaauacugccagacucugacucccucuuccccccauugggaagguuuugaguuugcauaaaaacgugacacauuuuucuaagcacuguuccucuuuaaaugugaaauucucuauuucgaggaaaaauuaauccauauguuucuaauuuagaacaccaucaaaauguucuuuugcgagggugguuuucuuguccaagaaucuuuacaagcccuuuuacaaaucuugccuuugauuuuugaaaugggauaucauauuucaugauuauuauuuuaaacaaucuuacuuagauguguuaguaccagauguagaacuauucuuacauuucuccagguucugacuggcagguacaaccuuuuaucuccucgugaaacugcuuuaguuugcaugugccauuucaggcaauuggcaaaguuuuuauuaagugcuuacuucccauagaggacucuuguggaacuacaguaaaacucaguacuguugauauuagcaaagagagaaaggaagccccugagauguagcucaaaguguauguaggugagauaauuccacaauaugcugaaugugaugucucaccucugcuuuucauuagcugcauauuucauguccuaauacucuuuuuuaaagaaaaguucccuggagccuuguuaauauuagucuuuggcuugaaaaaguaguuucuuauuuuacuuuauauagauuuuaugauaauuaaaaugaauugaaugugaaguuauuaaaagcagucuggaaaccuuuuaggaaguuuuaauaguguaucuuuugagcccuuacuguauagaauuuaaaauuuugccuuuuauuuuauuuuuuacucagcuggcauauuguauaguacaguuucuggagaaagauccuucacucacagaaccaguaagucuuuuuuccauaauuucaaaaacuuaagaaaaauuaccuuucccagaaguauauaugaaaaaguuaaaugccauuuguuuuucuccuuuucauuuuagguuauuaggggguuaaugaaauuuuggccuaaaacauguagucaaaaagagguaagugcuuacugucagagaguguucauagcuuacugaauauuuugcugagugccaaggauugggcuaagcauguauaaaaccgcaucaucagggcugggcgcaguggcucaugccuguaaucccagcacuuugggaggccgaggcgggcagaucaccugaggucgggaguucgagaccagccugaccaacauggagaaacccuaucucuacuaaaaauacaaaauuagccaggcgugguggcgcaugccuguagucccagcuacccgggaggcugaggcaggagaaucgcuugaacccgggaggcagaaguuugcagugagccgagauggugccauugcacuccagccugggcaacaagagugaacucugucucaaaaacaaaacaaaacaaaacaaaacaaaacaaaacaaagcaaaacugcaucaucucauuuaaaccucauuguaacucuauaaggcagggcugucagaacucuuguuuuacuaguuaugaaacuguagagagguuaaauagccugccccaguacacuaaguaaguacagaugauuaggccagaacucgccuccuugacuccuaaacccugucuuuuuauucacugugcucuucagccucgcuaagcccaggccaggccccaaucagguguccaguugucuagcuuuguugauguucccuuccgaguggcccccuucauaauaugaagguuuugcugucacuguacauagacgcuagagcagccugcccaaauacucauuuuaaagcaugguauagguggaucuugcugugucaucuuagaauagacaacagaccuuuaguuucagccauucacaaaugacccugggggguucaggccuacaaucauuuguaccuuugcugagaauucaccaggcaugugcuacuuugugagguuguuaugggguagugcaugaguuucuuagcuggaguugagccuaacugagcaccagaucugcagccauucuucuggaagguuagcaaccauguggaaaauggcucagaaaaaaagaucagcuguuaguuuuauauuugguuaaaacuuugggagaaauuccauauacauauuaacaaauggcaagggucuacuauauuuuacuuuuagcagaaacgccuuccuucucaaaucagcuucaauucuccaaacucuauuuuaauuucagaaagucauuuaauuucuuaaaaucuguuagauaaaauugaacugugcauugcuacccagauacaucucaaaauaugaaggcauuguuauuuuucauauuuugauugcucacuuuauuuuuucaaaguaauuauuuuuucauagcuaaauacguaaacugguuuuuauuuaucugucauuuucccauuauauuuaaaacaauugacucuacugcagauuuggcuccauauugugaucuaaaaacucuguuucuugcggcacccggugcugaguucacaagauucacugugcuuuguagagagcaagcgugugugugugugugugugugugugugugugugugugugucgagaaugcgucagugcaugcuuauggguuugaaguggcaccugcaugugagugagucugcucauuuguguuucuugaacuuuuuguuguauuaaugagugcguucuagagcauugagcauguagcaggggcuguacguauuuggcaaauaaccacauuugaacuuuugccucuuccauuuaggagggccaccuucucauuguuuuuuuuaaaaaaaaaaguguuguggaaagagagcuggauuacuaauaauagagaggaaggcccuacggggucaguuuugcuucucaggggccggugcagugugugagugucccucguucuauguaauauauauaccaaguagaguauuuuuuccaaguacguagaauuuuuccaaguacccuauggugaauucuuuguggaacgaacaucuucuaacaugggauaaugacugguucauguauguuugguuuuauguguaaauuuuucuuaaaauaauccaaacucucauuaauccuccuuguucuuauggauuuuuuuucaugaugugccucacaucuuguauuuugcuuguacuuacaggucauguuccuuggggaacuggaagaaauauuggaugugauugaaccuucacaauuuguuaaaauccaagaaccuuuguuuaaacaaaucgccaaguguguaucuagcccccauuuucagguuaguaguaaagaggacaugagccagggagcaugaguuauuuugguuaaauuuuauuuguuucaaaagcaauguaauggacccuagcuaccuauuguuuauuugcuauccccucacaugaugauaauuuuaauaguggccagcuuaucuugagcacuugcugccuaacagccacaguaauggugcuuucucuccaguaacuuuaauucuccuaacacccugcaaggagggcauuauguuuuuuuuuuaaagacauacagaugugaacacugaagcucaaaguggucaaaaguauuucagauaauuucuaaauaagugggcuggugagguuucucuaguguguaagagagaaugcuaaauaauguuuaagaggaaaaggagaaaaccuaauauuccuuacuaugcuagauacuuuagguacauuauuuauaaaugucccauuauccucugaagcuuuucuagaugaaaaaaaaaaaaaaaugaggcuuggagaacaauuuacuauaggucccaaguuaauagagaguagagucaaauuuugaucuuugguguagcugcuugcuaaagccggugaccuucccauagcacugcucugccuccucguggccacucggggcaacacuuuucuuucuuggggccauggcugcagugcuguggaacccacacaggagggaagaaggguaaacugggggagcacacguuagguuugauucuuuggcugucucaccuaaggcccguuucauaaaccuagacugugccuauugauuggaagagauuguucagacugugguucuuagcgcagaaccagaccucuaacggugucauuugauggcggacuuuuucccuaagcugucaacuaugcuguauaguuagagacacuagcugcugcuguuguuuugauuucugaccaaaagacauguuaauauguuaaagcagugacuuuauggcagucuagcaguuguaccgcaaagcaagaaaaaagaagauagaaaucaugacaagccugaauaaaaauggaaaaauuacagaacaguauauagauauuuugauaccacucagggccuuuagugcucacacaucuggauuguuuaccuuauuuuuuucaguuuucagcaggauguuuggcauuauggaggucaaggaacaaguauuuuuuuaaaaaugagcaucaucggcugggcgcaguggcucaugccugugaucccagcacuuugggaggcugaggcggguggaucaugaggucaggaguuugcgaccagccuggccaccauggugaaacccugucucuauuaaaaauacaaaaauuagcuggacgugguggcgggcgccuguaaucccaacuacucgggaagcugaggcaggagaaucgcuugaaacuggaaggcagagauugcagugagcugagaucaugccauuguacuccagccugggcaacaagagcgaaacuccaucuaaaaaacaaaaaaagaaagaaaaaagaaaggagaaaaaaaaaaaaagagcaucaccagaaaggccuaagcguuacucagaagcuuagaaaagagaggccaugucuuugucagcuugggcugccauaacaagacuggcgacuuaaacgacauuuauuuucucacagcccuggaggccagaaguuugagaucaggaugacagcaugguugguuucuggugagauccugcuuucuggcaugcagauggccuucuucuugcuguaugcucacguggccuuuccuggcaugugcauacagagagaggcaaucucacucucuuccucuucuuauaaggccccuguauuaucugguuaggaccccacccuuaugagcucauguaaccuuaauuaccuccuaaaagucuuguguccaaauauagucacguuggggauuaggacuucaacauaugaauuguggaggggacacaauucaauuugucgaagaaagaaaaaaggauuuuaaauuauuuggcagaaguaaaauugagaacaaagggaagaggcucuuauuuauuaaguguucauuaauaaauguuugcugguucauccacaaacauuuauuaaugaauuugcugguucauccauuuauugaguggccgccuuauguagccagacacuuaucauugcuugcuucagguauggcauuaagaucugaggucugcacgcuggugacacugccucugugugugcagaaggacaguggaucccaggaaaguaguggcucuguccuguugucagacacaguaauuuuuaacuuugcauaaacaauaccuuuccucuuuaaggggcuggauacauacuuuuauuaguggguuuacauauuaaaauggauauauaagagauuaaggaaguuguuagaguuaaauggcagguaaauauuggauucuggaggaauguccaaagagaccacgggaggaugccaguaaagaaggaggcaccuaggauuuuccucuaaccaguuagaauguucagaacagccucauucuuacuccuuuuuuucucccucuccuugccuccugcuuuaucugugucaguuacgucauuugcuuugaugauucccaaacacauuguccucguccaugccucuguccuccuuuccuuaaugcccucuaccuggaaugcccuuuccuucauccuucgaagccgagcuuaaaugccacuugccuauguuacauuucuuucuucuuuuuuuuuuuuuugagauggagucuugcuguguugcccaggcugcagugcagugguacagucacaguucacugcagcaucugccucccggguucaagcgauucuugugccucagccucccgaguagcugggaccacaggcaugccccaccaugcccagcuaauuuuuauguuuuuaguagagauggggguuuuaccauguuggccagacuggucucgaacuccugaccucaaaugauccacccaccuuggccucccaaagugcugagauuacaggcaugagccaccacacccagccccaccuauguuacauuucugccacccuucuguuucccaagucaucuggauuguugauucugcucuuuuccccuccuuccccugacacuuuauucauauaucugauauagcaucugucacaguuuacauuggauaggcuuguagaugccccuucucccaccagugugcgaacucuuuagggauaacagaguaaagagguuaagaauagagacuuuggaaucugccacuuacuagccaugugaccuugagccaauggcuucucugagucucagauucuucauccacaaaauagaaaaguaaugguaccaacucuguugguugugaggaaaugagauauuauauaugugggacacuuagcacagugccuggcauauagugaacaugcaguaaugauuguuuucuuuguacucucagggucuggugccuaaugagucucaggguuuuguuuuguuuuuugaaccaagcugaauaauguaaauggaaaaauucuguuuucucagugucuuucgguagauacaucuuauaccauuuuguucucuucuaaaacagggcuucuuaaucuguauaaaugaaggaagccaccccuuuuucccuuuuccccuguaacuacccuuuuuagagauuuuagguuuuguuuuugagauguucuuuugaauucaugaaauccaagaugagccaaucaggcccagcagaccaaauuagagccaguugauagcauggugggcagagaaaagggaucuaagagagcagagaggguaggugcagccagugucccugagaccagaaacugagcagacaucuccuggcuugcacaggaagggaccagaaacaaacucuggaagaagcccuagaaaugaggccccagucuuuaccauauugucaguguaaccuugccuacauuacucagucucccugagucucuguguccucaccuguaaaaugagcacaaugguaucuccuucugggauggugguaaggaugauacauucuacuugcuguguaggcacagugccugcccauaggagguacuuaguaaauauuggccgcucuacagggaugagcaacuguggguguuccucaguagcugugacugaaugcuaaccauaugcugggcccuggguucgaucuaagugugugugaugaaaaacauaagaaaggggaccagugagaugugcuaaagugaugucaggaaaguguggaaucagaugacaugggcagaauuagagaagaauauaaauuaacaggaaaacuucuuuuccuucccugagucgaugaaccacuugaaccacucuggacuuuuuuuuuggugggaggagaagacacggucuugcucugucacccaagcuggaguucaguggcaugaucuccacucacugcaaccuccgccucccaggcucaagcaguccucccaccucagccucccaaguaggugggacuauaggcacaugccaccaaucccggcuaauuuuuguguuuuuguagaggcgaggucuccccauguugcccaggcuggucucagacucuugggcucaagugaucugccugccuuggccucccaaagugcugggauuacaggugugagccaccgugccuggcccacuuuggaauuuuccaagagauuaaaaauccacaaacauuuaaaaugugggccaggcacggugguucacgccuguaaucccaacacuuuugggaggcugaggugggcggaucacgaggucaggagaucgagaccauccuggccaauguggugaaaccccgccucuacuaaaaauacaaacauuagcuaggcauaguggcaugugccuguaaucccaguuacucgggaggcugaggcaggagaaucgcuugaacccgagaggcggagguugcagagagccgagaucgcgccacuagcgagacucccaucucaaaaaauauauauauauuaaaaugugauuaauauuuaauuuuaccucuaauugaaugauuuacaaauagccuuuugaaauacuuuuguuuggaaagauuuauaauuuuguuuuaucuuugucuuuuucucucucuuaacauuuuauuuuucuuuucccaaagguggcagaaagagcacucuauuauuggaauaaugaauacaucaugaguuugauagaagaaaacucuaacgucauccuucccaucauguuuuccagccuuuauaggauuucaaaagaacauuggaauccguagguuuucaguuucuuuccuccguucucuuccucccuuccucucuuucuuucccuucagccuuauuaugugccagaugcuguccuuguugcugaagacguaugugaaaagauaaaauccuuaccuucuggggauucacugacuggagaaaauaaacagauacuuuaacaaaauaccgguuaaaguaucuguuuacuagacaggcuucuugaucugucuaugaagguagcagaucuuuuggggaggcacugcagcugagaggagagguguguagauacugacagcauggccaugcuuagacugaaucugaaaggaauuuggcagguggauggcauggggagagcccuuucagacaguggguccauccaucauguuaaaaggcacaaagauguaaaaagcagcugucaguuucugagaccugugaguuugggagggcugaggcacaaggucuuuuggggagggugcuagaggauguggcuagaaaagacugugggacucgugugagccuucaccaaguagaugaugaggaaguacugaaggguuguuaaguggggaaguggucugacuagguuuucauuuuagugugaucuauuuaacagccaacucagucgcuauauguaucucuuggaaaggaaggaguuuaaaaucaucaagggaaguuuaacauccagcccuaugaaaguuaaagcauucugaauuugaaugccuuuacauuuuucucuguggaauagaaggaaaauuuaaugugguauuuaaaaauugggagauacaauucaguauauucauaauauguuuaucuuuaaaaauuuugcauguaauuauaaaauaucacauuucuaauuuuucaaauuugccuaauuauauuaauagaacuuguaaaaauaaggagcugauaaacaguuaagucccuuuauacagauagucucuugaggaccuagagaacgguucuagcaagugucuguaacuacucaguauacuacauuuggugcuuucccaucacugcccuugggaggaaggucauucuggaaccuuaacagaaaagaacuuaaauuuuccuuuuaauggcacaaggcagaagcuacacagcaaguguacuuucuuguaaauguuuuggaaacaucagacucaugguuuauuuaauauauggcuaauuuuuaccaaugcauuuuucagugguauuaggagcauguuuguugcaaaacggaagcaacggauauuuuugcaaaaggaaaagcuauuuagacucuagucugaagcuaucaagcccaucauaaccuuguccucacauugcccaagagcuaauucuuguuaaguaugggcuaccauuuuggcuguuuagcuguauagugucccauagcuaauagcaaccaucccagcuugccaguuaucagcauauauuuugggucagcaggacuggugcagaucagagcuagacagauaauucauauugaaccacccaaccuacaugagggcuugauuucauuucuuuggauaagaauaauuuauauauauacacauauauauauaacauuuguuucuagggaaguagcuucugauuuugaugaauuauguguuauuuagaaaauagaauucuaugcaaauucagaugucuaagguuagugcuaucacagauccuuauuuuagggugaaauugcuuuacuauuauacuugccuuuuuauuaaaugaaauuaucaaaugcccacaggcagcucuauucugggugccaauaauuagaagggcaggccaggugugguggcucacgccuauaaucccagcacuuugggaggccgaggcaggcagaucaccugagguugggaguucgagaccagccugaccaacauggagaaaccucgucucuacuaaaaauacaaaauuagccaggugugguggcucgcuucuguaaucccagcuacccaggagacugaggcaggagaauugcuugaacccaagaggcggagguugcggugagccaagauggugccauugcacuccagccugggcaacaagagcgaaacuccguugcaaaaaaaaaaaaaaagaaauuagaagggcaaaguuagauuuuuuuucuaguucuaccaccccucagaaaauuaucuugccuugaaaucucuugauguggaaaugaacuguaggucauuuucaguuguuccaacuaaaaaaggauacagacagugugcaguacgagaaaucauucagacaaaaguugugcuuuugcuuucuucauucaguaucccauuuuauaagacuaacuaacacacuccuuuuuuucugugcuuuccagggcuauuguggcguugguguacaauguguugaaggcauuuauggaaaugaacagcaccauguuugacgagcugacagccacauacaagucagaucgucagcgguaacuuuuuaaagcuuuuuugucagcugugcauaaagcuauugaguuuuuuccuugcucuuugcugaaguugccuaauuguaccccaaaucuuaagcagcacaauuuuguuuacagucaugcauuacuuaacaaccaguauauguucugagaaaugcauccuuaggcaauuguauugugugaacaucauaaguauacaguaauuacacaaaccuagaugguguagccuacuaugacacaccugaacuauguaguauugccuguucuucccaggcuacaaaccuguggugaauaccguagccaauuguaacacaaaucacuaggcaguaggccuuuuucaacccuguuaaaauuuuaugggaccaccgugguauauguggucuguguugaccgaaauguuguuauuuggcacaugacuguauuuauauauucauuuuugcacacuuauuaacugugucuuuauuuauuuauuacugugccacugaguaacaaagcuuccugacacucauuuugauaaagcccgcuuucuuuccuuucuuuaauaauauuucacuucugccucaggguuaagagcccagcauuuaacugguauuuuagguucacuuaaagggaccaucagguaguuugcucucugggauucacucccacucugaacuuacuugaaguauaauugggcagaucuuguacuucacuccaauagcagggggaaugaggcaccauuuaucuagcucuugggcccaggacuuacuagaacccaacaaauuuauuacaauuuaaagaucagugaaaagaacaugaagguuaauagucugguauuaaccagaaauguuugagaccauaugggagaacaaaccaguggaacucuuugcaauaaaugcuuauggcuuaguaaaaaucuuguccaaugcauucuacuuuccaaaagauguacuuggggagauuauagaagucuagagagcucuuaguaguugcgccugugguuuggcuuugaucauccauaagcagaugucagcuuuguauaucauaaagcuauggaccuuagaggacccagagaugugugcgaguguucauacccagggucuugcugaaccucucugguucccuuggugcuuugcuuugucucauuuuuagucugucaacuugcauuuuauugauaaaaagagcaaugaggggaaagguuugauggcagagggaccauugcaaugauuuuuuuguuuuaaguuaccagggaugugguuuaugaaaaccaacuuaauuauggaauguggugaguauuuagcugagaaucucagaagaggcugggauuuuuuacccagaauauugggauuauuaucaauuaugggauauguuauuccauacucacaguuuaaacaacuuuuuuuuuuuuguuuuuugagauggagucuugcucuguugcccaggcuggagugcaguggcgcgaucucagcucacugcaagcuccgccucccagguucaugccauucuccugccucagccuccuaaguagcugggacuacaagcacccgccaccacgccuggcuaauuuuuuguauuuuuacuagagacaggguuucacugugcuagucaggauggucucgaucuccugaccucaugauccaccugccucggccucccaaagugcugggauuacaggcguaagccaccgcgcccagcccuaaacaacuuuuaauucaguauauuagcgauuguugcaaauuauaaauuuaugauaacccuccuugccccaaacuuaaaaucuuuaaaggauguuacuuaaaaaaacggccaaggguacauuuuaauacuguguugcaucguuaaaggugcuuugugcauaacaucuucucugaaagcacauuauuauuauccuaguugaaccaggauuaaauccguagaaucucaucaagaauauugaagaacuuggcugggcacgguagcucacgccuguaaucccaucacuuugggaggcugaggcgggcgggucaucugaggucaggaguucgagaccauccuggccgaauggugaaacccugucucuacuaaaaguaugaaaauuagccaggcacgguggcaugcgcuuguggucccagcuacuagggagacugaguugggagggucaguugaacccgggagguggagguugcagugagcuaagaucaugccacuguacuccagcuuggacauuggagugagacucugucucaaaaaaaaaaaaaaaaaaaaaaaaaagagagagaauauugaagaacaacuuauuuccacucaaauuauuugguuuguauuuagugaacuucaauaauaaaacuauuuucugguuauuaucuaaacuaaauagacuaaacccuugaaaaagaugagaauuaacuaaggggaccaggaauagauaaaacuauuauuuuaucuauuccugguugagguugauuaugauauucuggcauauuacaguuauuuauaaugaguguacuuucuuaaugagaaaaugggggccaggcguaguggcucacgccuguaaucgcagcacuuugggaggccaaggcaggcggaucaccugagguugggaauuugcgaccagccugaccaacauggagaaacuccaucucuacuaaaaaauacaaaauuagccgggcguggaggcacaugccuguaaucccagcuacucaggaggcugaggcaggagaaucacuugaacccgggaaggggagguugccaugagcagagauugcaucauuguacuccagccugggcaacaagaggaaucccagcucuuugggaggccgaggcgggcggaucacgagguuaggagaucgagaccauccuggcuaacauggugaaaccccgucucuacuaaaacuacaaaaaauuagcagggcgugguggcgggugccuguagucccagcuacucgggagggugaggcaggagaauggcgugaacccaggaggcagagcuugcagugagccgagauuacaccacugcacuccagccugggcgacagagcgagacuccgucucgaaaaaaaaaaaaaagaaaauggguuuuuaaaagcaagaauaauaauuugucaaaugagcaauagaaggguguacugacagauggaaacauugguuucuccauaggugugggaauaggacaagggaaugaagaaauuuaguugguacugucagagaauaacugaauggacaauuuuacuucaggauggcaagaaguuaaugguuucaguucagaucaaauuuugaaguauuacaaaucugaaaaugguggguggaauaaguacuuaacacuguuagauacauaugccaacauuagugcuauguaaaauugaaauuagaagagaauuugacaauauccccugcaugacagugugguuaagcguuaaaauuuccaccuacagggagagagaaaagugggaaagauugggggugacaauaacugugucagcaauauuuaggauuuuuaaagauagaguugucaguaugaaagccgugugauaacugagcauaaugcucaguuggaggaaaagcccaacaggauaaauugcauugagugccauauuugaucaaaaacaugaaacacuuuaguaacaagaugaugaauguuuuaaugaugucaacacuuaauuaaccaauuuaugccuaguguuccauuauuggaacgcuaagcuugugggaguuauuucuaucccacugcucaaggucaucgucaaggucugauuuuucacaagaaaguuuuacaaccucuggcauaaauggguuaaaacugcaaauuagggcaaugugaaccugaaauacauugaaauguuuuuuaguugaguaaaauuccaagcccuugcuuaccauccccuuaucucuccaaauaaaaaggucauauucaucgaaagucagcaggaucuauacaauugauuuauauauacccaaauuguguuuuuugcuaacauugauuuagaccucauaauuauucccagacuguacugagaaacaaaaagugauaauuugucaaacagcuugauuauguuuagaaucuggaaugcaccaggagugguggugcacaccuguagucccagccacucaggaggcugaggcaagaggauugcuugagcccaggugauugaggcuacagugagcuaugauugugccacugcacuuuagccugagcaacagaaugagacccugacucuaagaaaagaacaaaagcaaaaacaaaaaagccagaagaagauuggaggauuaucuaaucuugcccuuauuguccuauaagugcaauuuuuucagggucaaaauuaacaaauagguaauuuuaugaaaacuagucugcuuacugaaauuuauauugugcagauuuguauuugagauagcugaaacuaauuaugguaaacaaggccuaaguuaugaaaauauuaccuauuagaucaugauauuaauuaccauauggcuuuacuaagccauaaacauuuauuguaaagaguuccacugguuugugcucccauauggucuuaaacauuucugguuaauaccagacuauuauggcauuauaauucaacauuuccucaagucucuaguggaauaagaauauaaaauuacuuagguuuuucuugaguuuuuugggaguuggaggggaugaagauuaaucucuauugcucuagauauuaauauaacuuuuaaaaaacauugguuauaauguuuuaaaaaaaaugaggcauuggaauuacauacaaauuucacucaacccauguggauuucccugcguagaaauuguacuguggcugaaguuuuaauccuugcuaagugggguagugcauggauuacauccccaugccugagaugguggagcccccauuuucaggaauuaucugaauuccuggauuuaugaauguuaaucuggaucagcauuuuuuuuuuuuuauuuuuuuuuggagacggagucuugcucugucccccagacuggagugcaguggugugaucucggcucgcugcaaucuccguccaccacaaucuccgccccccggguucaagcgauucuccugacucagccucccaaguagcugggacucuaggcauacgccaccaugcccggcuaauuuuuguauuuuuaguagagacggggucucacugaugauccacccgccucggccucccaaagugcuaggauuacaggcgugagccacugcgcccagccugggucugcuuuuuauugguucgcugcaacauggaaaaaaaccagagacaguguagugaauuauuuuuaguaaaugugaauuuauauaacuuacaauauagucuuauauuccugcaucauguacuuccuacuugguugauguuaaaaauccuuuuuuuguaaaaauguaauuuuaaaauguccuuggcaaaauauaaaguuugucgauucuaauuuggacaucuaauuuuugggggaaguuuuaccaaauagugaaaucucaaagucugaaaaucacuaaauuuaaaaucagugaaauugauauugaacccaauuugaaggcuugaugcauuaaaauuuaauacuuaauaauaucaaccaaguucuuuucagaucauuaaaagugaaaucacaaguuuucaguuucuucuaaacuacugaagaauuuaaauaugcaugaggugggaaaaauaggaauaaaggagcagauauauuuucuugaccuacuauauucucuguaucagugucaucuccagcauccuuuuugagaaacuauuuggagauaaagaaaaauuaagauucuuacuaagcugcaagugaaaaucacuaauaugcccuugauuuuacaauaacugaugcauauaagucauucccauuuuuguuucuuaguaauuuuaaaguuaauuuucucaauuaagcuaaguauaaaggaguguuaaggugaaauuguaaaauauucauuguugcauaaucucauuaaaccucagcuguuuacauuguauucuguuucuuccucagugagaaaaagaaagaaaaggagcgugaagaauuguggaaaaaauuggaggaucuggaguuaaagagaggucuuagacgugauggaauaauuccaacuuaacaaaaacaaugacaacaacauuacuaaccuguggagucacacguuuauguaguagaagauggagcaacaguuuucuguauugugcaacuuuacaguagauuucaccuuuguuucauuauuacagcagcacuguauauaccugucucuaaguaaaggaaaaaacaaaauaaggacuucaauccaaaguuuggacaguagauggacuucucagaacuuugcaaacauaaucauuguucucacccucuuuuaaaaaaaaaaaucggucuucaaagaucuguugaugaaauugcuauguuaaaauuccauuaucgggaguuccuuauuuaucacuagcagagaguaugauacaauuuucaaaugugaacaaucuuaaauuuagcuugucuuucugcuaagcuguuaaauguauuuauaguaaaggaagaaaaaaagacugucauuuccuuauaaguuuguguaacauccuccucuggauaacuugacuguaauuuaacaucuuuuucuuuugcacaucuuccugaguugaauguccacguggaauggggucaugaauuauaaaagucccugauaaaaguuuuguuuacuggggugaacaucuuuccaguaaccagguaguccugguacuccuuuaguuuuaaaauuaggaguuaagagagaagaggugauaaacauaguagggaagggaauaucggauucaugcaucaguuuauggugaauccaaaucaaugucuugaauccuuugaaaacaggcacugggacaucacaggcuucaguaccugaccaguauuaguugcauauaucauugaacacacauaccagagauguuuuagaaaugugagaaaaacauccuuuuggaccauuugaaauaagaaagacaaacacuaaacaauacaaccaugaaauugaucaccgggauugcaaaucuaauugggaaaagaguugagcaaacagcuuggacuguuuggaguuguugccuuacuuuuuaauauguauuuauaaaguauuccagcaaaagaggauguagccucugggaaaaaacaaacauguuacaguguuuuuuguagauucucguucuauaucucaucacagcgccagcccuguuuuuagccggaaaggauucaggauaaacauuauuaugcauucugaauuggaugcauauuccuaacuacuguauuuguuaccaaaagugguucuacaaaugcuacugaaaaaaaucuggaaauuccuaauguccugaguauuaauaauaaaguuuaaaaaugcuuuuauaucaaaggugcaucgugaccaaauuguuuaagaaaaaaaaacaaaaaaaacaaaaucuagggcuguauuuuauauauauauauauauauauauauauauauauaucuuauuggcucucugcuuuguauuuaaaugaagaaucuuacaucuuggguagguaaacugcugauaaaauuuguguacaguauguacuuaccuaaugcaguugcauuauuacguacugaaagauauguguuuggagguuuauuuccaggaugcauuugcuuguuuuggucauggcagcagugaguugguaauccuaaaccaucacuuccagcaguauucaugguauagagcugaucuguguucauauguugaauugugauaguagcaaacaugaacauaugaacuauuguugcucuuaauagaaauacaauauaaauaugggcuuguauauuuucuuccuuacauuuaaauauaaaguagaauacgcaguuuuauuauuuucaagaaaaagaaagagaagcugcugaccuuucucccccauaaaguuuuucaggaugaucaggucacaguguguacguaagagucagcuaauuauggauauugucaucucgguaacuuuguaaaaaaacaaacaaaacuggcauuguuaauuccaaaaagaaaaaaaaaagcaguaaaaaaaaaaagucauaugcaacaccagacgcaacaugguuuaauggaauuaauaguuuuuuuuuuuuuuuuuuuaaagaacauugauggggauucacuguaaaguuggcagaggcugccaaagacgaaacaacugacuuuaaaaaugcuggaacaaugugauaaaaaauaaauuuguaacaaaucuucuccuuuuuagcccuugucauuuuagcccuuuaguuucaacucugcauuauauuuaguuuauauaguguaaacuuuuguuugccauuaauucaucuuuuuagguagaagacauuaaaaucacagguuuaugaagaaucucugcucauuggaaugaaaugcagucauuugaaaugagaaaggccaggauccuuuuuuguaccuuacccugucuucaagaguaaaggugaacacuuacagcucuccuccuugaugucaauuuuguauguugaucauuccaaacugagaagaauaaagccacauuuuagacauauuuauagaaucaauuaaagcuauaugucuaaaauucguagggcaacuucugagaagaaacaccgucuuuuucuuuuuuaauggaaagugacaaugugacauuagucauguugugugcggugacgcagaguaacugagguaaucugacuguugcacuaugugacauauuucaggacguacuugcugcauuugcagcagcccucucucucugucccuucccacaauucugcuguugcugcaacuugaguuaauugugacaaaugcaucuuuguguuauauuuuguuugcuucauaauuuccagaacuauauauaaauauauuuuuuaaauagcaaauauuguaguuagugagugaugaucacuccaaccuuauccuuaccauauugguuucagggauaggauuaagagugucuuuggaagagaaaaauacacacaacccugugguuuagaaugacgcugaggccuuaggcugugggccuagaacaacuaugugagugaauucacccaucucauacuuugaaucaagcaugcauuccuguuucucauugugaaguauccccaguuguuuuccuucaguguugaguuuuuguccuuuuaaauuuuauuauauuuugcucucccuaacauuugacuguuuuuuauaaaagaaaagaaaaaaaaagaaauaaauaauacccucgaugccacuggauacucacaagcaggguuaugcuccuucaucuugggcuuguuugccuaaaugaaaggguuuaauuuauuuuguaccuccuaugcgugggauaguccagggugcagagccaggacuugcuuguaauugcaccugcuauacuuaaauguauagcccuaggcucaaucacacuauggaaagaaacaaaaaaaguauauuuagagcuuuaaaagcuuuuuuauuuuuuuguggggaugagggugggaugggaaagggauguauggauguuauuggcauuuuuaaguguuuagaguuuuuugggguuuggggugguuuuuuuuccuuguuuuccuuuuuuccuuuuaauuggaugcacugaccuggcccaggaaaugaagagauucucuuuugaugcuauuaccaauguuaucauaaagugacagucaccuguaacaaaaagguggcaccagacaugaucacugauguuuuauuugcacaucaauauuuuuauuuuuguauucuggcucagcugcuucucugaguggaguuaaggaaugagccacaaagauuuuuguaguagguauauuggcauugcauuuuauauuccucuauauuuaauuuugaaaaccuaaaagaaggauugugcaucuugagagaaaguugagcaaauugugaucuagcggaauguuaauuugugcugcuucuugugcacgauagcagcaguaguaucucucuuggaaauaaacaucccauauuaugaugucuaugaauauagguuuccuuuucuuccuucccucccuccuucccccaccuuucucuuuuuuuuuucucucucagcuucucuuuuccuccuucccucuucccuuccucuuucuuuacuuuuuuugaaaucacuuauuguaaauaaguuguaauccaaaccucauguaucaauggggaauuuucaaauauaaauauuaccaaugcauuuucugguuguugucugauuuuugauugaaguauaaugagaaugacaugucuguugcuuuugguuugaggacuucgcuuuagcuucauaaaucuuuugguauuuuaguauuucauuguuuuagcaggagagggcagcaaaaguucauuuucccuguuaguaaugcugugguucaugaucgguuuuaaauuuagcuguguguguguuuuuuuaaacagcaucucuuugugaguagagguaaaaaugaaacauuuuugauaugaaaaguugcauaugaaaauuauagacugguucaaccagacagugaagacuucugauccacaucaaacuuaaaaugccacaaaacaaucuuccaccucuggcuaaaacaugcuacuuccuuuucaaacaccacaaaauacaagcugagucuuaaacacuuggaauuuaaaauguuuuucuuuggaaaugauuugcuuucuucaaagugguaacagaaacaaaaaugaaggugcuccccaaaaagaaauguaaccuuccccuuucacagaugugugagagguucuguacugugggugcaucauaauaaagaagcagugaagaguuuuc

SEQ ID NO: 17069 - RNA, 476 nt, Homo sapiens
cccgagucccuuaacuaaccgagagcuaacaggucggggacugcgggacggaagagggaggggaagaugaagaaaaucggugaugaauggcuggcggaaaugauuggcggaaagaaagagccaguucacagugcgccuuuguauucggcgggaaacccggccgaagagggagcuggaaaggacuccggaauccggccguaauuccagccaaucagggaguagaguugcggggcgggguuggggcggggcagucucgcgggagauaguuucgcggguucgggaggcgagucuccgguuuccgcccagucucuggggacgcgguggcggggucugaaucgccuggcuuccagggaguuuugggcggguccccgcacgggagcguggcaggcgcuggacucgacagcagauguggaacuggagagcuuggcgcgcccucauacuuugucacacaccuacgccaccagacuggggucggg

SEQ ID NO: 17070 - RNA, 20430 nt, Homo sapiens
uggaaagggguguaccaagcaggugcagugacucgagugaaggccauagcagugggguuggaagucaaggggaguguggggaaagaggaagcggucgggccugcggaagucacccugggaugucugucgauagagcccgugaugagcccugccaugguuucaugaacugguccacagugccaaccuagcauugguggagcugaaccguggugcagggucaauacaaacaagagggaaaacaauacagaaggauuuucuuucucuuuuguagaguauaucuaaaggauggaggugucuggugccuccccgccccgccccccagcccccagucuugaucuaugccguggcucagcccugcugcauccacagaaaugagcaaaugggugaagguguccauuucaugggccccaccaugggcaguggauagugauuaagaagcucugcccucuuccauugcagugagacuaugugcuccaacuccagaaggggcuguguggaggcagagcaagaagcaaggaccuuacagguagcuucccgucagcaagcuaaugagagcaggaggccuacucucuugacagagccauaugugcaaauguuccccuccaugcacagcauuaugggacauuauccugacugugaggucaggaggaagcaaggaaaggaggugugauggugugagggugagugagggguguaagagagaggaauguuaguugugacugggaaaaaaaagggagucuauccugugcuacuagcagaaaggagugugcuggguugggagugccuuuggcacucagggauaacuaagacuggauaggggugcugggguuguuauggcagcauucccagugugcuccggggacccaauccuuugaagggguccaugaagucaaaacuauuuccauaagauucuguaacaucuuauggcccuuuuacucucauuaucauucucucauugagcauauaauggacuuuuccaaagguuaugagacaugugaugucacaacagaucaagugcugucuucaauuaagccagacccagagaagaucugaaaaauguacaaugccuaaauuuugcugggaaaagauaaugcauuuucauguuuacaaaguucuuuauguuuacauguaacucaguuuuaauuucuaauaugguaaauaucaauagcuauaacccauaugaacaaaaacucuuuuaggcucucaauaacugucaagaguguaaagagguucugaggccaaaacagagaacugcuacauuaggacaaacccugaccaaaacaaauuugauuuuuauccuguaggccagggaguccuuauuuccuaaguuauaauacaagcuccugguggacaggaauuuaauaguuuuucaaaugauuucagaaaaccuagcaccaugucuuuucauguaggcccuaaagaaaagguguuaaaauacuaggauaaaaaguaguaggaauuucuaagcaguaggaauucagagaaauacaaaauucaggcuggaggugaggaugagccagucuccaccuguuucucuguuacccagggcagcccugggcagaucugccauucuccucucccccacucccucccuaggguguggaggcccuguccagcaugaacaguauacucaagaaggggcugaccucugucucagcuaacugguuugguuggcugguugccagugucacuauacagagggaugcagauuuaaaaagaacagucugaacguaaaacaguuuuuuguggggcuagccgaguacacguccuuggagggguuuagauauugucagauguccuccgaaagguaggccaggcagccgauuuuggcccucuuaaaaugcugagcgcugacggugccugugagugauaaggcagccaacacaagggcugucugcccgucccuugcuuuugcugccuguuaaucacgaggauaagagcaacucaaugaagaaacaggcagaagucauccaacuuccuuuuggccgucagcacacugccgauaaucagauacuucaacccaccacucaccguggggccgcccccgugcaucuugagagcccugacaguggcaacaagcaccaccacgugggggcagaggccggaauaccggcauuugauguuaaaaaacuuuuccauuccaaugucugcuccaaauccugcuuccgucacuguaaagaggaaagcaacaguaaaaaugccaucccaauuccccugauguuaaaagaaacauacagucuauucacugguuuugcaaaaaacacuaaccuacaaacccuucugggccaacaagcuugagugcgauccggucugcaaugauggaggaauugccaugugcgauguuggcaaacgggccagcauggacaaacacuggagugcccuguggaaaccaggacaccgugagcugagcugccaauccugcuucaaagugggaucacacauucaacgguauggaauugauuuggaaucggaaggaagaauacuucccagagggaaaauauaaagucaucucuuuuauuucaguaacgucccagucacaggugugaggaagaaugagaagaaagagaugagcaaguggagaaggucuugacuacccagguuaagugugcuuaauuuuuuuuuuuuuuuuuugacacggagucucgcucugucgcccagucuggagugcaguggcgugaucucggcucacugcaagcucugccucccagguucacgccauucugccucaaccuuccgagcagcugggacuacaggcgcccgccaccaugcccggcuaauuuuuuguauuuuuaguagagacgggguuucaccauguuagccaggauggucucgaucuccugaccuugugaucugcccaccuuggccucccaaagugcugggauuacaggugugagccaccgcgccuugcaagugugcuuuauaaccacucugcucugacuguccaaaaccaauucaagaaggcaggagucacucugcucaccuccagugucugcaugagauugggcuugauugcguccuucauaagcacugucagugcaccacucacccccuacaaaacaaaugugugcagcaucaacucccaccagcaaaaaaacccaaccuucugaaaccaauauuugacauucuaggcuuacccauguuagccaucuuggaccaauugauacuuucaccugaauuggaccauucaugguuuuuuucuggauaugcuaugaaguugccaauuauuaaauuauuuauuuuuugagacggagucuggcuguguugcccaggcuggagugcaguggugcaaucucggcucacugcaagcuccaccucccagguucacgccauucuccugccucagccucccgaguagcugggacuacaggcacccgccacuaugcccggcuaauuuuuuuguauuuuuaguagagacaggguuucauuguguuagccaggauggucucaaucuccugaccuugugauccacccgccucagccucccaaagugcugggauuacaggcaugagccaccacgccuggccaaaguugccagauagaauacaaaugacauucacauguaauaucuggaaaaacauguaacucuagaaacaagcaucuuaaucaagcucagcugcugacugaugugagaaauccauucuagacuauuuuagagcacgacaaugcucguucccagaguacucaguuauuuguaacucugguaucugggcagaaauuucuauaaauaccaaacucaauaugugucuuccaaagcugaaacugcaauauuacgcaagaguucaauaccaacuuuuaacaucaggucacucuauuaagccaucaaaguguagcugaacuaccuagcaacaaagauaaagcaaugguacucuugauguucucugcaaauugaagucauacacccacuuuuagagaugcccacaggaugaagauguuacucaaaucaucuggaacuugugaucuauuacuaaagcauaccagcuauuauucacucugauguacuuuuuaaacauuucauaauuaucuuguaauuagcaaaauaggauuaaauugaugaauuaauugcaaugucuuaaguacagcauuacauuuuguuauuaauaacugcugaaagacccuaggacaacagacacagauaugucgccaagccuggcgugucuggguacccaccagaucuucggcacugacgggcucuccuuucuuacuggaugccaccaccauuuugcccagucucucucucaugucuucuagagaaguggugagagccaggacagccauaauuucacuggccacagagauaucaaacugggccugugggcagggaaaagagguacuagcaaaaacuuuguguuaaaccagaagugugaauugcaaaagugauccucuuuuacaucugaggcuuaaacaaauagcuuaaaaggauagaauaacagaauacuacccaaaauacuuaaugaaaauaauccucuaauagcaaaaaaauauauuaauuaauuauuccaagacccugaguugucauuuuuuuuuuuuuuuuuuuuuuuuggagacagagucucggucuguugcccaggcuggagugcaguggcacaaucuuggcucaaugcaacauccaccuccuggguucaggcaauuuucgcgccucagccucccaaguagcugggauuacaggcgcgugccaccaugcccagcuaguuuuuguauuuuuuuaguagagaugggguuuggccgggcugaucucgaacuccugaccucaagugauccgcccgccucggccucccaaagugcugggauuacaggcgugagccaccacgcccagcccugaguugucaguuuuuuaaaauaaauguuauaguaggaccaaaaagcuaugauuuuaucccuaugaaggccgcuuauaaucaugcgcuuauuguuucuuucauauacaagggaauaauaugguaccucuuaaaccaaggagauauacagugaaauggccacaaaaaagaagcaauuuuaaucaauuucuaugcaaggauauucacuuggggcucuccaccuccaggaaaaaaugccgggggaaaaacacacaggugacacaugggauuuauugcaaaagcugucaggagugcucaaugccacacaccuacucacuuccauuuuaaaagggagaaggcagaacaacaccuggcaguaucagucguaugagagaggauggaggaggagagaagcagcaagaucuagugccucugaacuaauuuccuuggaaagggacaaauuguuaccguccgugugugacccuucuccguuggagccuguccaaucgugaucuuccucaggaaucuaucauugguauccaacacuacagcagacaggcaagauauagaacgauuuugaguaaaaggaccacaaaguuaaaggaagcagcagaguuuuaaagcaauaagucuaauuucaugauugucuaucaauauuucaaaauggauggcaaagcuagaauauguguuaaaguuaagaaaugauguucauauaccauaaauacacaggaguuauuuuuacagcaaaggaauguggaauggcuugguuuuaucccaucuagagaauucaaacaguuaacuagaaaucuggaaucuauuuuaaagcauauuccacauauaagaaaaacagagcagucuacauuuuuucaaaagacugagguuuguguuguuguucugugggaugaugacucauugacuuuccaccaccguaagaaaugcaggagccaucaaaucagggcaagugcaaauaucuuuugaaacacgcugggugccaggccuggucuggaaauuuaggaaacauagcacacuuagcagagagaauuuuuauucugaugacagaauaucuauccaauuauauaaccacaaaaaacauggcaaagaccaagcaacuaaccaacuaacgaccucccaggacuaacuacuguuaacauuuuaguguacccucaguucuggcuuuugguauguguaguguaauaggaaauauauuugaccuuugucauggguuccugacaaaaggcucacagagcucuuggaauuccaagggugauaggagugucuuguuauucauuacaaacuccuuuugaucacaccugaguuuaugguaauaaguuacuuaugguaggucuccuagacagccucaggaaaggaauggucaccaaaaagaccaaaugauuagagggcuggaacuuucagucccacccaccaaccucuggguaagguguuagggguguauaaaacucuugaacaggccgggcacaguggcucacgccuguaaaucccagcacuuuggggggccaaggugggcagaucaccugaggucaaaaguucgaggccagccugaccaacauggaaaaacccugucgcuacuaaaaauacaaaauuagccgggugugguggugcaugccuguaaucccagcuucucaggaggcugaggcaggagaaucgcuugaacccgggaagcagagguugcagugagcugagaucacuccauugcacucuagccuaggcaacaagaacaaaacuccgucucaaaaaaaaaacucuugaacaacaugauuugaugagccucugggcuggugaacacauccaggugcugggagagugaugcccccuacgcuucucuuccaucugguuguuucugagcuguauccuuuauaauaaaccauaaacacaagugaaaugcuucucugaguucugugagccauucuagcaaaugaaccugagcaggggguuguggggacccuccaguuuauaaccaguuggucagaagcacaggugacaaccuggacuugcgauucgugucugaaguggggcagucuuuuaggacugagcccuuuaccuguaggaucugcuccagacaguuagugucagaauugaguuaaaucauaggauacucagucaauauccacuggagaagugaaagcugaauuguuguggaagagaaaaacuacccaucuggugucagaagugaggugcugagaguacuaugaguauagagaggaaacaggaguugccauuucaguaucaaaugccaaacaauaucaaagaaacacaaaauuaaauugauccauauuccuacuaauaacaucauugcugauggcugaauauguuuuagaacagaguuuuucaucuuagagauuggugaagcaguguaaggaugugagaagcucacagaguacaaauuugccuauauauuuuguggguuuuuuuuucaagauguuuucuauuucaaaauuaaaauaauuucaaaguaaaaacacacacacacacaaaaugaacaaaaaaacccaguucauacucuaaaugagucaaggaggagaagcauuuuuaaggcacuugauaauaugccaaauuauuuuccauaaagacugucauaauuucauaccaaaagcagugucuuauauagcaaucagacacacacaccccccacucuugcuguaauguguuguuaaagccaacccuuauuuuucaaaagaaaaaaguaucagguuucauguaacuaauauuucuguaaaaaauagcuagucaauagguaugacugccucuaguugcuuagaaaacaugaaugagacacgaagcaaaagaaaaguaaaucggauacuaaaucuucaaaauggacuuuuagcuuauuccuuauaaaauauuauaccauuugucuaaagcuauugaagcaaaggaagagaaauuccaaugugguuuuagacauugagagugucaucuaaauaaggccauuagcuagcaacgguuauugagucaaggaaaaucacaaaaacagucaauaaacuggccuucagcucuauucugcaugaguggaugaagauucuuucucaauagugauacagaauagaagguugcauuguugaugcaaagugaaaucuaagcuacacuaguugugcauugagaaaaguagcauauggcagugaagccaggaaaccuacuuacugaacugguaaguauuuaaaccuugaaggcuaccuaauaugcuauaagagaauuuaauaaaaugagguaaaaaaaugauuagguaggccgggugcgguggcucaugccuguaaucccagcacuuugggagccugaggugggcggaucaugaggucaggagauugagaccauccuagcuaacauggugaaacccugucucuacuaaaaauacaaaaaauuagccgggcaugauggcgggugccuguagucccaguuacucgggaggcugaggcaggagaauggcgugaaccugggaggcagagcuugcagugagccgauacugugccacugcacucuagccugggcgacagagcgagacuccaucucaaaaaaaaaaagauuagguaagcuagagaacuacagaaaaaaaucaagucauuuaugccacacaagaguucuaagaauaaaggucacacaugauucaagaagugauuaaacauaauuucucuacuucaugacacuaaaacuuuuugcauaaaauuaaauuuguaaaaugugauuuuugguuuaacuacccuaauuucagucaacacugaauagccagcaaaauguucgaccaauccaacaaagagauuugaugauagcuaauaaggagagauacugagagagguggcaagaaaaagaaauaaugucaccaucuuggucaugccuuagcugguaaaauaccaacauggaagcuucugagccucacauuuuaacaacucuucuggaggguguagggugugcaauauagccaaaacaaacggggcuuguauacugcucugguaccucuuugccaaguuaugguuucuggaucaauguccaaucuugcaaaucuguuuaucucuucaucugucagugugguagggucagucuuuucaaugccuagucucugaaaguguaggaaaaugaaaacauaaaauaagacaaacagaagcacaauaaacguaagacaaaaauuuugaccccuaccucuaaaugggauccccucuaggaaaugcaaaccaucuuaaauucagaaggaaaaacugaaagcuggggguuauuuccuacugucagccuaaagaaagacauuacaaaaaauuaucuccaaguagguugaguuuauucaggaaugagcaacgaggauuauaaccugggaugccacaaauaugccuagugagggaagggaagauuuuacuagcaaagaaggagagcuucagcuaggcgugaagcucagccuguggcugagccuguaaucccagcacuaugggaagcugagaugggcagaucaccugaggucaggaguuugagaccagccuggccaacacggugaaacccugucucuacuaaaaaauacaaaaauuagcugggcaugguggugggugacuauaaucccagcuacuugggaggcugagacagcagaacugcuugaacccaggagguagagguugcaguaagccaagaucacgccacugcacuccagccugggugagacuccaucucaaaaaaaaaaaaaaaaaaaaaaaaaagaaaagagggagagcuucacguagucugcuuagagaguucaggucaaggcugcagugagccaugauugugccacugcacuacagccugggugacagagcaagacccugucucaaaaaaaaaaaaaaaacagaauucaucgcucccagaagcucaaagccagaguugucaauucauuggugcaguugccguugcuggauaaguguacuuucaagagcaucuuaucugaauuacucccauccugaagaaugucuagugauaagucuugucauggaaacauaaguauacauuugaaaugugcaagcugugcaaagcaggagaugugugaaggacgugaagggauuucuuuugggguuuuauaaaguuguuggaaacaauuuuugcuuuuguuuuuuugagaugaggucucauucugucacuuaggcuagauuauaguggcccaaugauagcucacugcaaccuugaacuucuggguucaagggaugcuccugccuuagccucccgaguagcuggguauaacuacaggugcaugccaccacaccuggcucguuuuuaaauuuuuuuguagagacgagguuuugcuucauugcucaggcuggucucgaacugcugggcucaagucauccuccugccuuggccucccaaagugcugggauuacaggccuugcaaacaguucuuaucacagacacguaaguguaagccuccucuucuucauguuuucccagcccuguuuuuucugggucugacaaaagugauuuuaucccgauaucugcaaauucacauuacucacacauguacaaagguauuauuaacauguuugucccuauaacugagcaccagaagauuucccuaagccuagaccuaaauaaucauaguaucauagugaccaagaaguguuguaaaacacaaacccaauuuuuuuugagacagucucugucugucacccaggcuggagugcaguggggcauccucagcucacugcaaccuccgccucccagguucaagcgauucucuugugucagccucucgaguagcuggggcuacaggcgugcaccaccaugcccagcuaauuuuguauuuuuaguagagaugggguuucuccauguuggucaggcuggucucaaacucccaaccucaggugauccaccugccucagcuucccaacguucugggauuacagguaugagccaccacgccuggccuccucaucucuuaaaaaaaaaaaaaaaaaaaaaaugcugagcucagugguucaugcaaguaaucccagcacuuugguaugccaagguaggcagauugcuugagcccagaagcuugagaucagccugggcaacacggcaaaacccggucucuacacaauauauaaaaaucugggcauggugguaccuggcuguagucucagcuaccuaguugggugaggugggagaaucacuugaguccuggagguugaggcuguaguaagaugugauugcaccacggcacuccagccugggugacagaguaaaagcuuuucucaaaaacauaaacaaacaggccggguacaguggcucacgccuguaaucccagcacuuugagaggccaaggcgggugggucaccugaggucaggaguucgagaccagccuggccaacaugaugaaaccuucucucuacuaaaaauaccaaaauuagcugggcaugguggcaggcaccuguaaccccagcuauucaggcugaggcaggagaacugcuugaaccugagagguggagguugcagugagcugagaucacaccauugcacuccagccugggagauagagugagacucugucuuaaacaaacaaacaaacaaccaaccaauaaauuuuugaaaaauuaaaaaacagaaaaacaaaaacaaaaaaucccuuguggccagacgugguggcucacgccaguaaucccaacacuuugggaggcugaggcaggaccaucgcuuuagaccaggaguuugagaccagccuggacaauauggugagacacggucucuacaaaaaaauaaaauaaaaaauuagccagguguggugguguguguaccuauagucccaggugcucaggaggcuaagaugagaggauugcuugaaccuggaagguggaagcuauagugagcugugauugugccucugcacuccagccggguuacagagagagacgcugucucaaaaaagaaaacaaaaaacaaaacaaaacaccucuccuuugcuguuccuuuauggucauacccucccuucauccauacccuuaacaucuauugaucuguucccuagcacuauaguuuucucuuauugagaauaucauauaaauggaggcaugcaauaugcaagcuuuugagacuggcuucuuucacccagcauaaugccacugaaauucauccaaguuguugcuuguaucaauagcucauuuauuuuuauuggauggauguaccaguuuguuuauuuauucauccaaugaaagacauuuagauuaguucccaguuuuuggaaauuauuaauagagcugcuaaaaacauuaauguacagauuuuuaugugaacagaguuuucauuuauuuugggugagauuucugggucaggugguaugguguaugcuuacuaacuauguauuuguuacagaaauucaaauaaaauauagauauaacuaugguuuuaacuguuuaacacagacccuuaucuauucagggcaaggcaaguauuauuuuacagacaaguaagcggagaaacaagucauuuaacaaauuugcuuaaggucccaaugaugcaaacuccaaaggcugcuaugccgccacagugacauccugacucuuguucauguuauaaaggaagugucguuucuuucuuagcugagggcagguugucaguguucuauuuauuccacacuagccacuucuaaucuauagauaaaugagaaauaaccucuaccauccaucuuugcuauguauaucaugacuuuaagacuaugauuacugauguaacuucaucuaaaauaggcuacuccaagaagacuuuuauguccuaaucaaugaucagauuccagauuccauacaauauaaaaaauguggaagaaaaaaagcuuaccuuuaaccuucggauuuggaugucagagaaccuucucacuccauuuacugauggcaccaaacgauuaaagagagccuuaaagaaaagaaaggggcuuuaaaaugagaggagccccacugcuuugcuaccugcauccucagcacccaagacaccaacacuaauucagaugguucaauacuuucaaaacuguucaaugggguucauggggcuuuggcauccuaccuugucugucugggucaguucaugaaauauccgagcaucaauggccgcagcaacgagguuauuagcugcagugauggcauggaugucaccugugagguggagauuaaacuacaaaagaacagaagccacauuagucucccagcugcucuguaucuuuccaacuuucauucuauugcaaagcucaaucccuauuuuaaagccaauggaauacugaaggcagcccaguuaguggacaaacacccaauauagggaguucuugaaaacauaaaugacuggcugggugugguagcucacaacuauaauaccagcacuuugggaggccgaggcgggcggaucacuucaggccaggaguucaagaccacccugggcaacauggcgaaaccccaucucuacuaaaaacauaaaaaguagccaagugugguagugcgcaccuguaaucccagcuacuuggaaggcugaggcaggagaacuugggagguggagguugcagugacccaagaucacaccacuacacuccagccugggugacagagugagacucugucuuaaaaaaaaaaaaaaaagaaaaagaaaaagaaaaagaaaacauaaaagacuaauuaucuguccacagaagaaucuccucccaaauacagaacuugcaguuuuuccaaaaugagauguccagagaccacaaauaccacaccacugggaucaacagccacacuggguuacugaggacacaccucaaaacagcgaggaggagugcacgggagcagcaccgacucuaugucuauguaauguuccaauuucugcaguuacauaaaugaauucugaaaucgcuguguguuggugcuucccgauaccaugcuucauuuggucauuugcuuauaauaaucauucccacugaaagccaaaguuugaaaccaagcuguaucacaagucugcaaauuaaguuguuuucccccuagguguugcuuuugcugagaaacaagucauuuguccgcuaagagcucuacaaaaaaggcuaaucuccagagagaaaaagcuauaauaaagaaucuaggcugggugcgguggcucacgccuauaauaccagcacuuugggaggccgaggugggcggaucacgaggucaggaguucaagaccagcuuggccaacacggugaaaccccgucucuacuaaaaauacaaaauuagcugagcgugguggugcaugccuguaaucccagcuacucgggaggcugacgcaggagaguugcuugaaccugggaggcagagguugcagugagccgagauugcgccauugcacuccagcucugggcaacagagcaagacuccgucauggggaaaaaaagggagcuaauucagcacccucccccccgacaaaaaaagggggaucuaauucagccaaaucccagaauacuuuaccucuuccauaggaaugaccugggaguagccgccuccugcagcgccaccuaggggacaggucaaggguggaagcucaguuaagcaugcuucuccaaugacuuagaaaucaaauaaaugcaaaugcauuauuguaacuacuaagcacauuuauuuauuuauuuuuuagaaucauuuggacaguuuugaucaaguguuuucuaauacuagucucucaauugaaaucugaguuuaaaugacaaaaccaugaacaaauauauaccuacucauuaucuuuagaaauauguuccuuguaauuacuggcauuuguuaaaacacccagcugacaguuacauaaaggcaaccuguucaauuuccuacucucauaaagcuacuuuggcuuuuaaaacagaaauauuuaaaauacauacaccuaacaaaaagacuauaauuuuuccuaaauagagauaaauagauuaggcuguuagaaagcagccuaauugcuagauuuuuuugggcuacuuggauuacagguugaguaucccuuauuuaaaaugcuuggauuuggguuuuggauuuggguuuuuguuuuccagauuuuggaauauuuucaucauacugauccagcaucccaaauccaggauuuaaaaucugaaaugauccaaugagcauguccuuugagcaucgugucagcacucaaaaaguuuagaauuuuggagccuuucagauuucagguuucuagauuucugaugcucaaucuguauuagccaaaagccaguugaaaauguucaggacaccaagcauggcugcucaugccuauaguccuagccugggagaucaaggcugcagugaguuaugaucaugccacugcacuccagccugagcugggacuccagacagagcaagacucugucucaaaaaaaacaaacaaacaaacaaaaaaaguccagguuaccacauuaucagugcaauaaauguaaaucagauauauauuuuuuuagacagagucucauacugucucacaggcuggaggguaauggucugggauuacaggcacauaccaccaugcccagcuaauuuuuguguuuuuaauagagacgggguuugccauguuggccuggcuggucucgaacuccuggccucaaguaaucuaccaccucacccucccaaagugcugggauuuuaggcaugagccacugcacccagcccagagauauauuaauauguauuuuguuuuugugaggcagagaccgugcagugaggcaauuugcaguaagaguaaaaggaaaauaauggguucaauaagcagaacaaggaauagcucgugcugaaguugaaaggggguuaagacaagcucaagagcagaacaaagugauuacauuuauaaaauagguggaagggugggcugggcacgguggcucaugccuauuaucccagcacauugggaggccaaggugggcagaucacaaggucaggaguucaagaccagccuggccaauauagugaaaccccaucucuacuaaaaacacaaaaauuagccaggcaugguggcacgcaccuguagucccagcuacuugggaggcugaggcaggagaauugcuugaaaccaggaggcggagguugcagugagccaagaucgugccacuguacuccagcccaggcaacagagcgagacugugucuccaaaaaaaaaaaaaaagguggaagggugaagguguucccggugucaacauuuguaguaauugcuagaacaagcaaaaugugauacccucaccaagcagagaaagcuaacucuaagaaccuaucauaauuaauaaacauuauuuuaauuaagacagcagcuuggcacgguggcucaugccuauaguccuaccaguuuggaaggcugagacaggcagaucacuugaggucagaaguucaagaccagccuggccaaaauggugaaaccccgucucuaccaaaaauacaaaaauuagccaggcauggucaugcgugccuguaaucccagcuacucgggaggcuguggcaggagagucucuugaacccagaagguggagagguugcaaugagccgagaucacaccacugcauuccagccugggcgacagagugagugagacccugucucaaaaaaaaaaaaaaaaaaaaaaaaacacauguucuuaguaccgcagcaauaaaaaucugaagguaaagugcgaguaugguaguaauuuagagcuugaaauagacauggaagaaucacucugguacuuaauacaggugccuuugaccaagccaccucugaagucccaguugcugcuauuuuaaaauggugacaauacuaucucguacuggaugauagaauaauaugcaaaaacugcucagcacaauaucuggcacaaagcauauauucaauaaagguaggcuuuucuuauucccaacaaggugaaacaucugugggguuugucauugucucuagagugucuguaagaugaucaguagcuaugauuaccuuuaugguuacuguagcaguggacuaugagggucaaauaaaagcaccuccagcuacauaucacccaucccagagaaucccugugcaguggccaacagugacagcaggagcuggggagauccaaugacagccuucaucaaaagcaugacuacagagguuugugagaaugacauuccugguguugaaaugaguugaagaccccauaaguaucauagguugcgugggccugggaggacugaaggagaagcagguccccugucaccacccaugguccagucucacuaguaccuuuuauuccaaagguggggcccugagaaggcugucgcacacacgcaaagacauucugguagagaugggcaccaagggcuugcacuagcccgauuguaguugugcuuuucccuucucccagggguguuggaguuauucuucaagacgaaagcaaaagagaaaaagguuuaaagaauuaaguguaucugaaucacuaagucauaccuagcagauccuagagaaugacucguaaucuaaagauuaagaaagacaaagucaggcauagcaguguaugccuguagucccagcuauauaggaggcugaggcaagaggaucacuugagcccaggaguuccaggcuacaguaagcuaugacugcaccacuguacuccagccugggcaacagagcaaacccccaucucuuaaagaaaaaaaaagaaagaaaagacaaagaaaaagaaagacaaaagcccugaaagauaucuuuuucaaaagucuuaguuguaauuuccaaaaaacuuuaagaaaaaaaaugauuccuguauuuuagcucuucuugcuguaagaagcaaauauacuuuaucuuguagagacacggcuauaauuuuaauuucucauuuuauauucucaaaaacuagcuuuuuaauauaaccucagcccagcaauaaaaaugaaugcuuaguaaauccaucgaauuaaugaauuuuggguucaaaaaggugauucuggccgggugugguggcucacgccuguaaucccagcacuuugggaggcugagguggguggaucacaaggucaggaguucgagaccagccuggccaacauagugaaacacacucucuacuaaaaauacaaaaauuagcuggguguggugccuugcaccuguagucccagcuacucgggaggcugaggcaggagaaccgcuugaacuugggagacagagguuguggugagccgagaucgugccacugcacuccagccugggcaacagagcgagacucugucucaaaacaacaacaacaacaacaacagcaaaaggugauucuaucuuaagaccggguuuuaagaccaaacucuuccacuuacuagauggauaaccuugaccaauuuucucaucuaugauuauaaucuauucuuaccuaccucucaggauugcuguaaggaucaaaugagaucaaauacgggugaaaaugcuaaaaucaaauuaaaggcaccucuacauacaugugccaagugcaaaugcaacgccuuaguaucaggacugauacuaagauuuggauggcaacaugaauaaaaagcauacccagucaccaccacguauuucccaucaggccggugcuucaggcguucuagugcugacagcagaacuuuggccuuuguuucaccauauaauucuaccucuucagacagcagaccaauuucucgagccagcuuaccaaugggcuucgguuuacaagaucgugauauaucaaugucacuuuggaaacauagaaaauagguauuaauguuuauccacugaguuuaauuaaucccacaguaguaacaagcccccaacccaaccccaaccacugaaggcaccuucagagggagcauaugugaacccacaguaucugucaacuaaaaaccaacaauucacaaaguuuuaaaucaguaaaacuuuauuuuuaccuuggaacaggugucuugagguuaagguuguuauacugaaucauccacuuuccuggcuuaaauuucuccaggaaacgcuuggcacucucuacugugcucuaagcaaaaugaaauaaaugaaacuuagaagaggugguuauuuuaauccucaccucaguuucaagcuccaggucacuccaguucaaucacaaaaugaacugcuucagacccacuuauuaccaugcuucaauccuagcuaagagucaagaggcaccuaacaugcuuuggggcugcucgccuggccccugucagcuggugcauguuagaaagggaaaacaggccgggcacgguggcucacaccucuaaucccagcacuuuggaaggccaaggugggcggaucaccugaggucgggaguuccagaccagccuaaccaacguggagaaaccugucucuacuaaaaauacaaaauucgccgggcgugguggugcacaccuguaaucccagcuacucaggaggcugaggcaggagaaucacuugaaucagggagauggagguugcgguaagccaagaucacaccauugcacuccagccugggcagcaagagcaaaacuccgucucaaaaaaaaaaaaaaaaaaagaaagggaaggcaaaccaaaacagaccuggccaagccagugugaucgcacuuuucuucuuucaaaguuauuauauuccaaaacagacuggaauuaugccaucccuacuuuccucuauuaaugugccugaucuuauuucucuauucuucccuucccuuuuucucaauaaauucacaucuuuacuucugaguagguuuuugacauuucuacuuggggagaaaagcagccaaaacucgaucagcuuuucagaacucuuauagaaacuuuuauucacaauuaccugcaugagcauugcaacugucaugggcccuacgccgccaggaacaggagugaugaagcucgcccucucuuuggccucgucguaugccacaucacccacaacuuuucucccauuugguuuuuuaucaucuggucaagugggggagaaaucaaaacuaagucucagaaucacaguccuggugaucaguuacgacaaaaacucagcagaauuguaggguguguuagucccaucaggcuccagugccuacuuaacuuaaaagcuauggaaugacagauguuugcuauuucuuagggagaaaauuauuuuaccugcaaaaauucacaagaugcauaagugguuuuacagaaccuggagaauccuuuuguagucucucagguggcaaauaaaauaccaacuguuuuuuauucuuaaaaccaacuacccaguauauaaugagcacccauuuuaaaauguuaauuugcuaaagccuacaaaggaaauuuuuugggugcacaaagauccaacucugucacagcugccagauaucguuucuacagcaacugucagcauuuugugagcuccaugugugagcuggaggaacaauucaacauccaauuccaaagacacagcuacuuaaauguaugcuaaaggcaaagaauauaauuacacuucccuuaaaaggacacaagaacaacuacaaaucuuaccagcaaagaauagcuauucaagagaacaaaacccaaugaugcaucauugcucacucacacaaagaacauccuacacuuggcuucagugcacuuccaggaggggcugggggcgggccuagaccucgaagcaauaaggcucccgcgcugcaucugguaguuuuagcgacaucaccacuucucucugaucagaucgccacaacugagaagaagcuccaagguggaggcaagaagccagaauuaag

SEQ ID NO: 17071 - RNA, 1297 nt, Homo sapiens
cuuguauuuaagacauccagguuugggacugugcaaucucaccaguuuucaaaauguccaaccauacaaacacagaaguacagcagagagaaaucauuuacagacuucacucuuaagaaaucaaaaauuaauaauuuaagugccacaaaucuauauguaguucaaaauauacaaagacacaaauuacauuaugaaaauucuucacauggcccauuuuuacaucaauuacuacaaaaaauggacauuuaucaaguaucugacucacaacaucaagaaugugccuguacaaauaaauguuaacgaaauuacacauuuuucacacuaucuuuuuccacgauuaauauguauuuccuucaauuuucagugaagacuuuucuaauaauacuauuauuaccuucaccccauuuccuguccucaucuacuauuuagaucaccuacaucaaagaaauaaaaauaggcugggcccaguggcccauaccuguaaucccagcacuuugggaggcugagauaggcagaucacaaggucaggaguucgaaaccagccuugccaacaugaugaaaccccaucucuacuaaaaauacaaaaauuagcugggugugguggugcgugccuauaguuccagcuacucgggaggcugaggaagaagaaucgcuugaaccugggaggcggagguugcagugagccgagaucgcaccacugcacuccagccugggcaacagagcgagacuccgucucaaaaaagaaaaaaaaacaaagguauuuauuuauuguuuuuguuccuuuuccuuuguguaaacaaaaacaauauauuugggagaacuuucaauaaagcugaaauugacaaaguuuuauucccaauaaugccaaagaacuaguauccuccuuacugaaggcuaaaaagaaacagugaugauuaaauuacaguagaacaggaauucuagcaacaguauuguuucuaguuauuuguaaaaaauaacaaugaguucugucaauuaguuauugaauauuagauaguacauuacugcuuuuaagaacauuuuagaauuuauaggcugaaauacuaaaguuaauaggucuagcuacagaauaaaugucguuuauaugguugauuuuaaucaauaauacugagagaacuuaacacguuuaauauaaauccucacaacaccccugugagguaaguauugcuuacacccacuuuacggaugggaaaucagaaagagcaagaaguaacaaucucaagaguuauaaauaaaaaaauuuuuuguuuucuuauaaggcagacugugcugaguucug

SEQ ID NO: 17072 - RNA, 2755 nt, Homo sapiens
gcgaggcaccacggccuggcggccgagagucagggaggaaccucauuuacauaacggccgccccucugucuccuggcgggggccggagucccgccccucguccaacuugaaaucuguugggucacgggccagucacuccgaccuaggcaagccugugguggagcuggaagaguuugugagggcggucccgggagcggauugggucugggaguucccagaggcggcuauaagaaccgggaacugggcgcggggagcugaguugcugguagugcccguggugcuugguucgagguggccguuaguugacuccgcggaguucaucucccugguuuucccguccuaacgucgcucgccuuucagucaggaugucugcccguggcccggcuaucggcaucgaccugggcaccaccuauucgugcgucggggucuuccaacauggcaagguggagaucaucgccaacgaccagggcaaucgcaccacccccagcuacguggccuucacggacaccgagcgccucaucggcgacgccgccaagaaccagguggccaugaaccccaccaacaccaucuucgacgccaagaggcugauuggacggaaauucgaggaugccacagugcagucggauaugaaacacuggccguuccggguggugagcgagggaggcaagcccaaagugcaaguagaguacaagggggagaccaagaccuucuucccagaggagauauccuccaugguccucacgaagaugaaggagaucgcggaagccuaccuggggggcaaggugcacagcgcggucauaacggucccggccuauuucaacgacucgcagcgccaggccaccaaggacgcaggcaccaucacggggcucaaugugcugcgcaucaucaacgagcccacggcggcggccaucgccuacggccuggacaagaagggcugcgcgggcggcgagaagaacgugcucaucuuugaccugggcgguggcacuuucgacguguccauccugaccaucgaggauggcaucuucgaggugaaguccacggccggcgacacccaccugggcggugaggacuucgacaaccgcauggugagccaccuggcggaggaguucaagcgcaagcacaagaaggacauugggcccaacaagcgcgccgugaggcggcugcgcaccgcuugcgagcgcgccaagcgcacccugagcucguccacgcaggcgagcaucgagaucgacucgcucuacgagggcguggacuucuauacguccaucacgcgcgcccgcuucgaggagcucaaugccgaccucuuucgcgggacccuggagccgguggagaaggcgcugcgcgacgccaagcuggacaagggccagauccaggagaucgugcuggugggcggcuccacucguauccccaagauccagaagcugcugcaggauuucuucaacggcaaggagcugaacaagagcaucaaccccgacgaggcgguggccuauggcgccgcggugcaggcggccauccucaucggcgacaaaucagagaaugugcaggaccugcugcuacucgacgugaccccguugucgcugggcaucgagacagcuggcggugucaugaccccacucaucaagaggaacaccacgauccccaccaagcagacgcagaccuucaccaccuacucggacaaccagagcagcguacuggugcagguauacgagggcgaacgggccaugaccaaggacaauaaccugcugggcaaguucgaccugaccgggauucccccugcgccucgcggggucccccaaaucgagguuaccuucgacauugacgccaauggcauccuuaacguuaccgccgccgacaagagcaccgguaaggaaaacaaaaucaccaucaccaaugacaaaggucgucugagcaaggacgacauugaccggauggugcaggaggcggagcgguacaaaucggaagaugaggcgaaucgcgaccgagucgcggccaaaaacgcccuggaguccuauaccuacaacaucaagcagacgguggaagacgagaaacugaggggcaagauuagcgagcaggacaaaaacaagauccucgacaagugucaggaggugaucaacuggcucgaccgaaaccagauggcagagaaagaugaguaugaacacaagcagaaagagcucgaaagaguuugcaaccccaucaucagcaaacuuuaccaaggugguccuggcggcggcagcggcggcggcgguucaggagccuccgggggacccaccaucgaagaaguggacuaagcuugcacucaagucagcguaaaccucuuugccuuucucucucucucuuuuuuuuuguuuguuucuuugaaauguccuugugccaaguacgagaucuauuguuggaagucuuugguauaugcaaaugaaaggagaggugcaacaacuuaguuuaauuauaaaaguuccaaaguuuguuuuuuaaaaacauuauucgagguuucucuuuaaugcauuuugcguguuugcugacuugagcauuuuugauuaguucgugcauggagauuuguuugagaugagaaaccuuaaguuugcacaccuguucuguagaagcuuggaaacaguaaaauauauaggagcuuaaauuguuuauuuuuauguacuacuuuaaaacuaaacugaacauugcaguaauguuaaggacagguauacuuuuugcaaacaaaugcauaaaugcaaauguaaaguaaagcugaaauugaucucaaagu

SEQ ID NO: 17073 - RNA, 2755 nt, Homo sapiens
acuuugagaucaauuucagcuuuacuuuacauuugcauuuaugcauuuguuugcaaaaaguauaccuguccuuaacauuacugcaauguucaguuuaguuuuaaaguaguacauaaaaauaaacaauuuaagcuccuauauauuuuacuguuuccaagcuucuacagaacaggugugcaaacuuaagguuucucaucucaaacaaaucuccaugcacgaacuaaucaaaaaugcucaagucagcaaacacgcaaaaugcauuaaagagaaaccucgaauaauguuuuuaaaaaacaaacuuuggaacuuuuauaauuaaacuaaguuguugcaccucuccuuucauuugcauauaccaaagacuuccaacaauagaucucguacuuggcacaaggacauuucaaagaaacaaacaaaaaaaaagagagagagagaaaggcaaagagguuuacgcugacuugagugcaagcuuaguccacuucuucgauggugggucccccggaggcuccugaaccgccgccgccgcugccgccgccaggaccaccuugguaaaguuugcugaugaugggguugcaaacucuuucgagcucuuucugcuuguguucauacucaucuuucucugccaucugguuucggucgagccaguugaucaccuccugacacuugucgaggaucuuguuuuuguccugcucgcuaaucuugccccucaguuucucgucuuccaccgucugcuugauguuguagguauaggacuccagggcguuuuuggccgcgacucggucgcgauucgccucaucuuccgauuuguaccgcuccgccuccugcaccauccggucaaugucguccuugcucagacgaccuuugucauuggugauggugauuuuguuuuccuuaccggugcucuugucggcggcgguaacguuaaggaugccauuggcgucaaugucgaagguaaccucgauuugggggaccccgcgaggcgcagggggaaucccggucaggucgaacuugcccagcagguuauuguccuuggucauggcccguucgcccucguauaccugcaccaguacgcugcucugguuguccgaguagguggugaaggucugcgucugcuugguggggaucgugguguuccucuugaugaguggggucaugacaccgccagcugucucgaugcccagcgacaacggggucacgucgaguagcagcagguccugcacauucucugauuugucgccgaugaggauggccgccugcaccgcggcgccauaggccaccgccucgucgggguugaugcucuuguucagcuccuugccguugaagaaauccugcagcagcuucuggaucuuggggauacgaguggagccgcccaccagcacgaucuccuggaucuggcccuuguccagcuuggcgucgcgcagcgccuucuccaccggcuccagggucccgcgaaagaggucggcauugagcuccucgaagcgggcgcgcgugauggacguauagaaguccacgcccucguagagcgagucgaucucgaugcucgccugcguggacgagcucagggugcgcuuggcgcgcucgcaagcggugcgcagccgccucacggcgcgcuuguugggcccaauguccuucuugugcuugcgcuugaacuccuccgccagguggcucaccaugcgguugucgaaguccucaccgcccaggugggugucgccggccguggacuucaccucgaagaugccauccucgauggucaggauggacacgucgaaagugccaccgcccaggucaaagaugagcacguucuucucgccgcccgcgcagcccuucuuguccaggccguaggcgauggccgccgccgugggcucguugaugaugcgcagcacauugagccccgugauggugccugcguccuugguggccuggcgcugcgagucguugaaauaggccgggaccguuaugaccgcgcugugcaccuugccccccagguaggcuuccgcgaucuccuucaucuucgugaggaccauggaggauaucuccucugggaagaaggucuuggucucccccuuguacucuacuugcacuuugggcuugccucccucgcucaccacccggaacggccaguguuucauauccgacugcacuguggcauccucgaauuuccguccaaucagccucuuggcgucgaagaugguguuggugggguucauggccaccugguucuuggcggcgucgccgaugaggcgcucgguguccgugaaggccacguagcuggggguggugcgauugcccuggucguuggcgaugaucuccaccuugccauguuggaagaccccgacgcacgaauagguggugcccaggucgaugccgauagccgggccacgggcagacauccugacugaaaggcgagcgacguuaggacgggaaaaccagggagaugaacuccgcggagucaacuaacggccaccucgaaccaagcaccacgggcacuaccagcaacucagcuccccgcgcccaguucccgguucuuauagccgccucugggaacucccagacccaauccgcucccgggaccgcccucacaaacucuuccagcuccaccacaggcuugccuaggucggagugacuggcccgugacccaacagauuucaaguuggacgaggggcgggacuccggcccccgccaggagacagaggggcggccguuauguaaaugagguuccucccugacucucggccgccaggccguggugccucgc

SEQ ID NO: 17074 - RNA, 519 nt, Homo sapiens
uacugggucaccgggaccggcagugcggccgaguccgccccacguacggccucucugggaaggccagccuuggauaugagacaccucgggggccgcccgcgggccaagggagcgcccagucgcucacccgguugggauauuccuucuccacacagucgccacacaucgcgacgcagucaacagggaauguccuccaacgcuuccgggaagacgaaaccucgcgagaacugagauacgguugccgcaugcgcccaaguacucgacuccuggguauuccgucucgggaaccgagccgaagucuccgccccuuagcaacuguugucaaggcagggcacagucuccuuggcaccgugcgugggcaaaggguggggcuucagaaaccuuuggagacagacgaagaaaucuugugcgcuaacagaugugacgggaagggaaagggaucuugggcugagcgaaguucucacagacaccuuccugagcuuaggcugacaagaaaggcaaaucacgacacacaagaaa

SEQ ID NO: 17075 - RNA, 1700 nt, Homo sapiens
cuucuucagcuucccgcgggacccugccagaugccagaaguggguggagaacuguaggagagcagacuuagaagauaaaacaccugaucagcuaaauaaacauuaucgauuaugugccaaacauuuugagaccucuaugaucuguagaacugguccuuauaggacaguucuucgagauaaugcaauaccaacaauauuugaucuuaacagucauuugaacaacccacauaguagacacagaaaacgaauaaaagaacugagugaagaugaaaucaggacacugaaacagaaaaaaauugaugaaacuucugagcaggaacaaaaacauaaagaaaccaacaauagcaaugcucagaaccccagcgaagaagagggugaagggcaagaugaggacauuuuaccucuaacccuugaagagaaggaaaacaaagaauaccucaaauaucuacuugaaaucuugauucugaugggaaggcaaaacauaccucuggacggacaugaggcugaugaaaucccagaaggucucuuuacuccagauaacuuucaggcacuacuggagugucggauaaauucuggugaagagguucugagaaagcgguuugagacaacagcaguuaacacguuguuuuguucaaaaacacagcagaggcagaugcuagagaucugugagagcuguauucgagaagaaacucucagggaagugagagacucacacgucuuuuccauuaucacugacgauguaguggacauagcaggggaagagcaccuaccuguguuggugagguuuguugaugaaucucauaaccuaagagaggaauuuauaggcuuccugccuuaugaagcugaugcagaaauuuuggcugugaaauuucacacuaugauaacugagaaguggggauuaaauauggaguauugucguggccaggcuuacauugucucuaguggauuuucuuccaaaaugaaaguuguugcuucuagacuuuuagagaaauauccccaagcuaucuacacacucugcucuuucugugccuuaaauaugugguuggcaaaaucaguaccuguuaugggaguaucuguugcauuaggaacaaucgaggaaguuuguucuuuuuuccaucgaucaccacaacugcuuuuagaacuugacaacguaauuucuguucuuuuucagaacaguaaagaaagggguaaagaacugaaggaaaucugccauucucaguggacagggaggcaugaugcuuuugaaauuuuaguggaacuccugcaagcacuuguuuuauguuuagaugguauaaauagugacacaaauauuagauggaauaacuguauagcuggccgagcauuuguacucugcagugcaguaacagauuuugauuucauuguuacuauuguuguucuuaaaaauguccuaucuuuuacaagagccuuugggaaaaaccuccaggggcaaaccucugaugucuucuuugcagccgguagcuugacugcaguacugcauucacucaacgaagugauggaaaauauugaaguuuauaaugaauuuugguuugaggaagccacaaauuuggcaaccaaacuugauauucaaaugaaacucccugggaaauuccgcagagcucaccaggguaacuuggaaucucagcuaaccuuugagaguuacuauaaagaaacccuaagugucccaacaguggagcacauua

SEQ ID NO: 17076 - RNA, 20870 nt, Homo sapiens
cauuauuacuccaaguaaauguaccuguggacaugugauugcaguguuuuucauuuuuaacuuuuauuuguguaaauaaaaaaguaucugcgacaggucucaaucaauuuagaaguuuguuuugcuaagauuaaggacgugccugugaugcagccucaggaaguccugaaaacauaugcccaagguggucaggcuacaucuugguuuuaucauuuuaauaagacaucaauuaauacaugugcucuacacugguucugucuggaaaggcaggauaacgugaagugguggggagagaggagggcuuccagauuauagguggauucaaagaguucuugacuggcaguugguugaaagaguuuaucuaaagaccuagaaucaauagaaaggaguaucuggguuaagauaagggguuguggagaccaagguuuuuauuaugcagaugaagccuccagguggcaggcuucagagagaauagauaguaaauguuucucaucagacuuaaaaaggcgccagacucuuaguuaauucucuccuggaucaggaaaaagaucuggaaaggaaagggaauaucuacauuuuccucauaagagacagcuuugcagggccauuuccuuuuagugucugcugucugucauguugguaccuuauugcuacaaacagucugcuuugucagucuuaaggccucuguuuuaauguuaaaugcuggucagcugugcccgaauuccaaagggaggaggguguaaugaggcaugucugacccccacuucccaucauggccugaacuagcuuuucagaucaacuuaggaaugaaugcccuugacagagaggagggguucauccaauugguugggaggccuagaauuuuauuuuugguuuacaauugguaucagacugugauuuacucuuuuuccuucuguaacuuguuuuuuacucaacuuuuaugucuuagacauuuccaugcuucugugucuaguucuaguucauuuauuaacuguggaaucauguuuuauuauuugauaagccacauuuuauuuauccauuuucugguugaugugcauucugguuauuuccaauuuuccaguauuacaaauggugcugcaaugaacaugcuucuaugugucucuguacacacauuugagaauaucucuagaagugggauuucugggucauagagcacaaacaucuucaauuucauugauuauuucugaauugcaugccaaaaugcccacaucaauccacacuccucuuagccacauacgaguuuucauuucuucgcaugcucaucacugcacagcacuguuagaauuuuacauuuugcugauuugaugguguaaaauggcauaucauuguuguuuuccccauuucuuuccccuacuuucuuuaaugaauuuagaagaagagcugccacagucugcaaagauguuucugugugcugauuuguuuccuaggaagggagaaggaggaacacuggguauagguuguauugaacagccaugugguuuuuugcucuguaccauggaugcuugaggugcauagcacccagugaugcugaccaccccucuuaugcuggaagaauuucccauaucauguguccugccucccuagguagaaaucagaaacucacuucaccagccgcccaaggaacaggauuuuaagcagagcuuaugaccugcaagcagacauacccacauaaaacaaauguggaaccugaagaaugaggugcuguauuguacgggucuaguuuggagaagggauagagagacaucuacuuucggaggccacagugguggagcuccugaagguggcauccuggagccaugcucagcuaugauagcugcugugaugguguguucccuggagcagucuagagugcaacugcgccauuccagaagcaagccuucuucccugacccucuuagauauucucugagcuguccuuuauucaaugccuuucugcuuaaacuggagggcauucuguuugugaccaagaaccccauccaaacucuccuuuauugaggucuuuauauuugccagcguuucccacacaaucucuaaguaugucuuagagauaagaggagauacagcagaugucucucuaccccuccuccagacuagaacccacacggcaccucauucuucauguuccaaauuuguuuuaugucauaugucugcuuuacaggucuuguggaguacuuguuagagauucgugugggagacacuggcaaauauaaagaccucaaagagugagaguuugguuggaguucuuggucacaaacaacagaauccacuccgguuuaagcagaaagacauugaauaauacuccacaaagcagauauuauuagccauuuuagagaugaggaaaccaagacaccaggguaacuugcccaaggccauguggcuagcggguguuggagcuggguuugaacccaaccccaacugacugcagaccccaucagauggagcuugccuccucccaccucugguugcucaccugcacgucacugcuuuuucuacuuuauagcacuuauugcagccuaggguuaucuuauuuauuggcuuacuuguuuucugucucuugcaauuaacauaucaguugcauagagaccaaagaccagaccuuguucacaauuguaccuccagucuugauaucauacuuaccacagcaggcauucaguaaauauuuguuggaugaguaaaugaauugaaccaaucuaccauggauuuccuugggggagauaacccuacuuagcauuucuguuaaacucaaaaacauguucaguacuuuaacauguguuuuauucauucaauaguaacagauuaugaggucucaugccucuuagaauccuaagcugugucuauugccuguuuguccuguauuuccuagagauuguaaguccuuccaaugucuguucaaaugugcugccgugcuuguccccggggucugcauccccacagcccagauaguuccagggucucugggggccaaaugacagcccgugacagagcuggacaggaguagagccacucagucgauacccuucacuaacugcaugucuuccaaaguuccguucuggacggaauguuggcccuugaauuuggguaaguuauagaaccagaauagucucagcuuuucaccugugggagaugcggggccaaguggccuacugaauccauugaacaccuggcaggcguucccaccuugcagccauucuguuucuaauccuuucauuucaguucaaacccucaaaccucuuacccuuauguccuuucccauaaauucuccauucuauauucuuuuggaccaguguuucaugaucacuguuuuacaaaugaauaaagaccaaacauaauggcuuugugcccaauuccuccuccaacaaauuccuugaagauggccauuuugaguuguuucuucucuuucucuuuuguucucuguuucucacucuuaagguccagaguagagaauuguuaauuaguucccagaauaaccaggauuguaagacccagcucuauuucccucuucuuaaauccacccagacagguaaauccugauccugggacacauuuaauggguauagagaacuuugggggaaaggugccaugaaaagcaaagaaauacugaugguaucuaucgauguuuguuuucccuaaacuguuauauggcagacuaccugaugggauggaaagaaugcaugccuguggcauuuuccaggcccauuugaaucccaguuccuccacuuacuggcuaugugaccucagacaaguugccuaaccuaaaccuguuuuaagauucaguuuccucauuugggaauaacccuugugggguugcagugcaguuuagagauaaugugaaaaaauuacucaaagagcaggcacugcucuuaccaaagcuaggucagggccugacuuggggcacccuccauuccuugcucacugcccugcccaacgcauacauacacacaccacaccucacacaccucacacacaaacacaacacuauaccauacaaacacauacacgcugcacacacacuacacauuccauacacacaccauacacacacacagaaacacacuauaccauacaaacacauacacacugcacacacacuacacauuccauacacacaccauacacacacacacaccucacacacgcacauacacacuauaccauacaaaaacauacacacugcacacacaccacacauuccauacacacaccagacacagacacaaacacaaaacuauaccauacaaacacguacacacugcacacacacuacacauuccauacacacaccauacacacacacacaaacacuauaccauacaaacacauacacacuguacacacacuacacauuccauacacacaccauacacaccacacacaccacacacaccuaacacaaacacaacacugugccacacacauacgcacugcacacaaauacacaccauacacacaccacacacagaguauacacagcauaccacacacacauaccccacacaccacacacacaccccccacacacagacacacuauacuauacaaacacauacacauaaacacugcacacacaccacacacauuccauaaacauaccguacacacugcacacaccauacacaccucacaccucacacccucacacacaaauacacuauaccacacacacacacacugcacacaccacacacacaccauacacaccacacacaugcacuauacauacauaccacacacacacgccacacacacccacaccucacacacaaacauacuauaccauacaagcacauacacauacacacugaacacacaccacacacacacuauacacacauaacccccacaccacacaaucucacacacaaacacaauaccauacaaacacauacacauacacacugcacacacaccacacacaccauacacaucacacacaccauacacauaccacacacacuauacacacauaccauacacacauaccccccacccuccccacacacaaacacaacacuauaccauacagacacauacacauacugcauacguaccacacacacacaccacacacaccguacacaccacacaugauacacacauaccauaaauacauaccauacacacacacaccccacacaccauacacaccuuacacacaaacacaacacuacaccacacagaccacaugcacacaccauacacacacaacacacacaugcaugauacacauauacuaugcacaccacauacacaccacacacacacaaacacauacacauaccacacacauacaugcacacacaccacacacauccacacacccacauaccacacacauacacacaaacacacauguacacacaugccacacacauacgcaaugccacaguaaacacaaacauaaacacaccacgcacauaaauacugcacucauaccacacacguauacuacauauaaauacacacacuacauacagacacacaucacacauaccacacaccaugcacacacacacauuacaccacauaaacacaaacauagacacaccacauacauacacacugcacacauguacauacaccacacacauaccacacauacgcacugccaaaauauacacacaugcacauaucauacacacauauauuauacauauaucacagaccucacacaaacauacaacgugacaccagacaaacacaaacauauacacaucacacacacacacacacacacacacacacacacacucuuuaggacccuuucucauccucccagcugaccuagugagaaaggagaaucucugcuaugcuuugaacaucuuaaaggccauguugauuucacuuagagaaaaagggaugcaauuucgccauuccacuggggagguucgaggaaguaaaugcagggaaagaacaaaguuacaauuuggggagaguuuaaaaaaaggcucauaaaaaacccaucacuuuuugguuguaguucuggcaaaaggaucuugaggaacagcaggucaaaacuauugccucaaaacacguaaggauuuggggugaugauuugucucuucuuuucacagcuagauuaaaguugacuccuguuuuccuuggaugggcuugcugggagagauaagcacacacuagcagcaucaccuucaaauugcacgagcauucuuuucuucagaaugccuugagugcauauuaugugaugacagagcagcucuugggaugcgucaaagcugacagccaucugcacuuguuaagccccucgagcuuuggcaaaauagcaauuuguuuagauucauauugaauuaugcuuuuggaccagucacuaaccaggcaacguaaaaaauauacagagucuuuuuacagguguauuucauuccauguagugaucuuugggguggaggcaggaugaaccggagcacacccuuuuccaaggagagaauuuaauuucuugaguacuacugggcucagcaccuuaccacauucucuuaugacagccauggaaauuagaugcuguuauucuccccguuuugcagaugaaaaaacugagucaaguagccuccucggguacucagaguacccgagucaggacucaaacccaggcaguucaacuccagaaccugugcucccaccuacugagguauaaggaugccauccagcacagcgaugcuggaccuuacugucauuaaggggcaaggucaaagacacaccaucaggagaaauaagcuuccucauaggagacuggacugcauuuucuauaaggaaaauuaauguucauguuggagaaacaugaacauuaauuccuagacaaagcagugagaaaaucagcugugaggcucgcuggugggaauaagcuggggugugggcucugucucugcucucacucucggugccugagugauucuuacugggauuaguuggugcuuuggcuggaaaaagaccgucucaacccuuguuggauguuuggcaucccuggcccugcagcacuaaaugccaauagugugccccagucacuguggcuguccccaacacucccuccauuuccaaaucuucccacucuacuugggaaccagccagaggacaugagaugcuggagucggaggaggugggaagggaggggacagcaccccuccucuguguuuguggaaagggguggaguuuccacuguaaagaggagggcuggguggggcaccugaaggagaggggcugcaugaaaacgguagagacugagaaggggagagagauggagaucuggggaaaggaagcuuuguuugaaggcucaagcuuaggaagccucuccuuucuaaguuaaaguaauagucauucugcuuucucauggccugcugcucucagagauuauaguaugcucugggcuugaccugggaaagguccaguagccagaaaguacucugggaagggaccacagugcuucugaaccaccuugcaguggcucuagccaagaagggacuggaggcagcccucuucaccucauaagggcucugggggccugcuguggcacagaggacaccuccaagaguggggcguggcagagcugcaacacugacacgagggauuuaggaaggugcuccauuugggagggcauuucagagagaaagccacacuuaaccuugaguuauaugcagugcaguaugagcuuaccaggcgaauucaaaccccucaccuuguguaggauauaccaggagaaguugaccauggaggugcuaugcaaaccugugucuuuucucauguaaauuuuaaagaaaaucagucauuccucaagaaagaaggcagguguggggcccacauggugugguagggugguggauggacucagcuaagccugcugcuccugggccacggugagaaaccagcuguggugacuggguggguuaggcgccuucccacagccugcugcucagguggugcagggcagcuacgggcugguagugacgcccuggauaugaaauccgugagugugugcgggaacuguggcugaccauccuaaggaggugcugcagggagggaaagcaccggggacagagccauaaaggagggaacguggauuggaggagccaggagcaagggagguuuauagcucaaggcggcagaugcacuggccccaaugaacagcagcucagaagcagcgcagauaaacaggcauggcuaggcccuaggcaggggauacugcauuuacuuuugcauaaauucaugaaguaguuauaugcuuuugacuggaaacaauaggaggcccagugaaaacaaagagacuuagcaauccaggcuuuuuaggauuggaugcuugcuugagaugccuaagcacauagaagacacucggaugccccuggggucaaagugucuacuggauguagacuuacaagggccacggcaauggaggauggugggggaagugauccccgggaaaagucagcugcggguacaccugcccucccucucaccacaccaggcaccuucuucaaguuugagucccuaaguaauuucuuaaauccgaccuaaccaaaauccaguccccaugcaauccagacauuugaacacucagugcugcagagcucuguccuuacuucuuuuguccaucucuacccacugcccuggagaccuuggugaucuuuucuggucucacaguuuugauuaccuucuauuugcugaggacucccaaguuccaucuucaggcuggaucuacucagcaaccucacuagauguccacuggauuucucaaacuugacacauccaauggaaaccucugaucuuuucccagaacccccacaugacuugcggcugucuccauuucagcugauggccacugugugaccugguggucagucauccuugauuccucuuucucacacccguaucugacacgucggcacgcccugcugaugcuuccuucaacaucucacuugggcucccagcacuucucaucaccuccacugcuccauuccugguccacauugucaucagccgcuacguaaauauggcgauggccuccuaacuguguucucuauuucccccuuugccccuugcaggcuaaucucaacacaggugcuggagugguccgauuaaaguauaaaucaggucauggcgcucaaacccucugcucaaaacccuccaaugguuccccauuucacucaaaguaaaacccaaaguccucacaauggcauuacaugcucugccuauuuuggcuaugaugacuucucugaccucgccuucuuguaugacuccugucauucccucuguuccagcuacguuccugucuucccacauacuguggcccccucagggcccaugugcuggcugcuccucuggcuagaaugcgucuucccuacauaucugcauggcucucucccucacgcuuuaaaaaucuuugcugaaacaucauauuuuuagccaggcccacccugaccacccuagagggcaaacagauuuucccugaucccuaauccuucuuauccucuuuaccuuacuauauauuuuccacagcaguuuccaccaguaucuaacauacccaaucauguauuuauuucauacauuuaggcucuuuuuccucacagggacauaagcuccauaagagcagagguuuuugucugacuugucuagugguguagcucuaguauuuaaaacagugccaauaggagcuuaauacauauuguugaaugaaauauuccccuuaaguuggaauuccuuggggggaaaggagcucuagggaucucaccgaagcgcuuucugaugcaucucauguuucuacuugcuagcccuucuuucaguaugguugcuuuccauuuaaucuuugggcagccauggcaucugagauucuaaguacccuccucacagccucgccuguuuucucugcuuuccagaugagguugugcugaucuggugaacugcccuuuggagcucaccuuagccaggucauaccgccacucugggaacccuggaauguuauuuguuaguacgggcuuucugggccuccugggucccuuacccaagcccugaccugagaguccgugaaacugaaucccuccugucucugagugggacuccgggugcacauuccuaguucuccuagaguguggcucugcuuuuuuuuuccccucugagccagaagcuuggaaacagagagguaacgaaauggaugagaaauagggaguacauuugaggacacuuaaauacaaccaggcaagaaaguuaaagaauuucuucaaggcuggggaugaaaauugcuguguguucauuuaaugaaaaugacauagaagagccaguguucagacaaaaaauaauucagagauucuaaaaguuagaauuuaucaguaugcugagaagucuuuaaaauucuaauaagcuuucaacauuugugccguuugcugggcuuaaagaaacacaaggaacaaagaacaagaauuuccucuuagguaggacgaugaugucuaaugcaucuauuucccuugcuacauucuauuuccauuucauucugagauccugcuaaauucggaagguugcccuuggguuuucaacacugcaggggaugauuuaaaucuaaauaauaauaaaaagccacugcuuuuauuguacuuuuauuuuauaaguugauggaaacauuucauauacacauuaaguuuuguaacccaaucuugguacuugcugggucccggaggggcuguuucacuacuugggacuucccuuguguuugcauuaucccuccaaggcagaaggagaaaaugcuuucacugaagccagaauaguguuuuauuugaaauaauucucauuuaaggcaaggcacacacauuccaagugcacauacaugcacacacagucucucuuauaugggcugcaucauaaaaucacagaguuuuggaauugaagggaccuuagagaucaucuguucuaacaccagcauguuaccuaugaggaagcuucugccagacagguuaaguaccucauccaaggucacaggcauguagugaaagagaccaggcuacaauucagauucccugacucaagucuaauuuucuuucugcuacaccauauugacuccaaaauaagauaauguauaugaaaucacuuugaaaacugaaauguauuacacagguauucaguguggagaaggagaauuacaaugagcuugcuuucuucagaggugagcaugacuugcucaggucucuucccggauaaaguaaguucauggugugugaaucaugaaccguauuucuaauuagguuucuggguauggccuccagaaaaugagcaucaaagcggucaaaccaaaacacagucuucauucaaguccagcucguguauagcucuacuuuuucuuccuucucacccucucugucugccucccucuaguguccaccuuuaguuauugcaugugugccccgcagaaaggcugcaugcagacuacuauccaccauguucaccauuauuuguucaaauuaccccccuauuucuugauaucaguagcugucaucacgaccaaauuaggaugcuuuuuauaucaacaggaauaaaugacuaauauaaagaccuggauauuaagaaaaguauuuaaaaucguuuugugauuggaaugauaacacauucaaaguuugguaauuaaauugucuuuaauagacuuaaaucacauaagaagcccuuauaauuaauugaaauguuuuaauuacaaacauaauuauuuuuaagguagaaggccuauuaaauuaacuaacacaugauucauuaaaaaaauuacugcuuuacauggaaugcugucaauuacuaaauauuauugcaaauuacuugaaggauuaaaauuuuauuuugguacuauuaauagauuaauguauuaaaucauauagugauuauaaauaauauuuaauuaguccuauguugccuucuuuaauauauagacauaucuauauaucuauauuuaucccucagucauuguaacguguucccuugaaagaaacaugucuaacuucauauucuaacuaggauccuuguuaauguguaaaauauugacaagaacacucacaacucauugguaggagauucuuugguagcguugccuaaaugcucuggaucaaguagaacaaauuggcugcuaacaaagccuguaaacuauggaucccauuuccugaucuuaaaagauccauucaaaagucugaacgacauuuacaaguaagagccuuccaccauguucccagcucuuuucagccugugacaaauaggucaacgugcacagugagaaggggaacugugcauuguucuccugccucauuucuugaguuggcuguaccuccugccuugauccuucaccugucccuccacacuccucauugucuagagaugcacacaugaugccaagcacacccgugcacacgcacgggcacacaugcacucugaaggccaaaaggcaagaagucauucaguuggauggcuguagcugggucucagaggagacggugugcagcuggaagcgccaugcuugcugguuuacuugcugcucagcaauauggagugcuuugccaacagacuccuacugcuucuuccccucuugaggagaaacugucaaacaacacgaggauaaaaauuaagcuacaaauaaaaauguuuacagcuuucaauagaaagucaauccuauuuuaacacuccaaaaguauucuccaaaaaguucaaugacacaaauugcgagggugauuuauugccgggugaaugaaaugaccagaugcccgcaaucugaauggggcuuuucagggaugcuuucgggaggaguuucacuggaccucugagguaggaaguugggggugaguauuguuuccacugccuauacuuuuuccuuuaccuucuucuggcgacagaccucuccuuccucccuguugggugcaugugugacccagaagagaccagucacagcugcucuuccccagccacaggggugaguccagggacagacacaaagcaaggcagaguccuuccccgaaacugugcuuucuucaugagucuauaagggcgcaaguccagaucucugguagcgaaggaagcagucuuuuaaggaugugcagaccaagggaagaggcaggaguggcugccuaagaaagaaugccccagugccaccguccccagggccaguugcacccauauucuuucuuugcagcuuaggauucucuccccuuuuuggcauaaguuaacuugaauagaguugcuguuacuugcaagugaaagaaccuuaaauaauacagaaaugacuccaagauuuaggucagaagacacauuagugaggcagcaguugcaagugacaaaauuccgucuucaauuaguuuaagcauaaaaaauaaaggauuggcuugaggaacagaaauguucaggaaagccuucaauuuagguuucccugauucaagcacucagacgauaucuucaggaucccacugaaggcguucuggaaaugccagccccaaauaugccacuguggugugcugaugacuuugaagucaggggacuugggaaacagugaugcaggcagagacuuucucugagccccuuuaucugccuaaagacggauccuccgaaaggaacucaauugucaugaauccccuccugggaaucuucucaacuggggaagauuaacucagcucacaggaaagaagaauagagguuggcaccagcccaggcagauugucaccucugcuccugagacaauauuuguuaccggagagacuuuuaucugcauaacaagacagccuuuauucgcacaaauuuccuccccucacgcucccauaacuuguguccccaccaccccccaaagccccaagccccuauuccuuucuguagcucaggaugcugcauaagcuucaaucacuuggcccgucuucaagguuuauucugcaggacugccaugcauauguauauaauuaaacguggcuuuucuccuguuacgcugucuuaugucaauuuaauucauagccuagccgaugaaccuagaagaguagaaagaaaccacuuuucgcuccccugcaccacuuuuucuccaacccucugcuccgucugucuuccccaguguuaguuuucuucccaggguggcucucuggcuuucucugcacaugguaaauaucugccacguugcaccccgccccaccugaggaacuucgcgcuugcaagguucuuaguucccacaaagcagaaggaaaauuccccucccuccccugacacccacaucacccccaaagugaaccaaucacugaguccagaggugugggugcuccacuuggucagacaugcucugggccugaccuggagguggagcuacuuucucacugcacaagcaggauuuuugccauagaaaugggaaaaggaugacccccacugacccccaccucuuugggagaagauaaaacuugugguaaagggaagauugaacauagaauacaaggaacaggcaaagcagaucagaaacuaugaagcagcaacagaggcggccggaagauaacaugucaggcaugcaacccacuggcugcugagacaccggacauccacagagcgucugcugugcgcgcagggcagcaccaaaacacugcacguuuugguugcugagccaucuccugaaagggaaucagugcaggcagcuggcaaagcaguucaagguggucaaggggcggauggcaaagaggaggacaaggugaacagcaccaaccagccauccuacaucugcucagcugggguggcggcauccuccugggcacauaggaugugaaaucugcugguggcguuuuguuuuucucucccuuuuguuuguuuaauugacaagaguauguuucucuuucucuuggcuugacuaucgugagaaaggagggcgggcucaauuagcuguagaugccuuuccuggaggccuaggagcuguuuaaaaaggcacaggugugugguggcuacacgguaucaccugggauuuacucccauaaaugggucagguguaaaagaacggccguuaauuaaugcugaugagcugaagaugcauugcuuacccugacugcucagcauggaaugugugaguuaauuccaggaaaucuaauuacugaaguuucuaguuugccucucccuucccugcgaugcuagcauuugaagcauugaaagcaucuuuagggagccuggguguuacuuuagacucaucucuccucccugcaguguguggccuuggagaaauggguuggcaagaaaucccagccugagaauugaauuaaagggaaaggagaugccuggcuucagaggagagcuaugauuuuggggguaaaggagauaaucucuuuuucauaggaaggacuuugcccuuggugggacccaaaagcagaaagagauucagagguuggucugguuagcuguggaagucauuggcagggcaauaaauccaucccagcugagaaaacuguuuacguacagaaccaaaccaagcaagucgggccuuaauaggcuaaagcugguuggcugcuuccaauccugaauuugguucuauccuccaaauauugauuuaaagcacuuuugauuucacaaacuccuuucaaaccuggaucaggagaugguauaaccuuggcuguaagcagguggaaaggcagauggaaugaggagggcacaaggagucagugaggguuuagcuccauucuccagguacuauauucuugcaagggggcugccauguacauaaaguggcccugggacuuuagagcacugccuuuaaacuggcaucagcuggagaugcuagaggaguagaagacagguucuuacccuucuggaggaaacaagcaacaaauaacaaaccacggcaagaauaucuagaaauguuccuauuaacugggauaagagcaacuaucaguuaaugcagccuagguagcccagcaagggacuugggcaguuggacaugcagaugcaacaaagaaaagauggaguugggcuaguccucuggaggggacagggugggggcucgauuuugguucuaaagauggaaagaaaaauuggcuaagaaaucacucaguacccacugagagcccacucugagcaagacguggcacgaaggauuggaguucaagccagaauguaucuccugauucugcugaaacaggcccucuccagccaccuucacccagacccagcugaggaccacccaggaggacaggaauggggagggaaggcagcagggucacuaaggcagagucaaauuuucaccugcugcaugguucccguaguggccaagagaaagcuuccccuucauccucugaaacuucacugaaaaaucaacucacaaaaggcagaucaaugggagaaauggcauauaaauuuauuaacaugcauugggggggaucacaaagggauuaucuuaugucugccucacaaagggguacggaugguuguauacccuuuuucuuaggagaaagggagaugggggaguguggaugauuuuagaggggcaguaaaugauuuuuaggggaauucaaugggcuugaagaacauacagugaccugggacaaagucuguugggcccacagagcagaccaugguuugugucaagucuguccaagucuguuagacuucagucuuucuuccugugauaugaguucaguuaaugaagacuccgggaagggauuggaaguaacucuuuucuucuuugguggcucuggacauuaggcagaugauaugguuuggcucuguguccccacccaaaucucaucuugaauuguacgcccauaauucucagguguuguuggagggaccugaugggagauaguugaaucaugggggcaguuucccccauacuguucucuugguagugaauaagucucaugagaucugauggguuuaucagguguuucugcuuuugcaucuuccucauuuuucucuugcugcugccguguaagaagugccuuucaccuccugccaugauucugaggccuccccagccauguggaacuguaaguccaauuaaaccucuuuuucuuuccagucucggguaugucuuuaucagcaucaugaaaauggacuaauauagcaggcgagggaacuucagagagcagcuuccuccugugcuuugggagagagagaggauugagagacaggagggaggcgaaggccagagagaccuagaggccguuucuucaguucagcaugucaaggugccagauuuugggguauugguuucugaccccuaacaguaucgauucuaaauaauaauuagaagcuaggaggagguccucugucauugugcaaugggauguguuggcuguacucaggucugggauucagacuccauggaugggugacgauaaauaucuuaucuccccuaauuucucuaccacauucagaaacaacggcugucacacuauuuaauuuguucuaaagaaaaaucaaauaugucucugagcucccaggcaccagugauaagaagucaagauugguuauggguuagccccaccucucccugaggaucuugcagaaaucccagggaacccagguggagcgugauguucuggggcagagccccuggucgccacccccuuagggucaauacugaagagaugaugggaggaagggcgugcccacugcuucugggcugaguaggaucuuggcagaggcucccaaacuuccaagucugguguccaucuccuggccaccuacacgugaaugguggcaugugccaugguagguuuagcaggugauccaaaauguagauccccauccacauugacagauuggaguggcccugcccucagugacccaggcugaugguuucagguguugaguagaaggagcuaugcgugacgggggugcauccugagcccuugguggagccuucugcagccuggacugcaacggcagaggcuaaaccggggaaggcugggcuaggcggcuggugagccaugcuucugagcaaaccauggcccugaacacugcuccugucuccaaagacccuggcugcuuuucugucucggcagggguggugccuaaguaagugaaucccucaggaggggcugguagggcagggcuggggcauguacccucaagggacccgccuggggucuuggcccuucaucaggcugccguagggcaagggacccucagaaaccaggcaaagccuggagacccugcaaggaaacuggguggggguuggagcugcugagcucuggggcagucauguaaauaucguuguuuauuugcaaugguuguuguuaaaugccagauaggucuggugcaucucauucucaguggcauugagauaccaacgguuccucaccacucuggguaaggcauggaaugguaacauguucuaauagauaaugaagauugugucucuggaggauuuccuccuaaauuauaggcugucaucugaauuaugugguacauuugguauuggguuuagcaggugauccacauuaugcauuaauguagccauagagaaaaaaauagauucaaauaagaaauauggggcugggcaugguggcuuaugccuguaaucccagcacuuugggaggccaagguggguggaucacuugaagucaggaguucgagaccagccuguccaacauggugaaaccccaucucuacuaaaaauacaaaaaauuagcgaggcgugguggugggugccugaaaucccagcuacucaggaggcugaggcaggagaacccaggaggcagagguugcagugcgccgagauugcgccacuguacuccagccugggcgacagagcgugacucugucucaaaacaaacaaacaaacacaaaugacaacaacaaaaaaaagaaauauggaagaaaggcuucccagcaugaaacucgauuacuaccugcucaucgguggcuucuuucuaucagguuguuaagcagguggcaauaauuuauuuuaaaaauaauuaaaucuucucucagaacaugugccguauuuguuauugcuguugucacccccauuauugcagcuguuaauuacuucagaaagcagagguguaaguaacuauuuaggucauuucuaaucucucucuggaggacaauugcuucuucuagcauguucucccaggcuuugguaggccugguuuuaaaaguauccugaaaugaaguccuggcccuuccccggggaaagccuguuccaugguuacaucugaucacgaggaugagcuuccucuuguuacucuuucucaacuuucuuuucuaaaugucauccuagcuaucauuaaucacagugaauaaaaguuauaauuaauagaggcccaaaucguucaaguggaagauuacucuuuugaauuacuguguuuuucuuggaagauguccucgaguuaauuauuuaguauuuaggguuuuguuuuuuuuuuuuuaaccacaguuucgcuuuuaagaagaacaaauugaucacaguaacuugggggugaggggauuauguauaauguaugcaggagacccguguuaaaaauaaacaauaaacacaaggcugggggcuuugcugcucccccugcuggcuuuuuagaaaggaaaaagauaagcagccuagacucagagcuguguagauccuaaggaagcugcaggaagcuggugaaacaugcaaccaagagauucccgcugucggauuccauuagauguugagcugggcucugggugaaggaucacagugggugagcagaagagcucgcuuccaagcauacaggagggugugguggcugcagggccccugaggccugccacucagcacacuaagaaauuguaucuuuuagauggagccaucuuguguccccaggauuaaaaaccuucauccacacugggaacaaggaacauuucaaguucuaacccaaaauacagaggcaacuguucaaaagucagcggugaaagagugcaaacuaaaaaccauacgcugugagucucugguucugugguugaggggagaggcagaggguacagaaguguccugagccccucccugucccugaccugcuggcuuggcaacucaagacagcaucccuccuggggcuaguguuaggauuauguucccaguuacaauucauauuuauauccuacguucccuuguuggcucauuggugccacuuguuuuuaaaaaggacaucucuguguauucucaagcucagcaacuucugggcuacaaagccccagggaggaguccuguuaugcugcugggcucuguguuguuugcgggaucuugcuggcauuggguuacaacgucuggaccucauucucgcugaccucaauucgcgcugcuggccuugggaaagcccugaaucaaagguuugucaauugcaauggaaaucugugauagaaacagagcggcucgggcaucuccacugaaguccuguacuaugcagggguggggacagaacggcagcacuuaacuccaggucuaaggggcuaaaauucauucguucauucacucauucacccacucacuuaaaaggcauuaauauaauuacaaauuaguuccuguaaugcaauauacugcaaagugagucccugugccuuuucaucuuuccacguugugaaaaauuguuggccauaaauggccucgaugauuccucccuauauacacuuuuuaaaaauguggcuuugcaguuuucuccguggaagagaagaaaucuguuucuccugccuuugaauccaggcuggucuuguuaccuuuuuggauccagcaggcauggcaggaaggaugguuuggagccagggccucaggaggccuggcccacuucugcuccacucuuucggaauccugccaccuugagagcaggcccagcacagugcuauucucagcuggaagaauagagaauggaggacaguccaacugucccagcuugaggacaucauagauccucuuacagccugccggcccccgaccug

SEQ ID NO: 17077 - RNA, 1932 nt, Homo sapiens
cuccuagaagaguucacccagcauagcugcccugggcucagggccuugguuucugucuagucccuggggauauuuauauuuaauaaacuuuccuauaaauacacagagaaauagaaagcauaaaaucugagguguugguggagaaaggcaggggacuuggcaagaagccagagcuggagaggucugcucaggccaaccugaccuccuccuugaccccuuuggcuucuggcuucuccuccuugguuuucuccucuucugugacuuugcucuucucaucuaggucuuucucuuuuccauccuguuuugacucucuuggcuuuuuugaaguuggaagaguucuuguggccacccucucucaccucaucagagucagagaacucuuccucacaggcaauucguuugucagaggaacagaucgagauccauuugucagggucuucuucgcucucaucgccacucuccucagggacagauccucuggaaucaccugcauuuggacccagguuuguggggcagcauucucagguucucaaacagucgcuguuuaucuucuccaaguaccauucguguucugguuagucauacuggaaggacugauguggagccugaaaucugguccaaacuauuccaaguagucgcuguauggaagcucauuagggaucucuguauccagggccacaccugucucauauguccagcacuaggcaacauuacaaauuggaaccacuuccucccagcaucagcauaggcagguuaaagcucuugacaaauuccauacacuuggcaugccccccucaacccuuuuuuuuuuuuuuugagauggagucucacucaguucuccaggcuggagugcccuggugcaaucagcucacugcaaccuccgccucuagggugcaagcgauucucaugacucagccucccgaauagcugggauuacagaagugcaccaccaugucugacuaauuuuuguauuuuuaguagaugcgggguuucaccauguuggccaggcuggugucaaacuucugaccucaagugauucuccugccugggccucccaaaaugcugagaacaggcaugagccaccacgacaggccagcaugugcuuugaugaucagauugaagcaaccuaaccaguccccagauaaggagucugagccacacuguaagagcacugaacuugaaauggccucauaggacuugucgucaaucccaucucggagcagguaguuaacagcauaauacuugccuuugccagccccaauauccuguagaucccuaguuccugaaaaguucucucccuacuuaggagaagacauagucaugacccagucugugguauagaaggccucuuccaucccaucgccguggugaauaucaaugucaauauacagcacccucuggugauagguuagcaguuccaggauggccaagacaaugucauugauguaauagaagccagaugccucaggcuucuuggcaugguucaggcccccagcccaauucacagcgaugucuaucugcugcuuauuaaguuucacagcacuugccagagagccaccaguagacaacuguaagaauucaaacaggccauugaauacuggacaguccuugcugacguugaaucugcaucugcuugcugugcucgaacauguaucugaagagauggagcgcaagaauuuaauguagucaucccugugguacuuggucaucuccucaguacuggguuugugagggugacagauuucuauuguucaguggagaccauagcugggcagcaaauugugaguaguagauuuggugaggcuucauuggauggucuugucuauaauauuaauuuccaacauccccgucguaguaguaacagacuuuccuccuggugcccugugucugcgucaucuugcuugccuuccaucccucccaucaguuggucuc

SEQ ID NO: 17078 - RNA, 1490 nt, Homo sapiens
uugaaaaauacugguggcgucgauggugagugauuuuuaucccacgugggccuuuugcucaguuccauggcaauuuuguaaauugacccuagccagagaauagaucaguauuucacugauaccacgaggaaaagaacaaacaaaacuuaaaaguauucauacaccuugcuaaccuaaaagacagcagggacaagauacauaugaggacaagguauacacccaguucugaauaacuugaagaacaggcuuggcaaagaaguaaguuuauccaaaucuugaauuucugccaggcaugguagcucaugccuguaacccuggcacuuaaggggccaaggcaggaggaucacuugaggccagugagcugugaucacuccagugcacucgagccugggugacagggcaagacccugucucaaaaaaaaaaaaaaaaaccaaaaaucuugaaucucccaucaaagccuuuucauuaaaaauacaauuucaucuacucccuacuguaccuuucacugaugucaaguggcuaucaauucauauagcugaaaauuagugauaguuugggucucauuuaugcauaaauuaauugaaaaucaguaauggccaggaagaaauaugaauauucaaaccacuuuuuucuuuuuuuuuuuuuuuuuuuggcaaaugguguuauauugccugggcaggucucgaaauccugggcucaagcuauccuccugccucugccucuguaagagugugagccaccaugccccacccaaaccauuuuucauaucaguuauagcaaaacaagacaaaccaguucuuaauaauguucaaaguuggacccauagagacaugcuaagcacuacaucaugcuaagaagaacaguuauuacucagcugccauacuucagccauucuacuuuuacaccaagaacaaaauggcuagagauuuuuuuaaaaauacaaaugccaguaccuugccgagacuuguucacugauuugccccaaccccaagguaauggucaucuacuuugcaaccuauggagauccugauagcucccauacaaagugagguacacuguugccaauuuggaggcaggaagccaucaaacuaaacguaguuuaauucagaugaacaccuaucgauauucaaaaggcaaaacaaaaaaacuaauuccagggacauuagaccuuggugaaaugccaaauggaaaauggugcuuuaaaagguagucucuuaccauauaaggaauaaguaaaacauuagcuugugauuucucauuauucaggucaauguuuuagacacgacuaacaagggacaguucaaacuauuaaagagaacaaauuuuuacuuaagcacuuugagguauccacuccccuuaaauguaaguuauguauuuuaucuguugauuaaggggagguccaagcauuuguacuuggcaggaaugcuggcaauagcuugugccagauuacuguauaaacuugaaaguaauaaaaauguucuuuaaaagu

SEQ ID NO: 17079 - RNA, 19784 nt, Homo sapiens
cccaagccaucaggaagacgauauucuauuaucaaugaacacucaaacacuagaaaaaucaugauaguugccaccauaauucaagauagacacaauaaagugauucuccugagaaugucuucaaggacuuauugcuuccucuucucuggaaaaaggaauccucgaggaggaaggguuuacauucccccaccuucccaacugucagacuucggaccgcuccucuccugucuaauccgccuuucauuucccagacgccaacaucugaucuccaggagaaacagugcgguaacugccuaaccaggauuggggaaaacugaaccaggcacuggacuugggucuggggagauagaggacugcagagauuucacaaacaccgcggugccuaguacacuauaggaauaaguguacuauuccuauaguguauacuuuuuuuuuuccagaaaaaucccucugggguaugagcacuauuuucaguucugguucaacuuuucauugagauucuauguggauaagaggaucuuguagugaaaaaaagauaaaaagcaguguuuucaucugagugugagaaaccaugugugccuagaggugggagaacugaguauucagaaggcagaaaaaauaacugagagcugggugaaugaucccacaggcccuaagcccuagaugguuggggauuagcgauguauaauucaacuucugccagcguuggcggcagcgcucccacguagccagccugaggcugucaagcucuggacuacauuucccagaaggucugcuccccgggcugucgcaauuugaauuggggcgugucuagaaagagaagccauagucggcgagcaacgcuggagcaucccgcucuggugccgcugcagccggcagagaugguugagcucauguucccgcuguugcuccuccuucugcccuuccuucuguauauggcugcgccccaaaucaggucugugcaaauguauugccuucucuugagaauucuuguugcggggcgggagggaaacauagaauccccaccaaagcuuucuuggaaaacuccccugggggggcuccaagauggcggagcccagaguucgguggguuggaggcgagguccagcuguccugggugccaggaggacacccgagaccccaggcggugagaaagggcggcaguccggggcacacugcuuuucccuggccuguuuuucuuuugucuaagcacccccugauucuggcuccagggaaucccgaggguaaggcuaccucaaacgcuugaguuucggacucuucaaugggauauggcccgacgcuguuuuccccuuauuccccacgccuuaaaccagccuucgagguacaaaggagcgauuccacauuucgcccucugaaacugauagcaaucguaacaucugcggccccauccuugcucucucguugcuguuacaaucgcuuguucugugggcggauguuguaaaggagaaaagugaaaaggaagaguguuugguuaugagcucuauccugccuugcgagcaggagcacgggggaucugaguuaggagcuaggguacuggggcggugagggcugggagaauggugggaagguauugaccaggugauagaucaaucagcccaaggcuggccaagugccccagugaaucagcagcgggcuguaaaaccggcagccugcuuauugguucuaaguaaaucaccaguggugacggaccagugacugaauagacagacacacuccuuccccaggugggcggucuuagucccaauagaacuugaagccaggccagaucacagucauuucuuaccacagucaccuacuuuccuucuuuuauuuuuauuuucucuuccuucucuggugccccucuuccaguuauauuuuuucugccuucugaacacucaguucucccaccucuaggcacacaugguuucucacacucagaugaaaacacugcuuuuuaucuuuuuuucacuacaagauccucuuauccacauagaaucucaaugaaaaguugaaccagaacugaaaauagugcucauaccccagagggauuuuucuggaaaaaaaaaaaauauauguguguauauauauauauauauguguguguguguauauauauauauguguguguguguguauauauauauauauauauauuccaggagcuguauucccaacucagcaggguuaugggagucgggccagagcuggacuuuuauaguugucucuuucauuccugcugguuaaggagaagaaagaacuaaguacagguccuacuaaguugucacuccuggagcuacauacaguaaggggaugugggaaacagccuagaggcuuguuuucugaggagggaggugaugguuuguggggaccaugaguuaaucugccucccugucagcauuuucgcacuaugcagguagcuucaauggcuaagaguauguaccuugcaauuccaaguucaaugaaaaaggcugaaaugcucuuuaagaaugcaucuccuggucaacagauuguuuuaaccagagucccaacauugccaagaagagaauaggccagucugagaaccaccaaucuguguuugugcauucauucauuuggaaaaggcaauauaguauaguacuuagaaacaagcacucuaggcugggcuuggugacucacaccuguaaucccagcacuuugggaggcugaggugggcggaucaccugaggucaggaguucgagaccauccuggccagcguggugaaacccugucucuacuaaaaauacaaaaauuagcugggcgugguggcgcaugggugagggggugagggaugagaaucgcuugaaccugggagauggggguugcaguggagguggagguugcagugagccgagaucacaccauugcacuccagccugggcaacaagagcaaaacucugucucaaaaaaaaaaaaaagagaaagagaaagaaagaaacaaggacucuaauuacacaaagcaagacuugaaucccagcuccccuuuguacauacauaaucuucucuuuguuuuaaguguguaugugcaugcguguggguguguuuuuuuuuucuuguuuauuuugucccagagucacaagcuuucauaauuuuaacuuuuuguauuggauuagccauuucucaaggccauaaaaugccaguuguggacagauugaccuacagaaacuaguuauuucuucuucugggcugaaucuugugauuuccuaagucacaagugccuuagagagcucaaaccaaagccaggugccuggcuaagcagguauucauccaguucuugugcugcagagaacagcuguaagcuuugcccuuguaauagaaucacuuuugucuuugagcaaaagcagaaaacuuuugucaucuuuccuccaacuuuccuuaaauggacacuguuuccuuaaaaggacaacaguggaaagaacuaaagcaaaccucagccagaagacacagggaguugcaggaaccuacuggcugagacaguagaaugaagaauugaugagcucuccuucucugucugcaggaaaaugcuguccagugggguguguacaucaacuguucagcuuccugggaaaguaguuguggucacaggagcuaauacagguaucgggaaggagacagccaaagagcuggcucagagaggcaaguucaccuccuuucaauucccuccuauuacugcuguuuuaccccucacaguaaugaugauucauucucauuguuucuucccaguuuuggaauucaagaacaccuaaggauuccacugauuugcugaucugaaacuaguacuaugcucuacauauaauggacccuuaaugaauauuauuaauuuauuuuucuuuaccuauuugcuaaucagauaccucuguugugaagaaaggguaaaaauguguguuuuuuaaaaaaauguuggaaauaacauuagauuuauaaugccagcucaaaaacagagcugaccauuucucuuucauauguuggcugacaggagcucgaguauauuuagcuugccgggauguggaaaagggggaauugguggccaaagagauccagaccacgacagggaaccagcagguguuggugcggaaacuggaccugucugauacuaagucuauucgagcuuuugcuaagggcuucuuagcugguaaguguagaacuagagagacuauguugugggucuugaggucaacauggcagauucaacuaaaaggaaaaggucccucuuccucauagaagugguggauaaaauauagccaaaaacuucuguagcugaacucauagucacugggacacaauuuaugucaaagggauaucuuccagaggcagaaacaaaaaaugaauucaaaacgucauagcagugaguaagagcugaagccagaaaucucaugggagucucagcacucaguacaggcuuuuuagggucuggggucuaaauacuuacacagggauaggagaugaggccacaggccuuugagagcuggagcuguauuugagguucuacacaaaguugagauucacaaagggccaucugguccauaguauagaagcuaauaaaaauccuggccaccagcucagagacaugacaaagaaguuuaccaucucuuuagacauagauggauacuuaccugcaaaaaauuagaacccgagcuggcaucauguguggggucugaauucguaccaccaaaugauaugaggauauuuauggguuugauuuuuguauguguguguaauacucuauggaaaauuaacguaaaaaccuguagugucucaucaaaagcaaauccaagagcacucuauaggcauauccccuuauagcccagggaucuaggccuccaaggaaaaagcuuucacuggugugaacucauagucauaaauuacaaaccacaugaggaaaugaaccaugagagagaauuggaagaugcaauaaagaggugaagccaguauuuauuucuuuggggaccugaaucccagggcagagguacauagagaacauucuuuuuucucuugcuuuggaaucuuuccauucagcuugggaagucuuuuuauugagagagguggaugcaacaauucccaaaagcagugaguaaguagcuccugaacuacaaggaucuggaaggucauuugguaguauaaaauggaauucugccccauaguaaaaguaggugggauucaacuaaagucuuaaaaugaaaaacaauagaaaauaaauaugaaggaaaaauggagggaagauugaaguccugcauccucauuuucaaagccugagcgugaggcagcuuucuaagauguaauagccuuggcuagccacuuccacgcuccaucgucuugucccugcagaggaaaagcaccuccacguuuugaucaacaaugcaggagugaugauguguccguacucgaagacagcagauggcuuugagaugcacauaggagucaaccacuuggguaagaaaucuggccuuaucacaaagcuagagagacccaaaauucucuuugggaaacuuaggggucagauugaggcuucuuguugugugauugaaccucaggaccauaauagaccaugugugcauaauaguuugguccuaccugauagcugaggaauaccugagggcugcuccagguucugcccgcuuuuuaaucugugauuuagauuugguuugccuuggcgcauuuuuuaacagacuaauugguuuaggggacuguguugcuuucuuaguagugauccuuguggccagcaucagguauaggucaucugcucuuuuuuuguaaagacagggucuugcuauguugcccaggcuguacuuaaacuccuggccucaggcaccuuccugccucagccucuuuaagugcugagauuaccggcgugagccaccgcacccagccaaccagcucuuaagaaugagauuaaccaaaguaggaaugagcugggacuucauauucacauagucuagaccuaucucgcucauauaaggaugccucaugucuuuggcuguuguuauuucccuaaaccuucauuaaacuuguuuucuaguugauaaugaaaaguuggagggaaagaccuuauuucugaauuaucugccucccauaggugaggccugcucaccacgacuccugucauuccuacauggcccugaacuucauuaauucuaguauuucucaacaggucacuuccuccuaacccaucugcugcuagagaaacuaaaggaaucagccccaucaaggauaguaaaugugucuucccucgcacaucaccugggaaggauccacuuccauaaccugcagggcgagaaauucuacaaugcaggccuggccuacugucacagcaagcuagccaacauccucuucacccaggaacuggcccggagacuaaaaggugggccuagaggaaaugaauguggagacaugagucagagagaggcagguaaaagccacaggaauggaaacuguuuccagagcccaucaccuggagaggaccugcuuccguggcuauaauuggguacaguuuuaguaaguagucuacaacugaauauuggagguggcuggcugggacagugagacucugacuuugagucugaaggccuggcuuuacuacuuacuagcugugugaucuauagcaaguuacuuaacuuuuuuuuuuuuugagacgggaucuugcucugucacccaugcuggagugcaauggugcaaucucggcucacugccgaccuccacuucccagguucaagugauucuccugccucagccuccugaguagcugggacuacaggugcgugccaccaggccuggcuaauuuuuguauuuuuaguagagacaggauuucaccauguuggucaggguggucuugaacucgugaccucaggugauccacccaccuuggccucccagagugcugggauuuuaggugugagccaccgcaccuggccauuacuuaacuuuuaggacuuccuucuucauauguaaaugggacuacuucacaguuuauugucauaauuaauucaggcuucauaagcaagucaagauuuuuuacucacagugagacugaguaugagggaaggaccugaacuggcacuagauaaaggcaguagacuaaaacagguacugggaauauggaggggcagggucucccuugcaaagcaucaaauaagagggaaauauaugcuugagaaggggaauuuccagucacaaauacacagagguccuuagcacugucuacucuggauuucuaauaaagagaagggaaaucgagggugaacugugcuaggaauugaggcaggcagaaugcaggcucaaggaaucaggcacaggugcccuauaguuggaauaggaucauccuaccaaaugaacaucugugagaugggaaggaaacuggugguuagcucaguccuuaugcccagucugugcccagggcaugacaucuuuuaucaguuuaggauagauaaggguaacuggauggugaaaacuauccaaagaguugaucagggagcuaggguggccuggagguggaaagauggguccaguggugagaauucacuaauacaugaaugaggugacucugauaguugugaggauucaguggaaaaucauuauggugcaguaaaagaacccugguuugacagaagauucauucauucagccauucagcagacacguauucagugcccauguuguuccgugcacuggguuaggggacaggggaugaauuggugaacaagauagguauagucucuucuuugguuugguuuacaucuaacgggggagaaagacaauuagcaagucuuuauacaaacuauuaaauguaaaaucagucuaguaaugcaugaauaauucucauuguaaaaagcucaaauaaggucaggcacaguggcucacaccuuuaaucccaggcacuuuaggaggccaaaaccggaggaucacuugaggccaguucaagaucagccugggcaaaauagugagaccucaucuccucuaccaaaaaaaaaaaaaaaagaguucaaagcauauggaaguauguagaauuaaggugaaaaaccaccuucauuuauuccccucuucccccugcucuucucccuucauaugaccauuaucaacagcuugugugccccuuuccaauaauuuuccuaugcauuuacauauguauguaucaugcacaaggaacugaaacuccaacacaguaucuuggagaucuuuccauuuaguacauauggauuuaccccuuaauuguauuggcuguguuguauuucguaguauagaugugccuuaguguauuuauguauuuccuuaacaacaucuggauuguuuccuuuuuguuguggcuguuuaauuauaauugugauaaauguuauaaaggagaaguaccaggacuuacaauggauuuuagugggagucuuggggggaccuuauucagucugaggguucagggaagacuuuccugaagaagugaguugcaugcugagccccgaaggaugauuagaaauuaaauggauuagagguacugauagaauguggaggcugaggccgggcgcgguggcucacaccuguaaucccagcacuuugggaggccgaggcugguggaucaccugaggucaggaguucgagaacauccuggccaacuuggugaaagcccugucucuacuaaaaauacaaaaauuagccaggugugguggcgggcgccuguaauccuagcuacuggagaggcugaggcaggagaaucgccugaaccugggacagaguuugcagugagccaagaucaugccauugcacuccagccugggcgucacgaguaaaacucugucugaaaaaaugaaaaaaaaaaagggccggacgugguggcucaugcuuguaaucccagcaauuugggaggcugagguggguagaucaccugaggucaggaguucaagaccagccugaccaacauggagaaaccccaucucuacuaaaaauacaaaauuagccgggcauguuggcgugugccuguagucccagcugcucaggaggcugaggcaggagaauugcuugaaccugggaggcagagguuguggugagcugagaucauaccauugcaccccagccugggcaaacaagagugaaacuccaucucaaaaaaaaaaaaaaaaaaaaggaauauggaggcugagaaacauuccaggcagaaggaggagaauguacaaagguccgggcucaguuugagaaacagcgaagguuaccauugguagguuguagaaagcaagaguaauaaagaucugagcugagacuggugagguagguagaugccaaacccuuagaggccacaguaaggauuuuaguguuuauucuaagagcaaugggaaacgguuaaaauuaaagccuuuucaaaaugggggcaagagggguugcagcaguugauuucaucagcagaggugagaaaugaggguaguuuggacuaggugguggaauuggaggguaguagaaacuucugagagagauuugguuugggaaagcuuguugacuggagaugcaugcuuuaggugggcauucaucagaacccuuuugccugauugggcaugucgggaacacugcaagaaccagguuuggcuuuaaaaguagaaaucaauuugggaccucugagucugcauuacuaugggucaucuagggagaugucgaguaggcaguugggaauaauacagcugugucugcagcugucaguccacaaagaccagaaaaauucuguuucuucaaagcuuuacaccaaaacucauuuggcagcaaaacauuuccuguacuagggagauuagauuaauaggcaguguauguauacauuucauauuaccuuucuacaaucagagaaaaaaauugaaguaugucuggccccagcguuuuccauaaaggauugggggccugaaauagcaugugcaaaaguaucauuuagcacuuaccaugcaucaggcacuuuuuuuuuuuuuuuuuuuuugcaccggugucucacucugucgcccaggcuggagugcaguggcacgauaucggcucacuacaaccucugucucccugguucaagucauucuccugccucagccucccaaguagcugggauuacaggugcacgccaccaugcccggccaauuuuuucuauuuuaguagagacgggguuucacuguguugcccaggcuggucuauaacuccugagcucaggcaguccaccugccuuggccucccaaaaugcuaggcuuauaggugugagccaccacgcccagcugcaucaggcacucuuuuaagaccuuuaacauauaugaacucauuuaauccucauaacuacccugugagguuguaaguauuaugauuauucccauuuuagagaugaagaaaugagucacaaaagggaacuugcccaagguuacacagcuaaugaguggagccaggauuugaaacugggcagucugucuacaaaauccaugcccauaaccaccacauuguguugacucccagugugucugcaguucagaggagcaguuuggacuguggacaaaaugugagcaccauagaauuauggagagggagucuggugagccacgagaacuccaacauuuaauguuuguguagaagaugaugaacugguccagaaaacugagacagagcagccagaaagguuaggaaaaccagaaguggcauaggcuuauggaagccagugaaaaagaagacuuuaagaaggggaugggcgccuguaaucccagcacuuugggaggccgaggugggcagaucacuugaagucaggaguucaagaccagucuggccaacaugaugaaaucccgucuccacuaaaaauacaaaaauuagccuggugugguggcgcaccccuguagucccagcuacuugggaggcugaggcaggagaaucgcuugaaccuggaaggcaguggcagaaggaagaucaugccacugcacuccagccugggcaacacagcaagccugucucaaaaaaaugaaggggauggggugggugugguggcucaugccuguaauccuaauacuuugggaggccaaggugggaagauuguuugaugccaggaguucaagaccagccuggucaacauagggagaccccaucucuaaaaaagaaggggguggucaacgauguuaagugcugcugagaggaugagucuuggcucugcugauuccugacuugaguuuccagucagaaauacacagagguccuuagcacugucuacucuagagccuucuuagaucugugagauggaaguauaaauuacugugagcaguacuucugaugucaccaugggcaaaagaguccauaugugaaggucacaugcuuauuuacauccuuuucuguuuugggcuauucugcaaaaucaaguccugucuuacccucucuucaugccacccccaaccaggcucuggcguuacgacguauucuguacacccuggcacaguccaaucugaacugguucggcacucaucuuucaugagauggaugugguggcuuuucuccuuuuucaucaagacuccucagcagggagcccagaccagccugcacugugccuuaacagaaggucuugagauucuaagugggaaucauuucagguaugaauguuaucucuuuuugcagaugagauuuauugcucaaaggagauaauuuggguuugucuggguauacccuuuuuuaaaaguacauugucucauauagcuuuugucuuuuaacucuagaguuuuuaccuuuuaguaggggaauuugacucucuuuuguaauaacugcuacauuugauuuuaugccaucuuuuauacugauaauuaugcauucuguuuguuuucuuccugucuuuguuaugucaguccaguuuucuuuauucuuuuuuggauuccuaauucuauuguuuuacauuaaaaagaauuuaaaaagaauuugaggccaggcgcaguggcuuacgccuguaaucucagcacuuugggaggccaaggugggcagaucaccuaaggucaggugaaacuccgccucaaaaaaaaaaaaaaagaauuugaaucugcauuucucuauuguccucaggauugaaauacuauggacuccccucucaaauaagcgaagacauuuaaaaugauuuaaauguagagaauuuugaauauaacacaggguuagauaaaauagugcacugagccugcauauaauggagccucagcuaccauuaacccauggccaauucugcccuauccccauucucuaccccuuuccauauuuuucuucucccauauuauuuugaagcaaaucccaggcaucacauaagaucaaaauuuuaacauguuuuuaccucuacuucagguuauuguugaaaugaccugaaauuuuaaggaaguagcugaaaauagcauuaagauuggaaagaaaggcagacagauuaugagaggccuauaaugccagccuuguggaggagccccagaguuguuucaguagacagacaaaaucuggucugugcuuuagcaacuuuguuucaugaaugaauaauuaaccuagugagagagagaguuucagaaaguuguaaugaaaggaaugguaaugugaaagaggcccugaagcagcagaauuuuuaucacuggaugauuaauuaaaugaggggaugagggaggcuuugcuaaccugaauuucaagccugaaugagguugaugaugacauuaacuaagacagcagacauggaaaaguaauguguggaacuuaggguucuuggauuccaaagcaguugaaagggacuuugucuagcuuaagcaagaaggaaauuuauuaaaauauuaguagggagaggagggaccccuagguugaaagggaagacugaagagccaggcuaagaagugucagaguggcagucagccagccggggcauugcugcuagagugagcgaaugccagcuaucuuuaguguuuagguuguauugcuuaucauccauucucuagggaggaagcauuggaucuccuuccuccuaucccuucauuuuuacucuuuugauuagaggcaaacagggacuuuauuaaugcucucuucaaacuauauugaggggaaaaggugauucugcagaaggaaaucagguugcuauugccgaaacaaaguagaauguucagccaaagaguaacaguuguccacuguguaacaaaccuggcucuguacauguugcauguguguuaucuauaaggcaugcaaguagaaauguauagcagauaguuggaaaugugguucugaaguauaagaagauagauuuauauaguauacuggauugauuuuccaagagugacuggauucuucuucccuagagauuuuaagaaaaaaaaaaauaacccuuuaucuugguuuugacugagugguuuaaagaaagucagcucuaaauccauaacuuacuauuggauugacuuuugaagagccuuuccugugcuauggauucuuaauucauuuugaagauccaacagcagccguguagaccaccaucaagaaaugaacauaaaagucuuuugauugaagccuuaagauuuuugcacuggcucuucuuucugccugcaaccacuagucugcuuuaugucucuaagaauuugccuuuacuggacauuucauauaaauggaaucauaugguauguggccuuuugugacugacuucuuuuacucagcuuaauguuaucaagggucauccaugcuaaagcaugugucaguacuucauuucuuuuuauugcuggauaacauuucauuguauagauuugccacaucuuauuuauucauucaucaggugaugggcauuuggguuugcacuuuuuagcuauuugaauaauacugcugugaccauuuguguagaaauuuuuguguggacauuucucuuggguacauggaaguggaauuucuggguuauaugguaacuguguuuaacugcugaggaacugccaaacuuuuccaaaaugacugccccauuuuacauucccaccagcagucuaugaguauucuaauuucuucacauccucagcaacacuuguuauugucucuccuuuugaguuuagccauccuagugaguaugaaggaauaucuuguuuuuauuuucauuucauuuuccuacuaaugauguugaacauucuuucaugcgcuuuuugguucauuuguuucuuuguuggggaaaugucuaucaaguccuuugcccauuuuuaaguuggauaauugucuuuuuauuguugaguuacaagaguucuuaauagucuagaugcgaguuccuugucagauauauaauuugcaaauauucucucauucuguggguugucuuuuaacuuucuuaaugguaucuuuugaaauguaaaacuuaaauuuugaugaaguccaguuuaucuauuuuuugucacuugugcagucauaucuaagaaaucauugccuuacccaaggucacaaagauuuacuacugucuuuaguaaagacaguuuucuguuacuaaacagaauaccacagacuggguaauuucuaaagaaauuuacuuagcucaugguuccggaggcugagaagucuaagaacauggugccuggcauuugguuagggccuucuugcugugucauaauauggcagagggcaucacauggugagagggcaagcaagaacaaacccacucccaugauagugacauuaauccagguaugagggcaaagcuuuuauuaauuaaucuguucaugaaggcagagggacuaaguuuccaacaugugauuuuuuaagggauacauucaaacuauagcaaccccuauguuuucuucuaauagucuuauaguuguagcauuacauaggucugugaucuguuuugaacuauuuuuauuuuauuuuauaauuauuauuuuuuugagacggaaucuugcucugugacccaggcugcucacugcaaccuccgccuccuggguucaagcaauucuccugucucagccucccgaguagcugggacuacaggugcacaccaccaugccuggcuaauuuuuguauuuuuaguagagaugggguuuugccacguaggucaggcuggucuccaacuccugacuucaagugaucccccuccucggccucccaaagugcugggauuauaggcaugagccaccacacccggccuugaacuaauuuuuguauaugauaugagguaggggucaaccuucauucuuuugcauguggauauccagugccuuagcaccauuuguugaaaagacaguuuucuacccauugaauugucuugguaucuguauuagucuguuaaggcugccauagcagaaucccacagacuggguggcuuaaacaauauaaauuuauuuucucacacuucuggagacugaaaguccaagaucaaggugcuggccugguuggucucuggugaggccugccuuccugacuuccaaauggaugccuucucucugagcccucgcauggccuuuccucuauguacacacacuccuggugucucuuccucuuuuuauaaggcccuguuggauuagggccccgcccugaugaccucauuuaaccuuaguuaccuccuuaaaggcccucucucuaaauacagucacacuggggguuagggauucaacauauuaauuuugggggaacacaauuggaguauaacaguaagcuugucaaaaaucaauugaccauaaauauaaggguuuauguuucacuuuucuguuccguucauuuguaugucuguccuuaugccaguaucacacuaucuugauuacuauagcauuguaguaaguuuugaaauuaguuuaucuuuuaccuauacuaauucuuagcaaaaucccccuggaaaugucaauacugugaccaugcugaugccauaggcacacuuaacuagcucuuacuuggcugggcgcggcggcucacgccuguaaucccugcacuuugggaggcugaggugggcaaacuacuugagcccaggaguucaagaccagccuaggcaacauaaugagaccccaucucuauaaaaaaugcaaaaauuagccaggcgugguggcgugucccugugguccuggcuacuugggaggcugagauaggaggaucaccugagccuggggagguuguagugagcugcgaucacaccacugcacuccagccugggcaacagugagacccugucuaaaaaaaacaaccagaaagcucuugcuguaguauuugauuaguuuuuauagccuacaaggaaccuucaugucaacuguguucuuugcucuuaacuguaaccuuaugaagaguauaaggcacagugcaguggaggaugcagaggcuuacaaaggcugagucauuuccagagagauacagagccuugugguucucacugaugaucuuuucacuaggaaauggcaaguuguacuggucauacuggugagucuucuuaaacagaaguacugauaagacuuguuuuguaaacgugacgauauuuugaaaugguauuucucaaacuuuaguguguucaagagucaucuggaaaacuaguugaaaauagauuccuggaccacaacccuagagauucucauucaguaugucuggaguagggcuggagaauuucuaacaagcucccaguugaugcuccugcugcugguuuguggugcacacuuugaaucccacugucuuacuugacauaguguuaagaguuugcauauauaguuaauucagacuugucaacucuuucaccuucagaauuugcuuagauacugaggaagcaauuuucuugaaauaguauacuuuuaaaaauuguuuccucacaugacuaaagauuguaauacauucaaucauuuuuuuuaaaacuuugacugaaugcuuaccagauguauaccagauccagagaauacaaaaaugagucagaauuguccuuaagaaaauuuucugcaucggaauuauaaaauuauaaaacuuggaauuacaggcugggugcaguggcucaugccuguaaucccagcacuuugggaggccgaggcagguggaucacuugaggucaggaguucgagaccagccuggccaacauggcaaaacccugucucuacuaaaaauacaaaaauuagccagucaugguggcaggcgccuauaaucccagcuacucuggaggcugaggcaggagaauugcucaaaccugggaggcggagguugcagugagcugagaucgcaucacugcacuccagccugggcgacagagugagacuccgccuccaaaaaaaaaaaaaaaacuuggaauuaauuacagcaaugaagagaggguauaugaaacacuuugcuaugauuugaaugugucccucaagguucauauguuggaaacuuaagccucaauacaacaguauagagaggcagggccuuuaagagguaaauuaggucacaagggcagcccucaugaaugguuuaaugccauuaucucuggaacggguucauuaucuugggagugguuccuuauuaaaggaugacuuguguccccuucccucucuugcccaugucaugccuuccaucuuguuauuacacagcaagaaggccuucaucagaugccagccccuugaucuuggacuucucagcuuccauaaucauaagccaguuucuguaugcucauuauaguuacccaguuugucguauucuguuacaguaccacaaaauggaccaagacaccucguaccuugguuuuaccauuucuuuucugugucgccuuuuccuuuuguuguuuucgaagcuggcuuuacuucucauaugaguuuacuaacaguauaacuucaaggaguccagaaauaagcauuucuuuuuuuuuuuuacuacuccaggcaucucugaccaaugugaauagcaggaucucagcuauaugacauuguccaaggcucuguagaaugggccuuauggacuuacuugaagaagauggauauacaugggugucaggcaggcacuaauauuaaauuauauaaauaggggaauauaaagaccaaauguaugcauuauauaucaaacaaagcauucugaugagagguggucuagcgaggagaucuaaaaugguaauuacauuuucucuggcuaaggacuggagaaugaagagauaaggacaaacacuggcccugugaaguacauggagaacaugugaucccuaguuguuuuuaugucauauuccuuaucccuggcagauggcagacuucauucuuaacacugugcuucauaccuuucucuuuaccuuccagugacugucauguggcaugggucucugcccaagcucguaaugagacuauagcaaggcggcugugggacgucaguugugaccugcugggccucccaauagacuaacaggcagugccaguuggacccaagagaagacugcagcagacuacacaguacuucuugucaaaaugauucuccuucaagguuuucaaaaccuuuagcacaaagagagcaaaaccuuccagccuugccugcuugguguccaguuaaaacucaguguacugccagauucgucuaaaugucugucauguccagauuuacuuugcuucuguuacugccagaguuacuagagauaucauaauaggauaagaagacccucauaugaccugcacagcucauuuuccuucugaaagaaacuacuaccuaggagaaucuaagcuauagcagggaugauuuaugcaaauuugaacuagcuucuuuguucacaauucaguuccucccaaccaaccagucuucacuucaagagggccacacugcaaccucagcuuaacaugaauaacaaagacuggcucaggagcagggcuugcccaggcaugguggaucaccggaggucaguaguucaagaccagccuggccaacauggugaaaccccaccucuacuaaaaauuguguauaucuuugugugucuuccuguuuaugugugccaagggaguauuuucacaaaguucaaaacagccacaauaaucagagauggagcaaaccagugccauccagucuuuaugcaaaugaaaugcugcaaagggaagcagauucuguauauguugguaacuacccaccaagagcacauggguagcagggaagaaguaaaaaaagagaaggagaauacuggaagauaaugcacaaaaugaagggacuaguuaaggauuaacuagcccuuuaaggauuaacuaguuaaggauuaauagcaaaagauauuaaauaugcuaacauagcuauggaggaauugagggcaagcacccaggacugaugaggucuuaacaaaaaccaguguggcaaaaaaaaaaaaaaaaaaaaaaaaaaaaauccuaaaaacaaacaaacaaaaaaaacaauucuucauucagaaaaauuaucuuagggacugauauugguaauuauggucaauuuaauaauauuuuggggcauuuccuuacauugucuugacaagauuaaaaugucugugccaaaauuuuguauuuuauuuggagacuucuuaucaaaaguaaugcugccaaaggaagucuaaggaauuaguaguguucccaucacuuguuuggagugugcuauucuaaaagauuuugauuuccuggaaugacaauuauauuuuaacuuuggugggggaaagaguuauaggaccacagucuucacuucugauacuuguaaauuaaucuuuuauugcacuuguuuugaccauuaagcuauauguuuagaaauggucauuuuacggaaaaauuagaaaaauucugauaauagugcagaauaaaugaauuaauguuuuacuuaauuuauauugaacugucaaugacaaauaaaaauucuuuuugauuauuuuuuguuuucauuuaccagaauaaaaacuaagaauuaaaaguuugauuacagucaaa

SEQ ID NO: 17080 - RNA, 1334 nt, Homo sapiens
cucagagcuuggguuuuaucaggccaugaaaggaaggaaaugccaggggucccaauggcagaggugauccacaaagcccucuacuguggccccagcgggugcugauguagggaccguuaaccuaaaggcaugcaguccuccccaggacugcaccugccaaugccgagcccugugggcugccaauacccagccuguuggauaaugagggcuggcuccugugggaucaguuaagcaguacacacucccagucuagaguuuaauacccuagacauggguggacaugggaaacucaaggggccaccagcaugcuggcccaaugccagaguuuaauuaggcccuaaaucuccagugauuacaugacgggcccaguccccugaggccagccaaagggagaaacaucccaaacagcauuguaucggccucuuuugagucuuuccccucaacucauuguuuguggaggcacugcuuguuagugcaaagaaucccuuccaagucacugaguagcuguacagaaaaucagagggccgcugcuuaaugaucucggccaucagguaggcuuucccacaccugccugcugcaucccgugggacagggaguccuguagggggacaggguauagaugaccacaaucacacuuccacucuuggguuucgauggggguuuggucagaagucagcaaaacuaugacuuguucagaaaacagaaugauuaggcucucugagagaccccaaaggcccaaccacucugcaggaccagggccugggaccugcaagugaagccuaaucuuucgggagccccuggggaggaagaggauuaugugaagugguuccgaaaggaggaaggaccugagacuuucacagaauuucugucuuuuccuucuugucuccauccuucuuucauagccuuggaggggaacauuccagcuucuuauaguuauggugaagaaggccaacaccagcaugucacucaugguccagaccgauuuccugaucuggguggccaagggugagaauaacauuuccacugagcugauugaugaaggacacggguacaaguuuaauguagauggggcggaucugaugggaggucgugagaagaaaaacuuucuugucuuccucugacuuucuguuuucauuugaagagaguaggauuaaguucuuaggucuuagagucagauggccugagucugcaaccuggaagagaccaccuagcaaucugguccuacccauuugggagccuacucaccccacgguuccucuacuugcaaugaguuuccuaaacagggcagggccagauuuccaccuugcgcaacuucugcuguggcuggagaagga

SEQ ID NO: 17081 - RNA, 5443 nt, Homo sapiens
ccggagucagaaaggcgaggggcgccgggaacuggcgugugggacuccagacaggagaggcugcgccuuccccgcaccgggaccuucgcgacacaccagauccucgccccuggcucgcgcgaacgcacaggaugaccaccacccucgugucugccaccaucuucgacuugagcgaaguuuuaugcaagguaaaggggggcggagcauuugcuuuucaaaaagucuuuuucuuuugccuuaagaaagaacccccaaaaguuugggucuuggaaggcaauggggaaaguggugcagcgagaugauucuuuucuccuccggcauuucucccaaguuugaaggaauuuggccccguccuucccacccuuugaguuucaacaguugcuggcggggauuacaugugaaucuggaggccaggguuuugaggggcgaaguuugccuggcagggcagcccgggggcuucggggggagggcugggauugggacaaguuuugggcgauccuguuuuacguaacgugcugcuggaucccagguuugcuggucugaucggguucccagucugcgcccuaggucuguccagcggcauuacccacccgugggguugggagugggaggucccucggggaagugagucucgggacaauguuuuccuccacucuuuggggggagcuggggauaugcgaggaagaaaggccaaguugugauucaaaaagauguugcagaacaaguuugcaguggggcuugaguccgcccuagcuccguugggcuucuucccgcgauagccgaucgugcagcaaacuuuggggugaaagaggcauucagguugacccgcuuaccuguguugccgaggcauugcggcucaucgauugcgggcgggguuggggggggagguggcgacaaaaugcuggcuugaacucgagagucccgcgaguaaggauuuaauggggggcuccuuaaaacauguugcuugucagccaguguugaaaaagcaaguuuuaaacucggaauguuccaggacugcgguuuaaauguacauagcaaaagucuauggauguuguuaaauuucuuuccaaccucccccucccaauuugaaagggugaagcugcugggcuacuuuuuaauugcugaaguguuuugccuucucuuaacacgucgggucauguugcucuguuuucccagcuugcugcuccuguuggugcagcugccaacgccccagggcugcaggguuggggugcagggacgccgaggagcugaagaguagcauuuaaaaaguuugaauuuuucagcuuccuucccucccugcacauucccaaacuccacuugccagcccggcugccagcgcuccccaacauuucuuccuucuuuucucgacucucccgcucuuugaucuauuucuuucuuuggccccccuccccccucacgacuuuuuaaaugaaccucauuguugggaaccagcucucgacuggguuccuguaauccucucgguggggugguugcaguuacagauucccggucccccccugcugauccuaagggaccaacauuagaauuugcacaaugacacccacaugggcugggaacuaacuccuaggucccugaccugcaccauuuccaaaucuuggguacaauuugggcaggugaccaggguccuauuggaacagaaaccugccauugguggcucugcccccauccccaccacccccaauccgcuauugacuaggagguggguagggggguuggugcuuuccuuuuccuuuccaucugcagcuuugcguuaaagauuaaacacuggagcucuuauccaagcuugcucuugcagccaaaagacuaauugcaaaggcaucuucucagugaagggggcggggugggcuagggcugaguggaaauggugagagagauuauuguagaaaauaucucuuccgggaacuuagggcaaagaguuuuauuuucaggaaucacaucccugucucccccaaccucagaccaggcccccaaucuccuccccacaagaaaaagcaaaggcagucugaaaaccuguugccaaaggaagggaacacuucugaaggaggaaguugagagucuuaggccaggucuugaaggaggggguaucaauuaagcagagacugauuggaaggggaccuaacguagccuaugauagacuccuuucugagguuuaccuguuuuugucgcgggcgguggcgggggcggggugcgguaaucuagagaggucuggguugugugagauauuuugaguugaagaaucuauuugacuaguaaaaaaguugaacuuuaaagugguagcuuuggggacagaggacauggggguugcauugcaggagucagcauggagcagggugcuugucacacaguuuggaucuugugguuucuuacgcauggggccaaaauaaacccaggugaauggccuaugggagggagagagggaagggagcuugcuagagccgagguagagaugaguucuuugagaaagagcgggcguuugugauuguguagggggcugcccauaguggacauccugguggauguccucuguccuuaccauccuuucucuucucucuccaggguaacaagaugcucaacuauagugcucccagugcaggggguugccugcuggacagaaaggcagugggcaccccugcuggugggggcuucccucggaggcacucagucacccugcccagcuccaaguuccaccagaaccagcuccucagcagccucaagggugagccagcccccgcucugagcucgcgagacagccgcuuccgagaccgcuccuucucggaagggggcgagcggcugcugcccacccagaagcagcccgggggcggccaggucaacuccagccgcuacaagacggagcugugccgccccuuugaggaaaacggugccuguaaguacggggacaagugccaguucgcacacggcauccacgagcuccgcagccugacccgccaccccaaguacaagacggagcugugccgcaccuuccacaccaucggcuuuugccccuacgggccccgcugccacuucauccacaacgcugaagagcgccgugcccuggccggggcccgggaccucuccgcugaccguccccgccuccagcauagcuuuagcuuugcuggguuucccagugccgcugccaccgccgcugccaccgggcugcuggacagccccacguccaucaccccacccccuauucugagcgccgaugaccuccugggcucaccuacccugcccgauggcaccaauaacccuuuugccuucuccagccaggagcuggcaagccucuuugccccuagcauggggcugcccggggguggcuccccgaccaccuuccucuuccggcccauguccgaguccccucacauguuugacucuccccccagcccucaggauucucucucggaccaggagggcuaccugagcagcuccagcagcagccacaguggcucagacuccccgaccuuggacaacucaagacgccugcccaucuucagcagacuuuccaucucagaugacuaagccaggguagggagggaccuccugccuacuccagccccuacccugcacccacaucccauacccucuucucccuacccaucccauuccccacaggcccuacauuaacaagguuaagcucaaccccuuucccccagcaccucagaaugugcccucccucucccccucauaaccccaccuaacauaaggacaagucaauuugucaguagcuucuucuggcuugaaacccccucccuggauuuuauagcccacuuaccaugcauaacagacaagucccauauuuugucaguagaugccuuuuuuuuuccggcuuaagccuuaagugccaaaucacaagagaaaaagcaguaacaguuuacagaagcaacuuagugccuuguaaucuaacuuugucacugugacuacauuaccucuucagcgccagagggcacccgugggccucccggagccucugcccauggcgggguggagacccggaaccagcagcccccuccacuggcgacacaacugcaccuucccucauuucagucucccgcacacuuauuccuccuccccucuucccgguggcaccucuccaccuguacccgcccccccaccccccccaccccugccccuuggaagaguuguugccagaccaggguuuugggggaaaccugucuugacauucaaaaccuuuuucuucccgaucugaaccccuguugacuaaucuugccuggguuuguguaggucugcaggaaggaaggcugaaaaagcggacgaagauuuugacuuaagugggacuuugugauuuaauuuuuucuuuuuuuuaaguggggaggaaggggaagcuagauggacuaggagagacuugauuuuggugcuaaaguuccccaguucauaugugacaucuuuuuaaaaaaaauaacaacaaaaaaaaaaugagagaaaagcuaaaaaaaaaaaaguaaggggugagcaguuaaugguauucauuccacauacaauaucuguguaaaacgauuuccuguagaaguagcuuuaaugguuuuugcucuagaauaccguaggucuauccuuagagcacucacgccaugcuuucuucccuggguuuuaaacuucauauaacuuucagaaauuggagagcaaaaauuuugcuugucacugcacaucaauauaaaaaagcuuauuuaacuuaucaaaacguauuuauugccaaacuaugcuuuuuuuuguuaauuuuguucauauuuaucgggaugacaaauccauagaauauauucuuuuauguuaaauuaugaucuucauauuaaucuuaaaauuuugugacgugucuuuuuccuuuuuuuccacaguuuuaauauauuauucuucaacgacauuuuuuguaacuuuacacuuuuuugguuauuuuauuuuaaaaaaaugaaaaauuaauuuaaaaaaaugcaaaaaacuguuggauuauuuauuuuagaaauuccccccuuuguguuggacugcaaauugaguuucuuucucuuuaggccuuucacaacuaggacugagaauguauguaaaaguucugugacaguacagaaggaaaacaacuuuuuauguauagcuucuaaaaggggaaaaaaaaaaaaagagaaacccuuugacuuccacgugcccaucucaagacauuccacucacagauuugagguucuggauuccaggucuggaguuuuccaauguuaauguaaacagaacuggcacacacacauuaagaugaauguaauuauuauuccucuugcuggucacuaccgucgcuuucuauuucucuuucuuugugugaauuuauuuaaaagaaaaaaaaacuuuuuguaacgacuauuugcaguuuaaaaaucaauaaaccccguuuuuucaagaaacauugaugguggagcugguuuuacuugguuuuggu

SEQ ID NO: 17082 - RNA, 3121 nt, Homo sapiens
aacaguuauauacauuuaugcaccuaacaacagaccaugaaaaauauaacacuuucagaagguaacaaaaaaucuuaaugaccugggguuaggcaaagauuucugagcugugacaccaaaagcaugacccacaaaagguaaaacugauaaauuagacuucauuaaaaugaaaaacuuuugcugugugaaagauccuuugcuuggagaguuaaaagauaagguacagacaugagaagauauuugcacgucacauaagcaacaaaggaacuuuauauauccagaauauguaaagaacucucaaaacucaacaguaagaaaaugaccaacuaaaugacccaacuaaaaaauaggcaaaagguuugaauagacacuucaccaaaaaguauaugcagauggaaaauaagcauaugaaaagauguucaacaucauuagccauuagaggaaugcaaacuaaaaccacagugugagacuaccacauaccuauuagaaugacuaaaacaaaaaaacaguaauacuguuaagugcuggugaggauguggagcuaguggaaacucucauauguuguuguuggaaaugcaaaauaguauagccacucuggaaaaugauuuggcaguuuuguauuaauuucaacaugcaguuaccauaucacccagaaaucucacuccuaguuauuuacccuagagaaaugagaauuuggccaggugcaguggcucacgccuguaaucccagcacuuugggaggccgaggugggcggaucccgaggucaggagaucgagaccauccuggcuaacacgaugaaaccccaucucuacuaaaaauacaaaaacaaaauuagcugggcgugguggugggcaccuguagucccagcuacucgggagguugaggcaggagaauggcgugaaccugggaggcggagcuugcaagugagccaagauugugccacugcauuccagccugggcgacagagcgagacucgaaaaaaaaaaaaaaagagaaauaagaacuuguguucacacaaaaaccuguacaugaguguuuauugaaacuuuauucauaauggcccaaagcuagaaauaauccaaugcccuucaacaggaaaauggauaaacuauuguauaagcacacagugaaauacuauuuaucaauaaaaaggaaugaacuauugauacaugcaacaacaugguuaaauaucaaaggcauauacugcgugaaaucaaacauacaauaugauuccauuuguaugacauucugggaaagacaaaauugcaaugauagagaacagaucaguggaugucagggacuagagauggagaaaguaugaaugcaaagggauaguaugagggaguuuuugagggguaauggaacuguucuguuaccugauuaugguggugguuacaugaaucaauucauaaguuaaaauucauagaacuguaugccaaauaaagaucaauuuuacuguauguuaaauugaaaguaaaaaaaaaaaguuacaggaaugaauguauacucacaaacugaaauaacuacuuugaaggaaaugaacauuccaugagagccuaagagagaggagggacacuguuuugugacaaaggaaagcaucaagaauguuuucccugaggaagugaggcuugaguuggguucuaaaaaaugauuuagaauuuacuugggcuaaaggaagguugauucacacagaagcauuugcaugugcaaaggccccggaguaggaggaagauggcucauucucaucuaaaaaggacuagagcacacggagugcccuggagggugggagaagugcauggggagugagaaaaacccaagcuggaauaagagagucagauuacgccagacugcucuagguggggccuagguuaggguggguggagagguguagcugugggcuggccugauaacuucacugacaguuggaacaucuugcagagacccgggcaaucagaccccccagggcaaugcuggaccugggauuggauucucaguaguccuagcaggaggcggccugcucccaaacccaaagauuccagacacccugcagugccgcauuuaccguagacccuaaagugcccucuccugaggccucugccuuguucaggagaauauugacagcucaguaauacacacuaagcuuucugaggggcuugagggcuuugagagauaagauagucuggcuuguacagacuaccacagggccccagugauguaguuguuuucaaaaauacuugugucaauaaucagguauuuuucagaugggcaacagauccccaucacccuacccugaaccacuuuacucucccccaggcuccaagcccagggccucuccccauuuccaggccucagggccugucuuauccagggcuggggguggaggcuagagagugacacagaucaaacuuauaaguugucaguugaccauuuaauggaagucuacacugaauaauccuuugccaagugaauagccccggaauuuguuuugugguguaauaaggguugccaaauggcuuaguuuacauacaacagcaugacauauagacgguugcagcgagacaugacucuaggcacuuuaugggccaaauguaggcaguuaucaugauuccuauuucagagaugaagaaauugaggccuuggucagugacuugaaaagucacauagcuagaaaauggccaagauuuggauccaggauugccuaacuucaauauacuggcucacugauucucaaacauuaguauuugggucgugagauggaaauuuaccaaaaaugcagauuccccggccccaucugggccagggaaucagcauuccaaacuuuaaacaaggggacuccaggugucucucucucuuucaaccugaagaauuugggggauuuugcaaaugaccugaagccugagaggaagugcaacacugcagggcucucaggaggggguacccugcugacgccugugacuaggccuaaccuucugggguccugcggcccagugcugcacacugucaucugccuugaggugcgccugggguccagauuggccgaugaauacguacacccgcagcgccuccuucacuccgaagacuuucacuuucccccuugcacaaaaccgaacaucccacccca

SEQ ID NO: 17083 - RNA, 5137 nt, Homo sapiens
ugaggaaccaccauccuauucucacagcauuugacauuccaccuacguuuauguugcauucaucgcacaaggauuacagcuucucaacauccuugccaagccccgcuaaguguucuugcgaagguagcagaagccagaauaguccaaagcuguggcuauuuaaaggagcccccaaauuucaugaaaugugagcaccagaggggcuccugcuccgaaucuugacuagucuagaguuuagagcucccuaccccaacucuugaguuauggauggagaagcugaggucagguuagcuacccacgagucccacugguugagggcagagcugaaaccagaagccaggauggauggugacuaggccagugcccugcccuuggcacacguuucuuaggaacuccuuccuacccccgacucaggcugcagacuacuucgccccauuuuccugacaaucugaagcuugaagggggaaagagaaugcuuuaaaccuccaaccagugagccccaguggugagaccagccuuccacaucuggagcuguccccugaggaucgagcuggggcugggagaaagucgcucugcuccccaguuuggguggccacccaauugggaguagccagugacuugugguggcucucacuuuaucaucccuuccuccuuuucucccucuaggaugauccacucacaaaucugaauacggcuuuugacguggcagagaaguaccuggacauccccaagaugcuggaugccgaaggugaaaggcgcuuuccuucugugucucuugcccaucgcccaccugccacucagcggcuaagaagggguggaccccagcaguccggggcuggacgggaggaggccuggucuucugggaccgcauuugaggagcauggggaucacagccucuuggggauucuuccaucguucuuugagcuuuggagagagagguguuaguugauucugcaaaggucuuaggggcuguucuugcaucgacugccugaggaugguucuugucuuugccuuggagucaggauagcgggugcugggguguggggaaaugugcccuuguuguccggcacaguuugggaugggaaguuucccuugcugagaggugcacuguccucacccucugagcccuggguggucucuggacagcugagcuuagcaucuccucuaugccccagcucugacuggggcuggcugggcaugguguuuuucucaucuguaacccuggcuuccuucuagcaucuucugaggagggugcuagagaacuauggcuuggacuuucucagugguggaaguguccaguucugaucugucugggaagaucccagccagaggcaguggcuccauguuggguagggaaggaaggagggggcccaaguugaguguugacuuuucuguuccucaccaaggccuugcugucccagaugcugcuagccaggaugccuggauggggacagguucaggguucgacacuagaacauccuuaccaaagauugggccuggggcuggaaacccagcucuuccuggcugcugaccuuaccauugccccucucccuguguagagcgucucggauggggugagcaggggcuguggggggaagggaagcaucugggagcauaggggucugugggcuuaugaagccagggcuggcagcuccaggcuggggucaggcugggucuugucccaccuccgcgcuugccccuugggaggagccugacucaccacagccccuucccugugugcucuccuuggccccaacugcucagugcugaagggcuagaaagggguuauggagacaggaaaagaccacggugggguccagacuguucccugccccucugccccaccaguggcuuuuuuuuuuuuuugagacggggucucccugugucacccaggcuggagugcuguggugcgaucuccgcucacugcaaccuccgccuccuggguucaagcgauucucuugccucagccucccaaguagcugggauuacaggcacccaccaccggcuaauuuuuauauuuuuaguagagacgggguuucaccaaguuggcaaggcuggucucgaacuccuggccucaagugauccaccugccuuggccucccaaagccaccaguagcuuuuaaaauuucaaaaugucaugaggaaaauuuucaaacgcauaaaaacccaggcaaaagcagaaagaauagcacgaugaccuuuccuauuuccaucauccagauagaauggcuacugaggucuugccacacuuuguguuuuucuuguuuucuuuguugaaguaucuuaaagcaauucugagauaucacaucauuuuaccacugcauacuuccgaauacauccuuaaaaauagaguuauuuucuuagucaaugauaaaguuaucacauuuagcaaauugauaauuccaugugauacccaguucauaaugaaauuucccuaauuaccuaugacauuucuuugaggguugguuuguuuuaaucagaauccaaacaagguccauacuggcauucgguuguguuucugacagcuuuucccaucucuaguacuucucuccucccuuugaccccuuuuauuccugccaaugaacuugcugcagaaauggggccgcuguccuguagcaaguuccuuauacuggguuuguccgccuccuuuggggcuucauuucaccuguuccucuacuuacauucccauaagcgcaaguugacgccagaggcugguuagauucgggcuccacauuuuggcaagaagacuugguggugcugcgagcuucuuucugccucacgucggggguguaugguguucuuggaaccagcuggcuuuaacuccagauuuuucuugacagacaucguuggaacugcccgaccggaugagaaagccaucaugacuuacgugucuagcuucuaccacgccuucucuggagcccagaagguacccggggcccccugcuccuuccaugcccagcacaccuccugcuggaccccaaaccauguccuccugcccgccuccaccucuccuggugacagguaucuggauggucuggucucucggacagaggcagucccuaguucugaaguggcguguuguucuuaccuggcucccgucccaccccacaccucucucucucaucuucuacuguuaacaagaaaauugggcagcagcucacuuucugggacccagaugacuggcuuaagcaggaagggcugugugcaugaggcagccggggugguucuggaaggcuacugaaaggugaacaggagcagcccuuccaugcccacgucuguugaagccacuggcucgauagagcagcuggagcucccuuagaagggcaaugcugggagacaccuccagucuucacuuacccacuuggcaaaggcaucauaaagccccaccuuuguccugcucaugggcaugacuuagcagaucuguccucagccccuugggcucuagugccuucuccuguauccugccugggacucccaugcggccaugcugcacucuguguucucagacauaagcagaaccucugggaggaagggagaggcggugggcagcugugagccccgucaaguguccuggcccaguuuugcuccgggaggccugagauuaaaguucagucgugcagguucugcaccacacagggguuccacgacuaaagggcacuguccaugcuguggacauugaagauuugaacauuuucaucaccaggcuuaggcagcauacaccccucccccagaccucccugguaggcaggacuccagaagaagcacaacaucaccaugaccacagaaucuucacgucucaugcagaucuccugcccuccacauggcaucugagugaccguuuuaaaaugcaugaugaggccgggcugguggcucacgccuguaaucccagcacuuugggaggccaaggcaggcggaucacuugaggccaggaguucgagaccagccuggccaacauggugaaaccccgucucuacuaaaaauacaaaaauuagccgggugugauagcacccuccuguaaucccagcuauucaggaggcugagaccagagaaucgcuugaacccgagagguggagguugcagugagccaagauugugccacugcacuccagccugggugacagagucagacucugucucaaaaaaaaaaaaaaaacaaaacaaaaacaaaacaaaacaaaaaaaaaacaaaaaaaaaccauaaaacaaaaaaaaaaugcaugaugggagccccugcccucucccaccucuccuaugccgucccugccucagacucugcucaccucccacccacucccuccccugcuguuucauuuuuucucuuucugcucauucccuccuuuucugucuguccgucugucuuguguccucuuucuguccaccauggcuguuuggguuuauucugugcugcugccgcugccuacuuucuccucucaaccucuucuccuucucugugcagauguguaggcacgcuaaggccggaugggaaggccgugugaccuaauguuucaugucacggccacgccuucucgggugugcagaaggugagcucucccucggccuccuccacucuccccucuugcccaucucuuccguccucccuggacacuccagcagcaggcccugggauggaaggagggacuagagaagccccuccuucuccugcaggggaacaggacucugaacuuuggccaggacacuugaagaugccagagaaccccagccucugaaugaccuccugugucucugucccuaugcccugggcauagcggauaccacaagcgagagagaagcuuguggucucagcuucuucccugcaccccgcaucaagagcccuuaucccaggcagcacagcucuuggcagugcuuucuauuuccuuaaacauccaggaccucuucccucucucucucucccuccuuccugcuugagcaaggccacccucgcaaauuuagccagcagccagagcagggagaacucuuccugccuucuccagggaguccagaccagagcccugccugaugcuucucaaccaggcugccauggacaguugugcagguugcagacuacucacaagugccacgugugugcaguggacaauggagauuugaauauugauuacuaaagugauccugcagaugg

SEQ ID NO: 17084 - RNA, 3925 nt, Homo sapiens
gaaugcggcugggccacaaaccugccgggguagcacuccccaccacgcugggcguccaggcuggaggucuuggggccgugggucucuagcaugggccucuccuguggcuuugaccuuccucuccuugcuggaccccuggagcacugcuaaggagcaggugccacccccucaugcuggagcuugagccucaagaccaaggcugccccaggcuggaggggaggauauaguuguauggugugcguucagcugucagaccuccucugcggaggugcacaaggccacugucaaaaucccugguuuucugcacccacgccacuguuccagcccucucccacgaacgcaccacaguuccagcccucucccacgaacccgccacaguuccagcccucucccacgaacccgccacaguuccagcccucucccacgaaugugccacaguuccaccccucucccaggaacucaccacaguuccaccccucucccaggaacucaccacaguuccagcccucucccacgaacacaccagcaccggugcaaaaaagagcucgcauguugucaucuuggaaacaguacagcgcgugguggggugggaccuacgacaggagaguuugguggcugggggcagggagaggauguggggugggagugcagaggagcaagagcaaguccucugagaccuggucccgggaucauuuugggggagcuaguccugucaucuuccuccuccccacuguucacugagcacuuacuaaauggcaaguuuuuuacagauguuuuugaguuaaucuuuuuaacuuuuauggagcgcuguuacuaucccuguuuuacugcaaagggaacugaaguuuaggaagguuaaucugaaggucacacagccaguaaauaguggaucugagaacugaauccagcucugaugcgucccgaagugcauguuguugaucaccgggucacagccaccauuuccuccucuagccuaaacuuugcgguggcugcugcuuguuggggaaacuuuccaguuugagaggugcccagagcccccuucaaggcaguaaucuauggggccucugaggauuggggguuuuaguaaagccauguuccagggcuuuguccaggagaccugagcaaacauagguguguuuuguuucccagggcugagccuggcuuuuccaggaaagggggcuggcugcuuucaacagcacuuuuccucuuucaaaagcagugucuuuuuacgacagcagccucuuccuccuuuaucucaucccaacccccuccacgacuggguaguaaacagugagaauuuauagcccccagcugggcgggugggcucagggcagugccugcuaggacccuggauguuucaggccacauuggaccugaaagcaucccuucgaguugcuggggcugacacaguuccccucaaggaaauagaaaaccuuaggcugaagguucagugcugggggacugggagugggugcuggggauggccaagauggugauaaaugagaaaagaccacccaccccagugucaacgcacacucaagugugaacgcacagcuugaagacacugggcagaccagugucagcugggagagaaugugcaaaaccaaaguaaauuauauuuguuuuaaagaguuaaaaauccuuuaauauuuuucuaccaauaaaaagaaguuaaaauaaggauaaaggcuaaaggcccucucaucuccugcagugccagcagcggaggaaggaugcuugguacauacgcuucccuguccugcugcguccucuuuccuccgagcugucuucuguguccagggggucccuaagagcacuguuugucccaucacccccugcccugagagcauucagccucacccacaaggugcaguuggaucucccaggacccucucagcuuugcauccaguuccccacuuguuccuucaccuggcugcccaauucuuacguccacuagaaugucugcugcacagaggcagggacuuuugcuguuuaguucacugcugugucccugacucugugcccugggucucugggauauaaaggugaacauugaguuucuaccuccaagagcucccaggcuggggguguggagcugacaaguggcuaggcauaaugggugaaugcagggugcuauggguguguguccagcccagacagagcagguggcuaucaggaaggcuuccuggaggaggugauaucucuacccagucuugaaagaugagugaguuaguuaagcaagauagagaggacauuggaaaucaguguauguccccuaucuacccugaucugugugccagucuucccagagcucugggauagcacaauacgccguuucucuucaucaugggaguaggcuggccugcagaguggagauauguuugcagggagagagagguauuccauauugguaaguuacuagugagacaugauugaaaaauuaagcccaaagucacaggguaucauaaugcugucccuuucuccccgccuguguggagggauagcuucugucccccuguucccuuucuuguucauaggcucuucaacuuuugcuccuaaaucuaagcagcuauuucuuuuccccugauacucgcuggugugauguucuucccucuuccuacccacuuauugccacuucaccuuuagaguuccccagggcaggaggaagggauuggggagcaugaagcugugaccuuucccaugaggaagaguauuucuaguguggcuccuacugucacaugaaugauacacugcccauccuuugaauuuugcagggcaggugggaagagagcugaauggcucugguguugggugagccccauguaauugguagugccauuuggugcagagaagucuggaguugccaaugaaugguuuagaucuaaagcaagggagcucuucucucugguugccacagaguggagacagcuggagagagacaccuguuuuagauggacauguaaaacugcgaugcaugcuuuuguuucucauguuuguugagacacccucuuccuguuugagccacuagcuggugcuguuggcacaggauggcuuaguugcugccucaccugaucauaaucugcuuaauagagaaguaacuaugaagcugauggucuuugauuugaccuccuuacauucccuuucuggaacucuucaugcuuuugcagcuuagggugccccuauccccacccaaagcacacacagauacacauuggggugcuuacucuucucccuuguccugacacccugcaucugaauucuguucucagcaaaacuuacuacuccuuucucuuagcuggcugccaagugagaaaggauuuaauauacuaauuuacccuaagguaucaacagggcuuaauauguuccuucgggguuacucugucuuaaaacugugaagauugaaacuaagucuuauaacuuaagagguaacuuguaagaauggaauuguggcauuuucaaaugugggugggcaugagucuuugagagagggcugggaggcggauguuaagggaauuugcugcuucauguauccugcuugcucccacccauguagcaggcucuguguagggucccucagcugcugcccuguggguagcucagugcuugguugaugcagugaaugagaccaugguggggcaacuguguugagaggcucugcugaguagguguccaccucccacccccuggcaccauuaaauggcuuguccaaugagggugacaacaccagcccccugaccacuugcccuucuugucucugcccagacauucacggcaugguguaacucccaccuccggaaggcggggacacagaucgagaacaucgaagaggacuuccgggauggccugaagcucaugcugcugcuggaggucaucucaggugaggcggaaccuggcccaggacgagauacugucuauuggugcugcc

SEQ ID NO: 17085 - RNA, 1168 nt, Homo sapiens
ccggaggcggccgccgaucucuccggcgcucuccccuccgccuaaggggcagcagggucccgggaggcccgccgcucagguugaacccagggcggcccaggaagcggcgcugccaccgcacgccauauggagagguggccaggggcggaagaaaagggaaaaucgauccggagcaagcagccccgagccggggucucagccccagccugaagaccaccgcccccgagcacagcccacgcggggaugguugcaacagccgcaggguggccuggaccacggacccccaaggagaccugcccgccagcggcgccaccuccccgcgcuccggcccggcguucccgggcuccggggcaggggcgcucccgcuuccgccaggcgccuguaacccaacaccccaccucgcaacggccgcaccgcccccgcccccucccgugcgcgcccggaaccgguucagagcccggagccgagagcccggcaggcagagcgggucggggcugggggcugggggcugggggcugcagcgggcgggggcggcugcuaaccuuucucugcugcuucucccaggccggguccaggagcaggucccggucccaguccucuucuggcugcauguaaucguugguuugcugagaaucauaaugguccaugauggugcgcgcgugcuagggucuggauuucuuccuccaccuucucucugagcaacggcugcugcccuggcguggggagggaguagggcugggcugggcugggcuggcggggccgggcucgcuccccugcgcccgguuccgccgcggcgcugcuggcgaaggcugcuacuggcggcgacagcggcggcugggcucgcggacugccugccucugggcgggcgcuuggaccuaaucuccacgcacacugaacuaggcggacacacuagcgcugcgggagccgaggcgggcgggggcggggggaaggggcagagcccucccgaggcucuccauuggccaggccgaguugcccaaacuuccccccaucgccucucauugggaauuccuggcauccgucagccgggcugcggcgcauauagguggacugggcggcccccucccggcgcgcacacccccgcccacucccgcggugcccguucccccgcggcucaugugacgccagcuuaagcugaacgggaccgaag

SEQ ID NO: 17086 - RNA, 1168 nt, Homo sapiens
cuucggucccguucagcuuaagcuggcgucacaugagccgcgggggaacgggcaccgcgggagugggcgggggugugcgcgccgggagggggccgcccaguccaccuauaugcgccgcagcccggcugacggaugccaggaauucccaaugagaggcgauggggggaaguuugggcaacucggccuggccaauggagagccucgggagggcucugccccuuccccccgcccccgcccgccucggcucccgcagcgcuaguguguccgccuaguucagugugcguggagauuagguccaagcgcccgcccagaggcaggcaguccgcgagcccagccgccgcugucgccgccaguagcagccuucgccagcagcgccgcggcggaaccgggcgcaggggagcgagcccggccccgccagcccagcccagcccagcccuacucccuccccacgccagggcagcagccguugcucagagagaagguggaggaagaaauccagacccuagcacgcgcgcaccaucauggaccauuaugauucucagcaaaccaacgauuacaugcagccagaagaggacugggaccgggaccugcuccuggacccggccugggagaagcagcagagaaagguuagcagccgcccccgcccgcugcagcccccagcccccagcccccagccccgacccgcucugccugccgggcucucggcuccgggcucugaaccgguuccgggcgcgcacgggagggggcgggggcggugcggccguugcgaggugggguguuggguuacaggcgccuggcggaagcgggagcgccccugccccggagcccgggaacgccgggccggagcgcggggagguggcgccgcuggcgggcaggucuccuuggggguccgugguccaggccacccugcggcuguugcaaccauccccgcgugggcugugcucgggggcgguggucuucaggcuggggcugagaccccggcucggggcugcuugcuccggaucgauuuucccuuuucuuccgccccuggccaccucuccauauggcgugcgguggcagcgccgcuuccugggccgcccuggguucaaccugagcggcgggccucccgggacccugcugccccuuaggcggaggggagagcgccggagagaucggcggccgccuccgg

SEQ ID NO: 17087 - RNA, 7121 nt, Homo sapiens
cagcgugggaccugcgguaccuccacgguuguagagguguagagggaugccgcagcgacggaaccgggcuucuuuuuuaaagaaucaaugugagggaagggugcagagccgcguuauuuuagggagacauugucgcacucccccucccacguguagguagcaucuggggugcgugcgcccuguucgcagaccccauggagagacgcuggcggcggcagauggggcuccuuucacgguugcagccggcaguaacccgaccccgccggcgcagagacugaagaagcgcaggggacagcggcgagcugcgaacaaaagcccuuggcgcggggccgaagcccaggacgcggggugaguaaaccggcucggguaccgggagcugcgggaaccugggcggccagguucuuugcacuccaggagcccacccacugggaugcugugggggaacucggagggcacccgagggcggguaucugaaccccgacugggguggaugguaucuuuagcacauucagacuuggaggagauccggugcgucugagaguauccaggcaccuucuccauccccagcaaacacccgguggggguggaggugggggcggaggcggcgugcagagcccucaguaagcccugccagagcugcuggagcaagaauccaucaccccucccggagaggccuuuggggacuucucccagcccuuuaaucacccgggggccuugcgaccgagucuccuuuggcaggggaaaucaaccauaaacuucuucccuuaggcaaauggggucccuugggaugaacaggccucuugcuuuuuuguuccugcaaagcugcauccccaguagcccgccuaagcuacaaacaaauacgcuaauccucccgggaauccuccagcgccucccucucuagcuccugccugcaccuggaucuuuucaucuuaacuugcagcagaaaggggaugcaucuagcgggcuaggcgcccagaggagccucgccacaggccuccaccccgcauuccggggcugagggagacccaggcugcucucugaacacgaguguccgccccacccccauccccguucuggcgcucagccugggcuuuccgacaucgguuuuaugauuuacguuccaccaaagccucugagccuaauccgaaagcggauuaaguugggauggggugacuauggaugaggaggggggaagagcucucagacguauuccucgaugucccuccuugugaucugcagagauuccaacaaaggacggggcucagccaugguggacccagugccugaagaagagaaggcaggagcggaacccggcgacucuggaggggacgaggccguggcguccgugcccccugauucccagggcgcacaggagcccgcagcuuccucggccucggccucggccuccgcggcggugccccgcaaggcagaagucccaugugcagccgcagaaggcgggcggcgggagcaguccccgcugcugcaccucgaccucuucaacuucgacugcccagaggcggagggcagccgcuacgugcugaccagcccccgcucgcuagaggccugcgcccgcugugcggucaagccgguggagcugcugccacgggcccuggccgaccuggugcgagaggcuccgggccgcuccaugcggguggccaccggccuguaugaggccuacgaggcggagcggcgcgccaagcugcagcaaugccgggccgagcgcgagcgcaucaugcgcgaggagaagcggcgucuuuucacgccuuugagccccgcggccgccgccgccgccgccgccgccgcggccucggccccgagcgcgggcagcagcagcagcugcagcagcgccagccucccggccucgcccgcgccgcgugcggcccgcaaggcuuccccuagucccuccuccgcccggacccaaccuccgccagcggguucucgaacaggcaggaagagccauucgcuggacucacugucccgccggcgugagggcgcccucagcuccgagucgggcgcaucgucgucauccuacaguggggaaagcuugagggagcugcgcuggccgccucgggccucggccaggaacagcugcccagcggggucggcguccuccaccaccaacgcuccgggccgcccgucugcccugacccugguuccgaucaccggccgcagcuucagccucggcgaccugagccauucgccgcagaccgcucagcacguggagcgcaucgugcgucaagugcgugcagagcgcggccugcgcggggugccggagcgugaccggaagaucgcggcgcucaugcuggcgcggcaccaggaggagcuccugcugcuggagcaacgcgcggcugcccacggccagugggagcugcagcgcgugcacgccaagcagcggcgggagcgcgaggagcgggagaagcagcgcgcccuagagcagggccgccgagccugggccgcgcagguggaggagcggcgaggccgccguggccgcgaagagcgcgaggcggcgcggcggcggcagcggcaguacgagcgcagcgaggagcggcggcgggagcuggccgaacgccagggccuccugcggcgggagcgggcggagcgcgcggcccgggaggaucggcugcgcaagcuucagcaggagcagaaccugaagcaacgugaggaaggucuacaggaagggcgggagcgggcugagcagauccgcagggagcgcgcccagcgcgcggcccgcgccaagcagcggcaggagggccagcugcagcgggagaagcgggagcugagccgggccgagcgggcgcgccacgaggcgcugcuacagggucggacccggcagcagcgccaggagcgagagggccugcggagcucgcuggaagccaguuugggccgugcgcaggagaacuacgagcauuugguggagcagcgcacccgggagcugcgggagcgggcccggcgagaggagcugcagggucggcgggccaaggaggcggcagagcgcaaagagcgggaacaucaggcgcaccuggaggcgcuggcccgggcgggggagcgacggcugcagcacgcgacgcagguggccgaggaagcagugcagcagaaggcgcggcgcgugggccagagccggcuggagaaggaacgagcccagcgcgccaacaaggagaagguggagagggacgaagacugccgccggcgagagcuacuccaggccaucgggcgcaagcuggagcgcagcgagcagcugacgcgggaacggcgcagugcgcuggagagcgcccgcuccacagcccgggcuuccuuccacgugcgugagaaggugcgcgaggagaccaacacgcgauccuucgaccgcauggugcgggaggcccagcuacacgccagccuggaccgcaaauaacugcggcucuuugccagccagauuggcacgcacagcccccuggggccucccucaaccacugaccaucgugggaguccccgcucggugcgcagcgcgguggccucucgaggcuucugaccaaugaggcaacaacaguacagacguuugggaccugucagcuggcccccuuuguuuuuaaaacuuacuucauuuggagaugacagcacaaucugcccacauccacccuugauggcucccgcaccgacccuugccaaacuucccuaugugucucuugggcuggaauagagaagcuugggggaaaggggcugaucaggacuggugagagggccccccaggagagggcagaggugguuguccccaccccuucugcagcaguugccccaggcaccuguucgacauuggugucugagacaguguugcuacugcugagggaacaucacccuggcucaccuccaucuuucaaaauauggcaagcugcacaaaucgcggaggccucccagagaaacacagcuccuccaaggugucaagccacgcccaaaugauccaaaaagcaguugauuuuuuagaccuuuuaaucggccaccugagcaaauucucaccaguuuugauaguuuuccaguuuagucccuuggguuuucuaguuagacagucaucugcagauaauguucaauuuuuguccuuugcccccucccucauucuaccaaguggcacaggaaauugguugguuuggugaugcuguuuagcuuuaauagaaacccccagccccuggaggggcuggauuccuuugggagcaguguuccauuccauuaagcuuccuugcaggguggggcccacuccaugaagacagcagucaugccuuaagaagcagagcuaccuuacgugccugcccaggcuguuccugccuaaaucuccagcccugcaugccgucucaagggugggccccagagaguuuggaguguaggauucccucugugaaggaaucaucucuacuucucugaggacaauuaggguauccuuggcugcuuuacugugguggccgaagagcuggaauugccuuuguugagaguuguguucacuaucaguggucguguaccuucuccaccugcccccaggaaaaagagucucccccuuaaauuuccugguacccccucaccuaugccugaaagcauuucacccucucaaugccucaccuuucccauucgccagauggaaccaucaguauuccucuccugguaccgcaaggccuccuggauccaaagcaccaugucaguauuauuuguugguccuuuuugugccuuucuugaccuggagggggaggcaggaggauugcugucagccuaguuucuuucugggaauauggcucccuaguguuggaaagggcagugccucguggacagauggucauuuagccucuggggugaaauacuugcaauaccaggucacucugugguccaaaaggucacauucaguugucaucaggcaacuuuaacccuuagagugcuucccuuccauuaagcugaaauugccccacggccauauccacccauugacucugccuucaucaaggaaggugggaaguaaaacaucacuuuuuacauuaaaccaggaucaggaauaaaauguuaccaaaaaaaaaaaauggaaacaggguagagaacugcuacauuaaacauauuucauauauauucugcuggguaaaauugucccugaaauggcugauuauuacacacacauccauacacacacacuuugucaacccuucacccccacuccaucacaugccaacaaauauaaaagguguauucuguagaaggaagcagugcuuggguguuaggcucaagauaucaugaaacaaggaaaggagcuguuuaccgagguuuuuuuauugaaugggugaauuuuuuccuuaaauuuucuucuuguugauaaccagguugucagugaguugaaauaauugguauuauccaugagucagaagcauuuaacuaaaagguuaaugugauucugguucuuaccuugugguucuugaguugguaaagggcuuuugaaaccauagaaaauuccgcuuuaaaacuacuuacuuccaaaguaugugcauucauuggaggagacaaucugauuuuucagauaaggcacugaaaggaacauagguggucuugccuggaccuuuaccuaguuuguuuucuggcuuacugagugacuuuggguugauugcuucucugugccuugguuuccccaaccuguagaaugggggaucaugauuucugcccugucugucacacaagcacugugagaaugaaucagaauccagauggguuccccacuucuacaacucuggaaccaaaggugcaauugcuauaaacagguagggucagguaacuguaccgugguuacagagugugauguacugucaugaccuggugcagaaaggaguagucuugaaaagcacaaauuaugguaucauguguugcaaaggcccaggccugaaucucaccaaauuagaaguuugcacuuagagagaugcacuguguaaacgcagaaacuuuuagauucuucaaaaaacaaaaauccacauagccaaguagaauuaaggcaaaaacagggcuggguauggugguacaugucuguaaucccaacacuuugggagcccaagguaggaggaucacuugcauccaggagaucaagaccagcccgggcaacauagugaaacccugaaaaaaaaaaaaagcaaaaacagaagccaaaccuagugacaauaaagaauguugcagaccaucugcuagaguauaggccgaccuccauauucuaggauaaauauccauauugcuuucugaggagaagcaauuuccagaaucguugucgggccccuuguuuauauccuuuucuugaagcaaugccagagagaagagguuguuuccuauucugaaaugcagcaagagaauguuggagguggaacaaggauaguggguggaaaaauggcuccugauguauauucuuuuggguggaauugucccuaaaugauauucuaacaagugcccagaauuuucuuuagagcaccaugguggauguguucuuaccacccaggggauugcagccuugaagugaccacagaccuucacauuuguccucuuggagcauccccuuguucuacaaaacagagacugugaaaugaagugaggagguaugggaggcauuggaagaagcuuagguuuaguucauuaccauggaagcaagaaggacaaaacgauuucagauuaaaucaucagugaagcuuaguuuaguguccugcucaggcagugacccaaugccuacaacccuaucuagacaggaugguggaagauucuuuuuggaagcaugcagacugugacucuccaaugaggguaguaaccgggauuugcuaaaggcaaagacccuguaggauagugaagauauaugagaaugcagucuguguucagacuauucuguaaaauccaucacuuaucauuucuucaccuuuacaaaguccauugaaauagaggugacucuaaauaaagggcuguaucuuguuuagcauagaauccccuacagccaaugguuuuacaucucacauaugguaagcacguagauacuggauggcgagaaggacagagggauggauggacaaaugaauggugaccagaggaaauguguauagaccagcuaggcaggacuccauucauucaacacauuuucagugagccgcugcuaugug

SEQ ID NO: 17088 - RNA, 103903 nt, Homo sapiens
auucuuugcaaauaauaguaauucaaucaugcaaauaauaauaauaguaaacgaacuggagagcgcacuggaaacgccgcauaguccagcugagucggugccaccgccccauccacuccagcgcagagggacugucucuuuaaggaccccccaccuccccaaccgcgucgcuucucccuuggguaccuggcccggccggcggcgcgugcgugcagggccucccggcggggcggucgcggcggcgcgacgccggcgccguugcgugcgcgccuggcccugccccuuucccgccccuuccccgcccccuccccuccgcggggccucccccgcccgcgcgguacagcugggucagugacgcgggcgcugcagccgucgcuaccgccgcguucuauucuccgaagccggcgaccgccccaccuccucccucccucccgcccgcuuccucugcccacagcgccggccagagcgagcuagacaagggcacgcggggccucgccuagacccgagaagacugcgggcgcgcgcaagcggcggcguggaagcugugagcgcccccaucccggaggucuccgccggcucccgggugaguugucaccgcggcccgggggcggcggggccggcauugugccaucgacgcgcucggccggcugucaggggcgcgggaccagcgcgcaccgcccaggagugacgcuggccggagcccgggccggcuucggcggcuccccgcgcuucucugcgccggcccgcugucacccggccgcgagccgcgccgcugggagccccgcgcuggcguggcgcggccagccggccagcagugggggcugcgcggccggggggaccggcggcugguuugcggccgggaacuuggugacccgcgguccggggcgcgccgucccgcgucgcugcccgggcagcaccggaagagccagacgccgugccgaugggugcagaggagguaggcagaggcccucugugccacugucauuacugcccucagcccagcaaagcugcggggcuugcgcuggggcagggcuggcuuagagaagguggauuuccugaggaaaucucagagcccgccugugcgcaccgcggcauucgggagcccccgcgccucggcugcucuuuaaucucaaaaacuucucuuauuaaccaggcuaaacuccccgaaaccagcuauuuucuuucaaaaaguaggcacguacauacagacuuuccuuuuuucgcuugguuuugagaccccagcuaugaguguggaucugacucucccucaugggagucguggcuggggagcugcugaaguggagaaaaguuacccuggacgaauuuaggagcaggagggggaggugguuauggggacagcaagacccaggagcaaagaggcgucaaaauaaagucuugggcugguuaaagggaaguuggcgucugggcaaggaggccuaaagcuguuguucccacagaauuuucuuucaguggcaggcgacaugcugggcuuuguugcucucgcuaacugggcuccugugugcucuuccagaggugcaguaagauuacucaguucaauuaggccuagggauuuacucccuuuuuugaucuacagagaugggaaguaugucuuuccuucacaguaguuaauucauuucuugcuguuuucguuccucugguguaaaaacauacauaggaguuacgcacacacaccuuuucuguuuugggaauuccacacccaaacugucaccaucuaguggaggcuaguagagacaugugcuuggcacugacuucugaguucucuggguuuuguguuuuuagcuagaagcauauucaaccagaaauuaaaauuuuccuggaguugggggagguaugucuacaucucaggaaagaagguauuuaagcagcaauaauauggaaagguucuugaggacuuacugaguaccaaccuuugugcuaagggcuuuacuuuuuugaacucauuuaauaacagacuuuugauguagauauuauuauccccauucuucuaguugagacccaaaccaaacaaguuaaauaacucgcccaugucacauagguaucucaugguggagcccacagucugaacuacuagauuauacugcuaguuucugguuuguuuaccuuuugauaaaauugaaccuggagucuuucuaaaaccuucugaaagcacugcugcuucaggcuguuucucagaucaugagcauucuaaacucuuucuccuggguacacacuuacgguauguuugcauaagauucauuuguucauucuuucauucaguacucccaaguaguuaugugauaccgaauguaugccaggcacugugcuagguauugcagguacugcauugaauaagucagaauccagcucucauggacucacagccuuuaaguccauuuguuuugguuuauguuguuagcuuucauugcuggccauuugcugcugaaggaacuucugcccagcgaguuaaacagaggacaguauugguaugaguccugauagauaggacuuccugucugcagaguaauuuuuuggauacuguaguagaaauggcauaugaaacaaauccucacuuacaccuagauagagacaggugccagggugcucaguguuuaaacccugagagcaaacccacugucaaaugggcaaguuugacuucuuucgcugaagccugccuucugaaagcccagaauuuggugagauagaagagaaagaaggguagaaugagguguuacagauacaggcuggcagauaaagagaccucagcacuuugucuguuuuccuggucagucucugagguguggugauugaacuuguguucuuuuuuauuuuuuauuuuuuuugagauggagucucgcucugucacccgggcuggagugcaguggcacgaucucggcucacugcaaccuucaccucccagguucaaacgauucucugccucagccuccugagcagcugggacuacaggugcgugucaucacgccuggcuaauuuuuguauuuuuaguagagacuugguuuuaccauguuggcuaggcuggucucgaacgccugaccucaggugaucugcccgucuuggccucccaaaguguugggauuacgggcgugagccaccgugcccggccugaacuuguguucuuauguaauguugcaucucucaguaggggauguccuccuuugcucuuuugguggggcagcaauuccugcagcagccuucccucuacaugcacacacacaccccuuccaaaagguaauaauucaccugguuucuuuaaaguuagaacuucuuucaaguuuauugcuacuaagcauuguuucacucccuccacacuuguccauuucccacauaaaaacuuggcuuuugcuucaaauauuuucuucugcccuuuuuucauauccuuagcucuucugacaaccaaguuacuacugguaucauuuguaggcugggagaaauacagcaucuuuaaaaaaaaauagugagguacauacucuuccucauuucaguaccaaacaagugaacuguggagaaugaagcagaaccacuugccagcagagagggaaggccagagggcacacgugguugucuuuccccucuaguuccccauuuauuaagagacaauucacacuugcaggcccgaaugucagcagauccauugggcccagguuguguaauugccauacaugaagugaguuauuaagcuccugaaaugacaugcuaucuccuaguugaagcugacaagcaggauuuauuuucccucuucuuucugucuggacacuauggaagucuuguuagaggguguucgcucaagcagugggagaaagaucagaaggagccaauagaggagggagccccaugucuugucuucuuuucaacuuugagagcaaacauugcuuuguugcagacuugaauguugaggauuaggacauuugguuaaauguaagcuuugggacaaaugcaaaacuaggggaaauagagacucuuuccccagguuucucacgagcuccauaguacucaggaaccuuuggguggacuguccuugcgcgucaagaucuguucacuccaccccuggcuuggauucaaggcaacagccauugugugucccuuggaugaguguaaguuuguguuucuguguaagaaccuuucaucuuaaaaaguacaaguucuggggaaaggugccucuuacaaggcuuagguuuucgcagcagagccuguuaggcaccuguguucuucuugggcugaugugucugcgaugguguccuuuuucuucccuuuuuaguuuuuuuuggccuggaaaccagcagggugccuccauuugcucucucauccucugguucuuacuugaguguggaagucgcuccacugguggaccuugcaguggcacugagcugggucacuucagccgugaaaggccaacuguacuacugucaaggcuugggacaguuaagcguccgugaagguacuggauacagcgacagcaggaagugcagcagugagaacugaaacuaauuucacagacugugguguugccugugauguagucucccucccuggcucuucuaucucaaaaaaggaaaauagccacccuugaaacaucugaaggcugcgugccaagaauucacacaguacuccugaaacaggauauuacugaagcauuuuucucaaacagaaacagauguaguucccuguuacugucgccaguguuaguagauccuuaaaauuaccugacagcagugugccccuaaauguacuccccgcuccuacacacauacacaaguguuuuauuuuauuuuauuuuuuggcaaagccuccuuccuugauuugagggaaguuagccugggauuccugaugacaguaauagauucucaguggguuugcagacggcagagguggugacugacaauucuuuauuacucagaagaggaucuucucuggugaaaaaugauucaggauucugcaguuggagauuggauacaaaaccucagagaagggacacaaauagagaucuuucucagccuccccuuucuugcuacccuuuguagaggagagggaaugucucauauuucuaaguccaaccuacugccagcagugacuugccuucacccacagaaauuuaagauuagaguguggaauugcccuuuauguaaacuguccuugcugaaauuuucuuugacuagacuaggcuucagcuucugacaaagacaguaaaaugaaacuggcuucugggaauggcauaagagccuguuuauccaauucuuccuuuagauuguucucaguugagcucagcaaacuaaguggacggaggcuuguaaaagguaacugcaaaaaggguacaaggugauuuugcuuaauuugcauuuuaaauuauagcagucuaugcaaacuguuugaaggaagacugagagauguuuuuugguggggaggcacaagauuacagauagcuuggaaaauaaaagggaaaaaaaaucagcaugauucuaccacccuaacauaauguguauucuguuuuuuccaucuucagaugguaguaccuguacauucagcuuuguauuuuuuucacuuagcuuuuuuuuuuaacaggucauaaaauucacccauuuaaaguacaauucagugguuuuuaguauauuuacagaguuguacaucuaucaccauaaucuaauuuugcaacauuuucaucaccccaaaaagucacucccuauuucucuacaaucccaccuagcccuaggcaaccacucaucuuucucucuauauagguuugccuauuuggacauuucauauagauggaaucauaugauauguggucuuuaauaacuggcuucuuucacuuagcauaauguuuuugaggcuuauucauguuuuaccauguaucaguacuucauuccauuuuauugcugaaugcuauucuguuguauugauauaccacauuuuguuuauccauucaucagcugauggacaguuggguuguuucuguuuuuugguuaugaauaauauugcaguauugcuaagaacguguguauaaguuuuucuguggguauauguuuucauuucucaaggagauaccuuuaaagcugcauccauccauaucucuacuuugugguuaacauucuccuagguuaugcaguuuguuugaggaagaacaguguuuuaguaaacucuugauccuacugugguguugcggauauugcccugaaucaagaaaaggugccaccaaaaaaaaauccaaaacccaaaaacaaaaagagagaauccuguuuuuaaguuugaacucuccaguagcauuguuuccaaauauuuggugcagaacuuuaaccauuggugagaguugacagacgcgauagugccuaaauucaaugcacauguacugcugcuuuaaacaaauaaagaggauuuucaaugcgaagccucagcucuaaaucucaucuuuguguuuuauagagaggacuuuaccaugaacccccaaagccuuccuuaucaaaugugauuuauaguucucagaagcuuuuccuuuucuugugaaaaauuccaugccaggguucugugcaccugcucaaaggcuucugcuagguuggggaguggaaugcuuauugaacagagagccagccagcaagguagggaggagggagagggucugugagugcccugaaaauguagaucugagaaagagugcucuuuagagcagcccccacagggcuuuuccagguggaccucagguguaacccgagguuaaaaacagaucaugccagacacaaaaaggagcagauggugcugcuuggagugucauuuccucuacaggaugugucccugugugguuuuacaucaugccaaccauauuaaugaaauaaugcaacagaaugucuccuuuugcccuuguuccaauuggaaccacagguugaguuucccuaaccugaaauaugaagugcuccaaaaucuuaaacuuuuugagcacccacaugauggagaauuccacaccugaccucauguuuuaggucacagucaaaacuaccuucagucuauguguauuacguguaaaugaaacauaaauggauuuuauguuuagaccagggucccaucccugagauaccugauuauguauauacaaauauucgaaaaucuaaaacauuugugaucccaagcauuucugauaaaggacacucagccuguacuagcacuugugaccaacagcuagucuugcuuucaacagcuagucuugcuuucccugaucguagaucccuacuaaaagcucuugaaagugugcauaugcaggcuaccuaaugauuuaacggaggaucaagaugguuacacugcagagaaacaggagggauagggcauaugcccuuuguccagcaagacagacaaaaacuaggaacuugaauucucuucucuggauuccuguaucuggagccaaggccaaggaucaguucuucuagaaaguucccuccuguguguguguguguaaaugugugugaaugcagccauaacuucccugccaaaauucauugccaaaaauuuugugauuugaagcaggccuuaccuguuaaugcaaauuugauucucaaauccuaagaguuuccaaagguugagugaagugagaugagacucuuaguugaagauccagaugcuucacuguugcuaucuagaugcuaccaaaacucccagcacaacaaaguauaugaagagagguucuagguucaugaaauguuagaguuggaaaaaugggccuuugggguucuucuuauucuaccuccucauuuuaaagaaaugcaagugggaaauggaugcucagagcugacuugccugagaggugaaagggcuaguggagaagccagagccccugauuccuagucuagugcuuuucccucccggugugaucaccucuuuguuucucccccucuucugggccuggucccggaauggggguugggaguccagcagggugucgugguucauauuuuugggaacaaauucaaguuacuucugugauuguaguuuugagucuaauagugaaauuacaaaggcagugagucauuaaguccaauucuucugaaagaaaacuguucuuaaaaugggugcagagcccucagggcugcucugccuauggagcagccauucuuuauuccuuuacuuucuuaauaaacuugcuuucacuuuaaaaaaucgguguaguuguguuuaggcugugccugcuuaacuuuuaaaucucugugcuguguaucuuugccauucaaaaaugccaccuggccugguacgguggcucacaccuguaaucccagcacuuugggaggcugaggugggacaauugcucaagaccaguucaagacuagccugggcagcauagugagaguccacaucucuacagaaaaaaaaaaaaaaaauuaaaaauuagcugggcauggugacacacaccuguagucccagcuacuugggaggcugaaguugggggaucgcuugagcuugggaagucaagacugcaaugagcuaugauggugccacuguacuccagccugggugacacaguugagacccugucucaaaacaaacaaacaaaaaaaaaccaccugaccccaggccaaugggaugugugcucugucugggagaacugaucccacaccuacaccccauuaaccuaccaaacccuucagagcugugucucgacuuccuugggcuuauuguauguggaaucagcuacccaccuaaaugcagcgugaacacacaucuauaacuguaugucucuaaccaggcacaaaggaagcaagucauauauacuggcuuuccccaucccagaaagccggugaacagagucuuguguuuagugggugcugcuguuucaguuggcaugcuugagccauugcuagaaaaguaaccaaugauauguuaucuggucuaccccuuuaucaauccuccaucugccuccagguagaaacucugccaugggaagaccgucugccuccuuguuucuguccugugggaauuuugcuuguuacacagcagaauagcaagaaaaacaggcucugaguuucauaagaauucaucgauccaucuuuccuuuacauguacccucaagucauaauaauuugugagccgauaaucugguuaggcuaugaugucagacuggugggaggcugguaggugguugcugcagaaaccaaagggaaguaagucuaguugucuggcaaauaauuaguggaugucuguucuaggcacuagguauacaguugugaacaaagaacaaaauggucauaauacuugcuggcauggaguuagcauacugcgggaauacucacgagguuuuuaauuugagaguaguguuggaggaauuuuuuguguacgguagacuuucagcuugauuguuugggauuugucaguuacuucugugcuccaaaccacagucauccuggaagggaagaacuugaaaaguaucguuagagaguuuccccuagucuccccauuaaauaaaugaauugucuuucucugcagugagcuaggucuaacaguuuggugugcuuugaggauuccuguuucuugcuuuauuuaaucaacuaguuuuuaaucugggaauguuuucagaccuugacauauccuauuuuuaauuaaaagaaaaaaggagauguggguucaacuaugagaaacugggagaaggggaauaagaggaucaguggcaugaauuccuuagggaaucuuuuuucuuccaucucccucaagccucaauuuuagauagaaauguugauuugugagaucuuuuuccugauauauuuguggcuuuacaaccugcuggggacaguaaaggaccuaguucccaguaaacguacgcccucccccuauauuuuaccucuuuggguggccaucucuguguaggcccugguuccaggcugacauuggaaguucccugagguuggugacugucugauccacuuccuuguacccccuccuggauuaauuggaugauuaauaaaugauugaccagguguaggggauuaaaauaacaaguauaggagggcagggugacuuugagguuaugagccuugaugacaaggaaugaaagagugguauuauugaugaaauucuaaaaauggagucauuuguagggaggccugguuugagugaaaaacaaauauaaacaggguguuaaaaagcuguuaacauucaccaaguucacccugucugguggcaggaaaagaagucagcucaggaaccauggcagugggaggugaaggagagagaggguauuagagguuguccagaauguuuuagcaaggccaaucagaaacaaacuauaggguccccuuauuauggggcugaagaccagaaagucaucccugcuaauuuuuagguagcagaucuuuguuucuagaauucuguucuuuuaaaagccuugggaggcaucauucauuccugaaagucaacuuacacauuugccucuguaguuuggagagaaauauauuuaguauccagugugucagguugcaggcaaggaaguaguuaacacuuuucucuuuguucuccacaauugaacuguuuuugggggggcaguucuacugcuucuggaauuacauaauugugugggucaucuccuuugaaggucuguccaugcuuuuuuuaaagcacaucguugaaagaagggugcucuguacaaaugcugacaugcuuuucucuuggguuauacgugagcaauuguagaaugaacagacuucaggguuuugguguugguauagcuuucugugaauagugaagguauuaggaggcuaauguuaaggcagcaggugaggugguuuucaggcaacacaucugaacucauuaauugaucaaguauuuaucagaugcucuuuccuauauacuaauuaucuccccaaaggaauucuuugcagcacaaaaguuuaacacuuaauuauacauuuugaguuguucuccaguguuuuuuuggcuuuuuuguuuguuuguuuuuugaaacagggucuuguucugucgcccaggcuagaguguagugguaccaucgcggcucgcugcagccuugaccuuacgggcuuaugcgauccucccaccucagccuccugaauagcugggacuacaggcaugugucaccaugcccggccaauuuuuuuggauuuuuuugcagagacgggguuuugccauguugcccaggccggucuugagcuccuggacucaagugauccgccugccucagccucccaaagugccgggauuacaggcaugagcuaccaccccggcccaguguuuugguuagucucuucuccucauagauuucaaccgccuugaggaugguuuacguuucucuguguuuacugugcagacuggacauccauauucauagcaguaaagauuucuucauuuuacaaacugcuuuuuguuuuuuugagauggagucucacucuguugcgcaggcuggagugcaguggugcgaucucggcucacugcaaccucugucucccagguucgagcgauucuccugccucagccucccgaguagcugggauuacaggcgcccaccaccacgccuggcuaauuuuuguauuuuuaguagagaugaaguuucacuauguuggucaggcuggucucgaacuccugaccacaagugaucugcccacuuuggccucacaaaguguugggauugcaggcgugagccacagcguccggccaaacugcuuucauguaagauaucgcauacugucaggaagauuguacucccauuuuacaaaugggaaagauaagaccuuuggcaaccaguaugcauauggcagcaacuguacuuguauguaguagugauguucagucagcugggguucaaaugcuaaaucagacaccgguaugauagcacauguugagaggugggaaaccuccuaggauugcagacuugauuaacuugccaaggaacagcaaacagcaacaugauagcaacagccccuuuuugguuccuccauccccaucucguuacagguacccuaaagucagcauguauuuguguacuaauggaacaaaaauacgaacaugugcauacagucaugugcaguguaauaacauuuugcugcauauaugauggugguuccauaagauuauaauggaacugaaaaauuucuaucaucuagugacauuguagccaugguaaggucauagcacaaugcauuacucaccuguuuguggugaugcuguuacaaauaaagcuacagcauggccaguuguauuagagucuagcacauacaauuauguauaguacauaauacuugaugauaauaacaguguuucugguuuauauauuuacuauaccauguuuuuugucaucaauauagacuguacuccuucuacuuaggaaaaaacuccccaaaaaaacaguuaacuguaaaacagccucaggcagauccuucagcagguuuuccaggaggcauuguuacaggaaauaacaguucuguuccugccuuugaagacuacuagugaaauaagaugcugagauggaagauagugauauagaugauccuuacccuguguaggccuaggcuaauguguguguuugugucuuaguuuuuuaacaaaaaaagauuuuuuaaaauagaaaauagcuuauagauaaggauauaaagaaagaaaauauuuugucacagcuguaugucuuaaccuagguguuauuacaaaugagucaaaaaguuuaaaauaauuaaaaaguuuauaaaguaaaaaagucacaguaagcuaagguuaauuuauagaagaaaaaauuuuaaaaaauauguagccuaaguguacaguguuuauaaagucuacaguaauguacaguaauguccuaggccuucacacuccauucacucacuuacccagggcaauuugcaguccugcaagccccauucgugguaagugcccuauacagauguaccauuuuuuaucuuuuauaccauauuguauuuuuucuauguuuaaguauguuuagauacacaauuaccaucauguuagaguugccuacaguauucaguaacauaucugcuguacagguuuguagccuaggcuaugccauguagcugagguguauaguaggcuaugccauuuagguuuauguaaguacacucugugauguccacacaacaacauugccuaaugacacauuucucagaaaguauccacggaaucagagugacccugcuucagucucaguucugccauguaucagccauaugaccuugagcaaauuuaaccucuuugauacuuaguuguuuuuuuuuuuuuuuugagagggaguuucggucuuguugcccaggcuggagugccauggccugaucucggcucaccgcaaccucugccucccagguucaagcgauucuccuaccucagccucccaaguagcugggcuuacaggcauguggcaccauauccggcuaauuuuuuuguauuuuuaguagagacggaguuucuccauguuggucaggcuggucucgaacucccgaccucaggugauccaccugccuuggccucccaaagugcuggaauuacaggcgugagccaccgugccuggccgauacuuaguuuuaucauuuguaggauagaaaugauguuaacacuacccaucuauagaaggguggcuaccaaaauuuugauuauugccugguguggggaauucuggaugugaaugguaaaggauaaagggaacuuuaacuucuuaaacuugcuuuuuguuucauuugaauuuuuugcuauuggcauguauaacuugaauaauuuauuaaaauuacauuuaaaaguacucccuuguagaauuuuaugaaaaucaaaugaaaugggauauuuaaaaagauagguaugugucugacaacuaaaagauacuuaaauggcaguuuggggaaguauuaauuaguggcugacccuuuuguaguguuaaauguucugucugacuguguggcuucagguaggucucuuaacuuuguuaagcuccagcuucuuuaacugaaauugggaguuaagaguaguguguauuccacgggggguuuugaggauuaaaugauucuagaugguuaagcaguuaacucaguaucuggcacauaguuaaguacccaguaaauauuaacuguuaucagcuuuuauccucacuaugcuugaagagaggaggcagugaguguaacuuuaccuacuuuaaaguuacagaaaaugaggcacaggguagugggugacuuguccuaaggcuagauguuggguuagcagcagaaacggggcugacgccuacauggucuccuucauguuucagugcagcccugucagaguggguggcagcaaaccacggaggcuucucggaugugcagacaggaagcacuggccaggacugcggaugugaagcucagcagaacauggccggucuggacagaggggguuagcaagggucaauguggggcugagugagugagagaagccagcuuagaaccacauccuuuuuccaccuuccagggcagauggaccacauccagagugaucaaaaggagaggcuuguuuccucucuccgccuccuggucuuguauguggcacacucuuuaccacuccccucgugggcucaguucucugaacucugucacauccagaaaauucaggucuggccuucucugugaaaccaucucugcugcuggaguccucacugacagccacaccacccgcgucugcucauccucucccgcuuucaaccuggauggccugugugaggauggcuuugcuucucuaaggaaggccucucucccuauaccacuuuagugcuccccaugguguuccaccugcucccagaacaaucugccuguuugugggacugaaugguugaguugaagccagucuuggugggaaauagguuuggagcuucucugugggcuccucuucuguguauuugcauuuugagaggggggaaaaaaagcccugagugauuucugccuaguacgguuuccagagaaugcgagauucuccuccucaaacucaguccuggggccagagcugauuaagcccccggcuucccaccuucccaccuuggguuuuuacaguauacuucuuauccuugcccuuucuguucucugcuuaucagaccuucccacaugugcccugcucucuuccugcugcacaggggucaugaaauacuuaccaauuagugaaaaauacagacaaugcagugucaaauuuuaccaaucucaguuugcacaguggacuggaagauggcaugugccaucuucuugcaggacuugauuguuuuuguguuugcguguguuucaaauauuuccuuuuccaaauuugcguuuaaugguggcuggcaaacccccauaguucacuuuucauuuuucguuguagauauucuuugaauaucuccuugcuauggguauugggcuuacauuuaauaauuccccaucaggaucugaaaaguaugagggugccuaccuaugaagcacccauuuuuuucaugcuuaauaccaacuaagucaccagacuuuuuuuucgagauagggucuuguucuguugcccaaauuggagugcaguggcuugaucauagcucacuauagcuucgaacuccuggacuuaagugcuuaucuucccagcucagccuccuaagcagcucggauuacaggcacgcaucacuauaccuggcuaauuaaaaaaaaaaacguguuuuuuuuuugucuugcuguguuccccagguuggucuugaagcccuggccucaagugauccuccugcuuuggccucccaaagugcugggauuacaggcaugagccacugcaacuggccugucccacuucuuuagaggacucugcucugacucccacuagcuuggcaacagguggauccuagaggauguuaaagaccucauggaagggacccucuuaacuaauugcaaaauaagaauguucauuggaaaagaaacccucccaccaccaugguggaagucccucuaaaacacaaguuguucaggacuuuuauuauguugcucuaguauuuaucugguuuuugaagauagucuugcuuaaauuaauucugauuucaagagugaugacuaaaaguuuuggaggagguguuuagaaaaggaugaagcucuggguuuauuucagggcuaaucaugaauuugcaggagcagcuucaggacaccagggagaggcauggcacacugccuuggagcuguccuuaggaugcugcuaccuuuuagggacauacuguaggcaguccuuggucuauguaaaguugugccugggccuuaucagaaauuaaacagauguuauuuauuuauuuauuuuuucuuuuugagacagagucucacucuguuccccaggcuggagugcaguggcaggaucuuggcucaccacaagcuccaugccauucuccugccacagccuccugaguagcugagauuacaggcgcccaccaccacgccuggcuaauuuuuuguauuuuuaguagagaugggguuucaccguguuagccaggauggucucgaucuccugaccucaugauccgccugccucggccucccaaagugcugggauuacaggcgugagccaccgugcccggcccagaugguauuucuaguaaaaguggcagauguucuugcugucagaauuaauuuuaaucuuuuuacauguaaaugugggauuaugggacucuuuuuggggggucuuagucucauauggaagugcugcucuuacuuuacagagauuuuaucuaucccuugcucuuacccaaagugacuuuuuuuuuuuuugagauggagucucgcucugucacccagucuggagggcaguggcgcgaucuugacucacugcagucuuugucuccuggguucaagcgauucuucugccucagcuccuacguagcugggauuacaggcaccugccaccacgcccagguaauuuuuggauuuuuaguagagacgggguuucaccauguuggccaggcuggucuggaacuccugaccucaggugauccacccaccucugccucccaaagugcugggauuacagacaugagccacugcucucggccccaaagugacucugaacucuguuuucccauccccucugaucacuuucucucaccacgugggucauuugugguggcaaaguacaaagugaccagccuucucucucauagaauuugaagguugcugauggggcuauguuacuaauggggcugugugcuugcuacagagauacugcuggugaugaaaguguaugacauuucuguuauuccuuuggguuaagacaucuguauuuagcagguauuauaccuagaaggagugucuauaucagaguaucccagaaaagaaagaagaaaaauccccuggggagugggaaaaggcagaaaguauugaaugugugcccugugccaggcagugugcucagugcuuuaacucgguaggcuaaucuucacuggauaaaucaggaaaccaagcucugaaacauuucaguacuguuaauuacuguauuggaacuagaaccaagguuggagugauucuaaagccugugguggguuuuuuuuuuuuuuuuuuugagacaggguaucacucuguuguccaggcuggagugcaguggggcuauguaggcucacugcagccuccgccuccccaccucagcccccaaccccaguagcugggacuacaggcacauaccacuacacccagcuaauuuuuguauuuuuugaagagaugggguuuugccauguuacccaggcuggucuugaacuccugggcucaagugaucugccagccuuggccucccaaagugcugggauuacaagcaugagccacugagcucgguucugccuaugguuauuuuauggcagguaaagaauauguggauucgaaaguugggugggggaugagguggugagggaggcagagaacaaaugccuggagagaggaggguagggccaggugggaguugcaguggaggggcacuugggagugaaugguccuggugaggguguggaaaggagggguugguuagcaaaaacaagcugaaguggaagagagguugggggucccuuggaggggguguaauguuggaugauggcauuucuucccugagggacgagggauggaccagaggagccuggaggaccagauaaccucuguauuuagguagauggccguugggcccccacaggaagccuuuuaaucccugguauuuauagacuggccuguacucuacugaaaggcagcucccauaucagucagcaaaggcaacauuaucugccuuugaaacaccaccuccguggauuaccauuuggcccaaugggagggucuggauaaugcccauuauauuauccuaauucccugcuaccucagagguuguuaaggggcacuucugcuguuucccucugagugaccucuggcugccacucucuugcagaugcuccuuuuccucucagggaugagucggagcugggacugggaaaggcagcccucuuguuucuguucaaguuggccaggaaugcccaggaaugaugauucuguuuugccagcuucuugccgugaggcugggguugcuguguuuacagcacaaccaacccuaaagucagugcaauucacuguggauuuauugagcaccugcuaguaugugcguguguugggggugguauaugaaaaugauggaggcaggucucugccuuaaaugagggagggugggcaaacagcucccacggucggcgguugaaccaguuccuauucuuucucauaggaaguguccauaaacauugucuugucucauuugcaugguuguugagagguuugaauguagugguaaugaauugagagugcuucuaaagguauuaagcucuugauuuauguaaaacuuucuucaguauuacuaggcaggcugauaauaaaagcuaacauauauugaaugcuuucuauuugccaggcacugcccuaagugcuuucuauauauuagcuuauuuaaucuuuauagcaacuuugaaguagauugcuuguguacccacuuaaaagaggauuaaaaaaacuugccgaggauggcacagcagguaaguagcagagccaggcagucugaacguuuggccaaacacuggccacuguaaagaucuuguggaagucagggaguagagguggucucucucccccaagugaaggcagcagccaggaccuaccgucagagaccagcaaggagcagagaaaggucaggcuggugccucagaaagcaucagcauuucugcacaacuuaauuaaauuacugaaaccuuuucugagcuuggagccaucuuucuuggagaguaauacaauugaaacagauaauuuaagccaaggaggaaggacagaauuggugagcucacauauguagauggacauguaaugacgucugacuaaaacacagaggaaaaaccuuaaagugaaucauguuuauucaauuuccaaacaagugcaaagacccaggcagcgugcuucauguuuggacucuugaagaacacacauggaaaaaaaaaaagaaaaaaaccucuuccccucucaacccuuuucuaaguuuuuauuaagaauauauuaauuugagcauuaauaugcaauguauccaucuuugucaguuauuuuccagaaaaaucuagcucauuuuuugaggcaacuucuagccaaguuguuucaguuguggagaauuggggucaagcguacaugcugaucauggaaaaagcaaucuuaaaugcacgccuguaaagaggacucugagaguucauguuucugaauucuuguuuuacuccacuccauucugucaacagcuuucuuaacaugaggugccugugacuuaaagugauuaucuguuuccuuagcaauucaggggacuuaaccaucaucuagugaccuguguccccaaagcuugcuguggcuucagaggucuccuggaaugccccaaggcagugucacucaaaguaugcuuuagcaucaccugggccaccuuagacuuucaaaaucagcccucacaugugcauguucagcuggcuuucugcugcuucucaagccaaguccaagucccaccccaccucaagggggugcauagcugcaagcagcaggggaacaaucuucagaccuucccaucucuuuuuauaaugaugccuccuaguccauaguauaucuaggauaauuuuaacauuuaaaaugaauuauguuauauaaaauggaauaaauuucaacucuaccaagauugcaugcuuuugggucagacuguuuaguuugauaucuuggucucaucacuuucuaucuguguaagcuuggauagguuauuuagcccuucugcuucuguuuuuuguuuuguuuuguuuugccuaaaacggauauaacaguaccuaccuuuuaagguuguugcaaggauuaaauaagauauuagauguaaaaugcuuacaucugugcgcagugacuaagcacucaaaugccaguuaauaauaauaauucugugauuauccugagguuucauguuucuggaguaggauuaugaccacaacauuuacagaaugaaguccugcaggaugacaaaacaucccuguccccauugacacagccccaagucacgggcuugcaaaagaauguuugccaucccuaggaagccuaacacagggcgcugggaaaugcuugcaaaagcagauauucucaggucacauccuuuuaguuuucugaggccccuguguuuaaagguacagcaugacuguucuaggguggucagaaucugucacaggugggagggaaguacuuguuuagaauauggcagagaauccaccaagguguuaauaccaacaacaguuucuucuucauucugggcuuuuuccuccccuuaugcuuguuuaaugguugggaaagagggcuaaauuguacuuuuccuuuguaaaggugcacaucucaaauuuguuuccccuaguagcuuguuuuuuaaaaaguuuuaagacaugacaaauuauacuucuuuuuggaagaaagauuaggaaauacagguuaauggcaacccuuccagagagcaccacuguucacccugcuauugcccugcugcuucucucccuggucuaggaugucagggacggcagaguggccagguggaggggucaggcuucagagggaggagcugcauuucugggagccaggcuggcccuccuguugcucucagggcugacacuucucugucucaucccuccucccucaguaaaugcagcuggggaggauugccuagaaggggaaaacucaucguguaaggagaacacuucccucguggcuuuuaaaauguaaugcuuccuuccccuuuucucuucuucccagaguaagagcugccaguaaaacuucagugcaggacuguugagacguauuugucaugaugugauggacaaaagaauugucagcuccuccuuucuguaucaucucauugaucccccuuuacccccuugcaaaugagaauuacaggaaaucacaacuagcauuaaaaaaaaaaaacaaaacacugggcagaugggaaggaugaaauguguaacccccguucccagaaacaggcagaauggcugagaugacugacccuagcauuugguguucacugagccaaagcauugccugaagauaaugacaccgucuggaaaucaaaaccugagucuuccugcucucauccaaaacuccccucuuuugagcuucuccaaucuagucagugacccgcccucccaguucuuucuuucacagguuccuaucuccaccacccuaaccagaccuugucauccgcuggccuuccaggcuguuucaaucucucuugccagguucacccugcuagaacacgguucuccucuccggugagacuagguaagagaaaaaagcccuauguguaugagguagcauuccuaucccuuccuaugguagagguguuccuucaggauauucuugguccucaaauauaggaggccuuuaggaaaugauuguugaacuggauuaggucagguuuccugcucaagaauauuuguugacuucccacuacuuacugauccaaggcagaauuucucugccuguuuuucauggcugugcaaacuggccuuaccuuaaauauucaguugaauacucaauacuuuguggaauagccagagucugcuaugugacagaugcuaagaaaaccagcaagaacugucccuugcccugacagauuucagaauggaguuuauuuucuguucuucccugauccuuggccucucuucccgaccuuacccugccacccgcuaucuagcauguuugcuucggcauuccugccccagaaggaauguucccucuuuacacccucauacuuauucagcccucaaagcuuucaggucagaucuccuuucuuuccuuuuuaaggcgcucuuugauuaucuugguucagauuaauuucuuuuuuuccuauuuuuucauuauuuuguucauaacucacaaauagcugcagcuuauucuuccuuauauucuaaucauucauaucucacugguuagcauuuuauugcacccauguagaauacugaaauagacaugauugccuuauuguguguuuugauuguuugcuguuuggguuugcagccuccucaacuccacugaaauucuugguaggcuggggauugugccuucuuugcauuuuaaagcuguauauagaagauugucaggaaaugaugauacauggaauaaacaaaugugaaccauuggaggugaaaggcgaccugauaguacuuugggagugcaguucccaguaggauuuuggguggccuggagcacagcagcagcuggaggcuggggaccauccaguuuuaggacucuggugaccaagaccugagagaaaguggaaaggucaggaagggucagacuugucucccaagaguuuguauuaucaugggauucucuugaaacucugguucauguggaaaaugugcuuauccuagaaguugacuaggguucuuggggaaugauggugaggccagaugccucuguuugauccagguucucugcauggugaaucaccccagaaggagggugugaaaggugccuggccacagggaagcuuauagcuucagggaaugaacucuuaggagcaaugguaagcagaccugucagauugaggauuugauuuauuuguauuauuggcacuuguauugauuuuucuggggaguuuggggauuugaauguauuuugcaaauacaaacauuuucuuugucaugucacugaugugguuuauaggcuuauguugcauuuuuucuuugaauaguagaaucuugcaugaaauuaaaagcaguauccuccacuucugacuugguagggcuuuaagcaucaugcuaacuuuuccccuccaucucccuuucauuucuuagauccaccuaggacugugaaauagguugguaacaucugugggcuaggacgguuucagccagcuaaauucccuguuacacaguuuagauuuaugaggcacaucuaaauuuacuggaauucuagguaggaagugugguugcaaaggcaaaacucuuugugauuguagcuuguaugaaaauagaagcagcuugaauuuuuuucucacaaacuuuauccaaaacaugucuuuacaucuuuuauuucugguaaauggauuuugggguggcauccccacuacuguugggaugaagggauauaacaagcuagagggugauuucacagaauccugagccuuugaaaaaugcuguugcuuuugaaaaguaauaaauauagaagccaggccaccuuuuucagauuuauacccucuucccauucuauucucagcuaguaaauacuauggccucaguuugccuaaaaagauaauggcuuaaguuuauuuaaaugucagcaguaguuugguaaugaauuaaguccuuugaugaugaugaugacgacgaugaagaugaugauaauguugaugaugauggaggacacucaguagcaguggacugaguuguggacuaguucuuucuaaggcucccaggaagaaaauugcuaacucacuuaauaugugaaggccuuagugucagguagaggaggaagcagcuguggaguguaaagaaaucaucugcccaaagguacacuuuagagaaagacuuuggaugaaguuguguguuuucuuuuuggaauaggguguauugcuucuuuugagaaggccuuuuacaauaguacaauaguuccucuggaacucauagcaggauucuuuuuccacccucuucuauauuuacagcugcuuuuccccuaggggagcauucaucuguuuuaaaaagcagggagagaaaacaaguucugucaaacagugagguuuggaaaucagaacuguacuuacuugccuuucaggaggacauauucuaaagaguuguuuuuuggguggaagagaaggaagucaucuccucugcccccacuccacccaaggcacaccacacacacacacacacacacacacacacacacacacacacacacacauuuucaccuccacccagagguuccuuguggcagaugugaaggaguuuagaacacaggguucccauuauaaccccuuuguuguacgagaccaaacguggcuuuucagcccuagaguaaaucuuuuucuggcaggccacuuucuuggccuuuauauccaugucuagggcccugggcuggcauuggcccugaaggccagggccagccuuuggggauugcacuugagcauguggucagggacagcaucugagggcauuuuggacaggaaagauuucugauuauuaggcuguuuucaucacaccuaugcuucagggucauagaacugaggauugccagggacugagaugaauuuaguaaguugguuuaaccccagugccucuuauucucuuucugcacaguuuuuagucagcuaguggguguggacaugcaucuuuguuuuacuaugagaagaggaggaauugugccuuagcaguugaauaacugugccuucuauuuagauucuguagaggguuacacucaaagcuaaugagugcuuucuuccacucugcacacacucuugcugccuggagugggcggcaggcuauagaaccacaauagagcaaguacuguugcuguugaaggcauagacggaggugacaguaagggcagcuaggcccugaaauuccaguggcucagaccccuggcugauggcuuaccuccugaggugagaccaagaggaaggccuucagcuucccugaaaugagugcuucucacaguuaagguagugugaccagccagggguagggacuggcuuccugaggaagagggugggagagccuuaauuaagccugccugguuuggcaguaccucagacucgccuccucuuucuguguuggcugauaauuuccuucagcucuuagaacaacucuucauuuccugggggaacccauuguugccaauauacacucacagagccuaucuccgguacugccaugugugcuuucugccuccuuuccagaagaggcagguagccagucuuuuuuucucaugagcuguuccuaccuuguuggaguuccuggaggcuagugcugcuggaccuccagucuggcagaggccuggacgagagcuauuccuuggguucucagaacagaccuagccuaguggagaacaguucugggccuggcucuguguccagaagggcucagucaguggucagauucugauugggagauauaugaggaaacuuuguuuggugagaguuaggagaaugggguucugguucagccauucucucaagaagucaugaucauuugauaggccucaguuuuccucuccuaaaauggguagauuggauuuuauaagaugaucccaaaguuccuuaaggcaguaauguguuaggauuccgugacaaacccgggagucugccccuggucuaggugaccaaaguuagcaaaggcugggacagcacagauugcaguucccaggucucuuuugccucccagcuuuuugauguguuucuucuccuuggaaugccccaccacucccuguacccaccucuuucugcucugucuggcuaauaccuucuaaagccagguaucagcuuagacugccgcuugccccauacuugugugggugccucuccuuggugcuggcauuacacccugugcucaguacuuaccgcaccauauuaccgucuguuuccuuguucuuccugaccuuaccugagcuucuugagggcagagacugucugcuaucaccacuguaucccucauugcuggugcagcgccugggaugugguauauacacagcaaauguugaaggaaugaaugucccccccuaaccagggucagcauaccccagugcgcucugggaacuguucucugacccucuccacccuuacccugccuaaggcucucucuuucugagcugugugugggugcuggagagccuuggauaaugcugaguuguuuuugaagugugucucauuguggcaaagcauugggugauguugccauccccacccccaggacacucuugcaagaauugcuuccaccagggaugggcauugacuuugaccugguccuccucaucuccagcccuggaggaggggcaggcaagcacgugcagauugcuguccucugaccagcugcccagggcugggccaucugcugcuugugacagcggguggggugagaggggugagugaccugugcaggggagggaguguggggcagcagcauagucacuucagugcacugacugcaugacagaguccagccccccuucuccccacguucuaucuucuuuuccagugcucaguuaugcuaugcuucauccaggucuugguuuuguuccagcugcugccccccaccacucugcuaggagaacucuugcuguguuuuuguuaacucugugugugugcuuugcccuuuugccuaugccuccaagaaucuuuauguuacauaagacagcagcagcaaaaaacagaaacaaaaacaaaaaauguuagaaaugaaacuuuggacccuuguuauucucuguucagaugcaaaugaugaaucucuuuccaucagaguuuauaccuuucuguuuaccaccccguuuucugucccuccuccuggagagccuuugaauggcagggaugggcugaaucacucacuuggaaggacuguaauuuagcuugugcuucaaaccuugccucuuucuggccuuguaaggaccuaagaaagacgcaaaaaggaaguaaucuacccccaucacucuuggugugaguuugaagguucugaacuggggugggguggggaguguguguguguguguguguguguguguguguguguaauugugugugugugggauugaaggaugaggguuguggacagucuuaaaagccaccuuuaccaaaugaagaggugacaaagcagggacuggaagggcagcauacccuaaccaggacuuccccaaacuuuaacaugcauaugaaucaccuggggaaccuuacuaaaaugcagauucugauucaguagaucugggaugaaggcugaaauucuucauuucuaacaagcucccaggugcugccagugcugcuguuaauggaccauacuuugaauaguaaggcuguguccuuccuauuccaccuuuuaauaguugauuuaaaagacugaccuagggaaggcaagacaggggcuagucaggacuugcguaauuuaaacccaagguccugggcuggcuucucagccagugucuacagagccuuuuaggcgggccccucuuaucuaagcugcuggcuucucugagcuccuuugguccaguuugguuuccaagguauaagaaccacagcccuucagagggugugugugcuuacucacaacaagauuggguccuugcccguuucucuuuggaucauuagaaguagauaaggccaggccgggugcaguggcucacgccuguaaucccagcacuuugggaggcugaggcggguggaucacaaggucaggagauugaggucucgauccuggcuaacacggugaaaccccgucucuacuaaaaauacaaaaaauuagccaggcguuguggcgggcaccuguagucccagcuacucgggaggcugaggcaggagaauggcgugaacccgggaggcggagcuugcagugagccgggauccagccugggcaacacagcgagacuccgucucaaaaaaaaaaaaaaaaaaaaaaaaaagaaauaaggccaaaccuagcguuuaaaacagaaguuuagagcugaaagaacuuuuacucuuuuccaguuuauuuuacugagggggaaaugggcccagaaaaguuuuguuacauguccagaaucacagccaggggcagagcuggggugaaaaaccagauaucuuaauucccaagccccucucugagggaguguaaaccugaguuagagaugagagaaucacggaguuggucuggggacaugcugguuggacaaaaaggcuuuccagugguuugggggaguuuugcaccacauguacaacuaagguggaucaacugacaucuuggcagcccauccuuuguucacuuaggccagggcuuucaucugcagcaucacugauguuggaucaagugauucuuuguuguaugggguuguccuguguguugugggauguuuaguugacaugccuugcucuauccauuagauaccaguagcaccuuacccccaaggugugacaaccaaauaugccucuagacauugccaaaugggggagguggcacaaaauuggucccaguuagaaaaccacugguucaggcaacuaguauuuuggggaagagagucccucuggggcaccuacacuguuuuuuuuuuuuuuuuuuuuuuugcggggggaagugugcauuagucucagauuauaaagguagcauggguaccagccuuccugggaguuuauuuacaguuuaguuuauaguuuagugggggagggaggaaccacgaaacuauuaacuauagacucccgggaaagcucccaccuuaaugccuccuccaggauguguagagacccaggcuggacucugaagaauggggucaaagcccagggugcuuaaugaggaagagauuuugcuguccugggcuggauugcauagcuaagaacugaguaacuaucauucacuuacuccuuaagagaauucuuccauucugaaaaaaauuuauauauauauacacacacacauauaauauauaauauauauauuuggagacaagaucuuacucuguugcccagguuggagugcaguagcacaaucauagcuuacuguaaccucgaacuccuuggcucaagugauuucuccugucucagucucccgaguagccaggacuacaggugcacaccaccacaccuggcugauuuucuuuuuauuuuuuguagagacagggucucacucuguugcccaggugguuucaaacuccucaccuugagugauccuucugccucagccucccaaagcacugggauuacaggcaugagccacugcaccuggugugaaaaauaaauuuuaucugaauuuguagagggcagugagacacauuaaccaacaaauaucuacacuugaagggagagagaccagcucaagccugacauugguagacuaacuccuuauuuuuuauuucuaacuugauuuuauucugauaugggaugaauccucugauagcuuuuccugucucuuuuccaguguguuaagugauuauugcuguaagacuggaauuacagucuguaacguucugaggacauagauauaaaacauggguaaaugcccuuuuuagaugugagccuaagaaaggguuuuuauccuuuuucaguuucagaggauacuguacuugcaaaugcuuuuaaggccacagaguucucacccuuguacucaacacuaggccuuccuaaauauuauuccagugcacaaaaagcauuagugauggaauggagccuccauugccuccuggcuugcauuauuccugacacugaaucugcuguaauucuuugcuccucugucugccaugugucuaauucccugccccauggcuacuuuuaggauuuucuuuaucacuguuuuuuuaacauuucgauuaugauguaccuuguguuuucuuuuuguguuucuucuucuucuugggguuugaugagcuucuuguaucuguuugugcauaauuuucauauaauuuggaaaauuuggggcauucuuuucucaauauuuuuucugugccuugcuaccucuccccaaccauuacuccuguucuauuaggcugcuugauauauccuacaguucagugauguucuguucuuuuuucagucuuuuuucucaguguauaauuuuggauaauuucuuuugcaaauuuacuauuuuuuucuucugcauugucuaaucugcuguuaauccuauccuguguacuuuuuauuucagguauugguauucuucccucuagaaguucaauuugaauauuugaaucuuuauuuuuuuugagacagggucucgcucugccacccaggcuggagugcagugcugugaucauagcucguugcagccucaaccuccugggcucaagcaguccucccaccucagucuccugaguagcugagauuacaggugcaugccacuacacccagauaauuuaaaaaaaauuuuuuuuuuuuuguagagaggagggggggucucccuauguugcccaggcuggucucgaacuccuggaaucaagagauccuccugccuuggccucccaaagugcugggguuacaggcacaagccacugugccuagccacuucaaauauucuuuaugacuuuucucucuucaucaugcucgugcuuuguucuucuugaacacauggaguauauuuauaauagagauuuaacauccuugucuacuaguucugucaucugucauuucuugaucuguuucuguuguuugauuauucuccuaguuuuggcucauaucuuccugggcuuuauuuugcaugccuguuaauuuuuuauugaaagccaaucauaguucuaccuugcugggugcuggaacuuuuuguauuuuuuaaaauacuuuugggcuuuguucucaggagcaguucaguuacuuggaauugguuugauccuuucauggcuuacuuuuaagcuuuguuagggugaguccggaauagcuaacauaacuaagcuggucccacuuggaggcaaaaaccuucugaagauuccauccagugcccuguguauuagaagacuuuucugccuuggcuggugggagcauguauuagucuguuuucacacugcugaugaagacauacucaagacugggaagaaaaagagguuugauuggacuuacaguuccacauggcuggggaggccucagaaucauggcaggaagugaaaggcacuucuuacaugguggcggcaagagaaaugaggaagaagcaaaaguggaaaccccugauaaacccaucagaucuugugagacuuauucacuaucaugagaauagcaugggaaagaccagcacccgugauucaauuaccccgccccccgccccccugcugggucccucccacaacacgagagaauucugggcgauacaauucaaggugagauuugguuggggacacagccaaaccauaucagagcaugaacuauuucugacucugagugaguucuagggguugugccacccacuucuuucugaucauuauuuucccacccuugcuaguuuccucagaggcaugcacagaucaguacucagcccaaaacucaaaggggucccucugcagauguuuggugguuuugcucuuugcagcucucuccuuuucaauuaauuugcccugcaaauucuagccacuugggccucuccaaauuuccaacucuguuuuuucaacugagugacauugcugaacucuuucagguuucucugcccuacccuauggucuggaaacucucaagggaguuaaguggggcaguaguagggcucacugcguuuuuucccccauuucucaaggauuacugcccugugcugccuguuguccaaugucugaaaaccguuauuuuaucugguuuuucaguuguuuagggaaggagaauaaguugaguccccauuauuccaccaugacuagagguagauauuccucagcugucccucaaaucagguauuaaccuuggaugucuuuuccuucuguguucacuuauugaaacauggaucauuuagacaaaucuuaugguaauucagccagauucacaucaugucaguuugccaaauauuuaucuggcaccugcuauguccaaaagaauaguauagccaguaucuugcugaacgugguauaaucuguaacuuuacccauauucuaaugcugcaccuucuagcagaagauucugugcauccugacaugcaugugacacaaauacacuuugagucuucuuccuguaccuccugaucauggucccauuaaaccugggcaaacaacugaacuaacuagucagaauuggugagcaaacagcaggugcuuggcugucugccuauucaugagucaggcccagacagccguguguggggagggaagagagcauuaagucucugugugugggugagcaccuccauuuuaccuggccuuauucugugccagauacuauauucaauuucaaaaaugugugacucauugacucuguaauuccaugaaguauaggucuguuaccucaauuuuauaugugacaaacagaggcucacaacaguaaagcagcauaccuaggcccugugagaagcuagagguagagucaggauuugaauucccuuuugugugacuccagagacuauguacuauucacuagacuacauugauugacccuguaauuuucucugucacuucccucuucuggacuccagcuuaucuuccuguuuuaucuuugacacguuggcuguauaucucccaugacuuuucacuuuguaccucauguuguaauuauuuguguuugugucuuauauauauacacaauauacaguagaccguaaacucuuaagggcguaugcuuccuuuaccucucaaggaaucucguacauguaggugcccaauguauguguugaauagucacugaguuccuuaagaaagaagcauguuaggaaugaguucauaagcccugucuggagggaaauaucaaauucucucauuaauuuaugauguuucuucuucaucuucucuguguuuaucauaaucccuuuuaacauauuccagaauguugccugaauuaauuaauuaauuauggcugggcacgguggcucacaccuguaaucccagcacuuugguaggcugaggcuggcggaucacgaggucaagagaucgagaccauccuggccaacauggugaaacccugucucuucuagaaauagaaaaauuagcugggcuugggggcgugugccuguagucccagcuacucgggaggcugaggcaggagaaucgcuugaagcaggaaguugcagugagccaagauuaugccacugcacuccagccuugcgacagagugagacuccgucucaaaaaaaaaaaaaauuaauuauuucucaggacguguccucaucugauuugccuggauuuuauaaaguuauucauuuggugccuuugucugaacuuugccuaauuuggauuacuuuuggaaucucuauuuggacguuugaaggacucuccuuuauguuaauuaguuuaagcaaacuccuugauuccugauuuagggccccacaugcagggaacuggaaguaugacuggagcuagaacuagaacauauagaccuuggcagagggacuuuguacaauuagaaggugagguaaggguauagguggcggcaggggcauggggcuaaucaaagggaaggaacagugggcaaguuccuacuucucauuuuugcuuguaccucacagucccaccuugacagcuuacaggaagcuuggguaauuuaugaugaagaggacaggaggaaucaugguuugguuauaaauuaggaggcuuccuggaaguuacacaagauggagaauauuuggagccagaagacaggaucuuguuuggcuugagugugcaccucauuggggcuguuaagcuucauuagauggaggugaagacaugucccuggaauccuaaaccugaaacucaggggaaaauacucagguuaguuucugacuagaaaggagggaaauggcagaaacugggaccauauguauggagaaccuuaaggccucagauguauuagggaaggucaccucuuuggcccugccacuaggcuauuuuuuuuccauucaugaauccuauagaagagguaacaauuucaggggaggggaugaugggguagagagacuuuguuguuguugaacacuaaggaagcaggaaacuuuaagcuguauccccaacuuuuaccuagcuuuugcuaaacacagaguguggaaguguuaguucagagagacuuuccauggaagagguggagggugucucugagcuaucuggaccauuuaggaagccuuaacucaaaucauuggguuaauugagaagguauaccuuauaagacacaaacccccucuaguuaucauccagucuuucuucucccuucuuuuucacucccuuccccaaauaguuuugcccuuauuacguccacuuucucacuuuuuuuuuuuuuugagacagcaucucgcucugucacccaggcuggagugcaauggcgcgaucucagcucacuguaaccuccgccucccugcuucaagcgauucuccugccucagccuuccaaguagcugggacuacaggugugcaccaccacgccuggauaauuuuuguauuuuuaguagagaugggguuucaccguguuggccagguuagucuggagcuccugaccucaggugauccgcccgccuuggccucccaaagugcugggauuacaagcgugagccacugcgccuggccucccacuuuuaauucauguuaaauuugauauaaucugccuucaccacuccgauaaaacuguucuugauuaggucaccagugauuuccuaguggccagauccagugggccuuuuucagucuucgucuuucugggccuuugcuguaucugccacuucucauguuuuccuugagucucucugucucucucuugacaucuguguugcacaugccccugguuuccauguaccuuuuggaguaucucucauaggcuuuccuuccucaguaugcccauuauaaguuagcauucucccuaggauucuguccuuaacuuucuucucaaccuguccucuuuccuaggugagcucaucuauuuugcaugguuucaacugucacuuacagguugaucacuccagggcuacaucacuccagggcuacaucccaagcucagagugcucuauaggguuucacauucauuucuaauuugccugcuagaccuuucuaccaguuaucccucagguaccccagcucaacauauuaaagaauaaucugaaugaaauucauuauguucccugaccaaaccugcuuauucaccuguauucuuuuucuccugugguagcuucuaccauuuaugcaguuacuuaggccaaaaacuuaggcuuuuuuuuuuccaucuuuuuuuuuuuuuuuuuuugagacaggguaucacucugucgcccaggcuggagugcagcggugcaaucuuggcucacugcaagcucugcuucccagguucacaccauucuccugccucagccucccuaguagcugggacuacaggcacccgccaccaugcccggcuaauuuuuuguauuuuuaguagagacgggguuucaccauguuagccaggauggucucgaacuccugaccucgugauccgcccgccuuggcuucccaaagugcucggauuacaggcaugagccacagugcccagccccaggcaucauccuuuauuguucucacucaccucauccuauuaguuuuugauauauucuauagcauuuggcacaucacaggcacugaaugaaugaauggauggauggaugaaaauguuuguuuauuucauccaaauuuaauuacaauuaaguaccuuggccuuggugaagcugaaugcuccugguuacacuaacuuuugggaaggucauuugauuuuuggccacacugaaauuauaucaggaagacucuuuugaaagauaaauacuuuguuggaaggauuagucauuauuagaaagggguggauuggucacucugcuaucuuuuagggcucucuaaggaacugcugagaaguuuguuuauacaguuagaggugaggugggugaagucaaauugugcuggcugguggagugggggugggguuguccauggugcucaugggaguacagauaguguguuggugaacuugccacaaugcuacggauuuaaugcaagaaauaggcaaagcuuuucugcugggggaaguaauaugccccauuucacucacuaauggauguccuaauuguaugcuaguauuucuaacauaaaggcugaggauguguauuuaaccguuuugccaaguuuaucucccuuuucuugcuguccaacccccuggaaaaaaaaaaaaggaaaaaaggagaaagugacuuaaagaaucaggauuugggcuggguacaguggcucacgccuguaaucccagcacuucgggaggccaaggcaggcagaucacaugagaccagaaguuugagaccagccuggccaacauggugaaacccugucucuacugaaaauacaaaaauuagucgggcuugguggcgcacaccuguacuucuagcuaaucggguggcugaggcgugagaaucacuugaacccgagaggcagagguugccgugagccgagauugcgccacugcaccccagccugagcgacagagcaucucaggaaaaaaaaaauaaagaaucaggauaucaggauuuggaaccagagaagcucuucaaguagagaucgucugguccagcccugcauuuucagaugaugaugacaauaauaaugauagauggugaugaauauaauaguaacuacuauuuuugaugacuuacuaagucacaggcacuaugcuauguacuuuauauauauuuccccauauaauacuuaaaauaucccugugagauaggcauuauuaaguaccauuuuauagaaaggaaauagagguccggaaagcuuggauaacuacauugagguaaagagaaugcugaaguagcuaucacgcagagagaugaagcagccuccuuguucaaggucaaguuuuccaguuaaaggagaaacacaaguagaauccaagucucuugaccuugagcucaguugagcaccuauuuuuuguuuugaccugagaacucacuuucucuggucauuuuugucuuauuucucacuauccuuuuaauuucaguaaaauugaaugaaauagagggaaggaugguuuagaguugggguuuuuggugaguuuuuaaaguuuauuuuuaaauaggcagcuuucccagacugacugggaauguagcagaaggccugagaaccaggaagugacacagaccuguuuauaccaucccacucccaggccuuuggaaaacgauccacagagaugguaaaaaguaaacauaacugcaucagccagcucucuaggguuugcuauuuuugaccuggaggagguguuuccugcauagcuguaaguacucggaauaccaaaauuuagcuccuaaacauucuuugagugaagguauauagacagacagacauuuuuuguuaccagacagcagcauucagugacuguaggcagacaaaauuaaguuuuuuuucccuccucucucugccauccuuuuggugaguuguucuuccauuucuuuaucuuucuuuguaaguagcacugugcaugcaaaacacuguccugggagcucuaaauuugugcauggguucaagguccaacucaaagcuuucucuuucacuucucccuacucccaucagaagucuuuguuccuguguccucuguguucucauagcacuuuuuaaaaaaccuucuuuggggcccuaguaacaauuugacaguguuauauagauaaacauaauuccucucacguaaguugugaauuccuugagaguaagaauugaacugugccccaauucaucucuaugaucacccaagccuugcauagaagacagccaguaaauauuagcugaauugcaguauagucauuggagacacagagcccuaagaagucagcuuuagcaaaucggcuucccggacuuuauuugccaacuggguauugaagccuguuccacucagcccugaugggaaccaagcagagagaugugaugacacaugagauauaucucuagggucuaggaaccaauuacagucgccucugccaagcaucuguuuugcuaccuggccaaaauuucaggauuuauauaaucuuuucccucuuguuuuauacaugcuguuauuuugccauuuuguauuuuucuauacaaauuauaucuugugaguuuaucuuuuuuucucauucacucgagaaguauuguugagcacuugggggcagagaauugguggucucugcaggaguuuauuaccugcggaaaugcagcauacaaaaguuaaauaacugugaguggccuucggggagggauaugauugacuguccuauuccugguccaggcagggaugcugaggguuuggaagagccuuccaugccuuugggcugaacugagaaauucuccccaaacuaagaugggaacuaagcuugaccuuuuauuuggaaaacaaaagagcagggagcccuauuagggaagcaggaggaggaaagacuuccaggccucuugaauuccauuuaucuguaaaauggggcuaauuccaccuauuuaaugagguaaugaguguguguauguguauauucccuuagucugccagaaacuaauauuauuuuaggauagucacaaacaauagcuguuuaauuuggaggggagguagugcuaagugcuuuaaaaaauuuuuagaauuugaugggaaagaaugugggaggcucacuuguuuaaccuguuggcuguucucuugucuaaacuaacauuguguuuugagccuagucucaggcaguguuuccaaaccagcugaaacagugcccuuuggggagucuagugggggucagucacggccuguuagaacaggaaggggcuuagccagcaugaauuugagcacccacuguuucauacaucguccuacaugucucacguuugucuuaauuucacugcacagcaacccaaugagguggguaucauuuauccaguuuacagacggcgacuguaccuagaccacccaauugcccuagaccacccaauugauaguaucugccauaauuuuuccaugauacuggccucccugagagauacauaguucaaguguucuguuuuacugaugagaaaacaggcauggaagcaaagugcuuguccaagguuggccccucagucauguugaagcuggguuuggagaagggguuuccuaccuucaggucaggaacuuacgacaggcuuuguuccugcucacaggcacuuugccuccuccccccucuuuuucugucuggucuuauuuguucucucuugccuucucucuugcaucuuuucucccuuucucccugggccccuguaucucugcagugugcagaggcuggguuuuguuguuguuguuguuguuguuaagauguguuauuuuuugaaagcauuuuaggaacacuguguacggauaguccauacaaaugugcugauggauugauuaaacccuaaagggaaaguggacuguccuggguuugcugcaaugcagagggauauggaugguagggauccgucuugggaagauguaggggaaugugcugcucagucagaacaaugaggauagaguuaauguugcuuccuuccagucagagccuguguugacuuacuuuuuagaggaaauacuuuugggccccuccuauucccuagaagacauuccaguuuucuuacagcugaaagguccuuuggggaucauccagguucaccccugagacagaaagacucacugacuugccugaggccaaaccgcuuuucaguggcuaggaccuaggcugucccuccuguccugugaucaggucccugcugcagucauccugcuguuaggugcuagagacuuguuaaagagaagacuuagguggggugguagugugucugcuggcuuuccuguugucugaaguuggggaaagcguguugcccagaugaugugagcaauucuggggguggaagacaagggcgcagggaauaucaaagcaauucaaaaaaaccucugacacuguguaauggcuuagguggcuuaagaggaaagcugaggguaauguuugugauuuggaggcugugugauuuuaacaggaguuugauguuugccuuuucaaguaggagcuggagauuaaaggaaauggauaaguuaauauucuggccugaaaggaugucagaguccgguaaaauauguggcugucgaagcacucaaguguuaguggcaaaaaggaaaggggaagauauagaaguuaguaggacuggaagaauccauugauccacaaugggagaagauagaaggcaucuauaaauaacugaauuuugggggguaggaggcauuaagguccaauaaguguuuagauauguuuugauacuguagccuggccauuucagggugaguaggaguacagaggggagauguugcagggaagaaagagagguuaaggaagggccugggcagcuuuggcuguauuagucauuucucuuacuuaucacaccccucuggggaacuuuggacuucaaaguguuaggacuuguuaucauuacaaccugaaauguaauuagcggguuaauuucuguucauguuucuggaacuguucuuuguccuuucucaucauguggcaggaucaagguuggugaacauaguuaauuaaaggaauaaacucuguuguucuggacucucaccacuacuaccauuauccucugucuagauuagucugaggcaagaaaaggauuuauguugguuuuaucaucccaguucccucucuuaacuaauggacagaggagccaugguuuaggaaaaaauuuguucuaaaaauuacauguagaggucgagacaggcagaucacuugaggucaggaguuagagaccagcuugauugacauggcaaaacccugucucuacuaaaaauacaaaaauuagccagucaugguggcgugcgccuguagucccagcuacucaggaggcugaggcacgagaaucacuugaagccaggaggcaaaggcugccgugacccaagauugugccacucccacugcacuccagccugggcaacagagugagacucugucucggaaaaaauaaauaaauaaauaaauaaaaauaaaaauuacauguaaacggagucugacuuuacccacgcagcaccugggagccacgcuugacugaaucagaccccucuugccuuuaggagaaguguuugauaguguuugauagugugagaugaccuugcaccuucagcaggacuauggcauucucagcaggggugggccccaggcacguggacugaggagaucugggcccuggcuguuuccuggcuggcccuagcugcugcugcuguugccucccaaggccagagccauuuuugaaggugacuccagggcaccuuuaaacuuauuagcaggcucuuggguuaacuuggaagcaucuguggcaacaacaagcaaguaaaccaugugaacuuugggcuuguguugcaggcccuuaccagaagcccaccgugcgugucaucauuucucagcccucugcugucuuggcuucuggcuaagacaauaaacauaagccccagguguuucuaguuuacaaagcauuuccucauauuuuguuccuuuugagccucaacagagucuacggagauagucaaagcaaguaacagccccauuuuacaaaugaggaaacaggggcagagaugaaguaagugacuuccucaaggucagagcuguggcuugagggcaguuuucuuccucauuggaggaacuuacggacaggaagugaguguccacgacaucacauucaguagggcagucacccagcuguugauauucuagguuuacagaggugggagaggcugcccuuuuggggcugacggucgagcugaggccuccugcuaccaccagguguuggggcagcagcacuaguucccaagaaauaaaaucagaacggugacucuccuuaccuguguuuugaagaggaaagccggcuauugggguaagagauggauuacagcaagagaaggguagaagcggugaagaauucuguggccuuagagccuuuuucagauguggaaacagaaggcagagagccuucaugaccagcucccuggcugguggcggaggugggacugagucauugaggcccucuccucugucucagcucuaaguucagaugugauauuccuugugaggauggccgagugcuaguuuugaacuugaugcuuaguucuagguuccucuucagugauaauuuuuuuuaauuaggaggaguagucacuaacaugccaaaggaauacugaagugaaauggauucuuuuuguuuaaacaaaguuuuagccucaguauuucucuagggauaaugaauaccuagugaaacuuuuuuuuuuuuuuuuuuuugcuugguguacuaaagccacaauccaaggacaagucuuguuuuuuuaaauucuauauucaaggcagauuauuucuuaaaaugauuagauuuauacuguggcccuuucuccacaguagcuggguucucccauucugggcaauacuuuggagauuuagggguuagcuuuccucuguuuuauuucugaagcaguaacccuuggccuagccuuacauauaaacaccccacugacuaccuucuauuuaucuuuucuuugcaaagcccucauuuccaucaccccgucuguucugcaccugucccgucuuaggcuucaggauggaauugguuccucgacucagguagcugcuuaagcaguaagggaggagccagcuauuccugcaaagcaaaaccaaaaacaaacaaaaaaccuaaaacugaucaggaacucauacauguacaucuugucugcuccauuuccauaccggcuccuccccacaguauucaugauuuuggcagaccuuugcuaccugccugucagaugccaggccuugugcuggcuauugaagauuccgaguugaguaauucacugucccugccuucaaggaagucucagccugguguggugagacagauaaacaaauagauacaauaaccuguuaaagguacagucauagcaggguaagaaggggucauuucuacguuggagguggguguggugugaagugucaggaaagaauuccucuagaugacccuugugcugagccccuaaaaugacucuauuccugguagagggagcaauuagguuuuugggauuuguuuuaauggcaguuuguugagagaggagacaaguggucuauaggaaggccuugcuacauuaacuuaacauuuuguuugaauagauaauacauguacaaaguacaacacucaauauaguaaaagggaauauaugcaguuaaaaauuuuuuuucuccuuccccguuaaccacucaguuccccucccugaaggcgaccauuaguuaccaauuucuuuuuuuuuuuuuuuuuuggugugugugugugugugugugugaaacagagucucauucugucacccaggcuggagugcaguggcacaauaucggcucaccacaaccuccgccuccuggguucaagcgauucuccugccucagccuccugaguagcugggauuacaggugcccgccaccacaccuggcuaauuuuuguauaucuaguagagacgggguuucaccguuuuggccaggcuggccuugaacuccucaccuugugauccacccgccucggccucccaaagugcugggauuauaggcaugagccacugugcccggcaguuaccaauuucuuaugcuuuauuccaggugaguuuuuccgugcuuauaggggugugugugugugucugucuuucaaaaauacaugcauauacccagguuauuuuuuucacauacuaauuuuagaagucauuccauauuagcacagguugaauugcccuguucuuuuuaaaccucuguacgguauuccauuauauuggguguacuauaacuuauuuaaguauacuccccuuucaugaacuuuuagguuacuucagucuuuugccuuuacaaacaauacaugaauaucuuucauauaugucauugcacaugugauuucuuagggcacauucuagaacugauaagucagaguauaugugcauuuuuuuggaauaguuauuaacaaguugcucuccgaaggauucuauauugauuauaaaaugcuagccaggcagaguggcucaucccucuaauuucagcccuuugggaggcugaguuaggaguaucacuugaggccagaaguuugagagcagccugggcgacauagugagacauccucucucuuuaaaagaaaaaaaaaaaaaguuaggugugguggcgugcuccuauagucccagcugcuugggaugcugaagcagaaggauugcuugagcccagagguucaggugagcugugcucacaccacugcauuccagccuggaugacagagugagacccugucuuuuaaaaaacaaccaaaaaacgccaaaaaacuaaauuuaagauucuuuaccauuuggccggccccacugcucuucccuugccuguccccucacaccccaccaaaauccucuaaaaucccugccaguaugaucuuccuaaaugaguuuagucuuauaauuucccuguuuagaauccuuguaaggguaaaguuuaaaccccucugcuuagccccugccuccagccucugccaggaguaaugugcucccauaguacucugauccacuuguauuuggugcuuccuuuuuuuuuucuuuuccuuccuuccuccuuuccuuucccuuccucuuccucuuccuccauucuucccucccuccgucuuccuccauucuucccucccucccuauuccuccauucuucccucccucccucccucucacauccuuuaggacucagcaucaccuccucuaggcagucuuuccugacuaccaccacuuaugcacaaaacaccuaagcacuaccuuauguggccucauuuauucacugcuuaaauauuuuuuauacacgugcugugauguggcacaugcaggugucauucuugaugauccacugguuauugccuugaggggaugacaacugcccgguaggguuaccuggugugacugcaccuaaaacagcaauaccaaagggcccauugccaguucugucacugaccagcuggggccucugaguauaucccuuaaccacuuuggaccuuaauuuggcaucugucaaaugagaugguggaacuugaggaacucuaaggccccuacugugcaggucuuauuaaugauuacaacagcagcagcagccaguguuuacugaggacuuacaaagcaccaagcacuuugccaggcacuuugucuauccuaauccuuacaucaacucuacgaaguuaguaugguuacuaucccuauuuuacagaugaggagacuaaggcuaagagagguuauaugacuugaccacaaggucauaauaaagaaacagauuugaauccaggcauucugacuuuacuguucuuagccacauaaaugggcacacauucgacacacaguuuuguguacuguuugguggucacucacagacuccaucccagaccucugcaugaaccaucccuguucuacaguuuuaaaggcucaaacuggagucugggugaaaccuggggacagaagacugcuauagucacaauuauuagagggaaaugggugaggaccaguggccagcucuguucaugaaccuuugacaauucucacagagagucuugcuuuggacagagacaacuuacguugcuguuuucaguuacccucuuuaggaggggagaguaggccugagucaugcuucagacacagauuaaaaucagauuugguaccaggugcagugguucacgccuguaaucccagcacuuugggaggcugagauggcggaucacuugaggucaggaguuugagaccagccuggccaacauggugaaaccccaucucuacuaaaaauacaaaaauuagcugggugugguggcgggcaccuguaauuccagcugcuugggaggcugaggcaggagaaucacuucaacccgggagguggagguugcagugagccaagauugugccauugcacucuagccugggcaacagagcaagacugugucucaaaaaaaaaacaaaaucagaucuggguaguaucccuggcagagucccaggggcauccuuuauuaggguuauagauggcagacucccuaaucuaugcauauaaagccuuauuaauggagaaggggguguguguguguaacuuaaaaaaaagaaguguaauauuauauggaauaccuguuguaaacuaaaauaacuggcaaaugaaauuaaauaaguuaacugaaauauaauaggcccacaccauaauguauuguaauguaucgucaacccauuuaccucccuaaaggcuuauagaaaagaaucuuuaaagucuugagcucugauacacacacucuuucucacucucucucugucucucuacugguuccuauuuuucugaagucuuugucugaacuagagugggugggugguagggcuaguuagcaauugcagcccauucuccaugccuccccccgucucaucuuuuucagggacagccaacauaauguggucacagguguguugggugagccuugauuaaugagauucacggcugucgagucagguccuccggcucaucagccuuuggcaguuuagcaagcaggcuggggcccucagcucccacugcugcauuccuucucuaggcgguguauucucucuuuacgacacguguucucucucuuuuuuuccuuuugguuaguugaacuuguucugaguccaaguggcaaaggcaaagccugacuuggguguagcagcucugugucaauagccgucucucugcuggagccuccaggcaggcgguggggcagagcugggcaguuucugaaagcccugcugugccugacugccauccaggugagacagagcucaccuccuggcuucugcacgcugcaggccuuguuuccccagggaggaguugaaaagccacuucugugcuugccucuccuggcagcagggauucgaauaguugcuagaauucucucaacuuugugugugauuauggcuuccuuaccaaaguggcugcuuuuaacuaacuuauggcugaaguuuucacuuuauguccuuguuuguuuguuacaggugaaucagcucccggccgacuuuaggauucuucuggauuuuaaauuuuuucuuuuuaaaaaaacuuggacggauaaaagaugugccauggcaggauagcaccaaagagcaccucaguguuugccguggccuccgugggacauggaguguuccuuccgcuagugauccuuugcacccugcuuggagacggacuugcuuccgguaaguccugaccugccuucugugugugggugggaaaauauuuaauaccauuguuucucucgaagacuaggacaggggacucuccuccuggcaggcgguuucagggagagcagaggguggagggcuuuugugguaaauauagcagggagccaguccuucugaggucuaaugagucaccuggaggaggggcgugugggagccugcuggugguaaccuugucaccccucucccccagccauaaucaucaucaggaggacagagguguaagguucagagcacaauaugcagguuaaggggacagacuuuggaaucagacugccuguguucagugcccauucucacuacuugccugcccugugacucugaacaaguuauuuuacugcugcaaggcucuguuuccucagcugcagaaugggauaauaauaauaccuaccucacugggugguugugaagauugagguaauaaaauaaguauguaaugauuguuagcugucuuuuguuuguucgucuuucugcgcuuuuucucagaaugaguggguaguugaaguauuguaauuuagugaaaauaagacccggucacugacacuacaaauguugugaucuugggcaagcgacuuaaccauucuagggcucaguuuuucccuccaucagaugaauggguuuaccuggaauaacauuuaaagucacuucuuugccccucaguaaaugcuuugaugauucuaaggacuuugugguugaagauggugagcuggacgggcccuagcaggggcuagacaugccccauugagccuuuuuguuuguuuguuuguuuguuuguuuguuuucagagagucucacccuguuguccaggcuggagugcaguggcacgaucguggcucacugcaaccucugccucccggguuccagcgauucuccugcuucagccucccgaguagcugggacuacaggcucaugccaccacaccuagcuaauuuuuuuauuauuuaguugagacgggguuucaccauguuggccaggcuggucuugaauuccugaccucaggugauccacccaccuuggccucccaaaauguugggauuacaggcgucagccacgugcucggcccauugaaccuuuuugaguuuguacagcccuuguugccuucaacagugcuccagagacccuucuaggcagucuuugugugaucuucuagacaaaauguccuuaaaggacauguuuggguguguacgguaggccucuggguggugugccacaaccuaccucugugucuacacuccagaaucaucauugaacucaccaauacugguguuccuacuggacuuuguuagaaacacauacauggcaguuuccuuguccagugcuuccuggagagggaucucagaacuagauccuggaaggggacuuugguggggacaguaggggagugguauauuguggcuguagagccuccauaguuuagugcuacuucuuucauucucuaucagcucccaccacccacuuauccaacauaaacagauaauggcacagucucagcuaaucuuuuuuuucuuuucuuuucugaauuguuggaagaaacaauuacagauuuuuuuguucauuguagccuucuccacuaccaacauauagaugugccuuuccuuccacccuauucugacacuuaacccaagccuuuucccccuaggcaugaggagccccuggcacagcccagggggccaugaugauugggaccccacaauguggccaucaugguuauaugagguuucaaaggaagagaagaccaggcuauaccaaugugcaacaaaaugaagcagagccuccuuucauagggucaccccaaaaccagaggaggccucuagaagugcuaguugcagaaccacagagugugguugacucucuuauucaccacugugucuuuagagcagaaguuggcaaacuggcccacaggccaaauccuaccugccaucugcuuuuguagaaccuuccaguuaacuguuuauauuuuuaaaugguuggaaaaaucagaaagauauuucaugacauguaaaaauguauaugaaacuuaaauuucaaugucuauaaaguuuuauuggaacacagcagugcucauucauguauauauugucuauggcugcuuuugugcugcaguggcagaguugagucguuaugacaaagaccauguggccugaaaagccuaaaauguugaggcuuuaaaauauuugggucuuuguaaaagagguucuuccccagcccagaacaaauggugcucaauaaguaugcaugugaauggaaugacugucagagcaggaaggaaggaaggccuagucaaaaccagcuugggcuucagagaacugugcacuugcugcccagaaucucacagcuaaugguagggccaggaccuagccuggugccuggcauaccacugugaccugccucuuccaaggcuccucuaaggaaacugcccuggcgugugguguuaguggcauaaugucugccuuaagccucucuagugucauuaagcuauccuauuuaccccuaaccucccuuuuguuggcuucaucccucccauuccccaccucauuuuccaacuacccacaccuucccagcuucccacucaagauccgaaauccauuaucagguuccauacuggcuggauaaagggauuauuauuuuccacuguggaaaaaugugucuguuuauagugugggcucagaccaggaugggaaaguuggcucuguuguuuucuuuccccucccccaccugaaagaaugcuccuucccugccaccccaaccuccaagucuuuucuacuccccauaaaacauguguacuggcaggggaaagggguucaccuuugcuuagauccuguguacuaaguugcuaccaauguuuuucccuuucuuuggaguagcuucuaggggaguaggugcccuuucuaggccugaaacccaaagcacaccuguauggccgugccuggcauaagcagcaugccaagcaggcuuguccagaaaccaggaucucagauacucugaagccgaggaaaggcaguuuaauucaggaaaagccucuuuuccucuucuuguguuucuuuuuucuuuuuauuuguuuuagagaugaggucuuacucuguugccaggcuggagugcagugguacaaucauagcucacugcagccuugaccucccaggcuggagcaguccucccaucucagccuccugaguagcugggaccauaggcaugcaccaccaugcccaguuaauuaaaaaaaaauuuuuuauguugcccaggcugaucucgaacuccugggcugaagugauccucuccccucuaccuuccaaagugcugggauuauaggugugaaccacugcgccuggccuccuucuugcauuucuuaccuguucuuauagcugcuccugaacacccacuucagagacauuuuuaagugggugcuuguaaaauauacagccuugcuauccagugggcuguaguagacccuggcuauaugcguguguacaggcacauucaugacucugagaauaccacuagacauagguaacugggcauccucuggagacaauuugucugcaucgucucuggucguagauaccacagucaucauaaucuguaucaucucaucaucaaauaucacaguuuugaucacagucuaagguaggaagaaucagguacuugagaguucuggaguaaaauuacaucauguuuaaaguucaguuuccauacugguuucucucaucuacagcucgagauuugcaguuauagcagaaaagguguuagagaggcauuggguccagcuuuccuuuggucauuccuuuaaauggggagaauuauugauaaguuuccuuuuuaagaguggcaaaaggaggcguaucuuauucuucacaccuagucacaccaugcaguggauagaccagaauuaaaaauaaaaucuaugcacaugcuauccaauuugccuuucuuggacuaggcggaauuaagaucuuuucucuguagcagccuuucucaggucuccaagucuuucauuuuaccuguagucuuaagaaacuugcuguaugaccugaggcaaaucacaugaccucuuugugucuuuugcaaaacagaaacaauaauccuuaagaauguuaaguugguguuguguagacuaauaaaaaugauuggaaggcaggcacuuggcauauaaaaugaagugugugauguaauucccaaauaacaacaacagaauugguaugugaccuacuguugaguuacaaggugcaguagacuuuuuaugcaguugauauucuuugcugucauugaaacacaaaacuuaaggugcaaaguacuguuugaguuggggauaagagauuuuuggagcaguuaucaaauuugaccaguaaggagggauuaauuuacuucaggaauccccauugcuuuccagaaagcucauguuugcauaguuugaucuuaauccaacuggcuugcugacucauaaaaaguuuuuguuugcauucucuuucuuuccugagcuuauuuacuaaacaaacucaguauuuuacuuguuucugauuuuuuuccccuuaaaauguugccaugacauguuaggccguguuaaacaucacacaaucaccuaaaacaauuuuagaauagcagggaaaacagccaucugcauuucuacaugacagaaagccaggcaguuaguuuucauugaaaauggaaaguguugagaacuagguucucugggagaugacuuggcuuuagccuguagcagagagauguuggcagguggcccuggcucaccucaucuuggaaggacccucgagucagagagaauguacacugaguugagaggagaaaacaaaugggaaacuaauguguauagagcaucacuuaugugucaggcucuguuaucguuccauauaaagcucucagaacaccccagcuaggcaguugugcaaccauuuuauaaaggagaaacugaaccagagacagguucaauaacuuguucagaaacugaugauuuuaaguggugaggcuggcugggauuugugcucaguaugucugacucuugccuauggucuuuucugggagccacgcuaccugugcugagugacaggcuucacugagaccuguuuuuuguauuuccuguuugaagugcucagaucagccuccagaaaauuauucugauggaggaagaaagagaugauguuuucuccugauggauaaaaaggauacaagagucaucucugggucaccauguuucccacuaugguuguuucuuuuuuuuuuuuuuuauuugagauggaaucucacuguguugcccaggcuggaguacaguggcgcgaucucggcucacugcaagcuccaccuuccagguucacgccauucuucugccucagucucccgaguagcugguaccacaggcgcccgccaccacgcccagcuaauguuuuuguauuuuuugguggagaugggguuucacaguguuagccaggauggucucgaucuccugaccucaugauccuuccaccucggccucccagagugcugggauuacaggcaugagccacugcgccuggcccucugugguuguuucuguucucaucuacaguggcucuugguuguuugguuccaguuuaggcacaagguuugccaaggugguucuauucuuggaaaggaacaauagggacguaguaaauaguuugcuaaaugaggauauaguucccaaaacauccgcaaagcaucuuccugucagcugcaaacccuguugaugaaagugauguaaucucuccaugguguaauuaccugugacuauaaaaaaaacuuagagauuaugguaggaggcuggaugggucauuauaguucucgaugaacccuagugucaugaaaaggcauugagaaauuacccucugcacacuaauuguugugccauguuuaaaacauugacaacacaugguaccacccucgcacuguaacuuucuaauaaaagaaacccagaguccacguaacugggucccuauuggguuaaaguccucauuaaacacagauuccaucugcugagcaauggugccccacuacccugcuaacuugccagcuuagagguuauucuucuuaccuacccgacuuucugcaaaagagaggcacaggaugcuaauaaaacaaaaauuaggguuaacacucagucuucaaugauucuagguagguuuccagaugaacaccucucaccacuucuuacccacuggaagagugcagugcaucacuugggagugggagccugcagagggugugaggagcccuuccagguggccugugcuggugugccuggcugccuggacugggaucagaucaggagagaccuuggccugccucagauuuagcuuuggggcccagagggacagaaacauuuagagauaacguuuccauggugcaaugugaaugaggaguucccuggcugcugacuucuuuccagcccuguucaucgaccucaucuucagcuaauuuaacacaugaaaauccgaauucacugaaagaugagggugugacuauaacuuuuuuuuucugagacaggguuucacucaguugcccagguuggagugcaguggcucugucacagcucaccgcaacuucugccuccuggguuaaagugauccucccgccucaccaccuuagccuccugaguagcugggacuauaggcaugcaucaccacaccuggcuaguuuuuuaaaaauauuuuuguagagauggguuuugcuggguuugcccaggcuggucuugaacuccugggcucaaacgauccacccgccuuggccucccaaagugcugggauuacaggcauuagccacugcaccugacugacuauaacuuuuuaagaacaggauugucccuaggauuucuucacauagcugucucuuaugagguggagugggauucaauucauguacaccucaaaauaguaaauaccaccugcagcucucauggagccacugagaucaugaguauaacugaguauuauaucuagguaccauuaugcuucaacucuucaccuuguuuuuuggaaugacugcauagucugaugaaaagcauguacucuggagucagauugucuggguugaauacugcuugcauuccuugcugcuuguguugccuuggauaauuuuugugacuucacugucuguauuucaccagaauggggaugauaaugucugcuuuauaagauuguagugaggaucaaauaagauaguauauguaaggcauuuggaacauugcucgguacacaaauaaauauucccauauuggaagaucagauccuagcaccaauugauaucauuccacacuucugguuuuaugacaccacagcugcuugguucagacagacucagguuggaacgugcucccuguuucuuccauaucucuuggauucuguuugaaucaauucagugcauacugaguagaguuagauccuugauauucgugagguuuucugagucccuaaauucucaaauaacacauguugguuucccauacaugaagacgaguagcaaagagugguaaaugcccuucugagauguuggugcuggagugagaucagcuaagugaucucacugugaacuauuuguucucuucagggaggcuacccuguugguauuucagagcugauauuccucagggaugcuauuuguuaggaacauuuggagucaguuuugaaacuuuacauauuaaauaugagaaugccaaggaucuguucuuuuaaagacauuuuuuauuucgucagcacagugaugugauuggaagguugcauuuuacaugauuccaaaacacaacugggagaauauaacauuagaauuaaaaaauaagaaauaucuuuuucccauuugguaguccuuuugcuuccucuugcuuuucguagcuauauugguauuucuucuuuuaggagccccuuucuaccuagauuuauuggcaucccuggugauggagauuuuuuucuuguuuaacuucuuugacuuauuagcuuugccaguaaccagaucuuuuaaaggagaauuguuuagucauccaaaauucugggaaguagugcagggaagguaaacagauugucuucaagauuucuuggccaaguuuuuuuuuucauucuuuuuaaaucacaaaaguauuuuugguauuucaguggggagggggcacaaaauguguuucaggaaguuaugaccaaguaaaaacagggcuauaaaauaauucugcuucauccuuuguuauucugaguaacaagugacacucuaugaaauacaaagggcuugaucaauucuucccauguaguagacacaugucuccuugggagagggcgggaccuuuguguuuauugucacuggcuuggcuucugaugauucggccuuguugacccuggcuaugguaagaggcaccagagaaugucauugggauuguugcacacuagacuaugacugaguggguaugaggaucagccugucaguguuuccugagcacuggucuaggcacagagggguuugguggcagauaggagaaaagucuuggauuucucuuuuucccuguugaucucauuaugauccagaggcuggauugcaaaugacccaguggagucuucagccagugcagccccacuaaggcuccuugauaacugugcaugguugcucacaguuucuuuuuuuuuuuuuuuuuuuuuuuugagacggagucucgcucugucgcccaggcuggagugcaguggugcaaucucggcucacugcaagcuccgccuccuggguucacgccauucuccugucucagccucccgaguagcugggacuacagacacccgccgccacacccagcuaauuuuuuuuuuuuuguauuuuuaguagagacgggguuucaccguguuagccaggauggucuccaucuccugaccuugugauccgcccgccucagccucccaaagugcugggacuacaggugugagccacugugccuggcgguugcucaguuucugauuagcggcccaugaaguuagcuggagcccuucaguaggcuguguggcucucuguuuuauaccucucacacaccucucugagcuuugauaucuguacacacugcuuucgguuuuauuucuuugguuuugcucuuuguuuuugauucuuguucuuuguucuugauuccauauguguuugcauauaagcucguugaacacagagacaaaauccuuuuuauguugcuccuuugcuacagccaggccagugaucaucccaguagauccaacacacgcauugugggaaagguacuccauagguggguuuaccccauaggaugauccagaaucauggcuuguccucugugugaggaaagcaggagcaaguccagggcccagugagcaguagcagugugugggggcuucccacugagugaugguuccucauaguauucuguccccagccuucuggggaggaaguggaggagcacgugaaaguguuuucaugccucagggaugcaggugguggggcucuucuguggagaaaagagagggcccaggcaaccugccuagaagaguacguugcagaguaugcuaccuuuagcuugggugaggauuucgaacccaguguggauccuguuaggugaugaagaguuauauaguuugaaaguauauccccagcugggugcaguggcucaugccuguaaucccagcacuuugggaggcugaggcggguauaucauuugaggucaggaguuugagaccagcccggccaacauggugaaacccugucuccacuaaaaacacaaaaaucagccgggcguggugaugcacaccuguaaucccagcuacuugggaggcugaggcaggaaaaucgcuugaaccugggagguggagguugcagugagccaagauugcaucacugcacuccagccugggcaauaagagcaagaauucgucucaaaaaaaaaaaaagaaaaggaaaagaaagaaaguauaccccuaccaaaucucauguuaaauuguaauugccaguguugaaguuggggcuuggugggagguguuuggaucaugggagcagauuccucaugaauggcuugggcgauccccuugauggugagcucucugaguucacaugagaucuggugguuuaaaaauauguagcacccccuccccaccuccacuuucucccuuucguucucauucucaccaugugaugugccuguucccucuuugccuuccaccaugauugaaagcuucuugaggccuccccagaagcacaugccacuaugcuuccuguacagcuugcagaaccgugagccaguuaaaaaaaaaaaucucuuuuuuaaugaauuacccagucucaaguauuuuuuuucuuuucuuuucuuuuuuuuuuuuuuuuuuuugagacagagucucgcuuugucgccaggcuggagugcaguggcgcgaucucggcucacugcaaccuccaccucccagguucaaacgauucuccugccgcagccucccaaguagcugggauuacaggcaugugccaccaugccuggcuaauuuuuguauuuuuaauagagacggaguuucaccauguuggccaggauggucucgaucucuugaccucgugauccaccugccucggccucccaaagugcugggauuacaggccugagccagugcuccuggccucaaguauuucuuuauagcagaguaagaauugccuaguucaaggagggaggaaagguacgcuuucauuaccagugggaagugaaggaggaauguauauggaaaucaugcuggcuguaaacauauccugacauuagagaggggcaugagagugccacuugggugggguuuggcuucacuuucuugccuacugccuuugcagccacagcuuccucuaccucuacgucuguuucuaaagaucaaggcuaagggacaacuccuucuccccuaaacaucuucaagcuuauucucaccugguucuuccuguggcuagaauucuaccuccugccuuuuccucccauacuucucuuuauccuucaaaguccaacuuagcuucuucuguggaacaucacccaucucucuuaccacuagaauuaauagggucugaaggaaggagagugggcuuuguguguguuuauugaauggaauuaacaagagcuccuagucguaguucuuucucuugggaggaugucagacagguuuuccuaggagcaggauuccaacucuuagaaucuugacugacuuugauuugaaaggauuggccagcuuuuuaugaccucugguaauugcagcuuuggggaacuugaaccuuuuguucuguacaucaugguacaugaacgcuauagaccuugcuccaaacccuaaugacccuggguuuugguaggguugcuguggggcagauuggguuuuguauuuucaugaguguuaacuccuuaagcaaguauguguugacauaaggugggcaggagcuauguaaugccacagagggcuuucuggggaugagguacuaggcuggaucuugacagaaguuaaucauauguaguaagccugugagaggagggcagcagcagccaggaacugugcucugcacuggaggaaugcagaguuaugguuuagcacucugauuuauuccacagguacucguugaauuccugcugaaugccaagacugugccagcuacugaaaauagaacaauuccaugugauacaugcuauaaucaggaaaguacugcacuacacaggaauacucauuagggggucuccugacucagcuugaauuggucauggaaggcuuuucugagggagagaagucuacacugagaucuaaaggcaagugaguuaacgaguauggggagacaagguggcauagucaggugaagaaggcagugccuugggccagacacgcugguuugaauccuaguucugccaguaguguguaauuuuaagcaaguuucucgaacucuacgucccucaguucuucauaucuguaaaauugggaugauaacguacauaccauauaggguuguggugaagaugaaauguugcuguuaucaucaucguuguuaaaauguggcacuugccaguggcagguacagcccgcuguugcggggagucuggagggaggagaggaagagaguauggugucugcucugcucaucucagcacuuccuuuccugggaacuucccaugucacuguugaaacuuuggauguccaauauacuguauucccuaaacuaauuuguuucuugcccugugaaugaagaaguguucucuuucacucugguggaguauguucaguagcuguaguuucaaaaaagaaaaauaaagucuaaccuuagccuaagaauucagggauuuagguugagcacaccaaaagcacaguuugaggaagcacccagauaggacugagaugcugcuaguggaggcaggugccuguccuggcugaauugucagaauuguggaggaggaggaggaagaagagaaacaagcucucuuggaguauccuaaggaucaaagaguuaaagaaaaaacaaacucuagcuaaugaaucaagaaguugaaugagucuaaacaggaaaggaaagaggguuggaaggaggauguuaauuuuagguacaauuugugggagaggauuggggaugagaagaauagcagugggcaccuauuugccuaugggacaggaagugaugggcuaggugaggcugcccuucugguccgagggaagaggucacucaggacaggccacaggagugcaugcuucuugacucucaucaccuggccucaguucagccaacucguaggaggcaugucugacaaagacuccuuauuucagcaagucugauguaccgcguggggucccaugugggucuuaucuggcgucacaaauuccauggggaggcuggagggugucagagguucuuaauugcuuggggaagggagaagaguggaggagcagcuggcgucugggcccuucagauguauuccaggauuuguccucuuggaucaggcugggguaauuggagaaguuggggugaggacugucugugauuugauguguucaggggugcagagaacuauugugacuuccagcagagaugugucucagguuucuuugaguggcuuucagcaaaggaacccuuucuuggugcuauuguucucaauaccuuguuguuaggcaguuuagaggcuuugcuguucaacuggcuccucucucuggcauucagaaaaucugucaccaguaacgcagacccuggccuuggaggaauaguuaagauugugaauaauaggauuaagugagauaauauauguaaaagucccggguaaacaauaaaagucuauuucaauggaauggauuauuauaauacuauuuuuucagucagcaucucuuuucugaauugcucagagcacuucguuaacacuaacugguuaauccaccauccaucccugguuggaggcuggcauuuaauagccccccuuuguaugcaagaucaaacacaaguuuccaacaaacccccacaucuugagcuugaagcccaaaccuauggaaucgaaaucuaaagcuuggacuucuaaaugugauaaugccucauuccugggaauaaagaaggugagaagagagaggagggaucauuaaaauuuuuuuuuucaugaauaauuggucaugucagacaaggcugucauagucaggauuuugaaugaccuagaagucagucagucauuuuccucugagaagccagaguuccugcuggaaaugaaacuugauaggagcuggagaagcagaaggcuaagaagagcagcuuuggggcaaagaacagggaagcagagagggggcuggcagauuucuucauucuguccuauuaggcugugguggaaguacuugagaugccagguucugcaucacagugcuaacugccuggcacauggcagugggaacacacucuccccucugauguguaccaggaagugucagggggacccacagcaggugcuugguguauucuucaggucucauguugaaacuucacagagcacccccgaguguccugcucaggccaguuuugcugcagaccaaguauugcaguccaguuuggcagggugggaucugagcagaucagccuuaggccgacucuccagucaaggaaaggccuaggugcauugguccaccugugucccuuccgaaggcuggucucaccagccuagagcuggcaugaaaagguccuguuuuguucacaguacuaggugaggccauucagagucaucaggaccuuuuuccaagcuuguacuucccugccucuggucaaggcuuaaagggcaguuccguccucaccuuuuguacucucuugcacagagucuugaacccuggaagcaggaggaggauauacugaguugggaaguuccuccuuccuccaguggcagaugugugggcucccagguuugaaacucuagaggucauucaggugugccagugaagaggcacauacucaugagagaaccaacaggcuggaccuuggagguuauuugcacuagugaguuucaaauuugagcuagcaucagauuccucuagagggcuuguuaaacacagauugcugggucccauccccagaguuucugguucaguaggucuaggaugugguuuaaaaaugugcaugucuaccaaguucccuaaagaagaacuugguagacaugaagcagcagcugcugcuggucugaagaccaaacuuugagaaccaccaauuuauacuugggcugaaaaaaaccugucugacucuuuucagagcaaauuuugcugaggugaggacagaguggguggagaaaucuugaacccacuagggagacaaguggcccucucagaaauaggcuacugcaggugggccaaccuaauaaaacugagaagagguuaagggaggaugcuggcagauguaucucuucuccaugcuggucugguccuugcauacuacccuacagcaaggagccagaccuggugagccccggggcuggaucauuuucauuuccuauucugcccccugaggcagcagugaguucuaaaagucugcauuuucggaugccuuuccucagucugggcucugugguaugaagaacgggacccugagccgggguccugggcaucggcccuagcacugccucuaauggacaguaacugaaggcaccucauguuacucaaggguaaugugaguguggacuagcucucuggugccuuuugugcucugauauucuggguucuuuaaugauuuacccugacagcuuccuccucagggucaggaacuucugcuggcuuguuacuuguuuuuuauuuuuuccguguaugagaacuucuguugaucagaaucccauccagagacuggcucgccaaaagugaaacuagagacaaguuugggaauuggagagaauaacuuuucuuuuuggagucauuggcaccugcaguugugcugcugccauaacaccugccuacagagagaaugacugcaucacugucgugccugccuaucuuaccccacugccagcuucacaggcugucugaucagcucugguuuccagggugcucaggauuguuauucgacauuccccacugccuggcacaguguguggcucaugguaggccugugugcaugcuuacuggauggauggaauaagcgguuguauccagcuaccucuucuuuucucgcuucuucuuaacuugguacaguugucuuccuuugcccuccucgcuuccauccuuccuucccugcuuccuuuguacucauuuuuacuccucagcacucuggcagagcuagcauguacgucgagugcuuuggggguuaaaaguauacacaagacaaucauaaaacacccuaugcaagccaucuaugugagggguuccuccagagcuccccacucuuccuccuugucucuucugcccacuuugucuaggguagcugggaauguuuucacuguccuaggggaauuugcuguucuucagauugaauuugaccccguuuucagccuuuauuucccaccagagccugaugguguuuguauuggcaagccagaagacuccuggcuuggagagaauuagaguuaguacagccugccuggcccugucuuuucagccucuaucugaaggggcaaaacaaauuuuucggccuugguuaauuguuacuuagccccucugauccagccugggcaacuuucagguagcucaggcacugacuagccugaagucucuguugaaacagggaagauuaaaguugauuugauucauuugaaguaaaaucagcaggcuuuugaugauuucauuaauuuccucccuucugaacacccuccuguuagcaguaauuggaaacccugacucuguuucucauuucccccccaccccucugcuuuaaucugagacaacuggaaacugcacucagcuuuuucauuuacuggaagaaugguuugaagaugguuuuaaugacuggcuuugacacuguuuccagaagcugagacuguugccgugcuuaaguucacaccuaccugggggccucaguuuugcucaccuugcuucuauaaaacugcuuaguucuuggugugcagguggaagaggguccccaugagaauucucuuuuuaucccaggcaauauauaugcaagcuuuucauuacucauuuucaucacucaacauuuacagacugccuggggugugugccaggcacuguccuaguaacugaguguguucccagcaccuccuccuggcccugguggacguccagaggacuagguaggugagauuccagcaggaugguggcuaaacucaaaccuugggaacuguagucucuggggcuuucuuucucuaucuguuuuuauaguugcaacuucaguuucugugcuuuuuuuuuuucuugggccugaagaggaauaaauaauaugaaccaccacuugaugucagagaaauagcagguagcaauagcugcaacagcuaaucacuauuggcaguugacaagauguacaaacacuugcuuguauaucaugucauauuguuguccucacgguaaaccaucacagccaguaaaggacaaagccagaauucaaccuaggccuucccauuacaaaucaaauacuuuuuguuuauuauuguuauuauuuuuagagaugagguuucacuguguuguccaggcuggucuagaacuccuggccugaagcuguucucccaccugaguggcugggauuacaggugggagucaccaugccuggcucugcuuuuuguacuauguuguuuuguuugaugguuugguuuuguuuuuaacgcugacuucccaugcuauugucuuuaguaugacuucaaccacuuaaguguuaagaaccuauuauguaugcauugggucuuguacaaggaagucagggucucacagucuaauggggggaaaagauaagacaauucaucuuaguugcccuugagugauucagguacugaaugcuauuagaaagaagagaauuaacccugaugucugucuagggaggcuuccccagaagagccaagacuugaauugggcaugguggaaaggcaauacucaaaccaagagagaggugaggaggaguuuugguuccuauaugacuaccucagacucggggauacaaagaaggugguaagguuuguuuccuucuucagacuuagaaaaccaguauccucuggggugaugcuccuccaacuuuacugugcuuuuucuuuuuuuuuuuuuccuuuuugagacagguucuugcucuguuucccagauuggagugugguggguaaucacggcucauugcagccuccaccuccugggcuaaagcagucuucccaccucagccuucugaguagcugggacuacaggugcaugccaccaugccuggcuaauguuuuuauuuuuuaaaaaaauuguuuuuuuagagaugacaucuuaguauguugcccaggugggucuugaacucuuaggcucaagcaguccucaugccuuggccucccagagugcugggauuauaggcaugagccaccgcccacagccuuuacugugcuuuuuaaaaugagauucccacauauuuugcccacaaagaaccauuuaguagaucucuguacagcccagcaaucugcauucuuuaaaaguuugcuaauaauguagaacaguuccccagccucucaaggucuccugccugaagagaagaaccgaaagguauagauuucauuuguuccuuuccagaggcagaaacuguuuggucagucagcugcucccguuauuauggugaagguggugagguggcccaggcuuugagaaacaccauaacccaagguguucucaugcccuuaguguugcagaaagcauuaggaaccagggaccuggguuuugauaucauagaggucuuacuugaugagaagaggacuaagaguguuuaggaugaaaccaaggaggaauggggacaguggauaauaaauuguguaaguuaaguugacucugacagcaccugggucagucugucugccagcuugauuugaaggcagguggggaaacccacugagucugaguaccuuugaaacaaaguucuggccuugcucagaguuacucauguuacucuguuacgccgggcgugguggcuuacgccuguaaucccagcacuuugggaggccgaggcggguggaucacaaggucaggagaucgagacuauccuggcuaacacggugaaaccccgucucuacuaaaaauacaaaaaaaauuagcugggcguggugguggacgccuguagucccagcuacuugggaggcugaggcaggagaauggcaugaaccugggaggcggagcuuccagugagccaagaucacgccaccgcgcuccagccugggccacagagugagacuccgucucaaaaaaaaaaaaaaaaagaaaaguguuuuuacagaccuguuugguagcuuagcuuucagaugacuguuuugcagaggggagugggugggguggguggcagcaguggagacagcugcauggucaaucagggggugaguagaaacagaucugccagaggauuuagcagucuugaugaaucuaauuauuuauuucuauauuuugugaccauaugguaccuagggugguuauaaagauuagaaaacaaucaccaaguuaccaaauacccuguuaagaagugauaugccuuagguuggaggcauuguaaaaauacuauaggcgaaaagaauuaacacuuauaaacauguaauguguuccacuguaaacuuaaaaaauggagacgaguguaaucacacauggauacuugccucccagauuuaauauuuugccauacuugcuucagaccuuuuccuccagagaugaccaguauccuaaguugaugugcaucauuccaaccauuucuguuuuuggauacuuaaaccuguauuccuaagaaauacagaauauuguuuuauguguuuaaaaaugugcagugcauuugguguuccugcuucaacaguguuuggauggaacagauccagggacucucuugggaaaaaaaaaaaguauguaaccuuccguagcauacuuuuuucacucaagauuucuuuugacauuuggcuauguuaguacauuucuuuuaccugcaguauagcauuccauuguguuaauauaaguguauauuacauauuguaacauaauuuauaauuauauauaauuauauaaauauauauuuauaauuauugauuacaaacuauaguuguaaauuauauguugcaauuauuugcagugaugauauguaacaguauaauuguauuaauaacaaaauauuuauaaccauucucucacugauggaucuaugggcgacuccaguuguucacuguuaaaaacaaugcugcggcugggcaugauggcucacaccuguaaucccagcacuuugagaggccgaggugggcagaucgcuugagcccaggaguuugagaccagccuggccaacaugaugaaacccugucucuacaaaaaauacaaaaauuagccaggugugguggcacauaccuuuaaucccagcucuucgggagggugaggugagagggucacuugagucccggaggccaagguugcagugagccauaaaugugccacugcacuccagccugggcaacagagcaagacccuaucucagaaaaagaaaaauaguuaacaaaagaaaagaaguuguuaaaaaaacaaugcugcaaggaacauccuugugcauguguccuaagcaugugugcagaauuucucugguaucuacaccuggcaggagaguuccggauuguuggaaaugcacuucaacuuucugcauauucuucacaguaauuguaccaguuuacacuacuacugauguauaagaagauucuuauaucuccauaugcuuuacaacaacugguauuguuagguguuaauuuuugccaguuugauggacaugaaauggaaucuccuuaaggcuuuaauuuuguauuuccuugauuauccucucccaauuuguagauuuuuugaacuuuucuuacggcagugguuuucaaggaccuuugagauccuuuuaggggauugacaggguugaaauuauuuucauauuaagaugcuauauuacauacuaagauccuguuugccuuuuuugcacucauuguuucaugagugaauaguugaguuuacagaagcuauauggcauguguugugaucauugauguuaacaucuguggguuuauuguuauuuuaaaaugaauuauaaauauguaaaauuuuuaguucuauuuucaaauaugguaauauugauagguguaacacacaaauucuuugggcauccucaauaauuuuuaguaguguaaagcaagcuuguucaacccacggcccaugggcugcauguggccuaacacaaauucauaaacuuucuuaaaauauuaugaguuuauuuugcuuuuuuuuuuuuuuaaagcucaucagcuauuguuaguguuaguguauuuuauguguggcccaaaacaauucuucuuucaauguggcccagggaagccgaaagauuggacaccccugguguaaaggaaccugagagcaaagaguuugagaaccacuauuauuuuacuaugucaauuuuuaaaauauuuuuuuccugucugguagguuucuuguuuaagaaauuauuuccuauccaaauuucauaaagaugggcuuuuauauuuucucguagaaguuuuggaaaguauuuuuauggguggcgucugccaauucccaggcccuucaaccacuaggaauaguuuuuaauuuuaugccuucucagaaacacuuauauggccugaauggaacaucuucccuaucugaauauaauuuuuuggaagggcaguaugugggaauagggauuuagccaccuucuucagaucccuuuuguucaagagagccuccuagcauuuugcagaguucagcagucucuccuuaagaaugguguacacucucauuuuggauccuuggguucacugguuuugcaguuggcuguucagaggcccagaacccaccagugacagggauucuggaagcaaaaucccucucugcagccccuaacccacaugccccaguuuccacuggauacuugaguuucugucaaggcaucagugcccuuacuccugguuguguuugugcuggagugggaagguguguaggcagcugacugguuaacugcagucaaggauauaaacaauggccuccucuaaggaaaaaaauuacauugcugacauccaaggccccaucaucucucaccaggcucuuacugguuuccgugucuccagugucuuucucacccuucuucccacaaaucugucuuccacccugccagaauaacucucagaaucucauacuuggcaugaugcuacuucuccucuuaaaacaaaagaaaacaaacucagggucccauaagacuuaugguaagguccauucuucuuagcaauauaacccucaucuguacuuucagcuuucuugccagcugcuucuguauccuauccucuguccuggaaucucaccaggcaucucauuuuuauuuauuuuccuaguauacugugguaugugcccccaaagccuugcuuaugcuguucccuccaacucaaauguuguucccccuuugucugcugggggagaucuuuuuugucucucagacccuacaaaacucaacaaguaugaauucuaugaggaugauuccuuuagucuucccacugauagccuuuccagucaaaacgaagacucagcaaaguuaucuuggucuuuguugcacuuguagcuuuguuuggggaaggcugauacaucuccaucccuuccccaaaaguuuccuacccauaaauuuuauuuacaguguuggccccaguuguuuugcagccuaguucuucaguaguugcacaaaaggaagaugccuuuuuugugguuaagagcugauguugauauccuuauaaauugucuuccuacaugccuuuccuucagggagggaaugcacugaacagucugauggcaacaacuagucccucacccuucgcuaccaccaauuauugugcauuuugaaaaaguaguacauugacaucugucauauuuuaaaaaugguacaugaaauacguguaugcauuaaugcugucugcagaaagguccugcucagggaaaaaauucuggauggugcuguuuuucccauuuagccacaccuagccuccugccuccccuuuagcagccuaaaaaaauaaaacuuuauaaacccuggacaucuguuagacaugcaaauuaagcagauuaacuuauuuucugaaagagcuuuauagcagaaauccacauggauguggagaaaagggggcuccugcuuggaagacugcugacguaaguggccugcaguaggaggguuguggugggccagagaaggggacggccccguagggggaucugaagugggagacuuugauugcaggaaucuucaugucauuguuaacaucugaaagaguugacuuucuuuggcaacuuauuuauagccuuuucauuacuucuugagaauggucgcuauaaagaugggaaaaguaagauaguaaaaugggggaaaaauuauuuccuuggcucacauugcagugaucauggcaaagguaggauuggaucuguugcaugcugccuuuuagucuguugcaaacaggcuagguggguaugaauucucaaguucaugaaaagggcuuacggcuaaagaaguggggucugagcacucacaaauucuggguuacuguguuaaauacuguguuaaauguugaaaaauauguuuucauauggacaugcaucagagagaaguuucuuuuguggguaaugcuugucuuguuacuugaagaguacugcuaauguugcuguaauguuugauuaguaguaguuugagaaaugaaauauaggccugguggggugguucaugcuuuaauccuagcgcuucgggaggccaaggugggaagaccacuugaggccaggaauucaagaccagccugggcaauacagcgaggccccaucucuacuagaaaaaaauucugaaauuuagccaugcauaguaaugcaugccuggaaucccagcuacucgggaggcugaggcgggaggaucuuuugagcccaggaguuugaggcauuggugagcuaugauuaugccacugcagucaagccugggugacagagugaaaacuugucucaaaaaaagagagaaagaagaagugguaaaauacaagaaguaauuagguaagccuugcauaucaagcagaaugguaccaauuuucucauucugcccuacuuugcccaugucucuucccguggaacccaggcccucuggcacauaugagaaaaacaauccuuguaaucaaaccaaauguaugaaauacaaauuuaaaacucuccccaauuaaaaaaaaacagaguauaguuauugcaaaaagauuuugccauccacugaaggagucacugugcaauuguuuuaaagagcaagggcucugguuuaucuauaauaagauuacauuuuccccuaauuuuuuauaaucacauuuguuguuuaaggcaucuaagagaaagagaaagugggaggguggagucccaguggcaccuugggcaauaucagaugaaguguuugguugagacugcaacucugaaaacuaugcugaguuccacaucugaucauaagaaguugccucccuuuuuuccccugcagcccugucucuccuagaacaggcuuugccaaggaugaaaagccugaaugucaaauccuuucugucugcccuggcagggaagcuguucuguuuuccaagaagccuuuuuuuuuuuuuuuuuuuuuuuucacuuggggaauuuuuacuuuccucuuaugggaaguugcuucaucauuucccaaaaauauacuguaccuccuguuuaaacagggugcccuugaagagcucuggagccugaagggggcuagggguguugugaaguccuuuguuucaugcuuugaugugagcugaaaugcaggcugucuacaggcagaagucucagaguuugccacgacuggggucuggaaugggguguaggaggagaggcucccugggaagcaagagcugggaucuuuuuaagcauuuaguuuauauauguugugagagguaacagcccuuccagacacagacaccaucagguauuugucuagugccuuaaauauguccaggaugguaaaggugggcauucugcccuuuugaggagcucaugaggaggaccaugucacauuuagaaauggugaacaaaaugguauuuaacuacuagauuguggagacauagaugcuuuuguuuagagaggaaggauauuccuguaaaagagagcacuaagauugggccuugcauuauggauugggucugaguugauggaggaaaaacuagaggauguugagggagagggaaaggagaaaucucugagaggggccagaaggcugagcugaggccaugaucaugggugagugaggccagugggggcugccuaguuggacuugauguuggagaaauggaacaagccaaaguguggagacaugcauagccagcagaagcauuuagacuuguagaaaguggcagccuuuggacgauucugaaaagaaaucaucaugaggaaaaauguguuuuggggggaagauuugcauaugaggauaaauuauaguaugccuccaggugggcugcaggaaggagccccaacucuguccaugguuuuuggaaggagaucaugcuguaagauacugggaggggaaaauggccugguagaagucucuuuuugucuugggugaguguggucccauaguggugccuauggcccaguggccuucugcagucccccuugcagggcacagcaguuggagccaucagguuguugcuggcugaguaggaucagcucucaggcaccacccuaaguaaagcuuugaucaggcccugcugcagguggaagugaugucuccuagcggacccaguggggucaagcauaauguguagcagguuucaagccucugcuggucguuggagaaugagauuggccaggagauacuguccagguccaagugacaccagucauuucaugccuaaucagcagugaaagugcgguuuccugaaaccuuugcugauauuggguguuacuaccuuccuuugugccuuggacccccuuaaagauuuuaaauaagaaaucugauauguaaaauaaaggaggaucagucaaaaaguguucuuaguagaauauguaucuagcagucacucuuugugaaaaauggaaauugggaaaauauuuugagagagauucuaucaguggggacaagcaagcauaaacauguuaugcuuaucccaagaucuauuaauuuccaguagaaguagggagaguaaauuauugccaagggagauacugcccaguuuucuuaauggucagaaaaugaaugacaguuucaauuucagcugcugucccugggcugggccugcugacuugccccaagugccuuggcacagaccgugguguggccaguggaaacaucgugucuguagccccgugaaugagcaguuccucuuugggggucagcucagcauguugccaggccagggggcaggucaggccgaggcuccacuguuagccuugacuuccccugccaggagauguggggccauuauggcagaagaggagcuaaggagaaacaccuagcuuggagccuugagucuucaacuuucaccucaaguuacucuccuuaaagaccagcacuuucuuucccacuuuucuugaaagccucuaggucccugauccuguuucaaacugcugguauauaaacugcucauaccacucugaguuaucacuuuguuagggcugaguagcaggguggcccuuaaacaggccugacuuucaguggcucugcccacguuugcagaagucacagugggaaauuuucacauuuuucucuguccuucuaagaugggacaguugagaggacucaggaaggguugagggagaaagcagcaagcccagaguucagaaucgguugccuugcagcuuguccuuuuguggugggugauuucacuugguuuuucaagugaagggcugcaaguacaaauggacuagcccuaaaggacauuacccacaugcauagagccaugaggcacauugauuguuucccauaggccacuuugcuccccguugaggaaggaaccauugugcuacuaauauuauuccacugcaaggucuggcuggaggcaucugcaaagacucuucagggcccugauugcacauuugacaagucuuuuccaucaacaaagcauagaguucggggaaacccaggaugagcugucauucugaguaacaggcuugugcaggugcugacuagcuugacuucccuugauucagugcaaaccuugggacccuggaggcaguccuggucucuuaguaaaaugcagguguguguguguugcugaguaccagagauuuuggagccucgauacuuuccucauuuguauguggaccuaccuaagaauauauuuucucuagguucaccaaagugauuccgggccuuuagggccaggagaguaaagggucaagaaaucuuaaauuugcuaaacccguggugggggagugagaggguagaaguaguggggauucugaagcaacuccaagcagucugcuuuuaaacauuugucaugggaacaaccuguacucugguaaauuguaaauugacaccccgauugccuuuguguaaugaauuuggacuuuugugcagcagcugagaaagaaccucuugagcagucgugagguguggcugccugccagucagcagcacacucugagcagccucgccagcucccucugugcagccgcaugugcugcagcgguaacuugcauuaucagaccuugauuuuguaaggaugaguugaaaauggaaaaaugaaaugacuaaugguaguuguaaggguaggucuucuaaaguugauagaauuggaagauuuuuaaauucaaugaaugugccagaaguaagaaaucuuuagugucaguugaauacucauugacuuaagucaacagcccugcucaguugugaagagaaaaaaacacacauagccaaagaauaaugucuaaaaugcccagguuauguuguccaagauugucucuaaaaggcaggcuauaauuagauauuuuaugaucuuuuuuggcuuucugaguugacuuucuuauaauauguaaaccuauuguuugacuaugaggguccuugcuagggaaguagggggacuaccugcaacagguucugguguaagagucgugcaaaaacaaagcccuuuuuguaagugugaaaggcccuucuagagccgugaguauacauuauauuuugacuguauuagucuguuuucacgcugcugauaaagacauacccgagacugagcaauuuacaaaagaaagagauuuaauuggacuuacauuuccagguggccaagaaagccucccaaucaugguggaaggcaaggaaaagcaaguuacauguuacauggaugacagcaggcaaaaagagagcuuaugcagagaaauucucguuuuuuaaaaccgucaaaucuugugagacccauucacuaucaugagaacagcaugggaaagaccugcgcccaugauuccagucaucucccaccagguuccucccacaacaugugggaauuaugggagcuacaagaugugauuuggguggggacacagagucaaaccauaucauugaccuagucucuucauguauuaauuaaugcuuuuccccacauguuguacucauuuauaugcuaauuucugccaucuuuauucuauuuagauacauuuagccuaugauuuuguuuuauuuuauuuugagucagagucuugcuuuguugcccaggccggagugcaguggugcgaacuugucuuacugcaaccuccgccuccuggguucaggcgagucuccugccucagccucccgaguagcugggauuacaggcacccgccaccacaccuggcuaauuuuuguauuuuuaguagagacaggguuuuaccauauuggucaggcuggucucgaacuccugacuucagguaaucugccugccuuggucucccgaagugcugggauuacaggugugagccacugcaccuggccuaauuuuuguauuucuaguagagacgggguuucgccguguuggccaggcuguucucgaacuccugaccucaggugaucugccugccucggccucccaaagugcugggauuacaggcgugagccacugugcccggccuagcuuaugauuuuaagcugucagaugggcuuuuauuuaaaagacuggccugcucaaacauugcuagccuucuauaacauaaaaccccagguuuggggaguuaagagaaaaccaccaaaaaauaaaccagcucuuagacugugaacuuucucaaacucucuaguuucaauccguaacuguggguagguagaguuguuauguaugugcuuuaaacgacaaaguuuuuaagaaaaacuaaccaacauuccacacugggguacuauuauaauagagaaaaaucucucuaauuauagcaguauugugggcuucucccaugccuggcuggccacgacauggaguugauaagcauacagugucuuucguacuugccguuacaacuguuaauuaagagaauucagcuguggcaccagcuggggaugucuggcuuuguggaagauugcaauuagaugcuuuuuuuucuuuuuguuuuuuuucuuuuuuuucccuuuucaacuuugguggaaugccuuugaguaggggcuuuuagucucagcaguauaaauacuuuauaaugugccuaauuauguaauuauacaguuauacucuucuguguacacacacauuguuuuaugaauuuguaugcccuuuucuaauacaugaaacaucuagccugcuuuuugguuguugugguagagccagacuccucucugcauugggcagaaagaagaagacuagauguauuuacugauuagcuucugauuaugaucugcccuacuucuguuccucuuccaccucccucuugacccucuaucucccaaauaauuagcaucuuaguagcuaccuagcaaagucaagguaauuugaauaaaauuggauuguauaauacucuuaucuuuccauuaguuugcaaauguaguccuucaaaguguguaguguuauuuuucccaguccucuguucuaggcaguuauagagcaugagccuggacgugagagcucaugcaugcaugcaggcacaaugggacccauugauuucuggcauucagcuugugcauagaggaccugugaccccagcuguuagaaccaggaccugggagcagcugcuuucuggauccaguccuccagggauaggccaucugcugccaugugagagaacccuggaaaagaaacugaccacaagauaucuuuguauuccuuuucugugugcuccagccccuuuaguucuuuccuguccccucucaccuaggcaaacuugagaagcaugaugaaucugcacuggaaaacucgcaauggauuuuccguuuucuuccccuuuccccacuccacccugucagcacauccagcccauuggaaaauaguuuccaggggauguaggcagacuuauaugggcagcuucuucagugggauugguacuauuuagcaggcuuucauuuuauuaugaauaacauggcuuugcauuauaggccuagaaguguccuuaaaaucucaucucauggaagaggaacccaagauuccacauucuuuagccuugcauucagggccuacccucuucuggcaccagccugauuuucuaaauguucaguuaucuccugcuaaaccuggaaacauuugcuaacuucuccguacacauaccaccucuucuugauucucugccuuuguuugugccuuuaugucccccaccauguucuucccacucuccuuuauccccgucauaauccuuuaucccguacucaugauccuacuucccgugaaguuggagcucugauaccauuucuacaaucuucuuuggucucuuccccauuggauuaauccuucuucagaacuuucuguagcccauauugauuucuaacauauaucuauuauagucguuuauuagaaagcuccuagaguguaggaccaauaucuuuuuaucuuuccaccugccuaccuucaccugccacagugcuuuugguacuuaguaaaaacuuguugaaaaaaugaauggcagaauuaagcugagggaagagaaaaaaagaaugaauggguaaauauaauccuuacauggauucuggaagagaagcaguagauauuacuauuauuuuaaucuuguuggggcuccuuaucuguauucccaaagagacugaagucuccucaagggcacaccauguguauuauuugcccuugaauuucuagcagcagccuaacacauagugcuuaauagaaauuuguuaaauuaaugaaggaauuuguuaggaaagugaaaccuggagagaauaagaaucaacacuuguaaauacuuuuaaaaauuuguuuaauuuuuugagauggagucucgcucucaccaggcuggagugcaguggcaugauguccacuuacugaagccuccaccuccuggcuucaagcaauucucaugacaagcccucccgaguagcuggaauuacaggugugugccacguugccuggcuaauuuuuguauuuuugguggauacaagguuuuaccauguuggccaggcugaucucgaucuccuggccucaagugauccgccugucuuggucucccaaagugcugggauuacaggccuaagacaccaugcccguguuuuuuuacucucuuuugagugaaaguuauuaguuauuaaaccugcugucuggaggacaagagauuaaagguauuuucuguacaucaauguggcauuuagacauaguuaucuaccaacaugcagugugugugaggcuguccgaggcauugucuucugacugggcaucucagacuggucagucaaaaguggcuugcgagagacuaggguccaaagagccaaagaggccaugacaggugacaggggcaugguccucacccugauaaauaagcaugguugagacucuacuccugacuguuagcuaguuuaggcccaaguuucacuauuuugagguuguuuuguuuuacuagagccagaccaauauguacacaggcuaacaucaaaggccaguccuagaccuucagggccaggcauccauccuucuuuggacuuugcagcaggcuugaaugcauuccuguuguuuuuaaagauccuuaaagaggcuuaaauguggcuuccucagagaaaagcaugugggaaggauucaaagagaaagcuuguaagaggagcagagggaucuuccaggagcacgguaugcugagcaagaugcaaaaguucaaaguagugaagaagagaacuccuagggggauuugacuccucacuguccagaaucaguuggugaaaguuccccucuggagaagugcaaaggaaaccaagaaggcauggcaaacugcuuuucccgugguggucauuugggagaaggugguuuaaaauuuugugauuuaagauuguucaaaacagagaaucucaucccgcacaagaugaaggaggaagaauauccaggucaauggacuugguaacuuccgcuccaccugccugugcacagugaguacagaguuccuuaggcuuguugguuuagaggcaauagagaugagacuuguggcuucguccagccuucuccccccgcaccaaaaaaccacacaccuuuuauugucucuuuuguauuuguagucccugucucauggugggaccccaccccccagaauguacagggcucacuucaugguaugccuuagacccagucacaucucuuucuucagaaaagaccauucagggcugggugcaguggcucacaucuguaauccuaccuagcacuuugggagguugaagcaggugcaucaccugaggucaggaguucaagaccagcccaggcaacauggcgaaacccuguccuuacuaaaaauacaaaaaauuagccggacuugguggugugcaccuguaaucccagcuacacaagaggcugaggcaugagaauugcuucaaccugggagaaggcagagguugcagugagccaagacaagaucgugccacuagacaccagccugggcaacagagcaaaacucuaucucaaaacaacagcgacaaaaaacccauucagaccuccaccccucaacugcugguguuucucaaagaccuaugguguuuugcugauuuggggccauugccucaguggauuucuguuaccauccauaacuagaguuuacugguguuuccuuucuuucuuugcgguugucuaggccuuugugaguagcaguggccuguugagugccuaagagaaucagcacacuaccugacccccuguuugggaguauguggcagaggcuguuuauuucaggcuuuggcagugauaacccaguggcccuguguguucugggcaguggcagaaagguagcccucuaauuccaggucacauccccauucugcauuuagugacaaccuuccuuucacauauccgucuuagaagucuuguguucucagccaggcuugguggcucacgccuguaaucccaguacuuugggaggcugaggcggguggauuaccugaggucagguguucaagaccagccuagccaacauggugaaaccugucucuaccgaaaauacaaaaauuagcccggugugguggcacacaccuguagucccagcuacucaggaggcugaggcaggagaauugcuugaacccgggaggcggagguugcagugagcugagaucaugccacugcacuccagcuugggugacagagugagacuccgucucaaaaaaaaaaaaaaaaaagaagucauguguucucagcugaaaaugccuacauaucuucucccacuugcaacuuugcugucugugauccuuaaauagcuccauuguguguaguacacagaaauuagugaaggaaacuguccugccuuuucccuccacuucucuggaaaaauguggccccaccugagauaugaacugaguccucugggcacaacuaaacucaccaggccauauucuucuccaaacaggaauuauagcagcuuuuguccauauguaucccaccccuauguuauacuuuguaggucuugggguaaauuuuuuucugguggcaucagaaaaaaucaagaagcuuccuuguagaagggccagccagaauuugaaugcagacucuaguacuuagaauccaggugaccucaguccauuacuaaauuuuucagagccucaguuuuuucugaacaaaucaaguuuuauaccaccuucuuccuaggguggaagaauuuaauaggauaacacuuuuaaaguaccagugcagugccuggugauaaauguuaauucucuuccuuacuuguauccuuuuggcaacagagaucauuaaauuuguuuuaaauuugauuguguguuucuugaggcccugcuguguaugccugggacuguacuuggcauuaggaguuaccauuagcugguaggauuggaaaugaaaccacaauuuuggccuuuguacccaagaguccaacccuguuuuaaacucuaagccagacuccuaagucaguuaucaccugcucaucagcuuuccuucugagcugccguaaacagccaucugggccuuuccugagaggaccagucaucuccucugggagaugaggaauucugagaggggagagcaaacacauauuuuagcucagguaggugauauggugaaggagaugagaacaagaagugacaauggcugaugaggaaaaaauaagcauucucugcuuuuucuuaagccuuuaacugccacugucaagggaaacaguaacacuugcuaauacacguggaauagccuggcucccuaccuccauugucaucccaccaucuggagguggagguaggagacagcugugggcucugcucuauaggucacuguacugaccuauagcagugguaguggcuuugggcacugagugggcuagcccuguaccuggagcagcaggauaaaggagaaugguccucuggccugccccuccuuguagcagugguaacagugggagggggagggguucccagccccagcuggcagccuguuucccugggucccugagcugcaagaacaagaggaggugaaaggguaacaggccauauggaguccauuugucagccaagagcagccugggcuguauugucgagaacgggaagugaaaaaggagccggcuuauuacugaacuggaacaaggagagagcaaacaacaccccccaaagugcuuauccugcucuguuuucugccugcccccucuccaaauauccagaaauuucugaaauaauccuuuuucuuuuuaccaaagccuuugcccauuccaaaaaucagagauaaggguuuaguuugcuacaugaaaauuuaucagugccuaguaaugugccaggcaugauacaagacccuuucaaguaugcaguuuuguuagucuucuaaaaaaaccuguggagcuggauauuggcugcuaaggacuaaggcucagaggaguuaugacaguugacaaggcugcagagcaggccccugggucaaacccagauucaucugucugacccccaagacuaugcucuuacuccauguggcucugguccuguuagguaggcaguguauuuucacaguuagguaccaauuuggagaauacaaauuguacccuggagagggaugcucuuugccguugucuguuauugacucaucucaaaucaaaaaucauuguggcucauugcaguugaaaacaagacaguguuuugaaauaaggacaaaauuuugcaagucacguugguuuucuacuaagcaucuacuaucuccuggauuauuugucagguacuagggauacaaaaaugagcagaacaagucucugcccuauggcuuagauguguggguuggugguuauuggggaaauggaggaaggaccaaccugugagaaaaccugcagagacuacaacauggugauagguuacaaauaggagugaagaugauguaaugggaacccagaggaggaauaauaaagcugcuguuauugaacacuuaguaugugacagacccauuaccagguacuuuaccugcauaguugugauuaaccuuuugaauccccauguuaaaaaugaggaaacugaggaauaggaagaucuccccaggacuacccaguggguaacuguuggagcagugugcaaccccaggccgugaagucucagcccaagcugguaagcuccacccugugcugcucauuguuucucucuggccaugccugggaagguggccuuggaaccuuggagaugggugggguuccagcugacugcaugugcuuucaguucaggguuucuaggcugggagagaaacaguacuuuugacugaaugacuaaggacuuuagaggcuuaggugccacuaaaagcacuuucuuuuauugaacgcugugccucaaacaugaaaacuccaggugacaggaguuuuuauguuugaggcagggugcaguaaaagaaagugcuuguuggcucugaggccucuggcuggcauuuucccucuccugugagggggaggaagugaggggcccaggccuaaaacaagauggacagguccgaggccugucccaccugucaguugcugaucuuccgaggagggcuuagguugagccucucuuaggaaggcaguggugggggcccgagaagagccacaggagguauccugagccaugggugguuucucccuguguucucccaccccagcucuggugccacacccugaaaaaggcuugagcuacugcaggcuggcucucccccagugagugggaaguucucaugagaaaagggauccugacuggacaauaggcuuccugucugacugcuaggaagauuugucucauaggagaggaagguugcaaauggcaugagaaaccaucucacuucccucucacugcagccuguuuuagacuugacuauuuggcgggaucgggaagccagaaggcugggcagagccauggaccagagcagccccagguaucucuuaaguagugggacuccugccuguuuuccggcucucaccacaaguccacagcaggaaucugucccaaugcaggaauuucugcauggacaggaugaucucuagccccucacaccuugugcuguauccaaaaccacaaugguugcaggacuuuugcgaaggaaccuuggagagguagugaggcccgccaacuuuagacaaauuugcaaaugucagaagagaucucagaggugaucugguucauugccuucauguauugaaacugaggcccagagucuacgggcaguacccaguuuguccuugucacuggacucugccaucuguggcucccuugacagauuaugggugugagagaagccugacuccgagacccucugauacugcccagugcuguggaaugggaauacagccuucugggguucaaauccuaacugugccacccaccugcugggugaaauugagcaaguaucucaaccccuggcucaucuguguaaugcauuguuauguuucuagaggguuuuuugugaaacuuaaaugaguuacauauguaaagugcucagauagugccuggccuguagucagugaacacaagcuguuguuauuaggaggcuucagaagaaaccuuuugaccauaucagaugucaucacuuguuuuuucuucuuuguauuugucuggaaugcucuaauuccaacuugccugggaggcuuucuuuaggggaaucaccuccccuuugaaaaaggcuguucauacuggguauaacucuuucuuuuauaugcuguacgaaguagcuggaugucuccaaagccauaggcugagcacaucaaauggggaaaugagccacaaaacagaaccuggcagguuuccugaugcccugccccccucagcaggccccggcuuaacugaguggucaggcuugcagcuuagaagccagaguuccuggugaauccagcccugccaauuacaaauguguggcuugaggcagaucacucaacucaguuaagccuuauuguccuuaucuguaaaguggagaaaauauaguaccugcuucauguagagagagaacccagaagaguacuuggcacagguaauaaacuaucuguuugcaauaauuacuguuuuccuuauuccaaaacaaacagaacuauacauuuaaacaccuuuguucucuguauugaccuugcuuuuucucuggaucucuuugcuucuacaaaccauugaaggcuagaaguagaaauauaaccuuuauauauaagaaaggguuuugagagcaagcacauaaauagugcuuuucuaaauaacuuuaagagacccuuagugcuaaaugccuccuucuuuccacaucuucagccucacauuucaugcccugucgugugguucugaaccuuuuccacuguuuucagauccccagaccuguccugacugcuggccaaggacuccuucacugagacugugcuguccacuacaauagccacuacuagguggcugcauguggugacugagaacuugaaauguguuuagucugaguugaggugugcuauaaguguaaccggaaagggguccagauucagaccccaggagaggguccuuggaucuuccacaagaaagaauucagggcgaguccacagaguaaagugaaagcaaguuuaugaagagaguaaaggaauaaaagaauggcugcuguauagacaguauagacagagcaguguggcaugggcuacucggcugaguguauuuauaguuauuucuugauuauaugcuaaacaagagguggauuauucauuagauuuccaggaaaggggugggaauuccuggaacugaggguuccuccccuuuucagaccauauagggugacuuccuauguagccguggcauuugugaacugucauggcuauggugggggagugucuuuuagcaugcuacugcauuauaauuagcauauaaugagcagugaggacaccggaggucacuuucgucaccaucuugguuuugguggguuuuggucgacuucucugcccaaccuguuuuauugguguggucuuuugugacauguaucuugugaccuccuaucucauccuaugauuuagaaugccaugccuaaccuccugggaaugcagcccaguagaucucagccucauuuuacucagccccuauucaagauggagucgcugucauucagaugccucuuauauaaguguacagacuacuaugagaaaaagaauauaaaguaucucauuagugaauuuuuauguugacuccauguugagauguaaucagucaacauauuuuuucauauguuggguuaaauaaaauauuaagauuaauuucaccuguuuccauuuaucuuccuaauuggcuacuagaacauuuuaaauuacaucuguggccauguuauauuucuguuggacagcuuugugcuagguuugugauuuccauccauuccuuccuccucuccuuaguuucuacucuuuuucuucuuugccucaggcucuuacccucccugggugccgaugaaugaucaccuagccagaaggacaccccaggcuauuagaaaagcucauauuugagcagcuugugucacauuuaacacuuacuucauugguuuaggguagaguuggcugugaccaugucugucuucucuagguuguaggcuuguagugggggcaugguucuguuaccggaaagagguccagauccagaccccaacagaggauucuuggaucucacacaagaaauaauuuagggaaguccauagaguaaagugauagcaaguugauuaggaaaguaaaggggcuggaugcgcuggcucacgccuguaaucccaacacuuugggaggccgaggcgggcagaucacuugaggucaggaguucgagaccagccuggucaacauggugaaacccugucucuacuaaaaauacaaaaguuagccgggugugguggcacacgccuguagucccagcuacucaggaggcugaggcaggagaaucgcuugaacccaugaggcagagguugcagugagcugagauugccacugcacuccagccugggugacaggggacagggcgagacucaucacaaacaaacaaacaaaaaaugcacuauagauaauuuaaauguaaccuucuccuacucaacccuaaucccuuugaggcugcaugcaugucacacugaucuuuauauucccugcuuuccacaccuuguuuugaaggagcucaaguauuuguucuguuuguuaaauugaaugcuuugaccccuggggccuuuccuggagcuuauuuugcuuugcuuguuuuggaauguuguaaaaguuuguuuuguuuuaauuugccuccuucugaaagguuggccugcaaaaccaacaaaaccagggaaccuuuagaaaggcuggugaggguccucagcaguuaguuucugcugagggugucaggcugaggcgacggaggugguggaaguaucagcuagaucauuuugcgucucaucugcauuguuaccaggguggacuuugacugaaugccuacugugugcacucccugugcucacugaaagccuauguggcugugggacagaauggaaagcagagaggaagcuaaagauaauucauugauuuuuuuucccccuguaaaauugucuggcuuucuccuuuucuuuuuaaaauuauguggcacugccacaucaggugaguucauugucuucccagaguuaaguacagagcuuccuucugcgaaccuggaauugucagagaaugauccuggugcacagaucaagacaguuucuugccuagacuguggcuucuggaagccacugaacaauuucuuugccauguggguuuugccuuuuuuuaguguucuucccaggcaucacugagaggguccucuucaacaccugcuguuggccaggacucugcucuuggucaagaggaucauauuuuuucauguguucuuuuucuuuucuuuucuuuucuuuuuuuaaacagagucucacuuugucgcccaggcuggagugcaguggugcaaucucagcucacugcaaccucugccucauggguucaagcaauucuugugccucagccuccugaguagcugggucuagaggugugcaucaccacaccuggcuaauuuuuguauuuguaguagagauggggauucaccguguugaccacgcuggucucgaacuccugaccucaagugauccgcccaccuugaccucccaaagcgcugggauuguaggcgugagccacuguacccagccuuuucacauguucuuagugucuuaaaaugacuugccuuuuuuuuuuuuuuggacccuuucuucuuaggcauccuuauuucuucuuugaaccuggagcaucuuaugacauacuucagcuuuuuucuuuucuaugaccuucauagaugggcauaaaauaauuuuuguacugaguuuauuuugccauacugaagcgguguuguugucugggguaauaucugagguucauugucccacagccauggaaaauuaggaugcagacacaccagagugagguuaagaguggaaguuuaauaggcgaaagagaagagcucucugcacagagaggggucccagagaaaauggguugcacuucugcaguuaaaugaagaagguuuuauagaugagcuugaggagaccauuuacauaggggacgaaagauugguuggaccaugugugccauuugcauaguugugaaauagcuggccgucccacccuaaucuuuuauuaugcagauggguucucuaccuggugggcaccauguugccugguccuuacuguacacguggugacaaagaaaagggaacauggagccuccacucugaacacaccuggcuuccagguggcccuuuucuauuggcacagcugcuggcauucaccugugcaagcuuccagcuugcuuaucuaugcagcucgauuuuucaggcugcucuuuguuagaaaagaaaugauuuugaggcugcuuuuccuuaaaagggaaaccuugcugaggacucuuuugccgucacuaucugccuaaauaauuucuuucuagcuccuguaucaauacuaggauugcuauaauguugacauaaucuaaggggucucuccuaccucuaguccaucuuauaucaaauuauaaauuugcuuuucuuauaaugcuacccuucucaagaaccuucagcggcucccccuuuucuuugacuauaauuauaaauaucuccuuuuguaaggaagguccucuacaagaugguuucaucacucuucauguuauuuuuuuggacuuuuaaaaaauuacucaacccagccaaacugggcugcuugcuguucucagaaguuaaccuacauuuucccacuucagugcauuuacuucaaacuaugaccucccuuccugaugaagugaagccccaucugaagugcuacuuccucggagauccuuuccuaggcuccccuauuccugcuuugaacuuccucucuuguggcacaaaucacauuauuugacauguguuagaauaaauuuguauauagaguaucuuuggaagaauaugguagaaacuggugcagugacucuggaaagaggaacccagugacgggacacugugcacccuuuuugaauuuaauaccuuguauauuucccaugagucuguuuuuuuuguuuuguuuuguuuuguaaaaguauuuuagauaacaaaaaccuaaucccuaaagcauuacaagaaaauacuggagaguauguuuauaaacucagaguagagaaagaguccuuaauccagaagccauaaagagaaugauuuuuuaaauauaugugugcacuuaauggucauaucccuauuuggcaagaaggaccugaggugcuuauauuuuuguccuuuuucagagcauagcacagugacccccuacucagaaucaguaaguauuaguugaauugaaauuaaacugaauuacaagucacuucuuugcaguccucacuuuuuuuuuuuuuugacuuauuaugagugcuaggugaccgccaggaucccgcucaaagauucuguggagauguggguuuuauggaaagagauacccagcaaagcaggaguggcuuuagaaucagcagcucuuccccugagacuguccuucccagcacauuggacuuguguguggguccugccugcuuucaggagcugccauggggugcucagcauuaauuaugccacggaaaugaaccaauuagacacaguccaaggagagccagggaguaagucagggagaucuguggcaggccugcugcccugaacaaaagagggaaaguguaaaggcuaaagcaguuugcggagguuucuuuggaaaucuagcuggccagcgcucugaacuacuuggccaaaguuaaagagcaccagaaggaguguuugcguuuuucuuucuccuguucaagacucuggugguggaggagaauagggacaaguuggguccuuagaggggacuuggggggagcuuacuggagcucaucuccuaguuucagagaagcugccagacuucucuggaucccuguggcaccuacccagcuuuguuuuguuaauagcuuuuuaaaaauggcaucuuuuuuuuaguggcaucaccuaaaaaaagaaaagaaaaagugccuuuucuccccaucucaagugauaagcaaauugaggguagggagccaucaucucuuuuccauuugguguccacuccccaaccuggcuggcagucagcuugcuuaacagccauuuguagauuggaaagaagaggcaugggugagagaggcugugagggcacagcugcagggugguguggucugccccucucguggaugagaaacugccuuaucuuggacagucaggcacuguggugugacucucagucacuccaggccugucagaggaaaugagaaaaagaaaacgaccguucuuauucucauacagauguccuugugauauucaggaugggggcagguuauuugucagcaaaauugaauuuccuuuggaaaacuuuuggucuuuauugcauucaugguugccuggccauucuaccucagcccaacauuccaaacagugauucuguagugcccccacuuuuacuguuuuggcugguaauacccggcaguccaccaccuggggucuucaguuuugcagugucaguccagaguggaaucagagguuguccuuuuccuccucagguccacucagaccuuccagauccucugacuuaccauuacugcaacuuaccaggguucccaccauaccuaggcacugccugccaucucccuaacugaccaguuucaagagggcaaaggggagguaaccuugacacccauaccccuuaaaggccaugcagcucaugggguagaagcaaugucugcugguggaaagagcagagguuuagaaucagaagauuugacugugaccccaagccugccauuuaccuugcuguaagcuuggcuaaaagucacuuaacuuuuguggcccucagugucuucuucuucaaaggagaguaacgauagcugucucacagaguugucaggacaaauaaggcgggaggugaaggugcuuuugaaacuaggcaguccuguauaucaguggaaaauguggaauuuaucaugggauagagacagguggugccauugacuacuauagucagagaauggaagaugcacaggggguuugggaagccucccagggaaucuaucagaaauccccucucaggccaagagugcacguuuuuauuauacaauagagucuuuucugacauugauaguggaaacaaggccaacauuuuuccuccuuucacugugauuuauuauguguguuacaggcuuuauuacauaauacaggcuuuauuaaaacuauuaugucuagaucucuauagguucaagacuuuagagucugccguucauuuauggauggaauucucuuaaggcaugguggggagggagggggaaauguugcaagcagccacuuccccuguugccaguauacuuccccucugucaguggcaaccugaguuuccaggguuugguuaacaguuccuccaaggaaaggguuauuuccuccuccuguguuuccuguagaggccuucagagcugcgucacugagagcagacuccuacuggauaccucaccacuguaccccugcucucucccugucuuugcagugugcccccuaccaccggagccagagaaugguggcuacaucugccacccccggcccugcagagacccccugacagcaggcagugucaucgaauaccugugugcugaaggcuacauguugaagggcgauuacaaauaccugacguguaagaauggcgaguggaaaccagccauggagauuagcugccgucucaacgagggucagucuggcagaugaaaaagggaugcugcugggguucugcuuucuguuaacucacaggaugcaaagcaugcuuccuccagagcacucuuugcuguggugcagcccagccccaguugaugcucugcagccucccuuccuugggucuucaugucuuuguggaagauacuugagguugcuggugcauguccuauugcauuucauugagccaucugcccugcucuguaaagcccguuugauguucaggaucucuuguuugcauggccaaguguuggugacccuugaccauguucugcccucacagugagcacaaugcuaauaccuucucuaauguaucguccauuucauuuuuccuugaauggagcuacagaccagcuggacaaaagaccucccacccuuacugcuuccuccugucuugcaugacaggaaaauccaccugcuugcaggaaagugugucauauaaccaucuuugugcuucccacucaggcuucaagaccagagcauguuuaacccaugacaccccagaaaugggugggaaccaaccugagaguuacaauuaaagcuguggaucuuaagacaagguuuuauuacaguccaguuucuguaaauuaauccugccacuugggaagaacauagguagaacuuaagaugguggaaugacaugcccaguuaaauugucgauguuuacaaacuucaagcuuuugaggaugggaucaaagugguuuauaaagguaaaaucucuaggguuaagugaguuuaugugucagauggaccucaaagauuggaagugaggggaauuuuuuauucaggaaacaggauagggaaaugguccuuuuccaaaagaacuguguauacauaggucauucuaagcuguuauuccugaaaugacccugaccguaggaugucuguauugcaccauucaggaggcauuugacaagaucagcuguggggcccaucagcuguuuuguguauuuggguacaaaacccuucugaugauggcuuguuuuuauagauaaagacacccacacaucacuugggguccccacgcugucuauaguggcuucuacugccagcuccguggcgcucauucuccuccucguggugcuguuugugcugcugcagccaaagcugaagucuuuccaucauagcaggugaguccaguggcagagcugacaugagacaggcaggugcaagcauuacugugggggccagucuuugguggaggguugcugguggccccaaucucugugggucuguguguguccagggaguggggagggcccugccaugugucaaacuccuagaugugccuaccauugugcuuauugcuuugcauacauuaucuuaauccucauaggaacauugcagaugaggaaauugaggcucagagagguuauucacucaggguuauaccucuagaugacaacagagcucagaacugaggcugcgcgcgguggcucaugccuguaaucucagcacuuagggaggcugaggugggcggauugccugaggucaggaguuugagaccagcuugaccaacauggugaaacccugucucuacuaaaaauacaaaacaauuagccgggugugguggcgcgcgccuguagucccagcuacucuggaggcugaggcaggagaaucacuugaacccacgaggcagagguugcagugagccgagaucacaccacugcgcuccagucugggagacagaguaagacucugucccauuaaaaaaaaaaaacaaaaaaaaacggaaaucuguucaauuccaaagccaugucauuuccccuacaccagucguucucaaagcgugguuccagcagcgucaggaucauggaacuuguuaggaucaaccaaaugagaagcucuaggggugaggcccagugauauuguuuaacaagcuguccaggugauuuugaugaacacuuaaguuugugagccacuauccugcacuccugguucccagucccggcugcaauauagaggcaccugggggaguuuaaaaacaaauaucaacacuugggccuccauucccauucugauuuauuugguuuggaauggaacccuggcauucacuuuuuauaaaaagcucaguuuuucugugcaacuaggauuuagaaccacugcaccacacuaaggagaaacaaaggaaguggauuuucuugccugccuuuaucaguuuccuuuuccagucuacugcuuuagccacaaguugucuaggggcgaggagcaugaagggcagagcugauggugcuggcccugaguggauucccgaugauggacuuuucuuccaggccauuguggcuucugcaguuacuuggcccuuccuggcaguuccucauucccucuugaggaguaacauuuuuuauauaucuucacaguccuucaucagucacuguuauaacucacaaacauaaagggccaaaguaaacugcauucaguaaaauguuccaaauuuggauuuacagacaaggaccaggcuagauuuaaucucuguguacuaugugugauuuucuuucuuuuauuuuguuuuugggaagaggcuagcaguuauuuuuaaaggcuauuaauuaauaggaugaagaggauuugaaggggauuguuuacuugaaaugaucagcuauuuccaccuaaagucaaacugaucaguucugcaucucaucuaaaugagggaguuuuccccccuauaguuaacuuguaaguuuguuaaaaguaacuggcuaguuuugcuugauuugaguagaggggagauuugguuuucauuguagaccccauuuaaauuuugugcuguguacauauauuacuuuuuaagccaaacacuauuuugaguaacaaaagucaagcacaugccaguuuacacacugcuuucuuuuuuuucuuuuucugagacagggucucacucauguugcccaggcuggagugcaguggcgugaucacagccuacugcagccaugacuucccugggcucaggugauccucccaccucagccucccuaguagcugcaaccacaggcaugugccaccauacccagcuaauuuuuuuguauuuuuuauagauauggguuucgccacauugccaggcuggucuugaauccuggucucaagcagucugcccaccucagccuccuaaagugcucccaucaaacuuucccuuccuuccaaaaaccucugccacuucucuccucucagaguguauguagcacagauuuuacugccaagagcaggugaggaaauugagaacuacuaacaacaaucuagcaacaauaauauggucuagcagcagaccaucuauauuucuugaauugaugagcugaaaggacacagcaucaccuaggauuggccugaauccaaugcugaggaaacuauuagacaaguccagauugugggacauucuuugagacagcuggccuggacucuuuaaaaaaaaaaaaaagccaaugucaugaaagaaaaacuauaguggacuguuuaacagauuaaaugagaugaaagacacaggacaauuaaaugcaauacaugauacuuaauuggguccuggaugaaaacaaagaagacugcagcugaaguagauauauuuuuggauaguuaggaaaauuuguguuauuguauuacaccaauguuaaauuucugggaucugaugauguaguuguaucagaaaggauacucuuaggaaguauauguuaaauaacaucuucaccuuacuuuuagaugguucagggaaaaaaaaggcauguuuauguguauaacaaaagugauccccaaaaaagauauccgcaugaauaagccucacacguaugauguugaguaaaagaagccagaaacagauauauacucucacaaauuuacuuuguuaucccauucaaguaaagauuaaaaauaugcaaaacuguccaggcacaguggcucacgccuguaauccuuugggaggaggaggugagaggauugccugagcccaggaguucaagaccagccugggcaacauggagaaacuccgucucuacaaaaaauuggccaggcgugguggugcaugccuuagucccagcuacuugggaggcugaagugggagcaucaccugagcccaggauguugaggcugcaguagguugugaucacgccacugcacugcagccugggcaacagaguaagacccuuucucaaaagaaaaacaauuuuuuuaauuaaaaaaaaauauaugcaaaacuaaaccacaguguugaaggauucauguuuagguaguagaacuguuaaaauaaaaagcaaagaaaugauuuuccugaaagucuggauagugguuacuuuuuguggugaggcaaugggagugauuuugggacaggugcaaagggucuagguucugggcaguguucuuuuucuugaccuauauaggaguuuuauaccaguguuacuuuuggaguaaaucagcuagcuguacacagauuuuucuuguguucuguuuucuguauuuguguucaaaguuuuuaaaaaguuuacaaacuuuuaaaaaaagcaguauggcugagucagaacaaaauuauugugauuucuaguccaguaucccacacuucccuguuuuuuaacagcuuuauugagauauauuccacauaccauacaguguaccuauuuaauguguacagugaagugguuuuuaguauauucacagauauaugccaccaucauucucucacuuccuuauuuuagcugugcugaaugaaugccuuuauuucugggucucuaggcuccuaguuuuuccacaggguaaaagggccaggugccuguguacccagagguuaagaacacaguuuuuggaggcugauggaaccggauucaaauccuagcuccauccuuuaccagcugugugauugagggcaaguuaauuaacuucucugagccucauuugcauucuuggugaaucccuaccugaaagggcucaggugagaauccagcaugauaagguguuuaaaauuccuagugcuuugccuggcacauaguaagugcucaaaaaugguggcggcugcuauuauuauuaucaugccuguuucucuguguguuuauucuaauucauccuuugucuuuuccuccuccacuccaggcgugaccaggggguaucuggggaccaggucuccaucaugguggauggaguccagguugcacuaccaucauacgaggaggcuguauauggcaguucuggucacugugugccaccugcugaccccagaguacagauugugcugucagaagggucugggcccagugggaggagcgugccaagggagcaacagcugccggaccaaggggccugcuccucugcagguggagaagaugaggccccaggccagucuggacuaugugaagccuggggcucucgggccucagagacugugauggugcaucaggcaaccaccucuuccuggguggccggcucagggaaccgccaacuggcacacaaagaaacugcagauucagagaacagugacauacaaagccuuuuaucccucacgucagaggaguacacagauggugagugguccaagcugaacaugaauuauuagcugcuuaggguccuugcugggagugaggaaggacugugagccuuucuaaauaauugguauauuuuuagcaaaaaaaagauaguaccugggguauuugccuacaaaauagaauuucacccucagaguacugaguagggcuuugggcucucuguagugagacuuuucacugacgccugugaauucugaucguuuggagucucugaggccauucauagucacagagccuugcuaaaucaaaagacagcuugcuggaguuggggguggggucuguccucuuguuauaaauguuauguuccugaaaggucaggaaugacaaggaggcauagguuauuuuacagaaaaaugagagccucuccagagcagacagcugcugcuuucuaaacaggaguguuccggguacuaugcuaguuuguuuucuugcacuaucucaguuaaacaucacagugauccuaagacacagguauuuauugacauccccauuuuacagcugaggaaacuaaggcucacagaagguaagucacuuggcccacugguaaauggcugagcugggauuugaagccagauucugccuuccagguggcucuagcgcccuuguggcaaacaaucauagaaugaaauuacugccuccugauguuucugccuuugccagaggccaguuuacccugggcuugagucugucacuuugaaagcugucuuuaagguaaaucccaauguaguucaggaugagacuaacccuagaugccccuuucuauagugaagacuuguacacucagaaagccucccuaaaagagccuuagaggaaacuuuaugcuuccuggguauccugggcauaguaaaugucuaagguuuagaauaucugaaagcaaagaaguuggaaauuacugaaagcagaucauguuuauggagcuuccugguuaucaacaucuugccuucguuuuucuugguuggccauuaaaauaguugacccagguuugaaucuggaagccaguaaccccacagucagccagccacacauauugugagauguguguaaguguauaucauagcccuuaucuucccaaggagccaagguggggcccuccucuuccuccucuuccaugcuaccuagcuuuguuuuuuguauuuaacaagcauuuugagaggccaucuugugccuaaugcuggauuagguuucaggggugauacagagaaauaugaaaugugcuaucuuccugcauggaguaucagccauuugggaagaugguggggccuauacucaagaaauaauagaaccaggaauuguagugucugugucagaaugagggguucagaaaacaagacacauuaagucaguaaguuccuugcaggccaugccugagcuguuugggacugauaauacccuaggaaguugggagcuugaggcccacagcauaugaagaagcugaaaccaaaagaagggaagugauuuauccaaagucacacgacuggcagauggcuuuaggaggcagugggacuucacagggcuuuguagccucauaggguggaauuaggagagaaagggaagugacuagaccagcagagcuaaggcagagaggaggaugguuugaauaccaggcugaacauugaguuuuuuucacauaggcacugggaaagauaagcuagaaagucauaaaaaaggagguagggaguuuuugccuaccuagaaguguaugagugggacauuuacuuucuuuaaauuaggggcuauguaggauagccccuaaguugcaguggggucgagagugcucuagaguuccacacaagguaaccacugugcuuuucuucuggucuuccugcagauauuccacuguugaaagaagcaugagggcagcggccagccuuuccucucugcgagguucucucagcccuuccucccucucccugugggauugagcacccuguacucuccagccaccuuaccuggauaccugagcugccaccuguguaucuguguaucucugagggcccuauaggcccaccuugcuggaaacucaaggaagauucucgccaucugccuguuggacagcuggaggagcuggcucuuugccuggccccgccuucccaucugucagagacauauuugaaugugcuggaucaaacccucccuuuuccuaagccucuggguccccuccagccagcucuuuggcggcagcccccaccagcuccugugggccugagugcugcuguguuuacuugugccuuucccccacccuguccaguuucccugucaugcagacuuguugcuguccacaagccuuaguggcugcacugcugcccccugccacacagggggccgggccugggucuguccuguuuccuuugaggguugccccuacugcccuuugcaggaacagauccaggugugagagcucuugagucaagaguggcagaaguggcucuaauuggggugagaguguagucccugggcuugcccuggguugacccugguggcauauuuccuuggcugaggauggaagauuuggagaaucauguccaugcuggcccaggacccagccaucuggcccaaaggcacaagcuccuggcccuguugaguugagaguuuccaagaagcauccagaagaucccaagggagagaaggaaaauggcugauaaugauugucuuccuaauaugcaaguucucacuuccuacuuccagcaucggccuuccuggccuugucuuuuuuuuguuucccuggaguauaaugggaaguugcaugcugccuccuggguuuuaucccagauagcucuggcuuucuugcugcccacaggggccuggggcaggaaggagacuugcugagaugccauggagugcccaucuggucacuggcagucugggcagguugccccuuucuggguuuguggugacggaggggaggccgagaggcacagaccaaguccccggguggcugcaggcagcuccagcccgguccugaggauccuccucaccauggucacgugccuuaguaacugugcccaggaaguggccugcugcuugcugugcugcugcuuuuccuacuucugcccuucccugccaccccucgcaugucacagcugacaagcaauuccuugucuucccuggcccccugggggaagggcugagaaacaguccgugugcaccccaaccuuaauggccugaggugggcagagggguguggagcagccuggaguacagggcccugggggaggagcccacugaugaggggcgcucucccauagccauguguugaaugcuaacuaggcugggguggacgaacucugccaacugcugucaucuuagaagauagaugcagcaguaaggaauguuuguuuugcuuuuuucugaaauuuucugaagcacuguggcugggaaacuucgaagcggacccugugcugcaugucugcuccuccccugagccugucugcuugggggugguaaaaauaaaaaucccaguuuauuuucaguaccuuaccuaacaggguuggcuccaggcguggguggccuagaagaugaggggaguggucuucucccagccuuuuacccucuugccuccugccuccgcgcuuacacacgcacuuuaccacccggucauucccuggccucuugcugccacuuguagucuuccuuccuuccucucaggguaagggcagugccugcugugccuguuggccacucccacacuuccccucccccaggagcccucaucugcugugcugaguccaggaaagcauaguuagguagggagcugguuggagaaggugcuagaacuagaaggcagaugagacuagcaugggcccaccuggagggcugucccuaauggccccagucgccuuaccucacccacagcagugcccuugucuuccuccaaaacagaaagcagugacaaaagggggaggggugguaaucugaagucucacugcugagccuucagcuuuuauuuuucacuguuucaaaacccgcauucuauucuagaaugguuuuuaaaauggaagaucuuaccuuuuucuaucuuguuacucugggguuuugucccccuaagagauugcacuuuuuguuugggguuuauucagcugcauagaugaccagcuugaucccuggugaaaugaaaagccuuccuucuccugaagccucuuuccgcccugcccuccacuaacaacacugaggagcacaagcccaggcuugcccaccugguaggaaaggaagaaauuagaacaaugggagccuuggcuccccucucgucuccuccccuccuucuugucacuggcuuugaugaggcccacuucccagaggcuccugggccugugagugcaggagcucauucuccccucacugcugaagucugugacagcuucuuccuccaguuaugucuuucuuccaaagcaauuucuuaaccaucagccaugugcugcuauuucuagggcuucugggcuuugucccuuacugagagauuagggacuccacagcugccuugagguagggccuggcugagagacaaggguagcagcagguggcaggcuguuaaaagacaggcugccugaggagccuggagcagguggaaacagguggaagaaaccggccacagcccugcuuuaccgggcucaccucuagggcauuccagcaagaggcugaugcaggagaauggccagcaccaaaggacauuuaaaagaguuuuuggguuuuuuuguuuguuuguuguugguguuuguuuuuuuuuuuuuuuuuuuggcacacuugagcugacucagugcagguuuaauauccuggugacuugcagucacauucuaaugacuuucaagggccagaauauggugaaaaucacuuaaaauauccgucccuuccaugccuuaguuuagcagguaggcucuaucuuuugccauuucuguauuuuaugugcuguguucccguuucacuggguaugaacugugaaaucgacugaauccuggccacuuuaugaguuuguuugguuuuauaaggcauuucaauguacauucuauaaauacaagcacuccauuugcaaacagaucuuaagcuaauauuuucuuucccauucaucuugcccucccccuccucccgccagcuuuaaaguucaguggagaagccagauggcaauucagacaaagguauacucuuccugcuucaugggugguggcacgggaauagauagcccuuagcccuuucccucccagucccagcugagcccucagaccacuugcuucccacauaacaaugucgccuccauuuccgaggaacauccuugcguagagaaugaaauaugcugcaaucauuucugcauccuuacuccucacccccaaagaaaaaaaaaaggccuagcagggaagcagcaugcaggcuucacagcuuaaugccaaggacagcgagugaggcugggagcuucucuugggccugcugggucugucagcucucggaauagggacaguccuuacuggugccccaaggugggacuuggagaauauuuugcuuggcauauguuuggucugaaugguguaguugcugguucccuagagaggaaaagguggcaggcccagcuuugcugggaaauggcucuuaauuuccaguugaaacccuaguagaauugugaaugaaaaccucaagguugagccccucugccaagcagcagagcuaguagaaggggaugcaggggcaaagcacucaguugccaagcaaggaggagagauguacgugggcuguguggcaguccccacacccugcccuggcuucuucagguuaucgcaccacuauggaauccuuugcagaaugguacucauauaaugguuuaaaacaacacauucauaauugacucugugcaggaugucacucaaucaguuuggguuugcuuuauuuuauuuuauauauauauuuuuugguauccuguacauugcagugggugugaagauaguauuuuaauauuuguacaaaguuuaauuuaauuuuaauuguucuauguauauaacugcauuucuaaauaauuaaaaaaaaguucuuaugaaggcaauucu

SEQ ID NO: 17089 - RNA, 1356 nt, Homo sapiens
uucaucaccaucagagugaggcaaagauguauccuggccuaguuauaaagacgaauaauacaugauaagaaaucauuaauuuuuuuccacguggggggcggugcuguccuagugauucauauauauauaauuuuugacuccuuacaauaauucugggauguggguauuacccccauuuaagaauguggaaaccaaggcucugauggcucuguaauuugcccagggucacacagcuaggaagcaaguugcugaucugcuugguuccaaagucaccucucuuuuuccucugagcacauuucuaagccacuacuuagaagcucuugagauaaaguuggccuagcucagguccaccgagguuuugagauugcccuuugcccaaggaggaguuguguccuuggcucaccugucaucugccugugacuggacuugaacccucgcacgucucagcugacauccuugaugcugcuggcugccuuccucgcccuguuuccucuccaugacuccagggguuugaagcacacaggagcuggacaugucaauucuguagcucuucucccaauaccacugaaggccgugagccucucuccuguuuccagccugcaggugcccuguugcugcucuucauuccagcuucuccucacuuuucucucagucucuugagcuuggaagccuuauuguagcuugugucuccucccugggcacuugaggucaggcuuuugccuuuuugucacauugagccacaugccuuugauacacaguuguagcaaagaagggaggugaugaacuugcucacuuucuuuucugauuucccucccuacucauccugcacuccccaccgaaacccagauaucuuauagucuaaggcuuguagaggauuaaggaaaggaauuggagauggguuuuacuuaguucacagaaaagcuuucuuugggauuuuuccucccccuuagggcuuuuaagucuaggugaagugaaaguucacacauguguuuguuugguugcucuguaauuagcuacuaguuuuuaucccuagaccuucucugcuccagugucuuguucauguguccugaccccguguccuugaauucccacuuugcuuugggauuuaaguuauuguauguugucaacaauauuuaaagaugaaaaaguccugaaggaaacuuaccagguucuuuccuuuggcuuuuuuuuuuuuuucuuucgagguacuguaaauuguuaacuagggaugccaagcaggcuugguucaauggcuaaaccucuuauuguauuacaguguaaugcugaucucagccuggucucaaugccagagcacacagagacuugaauaaaacuguuauaacgauuaccucuggu

SEQ ID NO: 17090 - RNA, 3657 nt, Homo sapiens
gggaauguggcucuuagcaugccagggagugaaaaagccuccguucacuuuagucccuucugaaaucuggacgagagaaugaaugaaguucauucacuucuggaauucaaacauguuccaaagagguuuaagaggagaaucuaaaggagccucucugccauaaucacuucccuucuccagagaacacacacacacacaagugcccucagggcugcagagccagaaaggcagccagagaacaccaaggaaaugucacacccagguauagauccaaaguuaaaagcuccuagauguuucauugcuguaagccuacacacuccuauuuaaaugcgagcaccgccagagagccacugccucacucaggaccugaggggaagggcaaguaaaaauuuaaaacguauuucacagugguaccuaagccccucucacagguccaggugaggggcaggcagggcuggguauagaguggagugaggcccucaccuuggguuaaaauuuaaaggggugccaaaaaaaaaagagccucaguaaucaagguaaaucauauugcaaugcaguauuuuuuaaaaaucagaguuauugaaaaauuccacgaugaauacaguaucaaaauuuuaagucaggcuuugucuggguugguguccaggugugaaggaucucaggaacaggcagcacacuauuucugaaaccuggccuuggacuucagugagcgcagggcaaggaacaccacggcccuggggcccucgcuccccagggcuccgcuugugacuacucugaccucuggguucagaaugcccagacgucuaucccucauguuccgguaggagaggccugucugugcaccccuggaaugguauucugcuguccaauccugagacaccuaacuaguuagacaccuaucucgauagacaccugucauguccacaucugccaaucagccuaguaaaacuaggugaugagugcuuucaaagagggcaggucagaccagacagguaggaagaugggucaggugaaaggcaggucuguuuccaaggguuaacaaagagagguguggaaaagcucagcuccuauaaccagcugggccccaaagcucuucucucuauccagcucaaggcccaaagcaggcuccccguaggggauggggaaccacagacaguaagaaucaggaaggaccagucccaccggcuccugaucauggagugagcccaacacgaagagcaaagccagggcucccuaggcagccuacagaggcccccguacuuccagggcccaagacgggaaauggaugaggaagcggguggacaugacugucaauaucucaucaggacaaaaugagaaagagcagucugagaggaaguccauaagagacucaccuggccugcacggcuaaccauaagucccgggcugagucaugauaauuaggcaccuaaacccuguuaauuagccuuaaucggcaggauuucagcuuccuccuccugccuuccaacaccagcaccugaguggugagcacccacccagguagcaaugccagggaaaagcccaggacugagguccucuccagaaauagcaauggauuuuccuuucauaugugaauuuucauuaauuugaauuccuaaucuaggaauacgcugauccgacagaagagaugcauuugguaaugcguuucuaacaauaguauaccuugacaaagacaagucauucucagaccuaaagccaaagagagaggcagguacauuagggugaaccauaugaaauagcugauauucgacuguuuuugacguaaaaccguacguauauuucacacacacacacacacacacuuuucugcaccaagggaagcaaucuggcaaggcugcaguuucugugcaggacucauggccccaggaccauacauuugaaaguuagaagggcuucaggagggaaaguagauagcaucguccccaguucacaguaggcuucugaaguccagugaggggaaaagauaugugcaaauucacacacccaggaaguaggcagcuuuuaucaccagguuccugccaacacgguuucaaccccaagguguaccauucacagccauccagucuucagugcccucugcucuuugcuuuguuaaaagugagcuggaugaguuaggauugcucgggaggugucuccuucacacaagggaaggaggagggagggaggucuccaauguggggaccacagaggcaagagaguucaugaaaagucaggucuagauguccuugggguaucucauugugucccugagcaacaguagccugagggaaagggggcuuagugaccaugacacaugucccaagaacaaggggacccuuuuccaaagauucuuccaggaacugggaugaucccaggcucuaaacaaaucagacugaugaccccaagaaaugagagacagccaacugucacucugauguugcuaccaaccucccucucucauuuccuucucuguaagacacaaccucccucucccauuuccuucucuguaagacacaaguggugaggaugacauuggcagacagcaucagacaaguuaagugggggaauuaggaaagaaugcuugucaacaccagaugcuauauaaaugcggcagaagggcaugggcccgaccagggcccccauuagucaugcucaaccaccuccaaaucacuccucuuccagaagccaaaggacgaaagaaaaggcaaguucccucaaggcaaaggugaugagagccacacucucaacuucagcgauucauccuguauagaugaaagaagcuuccucuaggagcuggcaaggagcuaugguguuucacugaccuucucugauacauacacccaacucccuugagaggaaagcaugugaugauugcuuuuaaaggaaggaaaucugagaggggcuaaagagacaagccuauggccacacagcaaaagcagaauggggaaugcagccaaccuguucaguucugagcccaguggccucacucagcaauuaguccaagccacuuuuucauuucucuucacuugaauuuucaucuuuaagcauuuccccuucucuacuagcaaggguaucaaauguacaaggaaaaugaugucauuuugcaaaggucaggaggaaaaguuagcacuauucugaguuguccagauguaagauaucauuguugcuauuacugcuaccaccagacccuagggaugccacaggaugccaagugaagaggauccgccaaagccucucagaaauaacauacagauaacugagguaucuacucagccuccuggcagcagucuggauccccaagagggucaaaaggggauaauccgaaucagcgguaggagcugaagaauccaagaagcaggggcagagagcaguaucuguuccuauuaccaucuuccaugaaguuagcaccugccaagagcagaaggaacgugucuuugugcaaagggaaggcagaggaaaggggggccggcuacugccacucaaguggcuucauccacagcuccagggccugcucccgaccaggaccacagaacaagggaaccugagcgaauagaaagccacugagaccugcuacuacuauacagauccuuagcccaucuccaaccuugccccacugagagagugcagcagucaggggcccaucagagaccagguguguag

SEQ ID NO: 17091 - RNA, 2195 nt, Homo sapiens
auugagaagaaucaaugauuuuucuccucucuuccccucuucccagggagugggaaggaauccacaaaacuaaauaguagaacauacgaaauuauggagaagcaaaaugacaauaaacuuacccaauuacucauaauccgacuacuuagagacccacuacugacauuuuucucuuuuuaguacuuuuuuuccuguuucuguuuugcugugugucuacaguuuguaaaacuuuuuuucccucaaguuaaaaaaaauucuuuuuuuugagacagggucuugcuuugucaccagauuggaaugugguauagcaaacacuguucacuacagccuugaccuccuagguucaagcaaucuuccugccucagccucucaaacagcugggacuacaggcuugcaccaccaugccuggcaaauuuuaacauuuuuuguagagauaggggucucgccauguugcucaggcuggucuccuuccugggcucaagugauccuccugccucagccucccaaacugcugagauuucaggcacgagccaccauacccaguccuaaguuaaaauuuuaucaagacaauuauuuucuuauggccuuuaaaaaaacacaauauaccuccauccccacucccuugcucucugcugcuugacaguggaaugguuuugucuaaaacaaaaccuagauaauuuacucagacucauccauaucuuuuccaguucauggauccuauguauaauaggaaucugagcauuguuuuaggucuuuacuuaaacagaaauccuuuuucaagaccuacucuggaugcuuuuuagaacaagccucaucucucuucuucaagaccucaaaugugugcuaugacuauacaguguagucauauugaugagcgaaccacagaauguucaaacuaugaggacacaggauaucuuccaguucacuccccucacuuuaagaguacaguguuaggacaccugccugaagucaugcagcugccuaguuaucuuuccaaauugccccgcugucuuuaguuuguguaauaauaaaccccaaacuaaaauucaacaaaagcacucacccuugcuaaauaaaucaugucuauuccuaccacugaaggggaaaagguaacaaaguuugguagaaguugggcuagauccuucagcacuggcuuauuuagaaauuucagaggacuaggugagguggcuaaggccuguaauccuagcacuuugggaggccgaggcagguggaugacuucagcccagaguucaagacgagccuguacuuccagcuacucgggagggugaggugggaggauggcuugagccuaggauguugaggcugcagugagccgagauugcgccacugcacucuggccuggacaacaaacugagacccuggaagaaaagaaaagaaaagaaaggaaaagaaaagaaaagaaaagaaaagagaaaaaaagaucagagaaccuuucuuacuggaagucaacguugccacgacaggauuaaagcaagaagaaacauuaugggccuccuaucucguccuuaauguucaaaacgcaggguauagcaaagcauauaggaagaggucguccucacucgugaacucagcaucggguucuacguuuauucugcuuugguucuucuuaaucugaccucuauagacuucgccacgauccaagguguaauuccaacaggcaaaagaagucuaaggauugucgaaaagguggcucccuucagacagaccaagcccaauucauggcagcguucccagccccaguuugaagcucaguaagguggucucuugccuuucugaauucugaaaaaagagugguauuggaaucucuucuuaccggaacccaggagagggcgagcuguggugcaguccucauaaaggggagaacuguaguuuucagaguucuaaugaacaucccaaugggccuaaaaggcuucaauaagagaugaaagguuccgggugagagugggcgugggcgaagcugaucccucuaggucggacuaaggcagagccagauccaagagggagaauccaacuguaaaagggaucuggggaagaaagagcucuguugggggugcagccggaugaagaacaccggugcugcucagugcagccccuacccauccauggcaaacaaaggcagcugccucccuuccagccuuuuaguuugaaugaaggcucaguauuaccuuuuagga

SEQ ID NO: 17092 - RNA, 24953 nt, Homo sapiens
uuaugggaaaacaaacuaaugcaguccagggcaguagauggauuucauucagaagagcagcagcuucuacugcaaguucaacagcagcaucaaccccagcagcagcagcaucaccaccaucaccaucaucagcaagcucagccucagcagacaguaccucagcaagcgcagacccagcagguucuuauuccugcaucacagcaaggugagacuggacuuguuuuccuacuuaugacuuggaaauuaaguuugucauuaugaaagaagagaaauauucugcauuuuuuggaucuugucuuuuaaggggcacauggagaaccuaaaaauaaacaaaaaccccucuguugauuucgggcuuuuuccccccuuucucuuggcugagggauguguauguaaauguauauaaauuuguauacaauguagguuguaucuguagaguaaugguagacaaguaauuuacuaauugaaagccuaagauauucagagaaguuauauuaauauuuuguuuugaaaaggcuauauagugauggauuuccuaaguuaaaucuaaaagguuuauuuacuaagggauuuauuauuuuauaugguacaauaguuauuugcuuucucuauaaaacauguucuuucaaagacauguuucagauuaguuuuuaaaauauaucuuacauucuggaguuuuuuguauacuuuggcaaucugaaaauucagcuccauaggaauuuauguaagccuaaauggacugaauuagauuuauuuuaaguuaagaguggauauauaacauaucuuaauuuauauuacuuggauuaaagcuaagaaaaagcaaauauucauagacuguguccauagugccuuguacucugcaagucauuuuauagauacuguuucacuggcaucuuauaagggcuuuguaaaauagcccuuggcucaguuuuacagcugaggaaaaucugagcccagaaaaggcuaagaaacuugaucuguauuuucucucaugacaaacaucuauucaguuauaaaacuuccugagcauucuaauucagugcaucugcuuuuaugggagaggacacuagaaguaaaugaaaaguucauuuuaauaucauuuaguuacucauuugccucauuugacaguauauauaugugucuuaaaauugguaaugacacacaguagaagaguauuuggguuauuuuacuguugauaucuagugguacuuuucauaccuaauuuuaauguguacuuuguaucaaauaauuuuauccuuuuauucuuuuuugaugacuguucuuccuguugccuucagaccuggcauuaggauuuuaggucaucauaaauuaaaauuugauuuucuucacucagagaauauuaggauaauggaguuaucuguucucugaaauuugcggaaucaaacauguaauuccuuuuacgcuuaaguaacauugccauuauuucugauuuguauuuuuuccgacuuuugccgguuuaccacucuucaggcaaccuggugguccccugcuuucaggaggccaccauauugaugccgaacuuauuuggacaccugaucagcauagcacauacagcccagaacuccugggcucaagugauccucccaccuuagccuccugaguugcugggacuacaggcaugcaucccugcacccggcugauuuguauuuuuuaaacagcugaugaaaguggcaugagucugucagcugucauauuuggaagaaaaggacuauguagauuucaaaaacuagucacaacuuuuugagcuuacuuuuauuggauuaguaacucauuguaacagugguaucauuguaucaguaaaacaguuaaccuugaguuaagacaaaauuauguuugaaaauguccaguuuacuuaagaaugcauagaacuauuuauguuuagauguuaagguaacucacuacuucauguuccuaaauucccuugcauccuuaggaauugccacuuaauuuuuuuuuuuugauauggaaccuugucacccauguuagagugcaguggcgugaucucagcuuacugcaaccuccaguuccggaguucaagugauucucaugccucagccugacacccaacuaauuuuuuuguauuuuuaguagagaugggguuucaccauauuggccagucuggucuugaacuccugaccucaagugauccacccgccuuggccucccaaagugcuguaauuacaggugugagccaccacgccugggcuuaaauauuuuuuaauguuuucuaguauaggguggguauaucacagcuguuauuugccauauacauuuauaauguccugagaugaaaugauugaaagcauuugagugcagaaaacaugaaaaacaugaaaaaaguuuucaucauuguauguaaaguguucuugugauuauaaaauagccucaugguuccuuguuugcauguucgcuuguuuuuuuguagccacagcaccacaaguuauuguuccagauucuaaguugauacagcauaugaaugcaucaaacaugguaagacucagaauguagcaguuugauuggcuguacuuaauucuaacccacauuguaauuaugccuauauauguccuauauuaacuacuugaaguuuauugaagacucaagcaaaacagcuguuuuaguuuccugaauauuggaucugaaguuuagcuugguaccuagacauuaagguucauaaaauuacggaauuguuuaagaauaccaaaagaauggugcuuugugagaguuauuccauucccuacuauuuccgaaaaaguuuuaggguaccuaccaagcuuauaaugccaaguaugguucuguuucaggagaccuaguaauugcaagagggugggaaggcuaagaauugugaacuuuuaaaaaaugaagauagacuggauaguucaguauaacuauuuuuaaaaucaagcauuuaaaaauauuacucugacuuaaccauaguauagucuaauaagucauuauaguguguaaauuaccacagaauacauuuuaaccagcugaguuauauuagaauuuuuauauuucugaggacuauccacuaaacuuuacaaguccucacucauauuuucaaauuacauuucagacauauaauauuucucaacaaauguaguauagguuaacuguaaacuugaaagaaccucuucagauccuuagaaaaucuuuaccuauauccuugaaguuguuuuuuguuuuuuuuuuuuuuuuggauaaaacauuaaaauauagucagauuagaguaguucaauacuuccuuauaaaugguuuuucuuuauucuguuuaaaauauacagacuguugauuucauugaguggugacucagcucuuacauuucauucuucagccaaaacuuuuauuuaaaggugaaagaaucaauauuuguaaaaagaucuuuuaaccuauguaacuaguuaguacuagaaaugagauuuuuuuuucccuccguucaaguuuuuuuuuuuuuuugaagauggagucuuacccugucacccaggcuggagugcaguggugugaucuuggcuaacugcaaccuccgccuccuagguucaagugauccucccaccucagccuccugaguagcugggaguacagguguaugucaccacaccuggcuaauuuuuuuguacuuuuaguagagacaggguuucaccauguuggccaggcuggucgcccaacuccucaccucaagcgaucugcccaccucggccuccugaaguguuaggauuacaggugugagccaccacgcccagccucaaguuuuuuuuuaaaccaaaaagcaguguaugaaaagaugaguucuacuuugugagugauacugaaucacaaaguucauuugugguuuauaagccagauaagaagggcuuacccacuagacagaugacuuccuccuacacauuaccagccucacaaauucauacuguggcagaauugaaaguuucuacaugauaguagaaauugcaguuuuuaaauucacaaauaucgaggaucucuguuuguacuuguaguugcaguuucuagaaucuuuucguuuacaugaaaauaaaaaauuucaugccuguuauuucucacaagauuuuuuauuggaaaaaacuccauuuuaagucuaaggccccaauuuuuuuuaaccuccacccuuaaaaaaaaaaaagucucacuauauguugcuuauuguaguugauguuauuaagacuauauccuagggaauaacucacauuauuuuaaaacaaauuuuggcagagucucuugugguaggccccucuaaaagaauuuuaaauguuguggaagagaauuuugaauuaguaaguuauuucugggauaaaaauuagugguccaucucuuacuuacugguuaagucuccuuuauucuaaagagcauauguauuuaaacaaaucauaggucaguuacucaggaaaauugauuuaacauuucuguauauuuuacauuuuacuuuguuguuuuuagucaguguuuccuucauguauuucugaacauaaucaguauaggcucuguaccaauaaaaguguuuuagguuuuuguggguuugcauuauucugauuuagaaauagcaaaaauauauuuguucuuucuaauggcucuguuugcauuagaaaugaacuaaucauaaaaacgugagauaauauaguagaaggcuauuucagggaacuucuagaaaaccauuguuuucgguucuuuuuuaugaaaugauuggucuaaugcauuauuuguguuugggcuguuuuguggaauacaagaagaaauuuuaauaguuauuaaguauaaggugguuaguguaugguacaugacucagcaaauauauguuaugcagcuugaauuuguggagggugugcagguaguuauugggucguguauucuauauggaaacuacuaugucaguuugcugguagagggagaauugcugucuuucaaaauaugaauuauaggcacuuaauauuucuaaauauuuuuguuuuuuucuuuuuaaauauuucuuaauaguauguggugguuaauauuuuccuuaaacuuagauaaccuuuaauuugcuuauauagccaaguuuuauuuuaaauuggguaauugaguauccaacuuaaauacgaaucacccgggugggcuauaguuaaauucuggagacacagugggaauuucaggcccaagauguagaaauuacuuagguuugucaaguggcaacaaguguauuuucuuggaaagcuauguaccuagagcccagacuagacaguaguugaacuauuaacucaguuuaauaauuuucuaaguuuguugacuucucugacacuagcauuuccaaagcaguuauauuuauuuuuuuaagcuuuuucagauauggguaguucuaaaacuguauagguuagauugaauguaugaaugguugguagcuaaagaagauugaaaagagagggaaaaaacuaccaaaauguguagcuauagcgggauacaggaaaauacuuaaagugcagaauaaaaaaccagagaauggcauaauucuuugcgggaggacaggaggagaaaacucuccagaacucuccaggaagucaagaauuuguccuggauuuaaagaaauucauaauauaaucccgucuauaucuuuauaacuuaagugucacauacuaacuugauuucaaaauguugaaacuaaaguuugugacuauugcccaggcuggagugcaguggcacaaucucggcucacugcaaccuccaccuucagguucaagccauccucccaccucacccucccaaguagcugggacuacaggugugcaccacccugcucagcuaauuuuuguauuuuuuguagaaaugggauuucaccauauugcccaggcuggucucaaacuccugagcucaagcgaucugcccacgugggccuccuaaagugcugggauuacaggcgugagccagucugccuggugugacuuuucuuaagauuuacagauuuuuuguauuaaucuguuauuaaugcauguuucaccuagaauauaaugccaguaugucccuuuuuucuuugcuaauaugacaucuuagaagaauugucagcuguacucccagugaagucuucugauacaguguucuuuauagauaucuguugauuuuaguagaaauuuuaaaaguuaagaauucuaaaaaguagauaauuauacuuuuaucucaaggaaauggggauaaggaaacagugggaaaggaagcaauaaugaaauagccauuucauauauuguacagcauuguuaauguggguauugucuaaaaauguguagguuagauugaguauaggaaggcuugguaccuuaaagaagauugaugggacaagaaggaaaaaaaaacugcaguaccugugagauuuacuuagagcaccuucucuaggggaaaaaacccaauuauauuguuguauuuaacugcuuaaaauaauuuaguagguuggaggcuagguuggucagucuuguaccauuuuauaaaaugggauuuagccuuacuagauuuuuuaaauuuugguauauucuaaacaaaaaguuucauacacuauuaaaauaugcuagagagaaacaguauuauacauguaugugguuuugauauuuuuucuuuguuuuuuucagagugcugcugcuacagcugcuaccuuagcacucccugcaggugugacuccuguucagcagauauuaacaaauucagguaauuaggaaugauggaaccauuuuaaaauguaauucagaaaauuguacuaucuagcccuuagguuuugucuucuuugaaagacagaaaauacuaauauuucuuuuaccauuugguuuagguuauuaaaauaacuuuauuugagggcuguaacacauauaacuguaaucguuguugaggauacaguaaagaagaugaaaauuguacuugaaccuuugaucugugcaugauaacccuauuauugaaguaugauuauauaaaaaugcuuacuuaguuuuuuacugaacacauuuaacaugccaagugaguauuaaacuucuuugaacuugugauaucaaaguaauuccuagagcauauuaagagcaaauuuauuguaugcuauuauuauacauaguaucucuucauugacaaaagaccaaugucuagcucauguguuuuggcauauuggugcuugaaaaauuuauuuacauggauuuuaaguguucccuauaaucuugauuauauaguuauuauuuauuuucuauucuguguauguuauuuuuguuaauuuguaaauuugugaaauuaggggcuugucuugcuacauauuuuaauaagauguaauuugcuuuuuaaucaauucaagauucuggguugucuaaaggaacauauugggggaauuugauucugugugaauuguaugacaaugaugauaacugguucugugaacuuuuauugcuuuuaccaauuuugaagcaaaguucuuuggugcuuuguuugguucaagauauuaaaugagcuauuaagcuuuuguuccuuuaaagcuuuaaaaaugaacagcucccgaagugucugaucuuacugcucuuucuucacuccuaagguuagcaaagauaauguaagcuuuagucaagucucauaaucuguuguuaaaaccuuguuggaaauagcugaaugaggauguaaauaugaaaaauaaaacauuuuaaggaauguauuugaacauggcgagaagucagagaaggggaggauuaugcauacuguguaugaaugacaaccuuuaauaaaauuguuaguuuucuugauaauuucuugugccuuuggugguaugaaauuaaauaugaauucauuucuuuugagauggucacugcuaaaaugauaacucggaaugcaugcuuuuugcuuuaggccagcuucuucagguggucagagcagccaauggugcccaauauaucuuucagccucagcagucagugguucuacaacaacagguuauaccacaaaugcagccugguggaguacaagcuccuguuauacagcagguaaaauaaucuucuauuaugaucaguaugggguucuguuuuauucuguauguauucccuggguaguuucccucuccuuauaugcacaaaagacucuuuuucagugcuacagacccaguuguuucaaauuucuccuguauacagcuuaacuuagauucagcauguauuaaacauguauuaaacaauuacuguugucucugcccauccuucaucauccccucgaagguggcagcacucuccuuccagcuuccuaagcuggucauucagccuuuauucaauaagcaguuacugagucucgggguauucacaagggucaggggauuuaggagugaaugacacagacaugacucuaguuuuaugaugcuuacuggaaguggguguguagaauccucccuuuuccuuaccucuaauacccaagguaucaagcccuaccaauucuuguuaauaguuuuucuuuucuuuuuuuuuuuuuuuucgagacagagucuugcucuuucacccaggcuggagugcaguggcgcgaucucagcucacugcaaccucugcuugcuggguucaugccauucuccugccucagccucccaaguagcugggacuacaggcgcccaccaccacacuuggcuaacuuuuguauuuuuaguagagaugggguuucaccguguuagcuaggaugguuucuaucuccuuaccuugugauccacccgccucggccucccaaagugcugggauuacaggugugagccacugcgcccggccuuuuuuuuuucuuuaacugcaguuuugccaugguugcagucccuuaauauguuugacacuguuuuuuucucagccucuuuuuucauuuccuuaguucauacuguccaugauuugucacuaaaaugcugcauugucuucuuaaugguuucucugccucucaucuuuugcccuccuaaccuggcugauuuauagucaucuuuuuuuuuuuuuuuuuuugagacagagucucugucaccuaggguggagugcaauggcgcaaucucagcucacugcaacucccgccuccuggguucaagugauucuccugccucagccuccugaguagcugggauuaguggcacgcaccacugugcccagcuaauuuuuguauuuuuaauagagacagaguuucaccaugucuagguuggacuugaacuccugacuucaggugaucugcccgcuuuugccucccaaagugcugggauuaugggcgugagccacugugccuggccuaucuuucuaaaaauccuaaaacuuuuaacagcuuuucauugccuacugagaagagccuaaacaacucaacaugguuuauaaaaucuuuuuguggaucuuguuucuuugaacucuccagguuuauuucuugccaugcucccaguuauuuucuuuagcugcauuuacaucaaaauaaacacuuggaucuacuuguguuauauucuugugcuguggcacuaaaaugaaagaggaaugguuauuuucuugaggaacuuauguacuuuauauguuuaugugucugucucuuuuuuaaaugucaguaaaauaguauuaugauagagacaagaucagagcaguacuauuaauccaguuuauuuacaucuuuccaaaauuauguacugcugucacuucuggguuucacuugauguuacacuucucuuaagaaugccgucuggcaacucccugcacuucccccaaacaaauagaaaaaccuggcuaaucuccuuaaagcagcagucucuuagcuuuuugacaccagggacugguuuuugcagaagacaauuuuuccauguacugggcagcagggaugguuucggggugaaacuuuuaauucaggucaucaggcauaaggagugcacaaccuccauccuugcaugugcaguucacaguaggguuccugcuccuaugagaaucucaugcugcugcugaucugacaggaagcagaguucagguggugaugcuggcucauccaccacucaccuccugcugugcagcccaguuucuaacagggguuggggaccgcugccuuuaagcacaaacagaaacuacuuacuaauaauauaaguaauauuugaucaugcuuuguccccuaaguugaauuugguacacucucuuguguucccauaacacugugucauauuuguacuacaucugcuguguuuuugaguuguuagugcuuugucuauuauaccauuuuuuugucuuuuguguuguuacaccacguguaagcauuuuaaaggaaauacugugucuuauuuuugcauuccuugaaccuaauggcaaguaacaagcaucuaguccuccuccuuuauuauaauacauauaguuaauauuuguuaguauauauuuuuucaaguuguggcuuacuuuagaauccuagaugcagaaccuggaaaggaacuucagaaaucugaucuggugguuuuuagaaaaauaauuagcuuuuaucucacacugagucagaauauuagggguauggccaagguaucaguacuuuuuaaguugccaggugguucauauuugcagccaggauugagaaccauuaagccuaguuugacagugaaacgacagaggccaagaggaguuaaaugacuugcgucugcuguauuuaugucugacuuuagacaaaaguagacccagguuggccaggcguuguggcucacgccuguaaucccagcacuuugggaggcgggcggaucaugaggucgugaguucgagaccagccugaccaacauggcaaaaccccgucucugcuaaaaauaacaaaauuagccgggcaugguggcgcgcaccuguagucccagcuacucaggaggcugaggugggagaauugcuugaacccaggaggcagggguugcagugagccgagaucacaccauugcacuccagccugggugacagaacgagacuccaucuauaaaaaaaaaaaaaaaagguagacccagguuuucagauucucaguccaguguucuucaugugaaggcaguguauaacuuuuguccugguagcuggcauauacauaguaugugcucaauaaaugaagcaguuaucuuuagaaaauccuuauuuucuagaaauuugauaaaauagaaauuuaaugggucacuacacuaguuaaacuaauugcuuuuguacuuugguaguuuuuaacuguguaugaaauauggccauucuggugaaucuuaagcauuuguuucuauuucuguguaccauacuugauccucuuaacuaguuacuguuaugugguuuucuuuugcuuuaggugcuggcuccucuuccuggagggauuucaccacagacaggugucaucauccagccucagcaaaucuuauuuacaggaaauaagacucaaguuauaccuacgacaguggcagcaccuacaccagcccaagcacagauaacugcaacuggccagcagcaaccgcaggcccagccugcucaaacacaagcuccauuggucuuacaaguugauggaacuggggauacaucaucugaagaagaugaagaugaagaagaagacuaugaugaugaugaggaggaagacaaagagaaagauggagcugaagaugggcagguggaagaaguaaguuucuaguaacauacuuaaaauaaucuacuugauuauuuccuuuuuuaguugguacaacacugauaaauuauauccuguuuuuuucagagacuguuaggugcuguacaacauaagauuuuaaagauaaaguuagauuguuuuaacuuuaguaagguuuuuauauucuggcuauauuuaucuucauaaaauauaacuuucauauagcugguaauaaaaaauguauaacaaauuaaauuguauuaauauguguaguaaagaguacagguaauucuaacucuggcuuacgcauuuauaauguggcuuaaacauaagacauugguagauaaauagaugugguuaaucuuuugcuucaguaauuuaaaaagcguggcaacauuuggggagagagcaaacucaagaaccaaaugucacaaauuuauuaaauauuuaaaaccuuuugguccauguucuauaccacuuccuuaaaaaccuauguacccuuaaugucuguguucuucuagaagcauauaaauaugccuuuguuuuccucacuauuucagcuuaguuacuaggcuccaaaaacuauuugucccaccacaauuuucacuguuaauugccuucguuagccuaaaaugcagucuuuuuguuucuuaguacaaaguucuucuaaauuaucuaaguaauuuuuuuucugaagaaaacauaguuuauuauugaauauugaauagacacaaaugaauagaaauguuucaagauaaaaaucauccuggugcccaccaucuaguuaaaauaaaauuccauuauuuaaagugccuuagaugccucucccuaaucccaucauuccuaggccaucaaaguaccuuugcucauacauuuguguugauuauuaauugcuuuuauauuuuaccauauauauuuauauuccuaaauagcauauuguuuaguuuugcauguuuacaacguaaaugaaguaauuacguauucuucugcaaguugguuuuuuccccuuaaaaugauauuccugagguuuauccaaguuguugcauauagcuauaauuauuuucauugcugaauauaccauaauuuuauuugucaauuuuucuaauccaguggacauaaggauuguuucuuguuguuuacuguuacaaacaguuauaaaauauuguaguguaugucuucuggggacacaaaugcaagagguucucuaaauuuuauaccgaacauugaacuucuggcuccuaagucaugcacaucugcaacuuuauaauaaaaugccaaaucacuucugccauucaauacauaauugugcagauguccauacccccuuaucaauaccugauagugucaggcuuccugauuuuugcuggucugguagguagaaaauaguauuauuucauuuugguuuuaguuugcauuuccucacuuaggaguuuuagccucuuuuuguauauuuauuugauauuuguguuuuguauagaagugcuuauugaggucucuugcccguuuccucccccuaaauucuucauaguuucagugcuucuugaaguaacauguuuuuauuaccuuuuccaguuuauugguaggauggaaauauguagcgcuuuuaauauucauccuugaaccagccaccguccuaaugucuuuuguuaguccucauaauguaucuguagauucuuuuguaucuucuguguagacuuucacaucuuauaugaagaacggcaguuuuuuguggcucauuggcuaagccuucgggaacaguauugauuagaaguggugauagcaggcacucuucucuucuucuuaaacugaaaaguaaucuuuuccaugcuucacuguuaaguuuaauguuuguuguggguuuucuuuuuuuuuaauggauaucuucaucagguuaaguaaauucccuucuuugcauugcuuuguuuuuuaaacuguaagugaauguugcauuuaauuaaacaccuuuucugcaaugauuuguauaauuucucacguaauguuauuuauaauggauuucauuaauugauuuucuauuuguaaaccaaucuuguacuccugggauagcacaacuugaucauuuuauauuucucuuuuuauaaauugcugaauucauuuuguugaggacuuuuuuguagauauuuaugauugauagauacugugugauuuucuguucucauacucuucuuacaagguuuucaguuaugguagcuuuguuaaaugaauuuggggacauguuuccuguauuuugaacucuuuuuuuuuuuucaaagauuguauuuaauucuucuguugauauuuguuaaaacaugacacuacagauaccugggucuaguaaucucaugcccuucaaguauuuuguuucuguuugagaccguuuugauaaguuauauuuuucuaggacucucuauauauuuaucuaaauuuucaaguugauuaacaugaaguuaaucaugauauugucuuuuugaugccagaauccuuugucaucuucauuccuaauauaauuauugugccaucuuuuuuuuucccuguucagucuuaccagggauguguugauuuuauuaauguuuucaaagaguaaacuuuuagcuuuauucucucuaguguguuuuucccauucuauucuuuucugacuuaacuguuuuguuuguagagaauaugaucugugugaugugugaaucuuuugaaauugcuugagacuugcuugauuuggucaguuuuuguauaugcuuugaaaagaauguguuuucugcacuuguuugguauuuguaugugucuguuagauuuauauugucaguagguuugcucagaugcucuuuauguauccuugauauuuuuugugugcuugauccauuuuuuuuuugagauggagucucgcucugucacccaagcuggagugcaguggcacuaucucugcucacugcaugcuccaucccccggguuuacgccauucuccugccucagccuccugaguagcugggacuagaggugcccgccaccucgcccggcuaauuuuuuguauuuuuaguagagaugggguuucgcuguguuagccaggauggucuugaucuccugaccucgugauccgcccaccuuggccucccaaagugcugggauuauaggcaugagccaccgcgccuggccacuugauccauuuuuuacuacugagugagauauguucauguuuccugcuaugguaguugauauauuucuucuuguuuuucugccauuuuuccuuuuuguauuuugagccucaaaacaggugcauguaaguuuaacauucauuguuuuuucucagugaguugaaccauuuaugaucauacaaugucuuaaguuauugcuaguaaauuuuuuuuaaccaugaagucuguuuguaugauacuguuagagcuguaccagcuuuguugugguuagaauuugccugguacagcuuuuuucauucuuucacuuuucaaacauuuuggaucuguaaacuuaaucuuuuuaaaauagaauauugcuauuuaugcuauuuguugcaaaacuuuaacaucaaccaagacuauucaguagggacagaauagucuucaacaaauuaugcuuggacaauuagauauccgcaugcaaaagaguuaaguuggaccccuacggcauaccacauacaaaaauuaaaguggauuagggaccuacaucuaagagcugaaauuauaaaacucuuagaagaaaacauagggguaaaucuccauagcuuuggcaacaguuucuuuuuuuuuuuuucgagacagagucucacgcuaucgcccaggcuggagugcaguggcgcgaugucggcucacugcaagcucagccucccggguucacaccauucuccugccucagccucccaaguagcugggacuacaggugcccgccaccaugcccggcuaauuuuuuguauuuuuuuuuuuaguagagacgggguuucacuguguuagccaggauagucucgaucuccugaccucgugaucugcccaccucggccucgcaaaguacugggauuacaggcgugagccauugugcccagccgcuugcaacaguuuucuuagacaugacacccagaguacaagcaaucaaagaaaaaguggacuuuguagauuaaaaaggugguuuuuguuuuuguuuuuguuugagacagaaucucacucuguugcccagacuggagugcaguggcaugaucguggcucacugcagccucagcaucuugaccucccgggcuggagugaucuuucugccucagccuccugaguagcugggagaaaauauuugcaaaucauguauuugauaaggaucuacuauccagaauauauaaagaacucuuaaacagcguaacaacaaaaagauaaugcaauuuaaaaacuggcaaagaacuugaauagacauuucuccaaagaagauacacaaauagcuaacaagcauaugaaaagaugcucagcaucauuagucauuagagaaaugcaaaugaaaaccacacugagauaaccacuuuacaccuucuagaauagcuauacucaaaaaagaaagagaaaauaaaugcuggugaggauuuggagaaauuggagcccuugugcauuguugguggaaauguaaaaugguacagcugcugugggaaacaguuugauaguccucaaaaauucaguauagaauuauccauaugacccagcaguuccacucuuaaauauauacacaagagaacugaaaacauguuuuucaacaaaaacuuguaugugacuguucauagcagcccuauuuaugauauccaagugguauaaacccaaauguucaucagcugauaacaguggaauauuauuuagccauaagaagaaugaaguauucguauaugcuacaacauggaugaaccuugaaaacaugcuaugugaaagacaucagccacacaacgccacauauuauaugauuccauuuauaugaaauauccagaauaggcaaauccauacagacagcagauuauagauugccaggggacagggagaauggggagugacagcuuaauagguaagagugaugaaauguucuggaacuagguaguggugaguguuauauacacuguaaauguucauugcaccugaauuguacauguacaaaugcuaaaauagugaauguuguuaacuugaauuuuaccucagagauuuuuuuuuuuuuuuuugagacggaguuucacucugcugcccaggcuggagugcaguggugcaaucuuggcuuacugcaggcuccgccuucuggguucccgccauucuccugccucagccucccgaguagcugggacuacaggcaccugccaccaugcccggcuaauuuuuuuguauuuuuaguagagacgggguuucaccguguuagccaggauggucucgaucuccugaccucgugaucugccugccucagccucccaaagugcuggaauuacaggugugagccaccacgccugguguagaaaauuuuuuucauuuuacauugaugauaccuauuuuaaauuaaagaauaucuauacauacacaccuguguaaguagguauaggccuagacauaauaauuuuuuuuuuuuguucuuauuguugauauagagucucagguuguuguccaggcuggagugcaauggugugaucaaggcucauagcuucaaccaccuggguucaaguaauccucccacccucauccuccugaguaggugggacuauaggcauaugccaccauaccucgcuaauuuuuuuuauuuuuuguagagguggcaucucacuguauuucccuggcuggucucaaacuccuggccugaagugauugucccgccuaggccacccaaagugcuagaauuaacaggcaugagccacugugccuguccauaauauagucuugauuauugucuucucuacuuugguuuugucuucucuuucugcauuuauuagaaaucucaguuacaucuucuaucuucugucacaauugaagcgaaauuuaacaugguuguuuauuuuaugcucuaguuagguuuuaucuuggccccuaacucucuuuaaugcugagauuuccuacuuucugccuuuaagaaaaaaaaaaagucugaaucuuaauucugcuucauaccucuaccauaaccaucaucaugcuaaacaugcugauuuguauuuagaguccaaguucuuuaauguaaagacagcaaggcagacugcuagccuauugcauugcucuucuuuucuccucuaauuucuccacuguuuucuguuuuauaugauuuguaguacauagugccauuagcucuuuugaaccuucauauuagguccuuuucuaggcaucuuaaacaguuauuguagagaauuaucuucuuguacuguuuuuaaaaaauaaagaaaauaaagauaggccgggugugguggcucacgccuguaaucccagcacuuugggaggccuaggcgggguggaucacgaggucaagagaucaagaccaucuuggccaacauugugaaacaccgucuguacuaaaaacacaaaaauuagcugggugugguggcgcgugccaguagugccagcuacuggggaggcugaggcaggagaauugcucgaagccgggaggcagagguugcagugagccgagauugcaccagccuggcuacagagcgagacugugucucaaaaaaagaaagaagaaaauaaagauaaacaucuuuucagacuuaaaaauuacauagcuuagcuaauuuaauuauauuuaauuucuuacauuucaguaauauuggcaaacuguuaacagcugauuugacaauauuaaauucauggcguacauauaugcauuuggcauuugguucucaaagaacaucaaggucauuauauuuuuuuuuucagugaauauuaaggccuucuuauaguaauaagaacucuccuuuuauuuguaggagccccucaauagugaagaugaugugagugaugaggaaggacaggaacucuuugacacagaaaauguuguuguaugccaauaugauaagguaaggaugucaucuucagauuacugacguuauuuguguuguaauuucuucccuacauuauucuuucugccuuauugaaacauuugggcagcugauucaugccucuuaaauucauuaugaauaguacgaaaacccuguuagaguuuuguggauuauuuuaauagaaugaaagauuaauuucuuagcuuuauguuugaaaaauaaguuaugaaugaaaugaaaagagcuacgaucuucuuuuucuauuuagacagucuuugaacuuguaagcagaguaaacagccacuuugagguuguccuuugugguaauagcuaacucaaugagauaauucuguuuucuauuuagccucaacuaucucaaaacuagaaggguucaauugaaucucuguaacuguuuuuauuauuaaggaaaagacuaaggcaaugaacagugcuaaaaacaaacauaaguuuuuacugaaaauuauuuaaaauauuauuuaacuuugcuguaguuugcuaacauuaaggaauuuuuaaaccagauacugugaaaacuagccauugauuccuuauuuucuuaauuccuagacagggugcuucuuuccaaguauuuuuguuacauuuauuuguauuauuucugagauuuuuguuuucaagacauuuaaauuguaauacaguuuuuuuauugcaaucauuaaauuuauaaugcaugcaaauauuacguugcauuuauaauuuuaguagagaucuuuaccaaaugcuaaaaauucuaacaaaagcuuauuuauucaacauuuauagagugcggaaauuuaccagacacuauucuaggcccuggcgauguaguuaugaacauguaaaauucaugccuugcaugaaguuuccuuuauagaugaagaaaaucuuaauucuguugcuuuuauggaaaugaaugugauaaguagccgugcuuacuucaaacagaucuauagggagaaugccaacacuauggaucuuauuuacuaauaaaaagguggaguuaggcuaguuuuaccagugaaguuauagaaugaagacaguaaggucauugagaguuucacagcauucauuuuugugcauaaugacuucugagagacuguucuuaaaaccauauaccaugugcaguauaauaaauguaauuuccuguuagauacacauagagcaagacuaugagguuaaaacaaaagauaccauuaaaucuuuauuguuaggaagucucagaggaucuccuugcaaccaaauuauccagaacacaauuucaugaugagaugucagauuuaucaggcaagcgaggaccuuuguuuuagccugacugaagaauauacuuuuaagugucuuccuacuuuaagacaaugguuguauucuccuuuggcacaaacuguacucauaauauuuuaaauguuaaaauugguuuguuuugcucccagagacauuacuuuacuguuuuaaauuaguaagugggagauagcucuaaauggugugcugaaugauaaauaauuuuaaaauuugcagaggucuaauuuugagaaucaaaugaauugcucugaagauuggaggagggugguggcuugaugucuuuagccaauaguaaagaacagcaguuuucuuugacugcgcaaaaugagguuggauauuguuugagccaacuugaauuucaggaauguaguuuugaagccuuaacuuuagaaugucaacaaugagucaauuuuagaagagaucauagaacgacuaauaaagcuuguauugccaaucaaaucagaaucuuaguuaaaugcuaauaauaugguagaguucuugcuuacguguggguggauaagggcugauacagcauuuagcgaaaauagcaucagauguagguaaacuugcuuuaacacauuuuuaauuaggaaauuuaagagggcuuucuccuggcuuuaagaauauuccuucaugaagggcuuagggccgguaaauagauugcuuuuuaaguugugacuuuguacuucuauuaauauaaaaauauuuaccauuuauuacccaacaugacuucaguguugacuguguggauuaguuggcccaugaaacuuugguacauuuauuuuuugcaaauuguccuguccuaugacagaaugcaggcaguuucuuuacuugucuauagaaucucuuauuuccuggcuacucaucacuuucuuguuuuugucuagcuaagcccacggucuuucugguugcagucacuugguucaugcuggaaauacauuuguauacacguuuguagaauaaauaauacuuuauaggaauucaaagauaaggggagacagcucuuuucaugugcaacagauacuguuuaugaugucccuuggcacuauucuuggagcuugagauacacuaaugaucaaaacagaacagucccugccauugggaagcuuacuccaaucaggggagauagaugcuaaaacauaauaaauuaggauuuauuuacuuauuuaaaacauaauaaaauauuuauauguuagaagcugauagucgguauggaaaaauaaagagcagggaaagaggacagguuugguuucaguuuuaaauaggauagucauaguaggucuuuggagaaaaugacauuuuagcaaagacuuggaaagaguuagcccugucaucugguggcagagucuguuguaugugaggaacagcaaggaggccuguguggcuagacuggagugagggaagaggagaguacaguaguagguagagagguaagggaaggcagauaguaaggauuuuguaaggacauggcucuuacucuuaagugaaucagaaaguuauuggaagguuucagugagacaaaugguaugaacugauuuaaauuuugaaaggauuacuuugcuuucuuuguagagagcauaauaugaggaggaagcagagguugcugaaacgagacuauuuagggggauauuauaauaauucacaugggagauaaugaugacucggccuauggugaugguauuaaaguuggugagaaguaguuggauuuuggauuuguuuugaaggaagaauguuaacagcauuuccugacucugagauuugugguagaaaagaaaaaggaaucaagaaugacucuugagauuuuuugaugaggauucugaaagaaggauggugauaccaucaguucagaugaggaaaagcugcauguggagcugguuggacaugccaagucugguauguccguuagacauucaagucaucaaucuuaagaugcuacauuuagcauuuauguaguguauuuagaccagagauauaauuaguucuuaauccaacagucuuuacccuaccugcuguuuuaccuuuauugugcuuuguuuugcuuuaauaaguaagcaaaguuugaauccagaagaagaacaugagaguaguuuccaaauaagaugaagguuguuugauugagugauuuuuuuuuuuuaagucucaaaaagcagagcuaggaucaauaaauggaaguuggagaagcagauuuccguaaggguaaacucugaaagauuuuacaagagagcuguuccaaaaaggaauaacuuaauuugaaauucuuugcucacuguuucuaaucguauuuaagcagacacugcacaaccauuugccaggaauaugucaugaagaauguuugcacugggagguuaggccauggaauuuuaggaaugagaucucagaaaauaucuguaccuggccgggugcaguggcucacgccuguaaucccagcacuuugggaggccgaggugggggaucaccugaggucaagaguucaagaccagccuggccagccuggugaaacccaucucuacaaaaauacaaaaauuagcugggcgugauggugagugccuguaaucccagcuacucaggaggcugaggcaggagaaucacuugaaccugggagggggagguugcagugagccaagaucgugccauugcacuccagccuggauaacagagugagacucugucucaaagaaaaaaaagaaaaagaaaauaucuauaccuguugagcauuucugcauuauuauaugaaacagacugauuuaguaaaagcguacuggaccaagacuugaaaaucaugauugucacuuaguagcaguauacacuuggucaaaccauugaacccuauccaaucugucauuucuucuucugaaaaugaaagccugaacuaguugauuuuuuuuuuuuuuuagguaccuuuagaucauagaauagggagaaccagggggccuucuuugcagaagauguggaacuugaacauuaaauaauuagugugacuuacugggaaaaggaagaaaggucacuucaguucauuaaguuuuacaacuccucucccccaccaaauccauggaauuacaaacaacuacggacuauaagugaaggcaaagaugggagugcccagagccugcccuucagcucuuuuuguuuaacuguggauguacauaguuuuugaaaucugguguaagugacuggaugauuagcauccuuuagauguauuuuuaaaauacugcuauguauaagguuccaugguaguuaggucuugagaacucuauaaggaguuuuauuuugguagaagaaaugaguccauaauuguauuacuuacaaauaauguaagaaaugucaaugaaaauaccauugggaauuuaacaguggaaaagaauaguuuuagcugguaagauuugggaaagcuuuguggaggauagucuuuuugagguagaccuugaaaauauauaugcaaaccugguagagagauaagacauuuuguaaagaaauauuuuuuaacuacuuuaaugaacacaaguacuaaaagcuauaaaauaguacuaauuacagauaaauuuguuuuuagacccaccuagugaguuuugugugugguuuuuuuguuguuguuguucuuuuuggugaaauuaaacuuuauuaagaaaccaauuuuuaggccaggugcugugacucacgcuuguaaucccaacacuuugggaggcugagauagaaggaucacgugaggccaggagcucgagcccagccugcacaacauaggagacccuucuucuacaaaaacaaaccaauuugcaaauacaauacuguaaauacuguuuuguggggggguguguguguacguguguguguguauggguuuuuuguuacuuguuuucucuguuuucugauuguaucucucaauuuuuaaaauguuguuuuuguuuagauacacagaaguaaaaacaaauggaaauuucaucucaaggauggcauuaugaaucuuaauggaagagauuauauauuuuccaaagccauuggagaugcagaauggugaagaguugcuuuuuuucuuuuauaaauaaaagaaacuuaaaaaaaauguaaagcggacaguuugaaacuuggggcauaugccaaccaaaacuucguuucugcaugucagaaaagugcaguagaagcaaagcuacuggaacaaagauagaccuugacaacauagacacuacuuacuggcaagccauggaacuguagcaccuaggguuuuugggugggaggguugggguuuuguguaggaaaaccauaauuguugauuuuaaauacagguaccugccaccgguaauuagcauguaaagcuuugucuauauuccuuccuccaacuuggguucaaucagaagauacuuguuggaaugaacugaagaaacuucccuuuugauagauugaacugaaacugcuuauuguaugugguuauauuugguaaaaguugcgugugagcuuuuuacaaaaggguaagaauuguguugaauuuuaauucacuuguauaagaaaacaauuuaaaacucucauaauaggucuuaaauauuuuuacuugcuauucucccucagugauauauaccucuuccuuuccagcuuuaugaaacaucuauuuaagauuuaaaguuaucagugaucauaguuuggagauaaaauuugacccaggaaugaauauuuauuuuaauuagguuuucauacuuauuaaauguaauuaaagacuugggucuugucugaguucaguggaauugaaaccacaacuuuaauuuccuuacagaaaaacuuaauuuguuucuuuuagugccacaccuuaaaaagaaaccccaaacuagcuccucaggaauauaguuuuauuuugcaagcauaccaucuagcugaaauuguauacacaugaauauauguagacuuuuccuguugggcugaagugugugcuuauaaauguguuuaguuuuuaagcuaaacauucaguuaacagucugugcauugauuagcauagggcagguggugaggaccuggauuuuuauuaaacaguuuaguaauuauaaaaguuucuuguguuuacuaguaaagaauuuuaaaaaucuauucuaauucaacaagu

SEQ ID NO: 17093 - RNA, 1780 nt, Homo sapiens
aggaugugccuucacucacacgggacaggcggugguuauagagucgggcaaaaccagcaguagaguaugaccagccaagccaaucugcuuaauaaaaagauggaagacaguaaggaaggaaaguagccacuaagagucugagucugacugggcuacagaauaaaggguauuuauggacagaaugucauuacaugccuaugggaauaccaaucauauuuggaagauuugcagauuuuuuuucagagaggaaagacucaccuuccuguuuuugguucucaguagguucguguguguuccuagaaucacagcucugacuccaaaugacucaauuucucaauuagaaaaaguagaagcuuucuaagcaacuuggaagaaaacagucauaaguaagcaauuuguugauuuuacuacagaagcaacaacugaagaggcaguguuuuuacuuucagacuccgggauucccauucuguagucucucugcuuuuaaaaacccuccuuuugcaauagaugcccaaacagaugauguuuauuacuuguuauuuacguggccucagacaguguauguauucucgauauaacuuguagagugugaaauauaaguuuaacuaccaaauaaggucucccaggguuagaugacugcgggaagccuuugaucccaacccccaaggcuuuguauauuugaucauuugugaucuaacccuggaagaaaaagagcucagaaaccacuaugaaaaaauuuguucaguguuuucuguguucccguagguucuggagucugaggaugcaaagaugaauaagauaaauucucagaauguaguuauaaucucuuguuuucugguauaugccaucuuucuuuaacuucucuaaaauauuggguauuugucaaauaaccacuuuuaacaguuaccauuacugagggcuuauacauugguguuauaaaagugacuugauucagaaaucaauccauucaguaaaguacuccuucucuaaauuugcuguuaugucuauaaggaacaguuugaccugcccuucuccucaccuccucaccugccuuccaacauugaauuuggaaggagacgugaaaauuggacauuugguuuugcccuugggcuggaaacuaucauauaaucauaaguuugagccuagaagugauccuugugaucuucucaccucuuuaaauucccacaacacaagagauuaaaaacagagguuucagcucuucauagugcguugugaaauggcuggccagaguguaccaacaaagcugucaucgggcucacagcucagagacaucugcaugugaucaucugcauaguccucuccucuaacgggaaacaccucagauuugcauauaaaaaagcacccuggugcugaaaugaaccccuuucuugaacaucaaagcugucucccacagccuugggcagcagggugccucuuaguggaugugcuggguccacccugagcccugacaugugguggcagcauugccaguuggucugugugucuguguagcagggacgauuucccagaaagcaauuuuccuuuugaaauacguaauuguugagacuaggcaguuucaaagucagcugcauauaguagcaaguacaggacugucuuguuuuugguguccuuggaggugcuggggugaggguuucagugggaucauuuacucucacauguugucugccuucugcuucuguggacacugcuuuguacuuaauucagacagacugugaauacaccuuuuuuauaaauaccuuucaaauucuugguaagauau

SEQ ID NO: 17094 - RNA, 2448 nt, Homo sapiens
acauucuuuggcacuuuaauaacuuuucuaagguucauacaaauuuaacaauaacaaacaggauacugaccccgacccgcccaugaaaaagaacucagaugaaagauccaaauuccaaaaaaaaucuaauaucugucucaagcagaacgacauggucaguguuacccaguacacugaagccugaaggugaugaaguuggugcucugaaaugaucacggaucaaggguuuuuuuuccaccuccaacuucuccuuuuccuuuuguaccuagaugagaugguucuuccuagaagaccuuccgagguuugugacacugaagcagugauaaagguaaaugugagcacacugaugcuuaucaagguaagaacgugaguuuaaggaaaaaaaaaaaaaaaagguagcaguggcagcggagaaucacuacugccuuguuuccagcaaucaacaagaaacuaauuuagggcuagaggcaucuuagugagcagcagccccuuaucauacaacgugguugccaaggacagcugguccuccacacugucacagggcaggucccccacucucacaaacucuggauaagaaccaagcaacaguuccauggcaucagcuugcuggggguauauuuccaagcacuuggguucuuccagaugauacacacgggaguuuuccacuguguaauagagaaacaaauggccccccucacccaccagccgagcuaucccauccugaagcauauggacuucuguuucuguugucaacugggcccccacguuuacagguucuccagccucccagcgaauuggaagcccguaaacacuuagugcccucucccuaucagucaaaacagggggcagagaaucgugaaugaagucuuuggcucgcuggucggccacagcaucaacaggagcaaagugucccaggcgggcaaccaagacccgcaccuucuccaugaaagcgguucuucgcggauccuuagaaucugaaugcugggcccccauguaauccaugaagucucggggcagaccccuccgaaacuccacauuuucuuccauugcagccugcacugccagaggcaguauggccucuaagaagucaccccagguauugcgcugguacguggacaaggugaggugcagagaguggacuccauccuggcauucagcuuggugaaugaagccccgaggaaaauacagcaaaucuccagguuccagcacggucugcagcaccggcucaccgaggucguccugacugaaguuggggcuggaugucagagccaguuccucgguugggacucggggucgguauacacgccagaguuuccuaccuuccagcugcagcacgaaggccucgaugucgucguaguggggggcaaagcccugcgaguuagggggcgugagguaaacguuggagccugccaugcuuccaaacugcucuugaagcacagccaaaaacugccacacaguaguagagaaagccugcggacagaggagacgcagggagcagccggccugguacagggaccacgcggcggcgggcagcgcgcggccggguggguucagggucucgcgucguccguugauguagcgagcggcguccaaaugcuggccgaacugcaccuccucguugcgcagcaucgaauccaggucagcgguagagaaaagucccugguaguaggugugguccugccgccgcaccagcaccgccucgcgcucccauaggcgccgguaaaagugaucuggcggcaugggcgcgaugagccacucaaagaggcgggccgcucgccgccggcugcuggggaugcgguucagcucggccaagacgcgccgcagcggggagucccaggccggcuccccacccguguuauccaccugcggccccgacgccgucgcaggggccccggacgacuggacggccgcuaaguguugcgcggugcacagcagggccgaggucuccaccacccggaccggcgcggcgggcaccuccaccaggcgcgcgggcggcgcggaagcgggcaccaggcgcgccgacggggucugcagggagcgcgcggcgggcgaggccuccagcagcucugcgggccccagguggccguauggcucucgccgggcugcguccgggacgccgccaccgccgccccaccggguagcgcgucccccaggucgucggccgucgacuccacccucgauuccuccgaguucucgcuaggcagcgucugcguccucagcgcugccaugcgggauacaacacuucgcagcugcuuucguaucuuccuggaccucaagggcagggccaggaccgacccgcuguguggcuggggcuugcgccggcgcuucggccgcccgcgccucaacggcccugcacuggccuggagcccauccauggccagaccacaccagucuuccccgcccggccggccgggggcgaagcuaaagcgguuccugaaugcagcggcu

SEQ ID NO: 17095 - RNA, 2617 nt, Homo sapiens
cagcaguaacgucgcggcggguugcggguaggacuggacgccagagcagccgcgcagcgccugaaccgcugcgggccgccgcggccgccccuucccacccucgccucugcugucuccagccucgcuucuccgacuuuccugcuccucugcugccuucguuucugguccucggccguccucgccgcccgcccagaggaguccccgcgcccgccaagaagccgcuuuccgcuggcccgcagccgccgcgacuucggcacaguuucucccucuggcuagucucccaaacggccgcuccucgcccgcgggaagaccaggcugcgaccgcgaacgcccgauccucuccaggagccgcagcgagcgcccggcggccacgccccgcgaccacaccccggcggcucucggcccagcgcgccugccuucgccgcccgccgucgcuccucgcccgcugcacgacgacgcgacgccccugcugcaggcggcggacccgaccggacccagacccagacgcaagauggcgacggccgcgugacugccucagcguccccgagcucggcuccgagugcaccuacggacugacugugggggcagagaagggcgagaucaggacucugucuuuguuaaucgugacugcaugaaggucgccucccucgggccuacuuggugggagugucugguauuguucuaaggccaggagcacggugagccacagucuguugguagaauuuggcgucuugauaguugagaaaauggcgaugacacuguuggaagacuggugccgggggauggaugugaacucccagagagcucuguuagucuggggcaucccagugaacugugaugaggcugaaaucgaagagacccuccaggcugcgaugccccaggucuccuaccgaaugcuugggagaauguucuggagggaagaaaaugcgaaagcagccuuauuagagcucacuggcgcuguagauuacgccgcgauccccagggagaugccgggcaaaggaggggucuggaaaguguuauuuaagcccccaacuucugaugcugaauuuuuagaaagauugcaccucuuccuagcuagagagggguggaccgugcaagauguugcccguguccuuggguuucagaacccuacuccgaccccgggcccagagaugccagcagagaugcuaaacuauauuuuggauaauguuauucagccucuuguugaguccauaugguacaagaggcugacacuuuucucggggagggacaucccagggccuggagaggaaaccuuugaucccuggcuggagcacacuaaugagguccuagaggaguggcagguguccgauguagaaaagaggcggcgguugauggagagucuuagaggccccgccgcugauguuauucgcauccuuaaguccaacaaccccgcgauaaccacugccgaaugccugaaggcgcuugagcagguguuugggagcguugagagcucuagggaugcccagaucaaauuucugaacacuuaucagaacccgggagaaaaauugucugcuuaugucauucgucuggagccucugcuacagaaggugguagagaagggggccauugauaaagauaaugugaaccaggcccgccuagagcaggucauugccggggccaaccacagcggggccauccgaaggcagcuguggcuuaccggggcuggggaagggccagccccaaaccucuuucaguugcuggugcagauccgugaggaggaagccaaggaggaggaggaggaggcugaggccacccuucugcaguuaggccuggaagggcacuucugagugccaggaaaggcagcuuuagugcagaccuagaucacagcuacuuuucuugucccuguggggucuuacagaugugucucugaguaguaaaggcuuagccuuguucuguuuuguuguuuuuuggaggggaagguuagucaggccugaguauucauguaacauucuaaaauugugccagcgagcaccgugaacgacugcaaugcaagcgggucuugcuggcuaaaaugccagguaaaggguugguuggacacagcgcuuagugcacgcugucaucauggacaucauaaucaguugugaaaaacacgcgaaccuaugacacuucuuauuccacacugaaugugaaauugcauguucagauguuuacuacgaggccuggcucacaggaaguguucaguaaaaguaugcacuguuagauuacugauaacgcggauagauuuuuguuuaccauaaauuguuccagauuuauauuaauggaaggaagugugcauuuauuagcuauuacucaacuuuacaaugcaaacaucuuauuucucaucuuuaaacaugucgaccaguuuaauugaaaaguauucugagacugcaaaaugggguguuaaaaaauacugcaguuacggagcuguguaaaccaguuucucauugcauaagauacagauguaaauugcauggagagguugauaugcaccuguacaguaauucacucccccauuucacaucuuugucagagaauaguucuuguucauacugaguguucuaaauuugaaguuauauauacaaauuaaaauauuuuaaaaauucuguugucuucucau

SEQ ID NO: 17096 - RNA, 3343 nt, Homo sapiens
ccgcccaccagcaggcccugcgggaggagagcggugcgggcgacaagggcugagcgcgggagccaggcuggcccaguccugggccucggcccuucccgcaccgccgccagcgcccgcagacacccuggcaucucaagagggagugaggagaggauugcagggacuuuucccugcgaaacaaaugagacaaugacauaaacggcucuuuuauuuaugaaggcccugggagcagcguuaagggcuccaggauccagcucucuuugcauuuggucugucggaagcuguccucgugcuuuccuggaccgggagagucccgguccccucgggagggacuccaccgccucucacacuccgauuucugcugcucugcugccccgcagucuuuucccuuuauuugcuucccccuccuccccucggccuccaggaagccaccguggccggccaagcacaagcucacccacuuuggagcagcauuucuccuccccagaggaccucgaaggcugcaacggcccugccccaagccccagaaaaagaaacucuuggagggagucugcgggcuucucugagaaggggcgcagccugacaccugugcugucccugcagucucuaggccugucugagcugcucccgugaccguguccugaguggccaccuccuccuugggagggaggccgcggcagguacucucccuuugcugcuugcuggcggccuugcuagggcuagaaaguuuucucagcguugggggaggggcuagcguucuuguccaaagcacucauccugcugcagggaagggagcuguacggaggcuggaagcugcaggguuaggcccgagagagcuuuugacaagccuggcucuuccugcuucccaccuuuuuggcugaauaccuuuggguccuggaggcugccaagggcgcuucgccuugagcaggucccggagaggcucagccugccccuccuggggccagccuccuugccucugcucugaccucagcagcuacaccuaaccccaccgcacccuacccagugucgauauccacaacccagcccccaggccugcacuuuggagauuucuggauccuucccugggagggagaggucuccuaacucgauuggacaggagccuucauuccuugacucgugucauuugggagcuauuuauuuauucuuaguauuuaauuuuuaacauccucucagggaccaggggccuccugcuuuucagaggcccgagugcauuuaucccaaaacgaggcaucuugacauccccuauccccacccccuaaauucccaaggcccuaaggucccucaccugguugcucuggaagcucuugcugauaggaaugauagcaacacugaaagagcgugggaagguggagggugucaccagacccacacagagcaagggagauuaaggcaguucuugcugccccuucucuggcugugcuuugccugagggaagaguuggcaagaggccagaauucuaguuugguuuauggggccuggauucuggcuugaagaagccauauuuggcaugggugaagugaaagggccaggagguucuggaggccccuucacuuccagucccauagcggggcucagcuauuuuucugaucuuauucaacuuuaguugugcaaaagaaauucuaagugaaugcgcguaugacaggucaacguauuaggaaggagccagaaaguauucauacugcuacuccuuaugagauagccaagaagcaucaugucaguaacugggaguggagagggaguuuuguuuugaaacuaugcagguauuuuucagcauccauuuguacauuaguaugguucuacaggaccccagcuguggaaguaacaaauuucuucucccuccagacucuuggaugacuaccuagauccccagcuuaccgguuaguuuccuccacaggcuuccaugagcucagugucccaagacagcaaaaaucugguauacccuguagaagcagggggguagcaaauuuaggcucucuucgaaauuacuuguacaauacgagugccuucgcagcuuagccccaaagugcuacuuauguuucccaaggucuuuucuauucaaaucauauuugguuucaggccccuuuaugggcauacgguaacagaaaccuccaucauucauaugagacccuuuugucagugguaacaucuuguacuuggaaaaaaaauuuuuuuuuuuuuuuuuuuuuuuuuuugagacagagucucauucugucgcccaggcuggagugcaguggugugaucuuggcucacugcaaccuccgccucuuggguuaaaagaauucuccugccucagccuccugaguagcugggauuauaggcacacaccaccacacccagcuaaucuuuuuguauuuuuuuuuuuaguagagacaggguuucgccaugucggccaggcuggucuugaacuccugaccucaggugguccacccgccucggccucccaaagugcuggcauuacaggcgugaaccaccgugccuggccggaagucuuuaaaaaauaaagugauucuacucuucuaagcuuacagagaccagaccaggugaauguaacuggggaaaaucaagaugguaccucucugcauuaucccgccagacacuguauuuuaugcauucaugucuaggauacagugugaaaauuaaaaaguuuagagggcagaugcaauuguggcaagugaccugccaauaaagcaggugcagcuauagaagcuggcauagguauauccuuaauggugcuuucucccugggcuugucuuuuuguuguuuuuuucccccuauauucagagcuccuugagaagugauaaacaccuccagcuuucuaacauccuccccacaccaucucaccauauccaucucccagcauccaucugcauucagcuaagggcgggaaacugaccuagugccuguguugcagaccauuucugaggucuccaccauccaaggaggcacagccgucauuacuguccuccaugccuucagcagccccccucacagcuaagguacauaccaccccuucugccgcgccuccaccccuggcaccaaggucuucugcugcuuaugucuaaagggaucaccuauauuuaacugccucagugaccuaaccucuuucuucucaugugccagauguuaagaugaaggaggaauacaacacauacucaagccucagccuguuuaguuguuuucacuggggcucgcuuuucugggacgguauuuauuaucagacuggcaagccuaacuccauagguuuacaggaaguagggauauuuuuauaaaacaauuguguccuccccacauuuugcuauguuaauauuugcuucuaacaauu

SEQ ID NO: 17097 - RNA, 4059 nt, Homo sapiens
acuuuaaauauucacauauacuguuuuauucaugcauuuaucaacaggcauucacugagcacccaccaugugcaggcacuguauagcuaccagggauacuaaggugaggaagaucuaggcugugcccuucaggagcucccauccuaguagauggcacucugauuccagauaugcugcaauaagcagguguagaacaaugugcaggugauggaguaaagauaaacagaggaugccaugggaguuuagggaacagaguggcugucugguccuuaggagcaaagacagagguuugggugcaugggauuuauuuaagaaauugucucuggaggaagggaggaagggaagcaggguagagccggggaagaagccaaguaaggagguguguguugcugcuggagcaugaauugcaccacuauugaauuggucccaccaaaggccccuuuugagaaugggguagcugugaguccuugaaagccaacacucagagcaucugggggacauuguaccaacuuuacaaaguagaucuggggcuccaacaguauacacuccaguguccuuccucuacuuggaggagucaaugaacgcuuccuggaagagcugccauuaaggucaagucuggugggagaucugggugugggauaauguggggaucaagguggcgagagaaggagcaugugugaagauaugagggugagaaugcaggaaucuuggagaacuucagguuguuuagccaugugggcugaggcugggaaguggggcagagccagaucgugugggaaaggugccuaacagucuagcuaacagucucagcuuuaugcaguagaugaugggagcuacugaagagaggugugaucacucugauggcaguguggaugguaaagugugcaaaaccagaagcaaggaaauagaugagaaaaaaugauagccaacacuuauaaaagacuuagugugugccagacacuguuuaaguaagcucuuacuaucauuccgauuuugcagaugagugguugaguaacucgcugaaggucaucaagcuagugugagccaagauuuggacucaggucucagccugugcucuuaaccuguacacccccauaagcaugaauguuggauucuaguccaugauguaucaguauuuguuuucauuuaaaaucagugcuuuaaagcaugcccuguugcacacauugggucucuggaguuccuguuccucuuggcccauugccacaacacagggaagccaagcuccagugaacagccagugaggaagucugucugggacuaguucugcagagggcauggaacugugcugaagggaggccuuugagaaguuggcagcucucggucugugaagaaagggcguuucaguccuguggcucugcuggccugcccucccuggcagccacaccuguuuuguccuucucccuacacccggccagacgucucucccagagugacagcagcaacuggggacauguacagaggcuccuucucaggccugacaaaggcacucagaaccuggcccaggccugcagggcagggaggcuggggagggggcaggugggagggccagggacacagacagcugugggcugguguggcaagcauggcccugccccagaacaggugaagucaaugugagcggaggaggaggguccccugggguuuuuuccaaggauaaaagagaagacagugcagagacaucucagcacacaguggcuuaacuucaugacuggggugguugugagcucgcgguuugcucagaaaagaccuggcaaaaagggcugagaagacacagcugguggagggguguuccuacucaggcugggaggacagcccuguggaaaagugugguggaaaggacacaaagaacaggcugggagagaagcguuggaggacaccccugaugagacauugagucaaugccagaaaaagucucucuaggcagugcccaugagaggguuaccugaggcccauggggucuuuucagggaaaagaacuaggugguuuuuuuuuguuuuguuuuguuuuuuuuuuuuuuuuuuuuuuuugagacagggucucccucuguugcccaggcuagaguacaguggggcaaucugggcucacugcaaccuccaucaccuggguucaagcaauucucaugucucagccucccgaguagcugggacuacagacgugcgccaucacaccuggcuaacuuuuguauuuuugguggagacaggguuuuaccauguuagccaggcuggucucgaacuccuggacucagaugauccgcccgcuuuggccucccaaagugcuaggauuacaggcgugagccaugacgcuggggcuggaacuagguucuuaagaagggauaaccuagguuggggaggagauacaggguaaaacaguaaaaauaauuaauuguagccucuuauauguacauagcaugauugaguuauaaagcaguuuuuuguccuuuugauccucucaagccccuggaaggugggcauccuuucguuguucaugcaaugaacacuuaaacagugcaucuguuaugggccuaaaaagugagguucagggaaggucagugacaguuuuccuaagucccuguguuuucuacacccuucuuuuuuuucuguuguaauuguagguaaugagguccuggagguuguacuuuaguucucuagagggaaacgacaauagggacacaagaacacaagggacauagggaccuggcuggcauuguggacuugggaugcccucaacaauauuuguacucccaguuccccaggcucugguaaagguugguuguuuacuuaaacacaccacgugugcuggccucauugggggaggaacagugggaaaaggacagcaaugcagguauggagccuggggagaaagacacuucucuuuuaaauagugaugauggcugcagacuuauuggaggaagguggcugggaggugagaaccuggcuuccuuggaagcuuucccccaacuucguaacagcuuuauugagauauacuucacacaccauaaaauucacccuuggaagauuuucuuuuuucuugagacaacgucucacccugucacccaggauggagugcaguggcgugaacacaacucacugcagccuugaccucaugggcucaagcaauccuccuaccucagccucuugaguagcugggaccacaggcaugugccaccacaccuggcuaauuuuuguauuuuuuuguagagacuggguuuugccacguugccuaggcuggucucuaaacuccugcgcucaagcacuccuccugccucagccuucuaaaguucugggguuacaggugugaaccacugugccuggccucauccuuggaagauuuuaauggucuagauacugcugaugaaacacagggcagugacagaccgcucugaguggaguccagagagcugauguggcccuaggaagccucucaaauuugccauauucuaccuuuauugggaaucagaguuuaggauucugucuagggugcuuuauuuccuggaguguuucucucuugucacacucccugguaacuggagcucuguacuccuuuuucgugcaguuuguaaagaggguugaggguggagaaaauccaacucuguggauaaggucucuggaacaccuccccauuucccugaaaggucaaccuucuugguugccccagagacuuguagcaggggcuggagcuucuaaaaccaaaacuuucacuucacacgucagugauucugcaccgucauaucugcagcaaaacugaccuccagggcuuucccggaagcgcugcagcuuucuuuacauagccucaucugcccgccuuuuugagguagacuucuccugccaagggggggcuauuugguauagucuugagcccuccuccccugcacacaugugugccccuuuucuucucucuccuuucuuagguggccugaauuuggaaguuuagcuguagugaagggcggugccgcuccaaggugagcaaggcuccuucagggccacugacuucucuguuuccccugccaccugccuccacuauguaugcugcuuccugggc

SEQ ID NO: 17098 - RNA, 740 nt, Homo sapiens
uuauuauuuuuucugcucuggaagcuuuuuauuguugcuccaaguuuaagaauuuucagugaugguagaaaaccaauacuuuuagacaaccucccgcauagcccugcucagcuucugaaucuuggucuuaacagacaugucaacauauuucucucaaaugcgcacaaucauuccacccaugauugacggaucagucuuacccuccaauuucaauacuuggcuuugacuuaggaagcucuucaggacuguuuuuaauucagagaguguggcuuccucuaaaggagaugcaguggucccugugcaagguaccucuccacgguggacacucaucaugauagaaaaagaagaaacgacuccuuggguauugcuuaagcaaccauauugagcaagcaaauugaucaggguuggagagagaaugucucuuuggcugugaugucauuuaggcuuuucacuuuaauggaacacuucacacagggauucaaaauagaagcagccacuuuggguuccuuuaggauuugugcuauucucaacagcuccuuuucuacuugcuccagcuuauucuguuucgaugcagcagaauaaagagccauggcauagcgaccuuccauacuguguaccuaaacaggaggccucacaagcuugacaauggucugaccacagauguacugaagcaucacaccugccaggagagcccagacacugcugggggguggccaucaccucccgggcacccuuuuacu

SEQ ID NO: 17099 - RNA, 2801 nt, Homo sapiens
aaaaucauugaaaaaguuauuuaacauaauuuuauauguuguaccuuuuggaaacaaguaugauagugacauuuaucuuuucagauaaccuacuuucucuuuuuccagcugcauuccaguccaugaugacaggagguaacauuggaaagcagauaguuugcauuucagaagaaaucucuuuguaauugcuguaaaugucaucaaggcaaucauagauuucuuuuccauuuugcauauuuucaaagauauguuaaaaaauccuuagacuauacauagcucuugauuuaaaugugaucauagguguuauuuuuaguugcauaggguauuugauacaaucauuaauggaucauacacaauagguuuuuaaaaauuaauaacuuuuaguaauuacuuuuauuaauuuaaaauagaacgcuugagaggcacuuuguaaagauuuguuaaacuggaaacguuuuacaugaucugauacaaccauuaaugaaucauacacaauagguuuuuuaaaauuaauauuaauaacuuuuauuaauuuaaaauagaaugcuuaaaauaaaauagaaugcuugagaggcacugaguaaagauuuguugaacuggaaauguuuuacaugauucuuaaacugaaacuugguguaaaaauagaauugagauggccuuuuuuucacauuguagacugaaaagagacuuaaugguaugauguguacauagggacugggggcaggauuggggguuucggagcuuguguaacaguuuuugggauaggagaccagcgguuuuggguugggauuaguaugggaagauaaauaacuuagguugguuaaguugacaagauuuacuccagaggaucaucucuuuguauuugccaaauaauuuacuguauagccuaaaaacuccauauauauugagaaaagcauauguuuauuuuagguuagcaggcacauacugucaaguuguaaagauugagagggcaaacagauguaaacaucacuuguaggugauuaaaaagauugacagccgggccugaugucucaagccuguaauccuagcacuuugggaggcagaggcgggcagaucacuugaggucaggaguucaagaccagccuggccaacacggugaaaccccaucucucuaaaaauacaaaaauuagcugggcgugguggcacacgccuguaaucccagcuacucaggaggcugaggcuggagaaucauuugaaccugggagggggagguugccgugagcugagcuugcaccauugcacuccagccugggcgacaagagugaaauuccaucucaaaaaacaaaaacagauugacaacaaagacaguuucagaaaaugacaggacugggcaaauuaacaaauguuuguaaacaugaauguucaggaacuacugauguaccucaaaaguuuguuuuauuaauuguacucaacccucgcagaacaguaaaacugaagauuauuguuucugaauguuuuggcuuaugauugucuacacacugccaauauacuuuuguaugcaacauuuguaauaaguagauucaaacuguguugguaaucagccuccccaguuuucgugaguggcccuuuuuuguuacuuuuccuggaccauuucaucgccugaggggguuucacuuuucucuguauguugcuaacucccaaaucuccaucuguauuucugaccucuuucuugagcacuggaccuuuaccuccaaguaaauauccucaacucuggauugcaucuuauacucugcuuuuuucuuuucuuuucuuuuuugagauggagucuugcucagucgcccggcgugcagcggcacgaucucggcucacugcaaccuccgccucccggguucaagcgauucuccugccucagccucccgaguagcuaggauuacaggcgcgugccaccacgcccggcuaauuuuuguguuuuuaguagagacggguuuucacggcguuacccaggauggucucgaucuccugaccucgugauccgcccaccuuagccucccaaagugcugggauuaaaggcgugagccacggaguccggccuacucugcuuuucuaaaguggaauuaucuuccucugaaauguuucuccuuuauuuuaaaucaccauuaguaauuuguguacccaaaccugucaucaaggcuuaucuuuaaccuugaaaaugccuuuuuaaagagaacuccuuuaauucccacgguugagucucucauucuuccgcacgcaaauauuuuaaaauaaguaauuucaagaagucagucaaacucacaaagcuuuaacaagguggcauccagcuuggaagucaaguguucaagcccgcagucgggacauccaagagcucuuuacauccuaauuacaacacggaacccagacucacugcauaccccgucccguauauaaugcaaaacuugauucugcaaguuccuuucucgggcggugaaacuucgaagguccucuccauggagaccuuugauaaauguuuaagcagugaucuuuucuuucgcguuugccuccauugcaacgccuccgcugaugggaaaaacuacucccuccgcuacugcgggguggcagugacgucaacgaauuagcugaccuguuuuuucgggcuucgcggacauaggagucccgaaggccgagagugagugagugagugggagcggggcggcugcggcuccuccuguccggggcggagcccugcgucgcgggccuggggaggccccgccagcacccuugacgucugggucccgagcagugcggcagccacacgacacugaggcgagcgagugggugugugc

SEQ ID NO: 17100 - RNA, 27366 nt, Homo sapiens
uguugacgguucuguuauuuugucauuauugcagggaugaaaguaagcuucaagauaaaaucuucaucacccagcaaauugcaauaucagacucuucuggugaaguggugcuacccacuauuccaaaagaaccucaggagucugacacaguaaggagucuguaucuaaucaaacaauguauauuguugucacccuuccccaugucgcuucuugcuaaaucacgguuauuuucucuacuaguugagagacuucagggaucaguggaaugaguaauaaauagcauuaguagauuacauaaauuuuuaaagcaauauccguacaaaugcauauuauacuaaugcaaaugcaaaugugugccucuuuuuguguagaaaccuauagguugccuuuugaaguaaacagccuagccaaaauguguacuaucuuuuacguaagaguaaacauagugaccuugugacucuuagcuuuccaucacaggugggaagucagagucauuacaaccuagaggacaaaggcuuauaaggagauaugaaaugauuuuuuuaagccaaguuuuucucuuuaagaguuuuuaauuuauaauuuguuauucauaauuaguacaauguagaaucugagaaauuucaaaugaagccacauuagaacaaaaagaaaauacugacuuuuuagccgcgaucacaugaauauaacugaugaguuuuuuucaucuaagaaauaagaaacucugagcagcaaauaguuggccagaugaguuguuucuaauuagagcaucacaguucugauuaguguguuuuuuuagaagugauuucccuuaaauauaaggaaaauguuaggaaucucugugacuacauuuaauuccacuuggaauauagacaauaaugaccuuuuauuuaacccagccuauaguuguuggauuggauuaaauaucacuaccagggccaggugcggugguucacgccuguaaucccagcacuuugggaggccgaggugggcggaucauuaggucaggagauugagaccauccuggcuaacauggugaaacccugucucuacuaaaaguacaaaaaauuauccgggugugggggcaugcaccuguaaucccagcuacucgggagacugaggcaggagaauuacuugaacccaggagguggagguugcagugagccgagaucgugccacugcacuccacccugggcaacagagcgagacuccaucucaaaacaaaacaaaacaacaacaaaaaaaaucacuaccaguugccagcugugauaagagcuaaaacaagggguacuguagucucaaauuauaaauuucuauugccucauauuuaggaaagcagaaaaaaaaaaaaaaaaggcccaguaggaucauaaguguauuuuacaaaaguuccagucaccuuaagugauugaagguuuugacauuuuauccagccaggugguaguaauaagccucaaauccacaggguacacaacauuuucaaggucuuuuuuuuuuuuaucauacuuaauucaugaauaacccccauaguguagguuaguuagcacuaucaaagugacugguaaggacgcaggaaaauaaaaagaggauucaauuggauugguacugcaaaaagaauccauucuguucagcacaugaauuucuguucugaccuuaaguuuagauauaucaaagaaacaaaaagcauagaggcggcugggggugguggcucacaccuguaaucccagcacuuugggaggccaaggcaggcagaucaccugaggucgggaguucgagaccagccugaccaacauggagaaacccugucucuacuaaaaauacaaaauuagccaggcaugguggcguaugccugaaaucccagcuacucaggaggcugaggcaggagaauugcuugaacccgggaggcagagguugcagugagccaagaucacgccauugcacucuagccugggcaacaagagugaaacuccaucucaaaaaaaaaaaaaaaaaaaaaagcguaaaggcaguugaacuaauggcagaagaagacugucaaagcauuuuuuuuuaaccacuuuaugucauggaaagcuucgaaauuucuuaggcccaguuaauugcucuacaugaagaguucuucauuaaacaaaucacuaauuagaaauacaggcaagagaaaagaauauauaaaauuuggcaaguaauagcagguuagauuugcuuaaggcaggugucuuacccauuuucaugguuggaacaauccuugauuucugggccuaaaauaacuuuugaaauaauuuucuaagaaaauuauuugcaucuggcugggugugguggcucaugccuguaaucccagcacuuugggaggccgaggcaggcggaucaccugaggucaggaguucgagaccagccugaccaacacggagaaaccccgucucuacuaaaaauacaaaauuagcugggugugguggcgcaugccuguaaucccagcuacuaggggggcugaggcaggagaaucgcuugaaccugggaggcggagguugcggugagcugagaucacgccauugcacuccagccugggcaacaagagugaaacuccaucucaaaaaaaagaaaaaagaaaauuauuugcaucugaauuaauggcugaaguauuaauuaaugauugcugaagagaacccugaaacuuaguacuuggcacauauaacaaaaaguugauuuauccauugcuuacugagguauccuugagaagugaucuuaagcaggagcagugacaaugauagaauuaauaguggucaugaauuacuaggaaacaaaguggcauugagcagaaaagaaagaagcuguugccacaacuuugggauauauaaaaauggauuauaucuuguguauugugggauaaaagaggggcuaaagaaaacuuugcaggaggucucucccaguggcauuuagguagcgcuauguuugaggaucaaccaaaagcggugaguuauuucuguccuguuuccccaucuaagaguucuucuugcaauuauuggaacaucuucuuuaaaaaauuuuuuuucccuuuucuuuuuuuacuuuuucaauuuuuuuaaauaauagauacgggguuucgccacguucuucaacuccugggcucaagcaaucugcccacuguggccucccaaaaugauggaauuacaggcgugagccaccgcgccuggcuggaacauuuucuuuacauacacuggcuuuucuccccuucaaaucaucagaaaaugggauaauuuuuagaaaucagguuuaagcacuacuuucagauaagcauuucauaguuacaacaguuaccucaaaauagaaguaugaagagcaagugagaaaucugguuucauuguuacacuaggcaguucccuauagaaacuuugcggggguuaauaguccugaggaagauuuuaguuacaauguauuccaaucccaucgaucugaucugagcaaagcugacaaaugaagcuggucaaaaauaaagggagauuacucaggauggagucagucuuaaacaaacuuguuucuaacggcccaugguaggcaugacaacagcaggugaggaaagaguagcaucuucuucuuuccacugagaaguaauggucuuuaacugaguguagaauuggaugcccuaaggaaaacagaaaaaaaguuagcauauauuucugggguuucaugauucuucuuuuaauuagcuuuugaaggagguauuauaaagugcuacucacuuuccuaauugagaaaugcaaucagaauccaauauauauuguuccuaagauaauugaucuaaaacauuuaacauaauaccuggcagauaguaaacaaucaaaccuuagccaucauuauuaugcugaaacuaguauuucuuucuuuuuuguuugagauggagucuugcucugucacuuaggcuggagugcaguggcaugaucucagcucacugcaaccucugccucccggguucaagcagcucuccugccucagccucucgaguagcugggauuacaggcaccugcuaccacgccuggcuaauuuuuguauuuuuaguggagaugggguuucaccauguuggccaggcuggucucgaacucccggccucaagugauccgccuuccucggccucucaaagugcuggaauuacaagugugagccaccgugcccccagcuauuauauaguaggccauuuauuuauuuauuuauuuauuuugagacagagucuugcucuguugcccaggcuggagugcaguggugugaucuuggcucacugcaaccucugccucccagguucaugugauucuccugccucagccuucugaauagcugggauuacaagugugugccaccaugcccagcuauuuuuguauuuuuaguagagaagggcuaauuucagauuagcccauguuggcuagcaccauguuggccaagcuggucuugaaccccugaccucaggugauccgccagucuuggucucccaaaguucugggaucacaggcaugagccacuguacccagcggccauuucugauaauuaucagagaucaugagcucuauauugaaguggcaaacccaaaguaucuuagaaaucuaaaguaaaaugucugacauuauacaaauucacuucucaauuaccuauaacaugugagcccaaaaauucagcauauuuaacucucucuauauauagauauaguuuauaagaguaggcuugagcaaaagagaauacauugugcagaucuaacacuuauauaauuacuagcaagcuagaaugacauuuuaccagauuaccagaguaauuuauaauaauuaaacuggggggugcagccaggagcgguggcucacacuuguaauaucagcacuuugggaggcugagguaggcggaucacuugaggccaugagcucaagaccagccuggcccaacauggcgaaaccucgucucuacugggaaaaaaaaaaaaaaaaaaaaaaaaaaaaagcugggcgugguggagccugaggcagaauugcuugaaccugggagguggagguugcaagugagccgagaaugcaccauugcacuccagccugggcaacagagcaaaacucccaucucaaaaaaauaaauaaauggagagggugggcagggaacaauuuuuaaacaauaguuguacucuguuuugcuuaaaagaaauguuacuaguaucaaauuagucauuuuuacaaaagcugugacuaggccgggugcggugacucacuccuguaaucccagcacuuugggaggccgaggcaggcagaucaccugagguaaggaggucgagaccagccuggccaacauggcgaaaccccgucucuacuacaaauacaaaaauuggcgggugugguggcacgugccuguaaucccagcuacucgggaggcauagauacgagaauugcuugaacccuggaggcugagguugcagugagccaagaucaugccacuauacuccagccugggugacagagaaagauuccaucaaaaaaaccccaaaacaaaaaaccaaaagcugugacuaauauacaaacuauauaaucaaccuccaaauaccaaaguguugacuucuuaaccauuuggccacacugucauaaugcuaugcaaucccauuguuaauuuuuuaauaacccaaacauaaauaaaauaaaaaagccccacaucccucgcccuguggcagcacauagcuggcacagaaaaaaaaaaucaaccuauaaaaggggagacuuguauaacaaaacauguaauuuauuaaugaagguuucaaaauggcucuaguccuaugacuagaaagaacuuccccuagccuauuuguucaacaaauguuugggcagccugcucuguuccagguacugcagauaaguagauaacaacuacagucugaugagggcuucuuuaaauggcuuaaagagcccuacaugacucaaccccugccugccucucuaacuucauuucuuccuuuucuucucauuugcucacugugccccagcccauuuccgcugucugaaugugccaugcuucuuccugccucgggacauaugcaccuguuggccgauguggcaauaguaauaauucuucuuuuuuuuuuuuuugagauggagucuugcucuguugcccaggcuggaguccaguggugcaaucucggcucacugcaacuuccgccucccagauucaaaggauucuucugccucagccucccgaguagcugggauuauaggcaccugccaccacaccuggcuaauuguuuuauuuuuaguagaggggguuuugccauguuggccagauuggucucaaacuccugacuucaggugaucugccugccucagccucccaaagugcugggauuacaggcguaagccacugcaccuggccaauagugauaauucaguccuuacaauguuaugaaauacauagguacuauuguuauucauuuuauacgugaauaaauuuaaggcauaaagaagguauccugguuggcugugguggcucaugccuguaaucccagcacuuuaggaggcugaggcaggcggaucaccugaggucaggaauucgagaccagccuggccaaaauggugaaacccuaucuccacuaaaaauacaaaaauuagccaagugugguggugggcaucuguaaucccagcuacuugggaggcugaggcaggagaauugcuugaaccugggaggcggagguugcagugagccaagauugugccaccgcaccccagccugugcgacagagugagacucugucucaaaaaaaaaaaaaaaauuaaugguaucccccaaagucagacagcuaauaacuggcuuagcugggauuugaacacaggcaauuugguuccagaucugcuuuacuuuucuuguucagugcuguauucauagugccuaaaauaaugucugcuacagaccgggcagaguggcucacaccuguaaucccagugcuuugggaggcugagguggguggaucacaaggucaggaguucaagaccagccuggccaacauggugaaacccugucucuacuaaaaaacaaaaaauuauccaggcaugguggcaggcaccuguagucccagcuauucgggaggcugaggcaggagaagugcuugaacccaggaggcggagguugcagugagcuaagaccaugccacagcacuccagccugggcaacagagcgagacugugucucaaaaaaaaaaaaaauaauaauaauaauaguaauaauaaugucugcuacaaagaacgugcucaacaacauuuuuuguaaaugaauaacuauuacagaaaaaauacgugcaaugggaacacacuggggucacacuacccagcacugagggagggguggugguaguuggaggagauuuucuggaggagcucauuuuuuaaagugagacaugacagaugauuaggaguuagucagaugaaaggggagagauggggaagagggucacacacucaggaaauggcauauacaaaggcuuagacuuccccaugcucuuuccucaaaacuuuguugcuuugaauuauucaggaagaagcagcuuuggcaaaauuuuguuaacuuuuaaaucuuuuuuagggaaccuucugagaagcacugauuaugaccucacagaugcugcuggcagucccuuccuugcagaauccuugcuccugaauaucuuuaagaaaauuucuuaaaggaaaagacaaaaaauuuaacucaaaaguuaccuguuugccauagaaauuggugucuccccugaaggaggaucgagagccggugaaugagaacauuggcaaaggcacuggaauggggacauucacucccaccuaaaacagaacaaauccgugucauauccuaaggacaaaggaacucuccauuuagaaacacaaaggcaucagagaccaguuuuaaauacccaccuucuacccuauccucuaccccaugaacuuucauuccugaggaagaaauggggcaaugugggaggucaugggggcaaucuuaaaccaaugacucaccauuauuuacuguuuccucuuaggaaauaguaaauggauauaagaaucucuuaaaaauucuguucacgaaccuguccaacauccaccaagugggcauauuuccgagcaguggcuccauugguggugaagauggcaguuccauuuccauauggguuguuauuuacaaucuggauggcuucauccaauguuucugucuccagaaccacaagaacuggaccaaaaaucuccucuuuguaacaggucauauuuggcugccaggagugaugcauccagaaaagaagucagcuuuuuggauucugaguauuuuaugcuuauuugguacuuucacuuacuacacaucauuuacguggacaacuuucauauuacuaaucucuuuucauuucaaaucaccuauuuaaaaaaaaaguccucucucaaguguauuccgucuuccaaguuaccaaucauauaaacaacuuggaauuccuaucaacaauaaccacacuuccuuuaagggacuguaucuuuaguucaugacccaucaucagcugccuuuuuaauaccugaacgacuaguuucauccaauuguuaucaaaaaguuacaugaaaauuuauuuuuuauaaauccaaucuauaguaaauauaccaggauaauuuuucucuuuacagaaaccccaugcuguuuucuguaacauaaauaauccauucuuauucacuccuuugccucccaaauaugucuguauguuuauauuuugauaucaggucgcagacacucaaaacauccuucaccaugcaauuaauguuuguugcugauaaacggauuuuucuguaugguucuguggcaagagauuucauaauuucuacugcacuuacauucaacacuugaugauucacuauuauaguaaggauauaugaauuucaaaaaaugccucauaaccucaauuuuuaagucauguuagcugagagacuuucaaaguuuugauaaauaaaaauugacaagucaauuauuuuugucacuuucaauaaauauugggugguugauauauugauugagacacugcaguagccauaagcuaggcagcaagagggagaggggagagaaaacauuaacaaaccaguauaagauaagauagcguuuggcaaacuauagccugugggccaaauguggcuuccugccuguuuuuguacagccccaaguuaaaaaugguuuuugcauuuuuaaaugguugaaaaaaaauuaaucauauauaaaaugauaugaaauucaaauaucaguguccauaaauaacauuuuuuuuggaacacagccacacaauguuuauagcugaucucacacuacaaugucagaguuuaguugcaacagacacuauaucccugcaaagcuggaaauaucuaucccuuuauggaaagucugcagacugcugguauaguggaaagaguuugguugggaguuagaaggagaggcucauucagacuccagauaaaauaauugaucaauccuggcaagagauaaggucuuagucauuaaguauuuucauuaauaaauuagagggaugagauucuauagccuuuaaggugccuucagcucucauauuugugaagugaaaguuguucaccuugacauucgagaugaugguugguccaacaaaguugccauuuucauagccuuucacuuuaauuuuucguccaucaagaaggauggaagcucccuccuuuguuccacuaucaaucagauuacagacucgcucuuuggccuggggagugaucagagggccaagaucagcuccaggcugaucuccuguaaaacaacacagaagaauuuaagguccucauuaacauaaauuaugacugcugccagggcucaugccuguaaucccaaagcuuuaggaggccaaggcaggaggacugcuugagcccaggaguuccagaccagccugggcaacaaagugagacuucauauuuacaaaaaauaaaaaaauuagccaggugguggcccgcaccugugguccaagcugcucaggaggcugaggcaggaggaucacuugagcccaacaguuugaggcugccaugagcuaggauggugccacugcacuccagcuuggguaacagacagccugugcuuuaaaaaaaaagacugcuaacaagaugacuccaaaugacaaguacaguauaaagagaggaaauggcaagaauagacaugauuguucccacuggccaaggccagugacagaacccaagagcuuaaugccacagaugcaaaaucuaagggggcaagucaggugauugauuaccugcauugacucucagguuuuuggcaugcuccaccagcucuggcagccacuucuuggcuucucccacaaggacugcuguugaaagagccaugcagcgcugaccagcagcuccaaaugcugccccaaccagcugguucaggguauuuuccuuauuggcaucuggcaugacuaccccaugguucuuggcucccuaaaaaaaaaugcagaaagcacaugagucuuccuuggccaaauacaacuaagcuaagaaauuaagcaguggaccaggugugguggcuaaugccuguaaucccagcacuuuggaaggcugaggugagaaggauaacuugaggucaggaguucaagaccagccuaggcaacauagugaaacaccaucucuacaaaaaauacaaaaaauuagccaggcauaauggcaccagucuguggucccagcuacuugggaagcugagguagggggaccacuugauccugggaggcggagguugcagugagccaagaucacaccauuguacuccagacugggugacagagugagaccccugucucaaaacaaacaaacaaacaaaaaacaggaauuuguugucugcuggguuuuuuaguuauaugaagagcaauguuaaaaaaaaaaaaaaaaagaacuuacagccuuacagcaauaaugccaguaaccagcugaaaggcaaaacagaaaguagaccucuugauguagaauuucaagaaagaggccaggcaugguggcucaugccuguaaucccagcacuuugggaggcugagguggguggaucacuugaggucaggaguucaagaccagcuuggccaagaaacccugucucuacuuaaaauacaaaaauuagcuggguguggugguaggcaccuguaaucccagcuacucaggaggcugaggcaugagaauuguuagaaccugggagguggagguugcagugagcugagauggcaccacugcacucuagccugggugacagaguaagacucugucucaaaaaaaaagaaaaaaagugauuaacgugacuuagaaugaaacuccucaaaagguucaugauuaaagagaagacauucaggaggauaugguaaggcuuacgccuguaaucccagcacuuugggaggccgaggcgggcagaucaugaggucaggagaucgaaaccauccuggccaacauggugaaacccugucucuacugaaaaaaaauagaaaaauuagccgggcgcuguggcaugugcuuguauucccagcuacucgggaggcugaggcaggagaaucgcuugaacccgggaggcagagguugcagugagccgagaucaugccacugcacuccagcuuggugacagagagacucugucucaaaaaaaagaaagaaacacugacauuggagugggaugaguggccucucugcugaaggucuguuccuagguaauuuucauauauagaacaaagauuggagaaaaaaggaauaagaagucaccauauuggcuugaacccucuugccaugucuugauccucucucgaagauauacucuccugccuuguuggaucccacaaagcugauugcuuugauguccggaugaucgcaaauaaaauuuacagcuuuaagaagaaaauaaaugaucacucacaaaggagcaaauggauucucaacauggcaaauuuccccuuuccccacugcuauggauuugaaguuuuccuguguuuuucuuuuacuuuuucuuuuuuuuuuuuuuuuuuuuugagacggagucucgcucuguugcccaggcuggagugcaguggcacaauuucggcucacugcaaccuccgccucccagguucaagcaauucucugccucagccucccaagcagcugggauuauaggcacccaccaccaugccugccuaauuuuuguauuuuuaguagacacgggguuucacaaucuuggccaggcuggucuugaacuccugaccucgugauccacucgccuuggccucccaaaaugcugggauuacaggugugagccacugcaucaggccuguguuuuucuguacuggauucucauugugaaguucucuccuuguuucuuuuaaauucuauuuagccggcuggacacgguggcgcaugccuguaauuccagcacuuugggaggccgaggcagguggaucaccugaggucaggaguucgagaccuuccuagccaauauggugaaacccugucucuacuaaaaauacaaaaaaauuagccaaaugugguggugggcaccuguaaucccagcuacuugggagucugaggcaggagaauugcuugaacccgggaggcagagguugcagcgagccgagauugugccauugcgccucagccugggcaacaagagcaaaacuccaucucaaaacaauaaaaaauauaaaaauaaauucuauuuagucucuuuccuuucaugauuuuucucauuugcuauuccagaauuucuacuucuaaucuaaccuuuuuuuuuuuuuuuuuuugagacagggucucacuguuucaccuaggcuagaguacagugguacagucuuggcucacugcaaccucuguuugccaggcucaagcugucuucccaccucaugggacuaccugcacaugccaccauuccuggcuaauuuuuguauuuuuuuuguagagacggggguuucgccacauggcccaggcuggucucgaacuccugggcucaagugauccgccugccuucaccucccaaagugcugggaucacagguaugugccacugcacccagccuuaaucuaacuuugaaggcugcaacuccuauuuuccuccaaaauaacagccuuugaauacugaacccuucuuuuuuguccuuuaagaauaacaauaggcaaggcacaguggcucacaccuguaaucccagcacuuugggaggccgaggcggguggaucaccugaggucaggaguuugagacuagccuggccaacauggugaaaccccaucuguacuaaaaauaacaaaauuaguggggcacgguggcgcaugccuguaaucccagcuauuuaagaggcagaggcaggaaaauugcuugaaccugggaggcagcggguagagugagccgagaucgcaccacugcucuccagucugggcgacagagggagacuccaucucaaaaaaaagaauaacaauauuuccucaauggugacuauguacugggacacucagacacuauuguguucucauguaagagguaauauaguguaguuuuuaaaagcaaaaaucagagucagccuuccuggauggguauacacauccuggcuuuuucuagcacugugacuuugggcuaauuaauuucacuaugucucauuuuucucuucugcaaaauggaaaaauaauaccuaccucaaagggugauuauaaagauuaauagauaaaaagcacuaggaacggugccugaaacacagaagcacuauuuaaguauuagcuauuauuacaugaauuagaaggccuucaguaucucugagaucugcaaauucucugaauuaaauacccucauguauucucuucacacugaagaaaaaaguuucuuuuuaaucuuaucugugucuagcccuaauccauauuucuagugucccaauauauacuguagggcaacaagcacugcuauuccccaaucaguuaccuuggcgcacaaagauggcaaaaucaucaacaaacauggagguuaaaaugaguaaauccuuuccuccuuacaaguagguuccuuauccuaaaacauccaaccaucacucaacaccuugauuuuuugguagccagauuaaguagccauaugcauaagggcaguuaccuucaugcuguccauggaugauguuuaauguuccaucaggggcaccagaauccuggagcaacuuagcaagaagcauaguugcuccagggacucgcucagaugguuucauuaggaagguauuuccacacaccauggccaugggaaacauccaaagggggaucauggcaggaaaauugaauggagcaaugccugcacacacucccagaggcagacgguaggaauaaagguccaugucuuuggugauggauggcauggucucucccaucaugagggaugucacacuacaggcaugcucaaccaccucuggaacacagaagucaggccaucagcucuccacacuguguacuaguuagcuuuguccuguucucuucagcccugaggacaggaagugguucaggccaaugaaggggugcaggguacacugacuugcccuuccaaguuaaggguuugugcaaaaugagauucucugaaugggaaaaauacagcgauauguauauacccacuggaagaucauuugaguaaagaguaaaguaaaucagucuuagggauacugaauacugccauuuuucacaaguauuaaaaaagauaucaugggauggcaaaaucuauguaaaggaagaagcaaccucccauucugcgaucuuugccucccaucuuccuuugguccuucccaaaagucccauaaggggcucccagcuuacgaaggccucgaaauacaucuccuucagcaucagcuagggucuucccuuguuccaaugugauuaacuuggcaauuucuuucuagagagaagacacacaaauagaaauuaaugcaagaauguuccucuuuuaaauucugagguagcaaaggaagaauaagacuggaggagaugcaguacaagggagagagucaugaucaacgucucugcauacugcagaguaagggaggguggcugaaaaggucucugugagagugacaaacaugcccuaggugacaguuuggaaaagcauaccauuuagauuucauaccaaguuuucuuuaauaaguuguugauagcggagcaagaccugcuggcggcuuaauacugaagugucugcccaugcaggaaaagcacguuugcaggaagcaauggcugcauccauuucugccuugguggccugagggacccgaccaaugaccucauugguggccugaugagaaaaauaagcacaugauccuuugccugacucaccuucuccacuguacauccagucacagaaguggcacuaugugcuuuacaacagacacccaggucccuucuugcccaucaugucccuagaauucuaggcucauaaguugaagucccaaagcagcuucgcuuacuggguuguggauaucgauccauuugucacuuuuggauucaacgaauuucccaccaaugaagagcuuuacaguuggcugaaaaaaacaaacaaacaaacaaacaaacaaaaacaugaaacuuuguauuagcuaauugcuuugcuuuucccuuucccuugcaccaaaaggaaagaaaacaaguugauaacggaaucuucuggucuuuagaaauguuaccacuaggaaagagacacauaauaucccuaucuauucuguguguguguguuuauuuuuuuuuugagacagaguuucgcucuugucccccagucuggagcacacagugguaugaucucggcucacugcaaccucugauucccggguucgagcaauucucuugccucagcccuucgaguagcugagauuacagacacccgccacaacacccaacuaauuuuuguauuuugaguagagaugggguuucaccaugucggccagacugaucucgaacuccugaccucaggugauccacccaccucggccucccaaagugcuaggauuacaggcgugagccucugcaccuggcccuuauuuuuuauuuuuuauuuuuuugagacauggucucacucuguugcccaggcuggaguguagugugaucaugacucacugcagccucaacccccagggcuuaggugauucucccaccucagccuccugagcagcugggacuacaggcacaugcuaccaugcccagcuaauuuuuuuguacuuuugauagagacgggguuuggccauauugccuggcuggucucgaacuccugggcucaagugauccaccugcgucaggcucucaaagugcugggauuacaggcgugagucaucgugcccagacuauaguauauauuaagauguggcacagccucucaauacugugaucucucugagaaugggaaauucccugcuauucacacaguggaacuucaugaguagaaacacgauauuaugaagcuuauacuaaaaaagcagcaacucuguuaauaaagauuagcuauuaugacuuuuuggcccagcugacuguuacauuacugugagcauguauuaccuuuaugaucaaaagauuuuuggcugggcaaauggcucacgccuguaaucccagcacuuugggaggccgaggcagguggaucaguugaagucaggaguucuagaccaaccauggacaacauggugaaaccuugucucuacuaaaaacacaaaaaucaacugguuuugguggcaugcgacuguaauccuagcuauucgggagguugaggcaggagaaucacuugaaccugggagguggagguugcagugagcugagaucacgccacugcauuccagccugggugacagaguaagacuccaucucaaaaaaaaaaaaaaaaagauuuugaaaauguuucuauguauuuuuuucugagauauagcucacuuuaacuaauuuuuuuuuuuuuuaacauagagucuacuuugucacccagguuggagugcaguggcacaaucuuggcuuacugcaaccucugccucccaggcucaagcagucccucuaccucacccucccaggcagcugggaccauagguacgcaccaccacgccuggcuaauuuuuuguagagaugggguuucaccaugucucccaggcuggucucgaacuuuugaacucugacaauccaccugccucagccucccaaagugcugggauuacaggggugagccacugcgcccggccccuuucacuaaauuuuuuuuuuuuuuuuugaaacggagucucgcucugucaucaggcuggagugcaauggugcgaucuuggcucacugcaaccuccgccucccgaauucaagcgauucuccugccucagcccgcagaguagcugggacuacaggugcgugccaccaugcccagcuaaguuuuguauuuuuaguagagaugugguuuccccauguuggccaggauggucucgaucucuugaccucgugauccaccugccucagccucccaaagugcugggacacuaaauuuuuaaagcggucuaugaaccaaaaaauggugaccuacugugguacagugugugcauacuucuguguagaaagaauuugagcaauaguccuuauuuauuagauuuuagaugcuggaagugguugacagacagaugaucuguaaaaaccacucuaaaggucauuaagaagaagacaacuaucuggcagggucagcagaaccucuagaagccaugaaaauguuuguaucuuuugacaugguaauccauuucaggagggaaauaauccaaaaggaggaaaaaacuagaaaguuucacauacacucugaugacaauuauguaaagaagauagagauacccaaaacuauacugaauuccuucucagaagucaaccucuaugccaaauaaacucaccacugaagaagagaaggaagaugcugaauaccaggugggacuggauuucaccuuggaagaaaccugugaggcaaaagaacgauuauuuugauaaaugagagcagaaaguuauuuaaaauuuagcaaauagcuacuauaugcuauuugcuauaguauauaggggguauguuucucucaaaggccauacagucauuaaagagaaaagauaugaaucuaugacacagcaaacuaugaacaaacaauaaaccauaauaaucauguccuauauuuccaggauaguacugauuaaaaaaaaucuuuuugucauuauauuuuccuaauuugggccuggcaaauguaccauaaaucuaacaauaugaaaauacuuagcaugguaucuaacacaauagguacugaauuuaagaucauauaaaaucaaugugcugggcauggugacucacgccuguaaucucagcacuuugggaagcugagacggguauaucacuugagucuaggaguuuugagaccacccugggcaacauggcaaaaccuugucuacaaaaaauuaaaaaauuagccaggcagugguggcacaugccuguggucccagcuacuagggaggccaaggugggaggauugcuucagcccgggagggugaggcugcagugaaccgugauuaugccacugcacuccagccaggaagagagagggagaccuugucucaaaaaaaaaaaucaauguaaauauaaauauaaguaauagaguauauaaucaauguaaauauaaaucaaaauuuauuaccaaaugcaauuaaaauuauguccauauagguauuugaaaaaugaauguucauaagaacuuuauuuguaguagcccaaaacuuggaaacaacccaaugucuaccauuggaugggugaauaaggaaacuaaugugguauauucauacacuggaauacuacucagcaaaaaaaggaaugaccugcugauacaugcaauauaaauagucauaauaauuauggcaagagacagaaguuagauaauaaaaguacauacuguaugauucuacuuauguaacacuagagaaugcaaacaaaucuguaauaucagaaagcagaacagugguuaccuagggaugacgagggaaacuuuuuggggugauggacauauguucauuauguugauugugaugcuauuuucacagguguauacaaauguuaaaacucaucaaacugcauacuuuaaauauguacagauuguuuugugucaauuuuauuuuaauaaagcuauauugaaaugccauagguacauuaaaggaaaaaauguguuggauagauaauauuugauggaguaaaaucaguaaacggggaggaucaguuucaacaagauaacucucaaauuguaacucacuaaaaaagucuguauauauguuaucaaaguugauuuuuugagauggagucucacucugucgcccaggcuggagugcaguggcaugaucucggcucacugcaaccucugccucccguguucaagcgauucuccugccucagccugccaaguagcucagauuauaggugucugccaccacgcccagcuaauuuucuuuuuauuuauuuauuuuuugagacagaauuuugcucucauugaccaggcuggaguacaguggcaugaccuuggcucacugcaaccuccaccuccuggguucaagcuuuucuccugccucagccuccugaguagcugagauuacagacacccgccaccaugccuggcuaauuuuauuuuauuuuuuuuguauuuuuaguagagaugggguuucaccauguuggccuggcuggucucaaacuccugaccucaggugauccacccgccucagccucccagagugcugggauuacagguguaagccacugcacccagccuauauauauguuaucaaaguugauuuaagaaauacuuaagccaaucaaaaugagcaaacuaaaauacucaggacugggauauaaaggaaagcugcaaucuaauaaucuuuuaucuugccugaaaagggacucuguuaaccagaguauagagcugcaugaagggugccugcagcacugcccaggaaaagguggugguccuuugguccagcagauaguccuuccaaauaccucaucuguuugcucuucuauucccuaccaaagccauuucaaaccacugacacucuccuggagcccaucaugucuuauuuauagcuauguucccaauaccaauauaguacucgguagguaguagguguucaguaaauaucugcugaauaaaauagaagcccauuccugucugcuuccuaccccaaacuagguuaagaggcccuuuuuuguccucugaaagcagccaauacuucccguuucaggcuuaucucucuguguuguaauuguuugguaucuuauuccguuuuguguugcuauaacaaaauaccugagacugggcaauuuauaaggaaaaguaguuuauuuaguucaugauucugcaggcugggaaguucaagggaauggcucuagcuucuggcgagggcuucuguccugugucauaauauaacagagaagaucaaaggggaagcagaccugugugaagaggcaaaacuggggggguauccuggcuuuauagcccacucacacaggaacuaauccauucccaugggaacuaauccagucucaaaagagcaagaauucacucacuacagcacaaagccauucaugagggauccacccccaugacccaaacaccucccacuaggucccaacacuaucacauuggagauuaaauuucaacaugaguuuugguggagacaaaccaaccauauccaagccacagcaccuggguacuuaucuguuacccauaaagacugucaguuucaggaggguugacacugcaucugucuuguucaccuacuucagaguuaaagauuaaaccugaucaggacuguccaguuauagaaaaguaguuagcacaaagcugguacucauuaaaucuuauuguuaugucauuguaaauaacggcacggugauuucugccuguagucccaacuacucgggaagcugaggcaggaggaucucuugagcccaguucaagaccagcuuggggaacauaacgagacuccauuucuauaaauaauaaacacuuauuguuuauuuucacucuuugcuauuccacaacuuuaucuuaaaacucccaauucuacuaauuccucuuguacuuucaggagcugacuuuguuuuucuuacuucagagcacacagaaaccaucagaugagaacuucucaacuuccuacuagcaaaccuacaaaacugaacucaaccuaauggagaagguagccagcaagcuccaugcaggaaaagugaccgagacaguggugcacgaucaauauauguggacuggaugaagagguauauacuuuuuuuuuuugagauagggucucguccugucuccuaggcuggaaugcaguggcaugaucauagcucacugcagccuccaucuccugggcucaagccaucuuccugccucagccucccaaauagcugagaccacaggcacauaccaccacacccagcuaauuugcuuuuauuauuuuauuuuuuugagacagagucucacucugucacccaggcuggagugcaguggugcaaucuuggcucacugcaaccuccaccucccggguucaagugauucuccugccucagcuuucugaguagcugggauuacaggcaugugccaccacauccagcuaauuuuuuguauuuuuaguagagaugggguuucaacauguuggccaggcuggucucaaacuccugaccucaagugaucugccugccucagccucccaaagugcugggauuacaggugugagccacugcaccuggccacauuuuuguauuuuuaguagagacaguguuucaccuuguuggccagguuggucucgaacuccugaccucaggugaucugaccaucuuggccucccaaagugcugggauuacaggggugagccaccccaccaggcugccauuaacucuuuaaguuucccaaggcuugguccuaggccuucuuuucuucucauucuguauaugcuccuugggugauuuuaucaacucucauggcuuaacuaucuagauccugaugaugcccaacucuuuaguccuuggccaguauuuuccucuucaggugauacccacguaauuaucuuuaccacaucucuauuuggauguuacuugggcacauguuaaaaaaagguggcugggcacaguagcucacgccuguaaucccagcacuuugggaggcugaggugggaagaucacuugcguucaggaauuugagaccugccugcacucaauggaguacaauggcgcaaucucggcucacugcaaccuccaccucccggguucaggcgauucuccugccucagccuccugaguagcugggauuacaggcauaugccaccacacccggcuaauuuuuuuuucuuauuguuuuuuuuuuuuuucuuuuuuugagacagagucucacucugucgcccaggcuggagugcaguugcgcgaucuuggcucaccgcaagcuccgccuccuggguucacaccuucuccugccucagccucuugaguaacugggacuacaggcgcccgccaccaugccuggcuaguuuuuuguauuuuuaguagagaugggguuucaccauguuagccaggauggucucgaucuccugaccucaugauccgcccgccucagccucccaaagugcugggauuacaggcgugagccacugcgccuggccuaauuuuuuguauuuuuaguggagaugcgguuuugucauguuggccaggcuggucuugaacuccuggccucaaaugaucugcccaccuuggccucccaaaguucugggaugacaggugugagccacgacaugugaccucuacggauaauuuuaaaaauuaguugggcauggucaugugcaccuguggucccagguacuugggaggcuaaggcaggaggaucaccuaagccuuggagauugaggcuacagugagcugcgauugugccacugcacuccagccugggugacagagcgagacccuaucuuaaaaaaacaaaaaccaaaaaacaaaagcaaaagcuaaacucugcaucuuccuuuugccaguuugcuaugccuccuauagcccaccucucgguaaauagggcuacuccuuaacaaguugccaaaggagaaacccagauacuauuccaauuccucccucucucucugcagggaagcaaaaaacuccuggcagucuguccuagaauuguuugaaacacaucacucaccucuagcuguccugccauuaucccagucuauaccaucauugucucucacuugaccuuccauaauagcuuccuaacacaucucucagccucuaauguuaaacucuuucuuuuuuuuuuuuuuuuugagacagagucucacucugucacccaggcuagagugcaguggcacaaccacagcucacuguagccucaaucuccagggcuuaggugauccuccugccuuagccucccaaguaccugggaccacaggugcacacgaccucgcucucaggcucaagugauccucuugccucagucucccaaguaccuaggaguacaggcacaugccaccaugcccagcuaauuaaaaaaaauuuuuuuuuguagagauggggccucccuaucuugccagggcugguuuugaacucuuagccucaagcgauccuccugccugggccacccaaaguguugggauuacaggcaugagccaucacacccagccuacucuuaaacuuucugaaucuaguuuccaucccauaaucagagggucuuucugaaacauaaaucuggucagauuauucccuuguuuaaaauucuucuuuggcuuuccacugcccuuggaauaaagacuaauccccuugauguugcuuagaaaacgcuacauaguaucuuugcuuuucuaguuacauaacuggcuacuuuccucccuguucucuaugcuccugcaauuuaacgugugucuugcuuucuuugcucuugcacaugcugcucucucuugccuggcacuguuucaucuaauuuccuuggcucauuccuacuccuuuagguccccacucagccaucaucacuuucucuaggaagucucaaccucaggucuaugguaagcagcugauugugaagcucauaaagcacccaaauuccuuuauuucucaucucacgcuaugaaauaauagcuugucuaaugauuaacuuucucuccuuugaggucacuagauuguuguguccccagccccuagcacaauuccuggaagagaguaaguacuuaguaagcaauauuuugcacaaugaaagaaugaguacucgccaagcaaucauuugauauuguuucaguacucucaaguuggcagacaaugcacugaucagccaacuugagcauucuaggccacuuaaauuuuauuuuuucacuuguauacagccucccugcuguuaagaggauguaaaaagcacuacaucugguauaauagaacauauucauauaguuuuuugacagguucgaucuucuaucuuuucuucauuuccuaagaaacacccauuagcauuguugcugaagaaacuauccuguggccagucaccccaaacugcugcucucuagauguuuacuuccuacuugcuauauccuuuauaaggaacuccuuccucuccugguucauggccugcuaguccugcaauacuuggcucuuucccuagguccccacaguaucccagauacuccuauuguuuaucacuuauugcaguacaauaaaggagcuuucagugagcauuuuacuguaagccuaugucagugccuaacauagaaagagauggcaagacuuaaguucugaauuuucagccccaucaguuacuaguucgguaaccauaucaccgacagugcaagucgcuacaucucuucaagaguaauuuucuugcccaggugcagcgguucgugccuguagucccaacacuuugggaggcugaggugggaggauagcuugaguuuaagaguucaagaccagccugggcaacauggugaaacccugucucuacaaaaaauacaaaaauuagcuggcaugggggcacgaucuguuguugcagcuacucggagggcugagauggaagaaucacuucagcgugggaggucgaggcugcugugaguugugauugcaccacugcacuccagccugggugacagagcgagacccugucucgaacauuccuuuaucucugcaugggagugauaauaucacaaggagcagagagagguuuuagguuaaguuugacuacucuucguggcagagaaaaauaagcugaauacuuaaaauaauugaaaacauuaacuuucuccucuauaaauccuuuugauaguucucuaauauucauggcugccaaaaucgagguuuuuuuuuuuuuuuuuuuuuuuuuugauggagucuugcucugucgcccaggcuggagugcaauggcacgaucucagcucacugcaaccuccgucuuccggguucaagcgauucuccugccucaacuuccugaguagcugggauuacagucgcccgccaccacacccggcuaauuuuuguauuuuuaguagagaagggguuuuaccauguuggucaggcuggucucgaacuccugaccucaggugauccacccaccuuggccucccaaagugcagggauuacaggcaggagcuacagcgccuggcccguaggcuacuuuuuaucgaacuuuuaaucaaagauucacguuacaacuccuaguuggcugaggauuacucuaucuguucuuuuccaggucacuucagaaguuucuccaaaugaaucagaaaauacauagugucuguuucugaaauaaaaguacauggaaagagagauucuucuccuugauggaaaaggacaaaauacuuucuuaagguucucaaugacucauugugaugggaggggaagaggaggcaaaggaaaaaagccaauuucaguaaaagauuucaagaaguugguaagaaaaauauaggguggaaacuuuguuuuccugcuacuaaaaaaagauacuagaacagaacaaggaucgcagcaagaaauaugagugaggccagaccaucugccaaacccuucaaacucauccuuucuaccuuccccauuaaauagcauauuuaaaaaugaaucuuugcugacucugccaagaaucuuaaaacugcccaaguuucuuuacuagaacucacggaaaccuggugaauacuaauauuaccuaaaagcucagcaauauagaggaaauucucagacuggauguaaugaauaagaacggcacuguuguuucuugcagacuguuucuugccugcgguaaaucuugccacauacucuaaauccuugguaggccaugaacaggggaaagacuauaaacagaguuggagauuacaggccucaggcaugcaacuccuguagcuuuaccauuucuccuuagguuggcuucagagaggacucaaucccccaagugcagagaugaggguguguagcacuagaagagcugauuuuggggugggaacuuagacuucuugucuuaccuggcucccacuuucuaucacccguuuuaaagauguuugguaccuugaacauacauggaacauacugguagcuuuaacugugugcccuuaucuacccuaucuauguagaugugcccuaucuauguaaacuguaacuuagcugagaaaaaguuuaacucaaaguuuuggcaagaaaggggacagccaguccauggaaaauacaaagagccacacuuagggaaaauagcuuagcaaauggcugccuuuggugaaaaucuagaguccaccucuagaaggaaauucaaaguucauacacugacccucgccccucgcguccccccucccccuuaccucagaucaccacggauagugaaguagggugggggaagggagcaauggcaaaguggacgcucacggcaggggacagaguaaccaaaaagaguaguuucugggggagagagagaaggcuggugcagagguaaaaaggaaagacggugggcggauggagagaugagggcaagagagugacagcagggagcgggcagagcuggagaaggagagugggcgagagccagaaaagaggaggcuuaggaguaaaaggguagagggccaaggguaacagcccaggguuggauccgggaccagggagguuaugaagugagggcugggcaugggacagggccgcacaggucggguaggaggucuggccaaaaagggguugggccaagaagguggucccgcccgaggauggcucagggagcggacggaaaggauccaauuccuagcuucauggugccuuggcaccacccucacucgccugcaggauccgggcucgcacugccgccgccgccaauagcgccgccauggcucucggccgcccuagcuccgcaccccgcgccucuacugcccagaagcacuacagcugccaggccucgcccuccauccu

SEQ ID NO: 17101 - RNA, 10866 nt, Homo sapiens
ccccauauucgagccuaauguuccuuugggaaacaacugaguaaagaggaugccaacccccaaaagaaacugaagauaacguucugcccagugggaccgaugaucaugcuauaacacuccuuuugucuccaggaaaagcugaaagcagcucuagcuaaccaaccccccucuaaacccccugacauacauacggcuuccaacuccagcaagggggccaaccaacccacucaaaucaaaaccaaaaacuaaaucauaacaguaaaaauaugaccagcaaacaacgaaagaggauaucucuggucccacaguuuccuacgggagaccagauggcugauuucuggcauucucuguccuggagccagaaaauaacacaaauauacccuuggacuuaggguagacacugugggacccagagcaaaggacauccuggccaagccuggggucagcucaggucccugacccucuccaaacuggucccccuucuucccagccccuuuuguaccucccugucagccaucuaccagggucaggccgucauagagggcucgcuuccacauguaguauguggagcgggcagugaggggaaagagggcacugaacuccuuguaggagggaaagcucuuggacuggaagcgcuucugcaagaacagcuuggccugggccuugaacuucgugguagcgaucauguccaucaccagcauccggccaucccugccacccgcugcugccaccacagguuggcucagcaagggcccacuguggggcuggcccugggcuguggcccccuccugcagggcccccucucuggaaggcccucccucuacaucuucugaagaagcccccacagguggggccaucacagcugucacaucccugccagccuccuucuccugcuucuccucagccuccugccccccuuugcccaagguggggaccggcaccugaaguuuggacaggccucugggccaaccccgagcaagacucuuccagacccaaaaggcagaaggugacaggcugggguagcggaggcggaagcggcagaaagggagaugcccacucagcaccugccugcgggcagcccugcgcagacgccucugccaacgggacaggggcauccuuaguggcaggagcuccccgggggcgggaggguccucaccuguggcauucccugcccccucuuccgccucacucuuccaaggaauuacagccccuuccccaacagaugcuagcuggggagucccagcagcagagagggcuggugccggcuugaagcugggguuccuccggagggccuuucgccgccaauuauaauaaguggaccgugagaugccagggaaccugcguuugaagcagcgauaggguaccaguguguucagggagaugcaaugcuccagguacaacuuggcccgcugcauuaagaccauuccagggcuugacaccgccagugcggagcacuccagcuccuccucagccaccugcuccuccggcagcuucucuagcuccuccaugcccagcaccucccuggggggcaaggccgggcaggugccagagcccagcagcucaugcuuccaggcauaguagguugagcgggagaucuccgggaaccgcuggaggaacugcugaaguggcacgacgcccccccgguggaagcuguccugcaggaagugcuuggcggagaagcgggcagcaaccuucugccggugcuccugggacugccgccgccagcgguagaaggugcuuuuggugacgcuguagcgcucacagaggugagaguagcugaggccagguucacgguugagcagcuccagggucuuggccggcgaugagaguggggccagggcuggaagagcuggggccacgccaggggcaccuucagccuccaccucuuccagccccaccacaggggcaaaguacugguggcggaagaaguggcuggugaggggcuggccagcccacaugaugugcagcguggagggcacguggucgcagcggcggggccggaugacacgguugaaguagggccggaucuugagguugcgcaugggguagauggaguagauguuccgcuggaggacagaggcgagagcauacaagugccacacguuggagaagcugcuggggaaacaggaggccuugacgucggcaucgaagauggccuccagcguggcggggggcaagcuggucaucucaggggacuccucagagcauagggaguagcgcacggccugcagcaucacuuuggagucgaucaugcccuggagguaguagugucugugcagcagcaucucuaccacggugcgggcccgcagcuccaggcugaggccugcgucaccccacagcagcaugcuggccgccucgaacagcaggcugcccucccccuugcacaccagcggcagcauguuccguggagcaucuucuggauacaggcucagggccaccgaguccacuuccagcaccuggaggccagggccucccucccggcagguggggagagugaaggaagacaggaccugcuuggccuccaaggaagcaccuaugagacccuccaggccuucgcacuccacugcuuccugcagcuccugcagcaccuucugcaccagcugguuccgagaagucauccugccagggcaaaagauaaaggggcaguagucaggucgaagugcccagaugaugacuagcaaaggugcccuguccacuccugcacuuucucccaaaagguaaugucuaucugcucccguccucccacaacagacgggauugguucaucacugaaugguacugaggaaaaguguggucucuagaaccuggcuuugaauccuggcucugacauaagcuuggucaccuuggaucacuuaaccucucuaugcuucuguucauuuucuauaaaaugggaaugguguguuaaaaucugcuuuauaggccaggcacgguggcuuacaccuguaauccuagcacuuugggaggccaaggcagaugaaucacuugagggcaggaguucgagaccagccuggccaacauggugaaaccccaucucuacuaaaaauacaaaaauuugccaggcauaguggcaagagccuguaaucccagcuacucuggaggcuagggcagaagaaucacuuaaacccaggaggcagagguugcagugagcugaguuagagccacugcacuccagccugggcaacaaagugagacugucuccaaaagggaaaaaaaaauuaauaaaauaugcuugaguuguucugggcauaaaugagacaauaaagagauguuggcugggcgugguggcucaugccuguaaucuuagcacuuugggaggcugagguggguggacugcuugaguccaggaguucaagaccagccugagcaacauggcaaaaccccaucucuacaaaaaauacaaaaauuagcugggcacaguggcaugugccuauagucccggcuacuugggaggcugaggcaggaggaucaucugagccugggaauccgaggcugcagugagcaaugcucgcaccacugcacuccagccagggugacaggaaugagacucugucucagaaaaaaaaaaaaagagagaggccaggugcaguggcucaugcacuuugggaggcugaggcaggcagaucacuuaaggucaggaguuugaggccagccuggccaacauagugaaaccccauugcuacuaaaaauacaaaaaaaaaaguuagccaggcaugguggaaugcaccuguaaucucagcuacucaggaggcugaggcacgagaaucacuugaacuugggagguggaggccgcacugaguagagaucaugccacugugcucaagcaugggugacagaccgagacucugucucaaauaaauaaauaaaugaugcuauuuuuuuuuuaaagaaaagaaagaaaaccguuauccuuaaguacaugucguuuucaauacuggguguaaucaaauggggcauacuuauaacacgcuugcugcaacccgagguaugaugaaugucuccauuggaugauuguucugcuuuucugauaaauuagcucccuuuagcaugauauacaauuuuuacuugaaagaaagucuaauagacacuggucauucagauuuggauauauuuggcagauauuuucucaaaaaugaaugaagugagacuguaauuucaagggaaacaacuauuugcugcccauaaaaacuuaucagcuuccaucugaaaaucucaauuuuucugaugagaucaguggugacaauuuuuuuuuuuuuuuuuuuugagacugagucucguucugucacccaggcuggagugcaggggcgcaaucucaacuggcugcaaccucuaccucccggguucaagagauuugccugccucagccacccgaguagcugggauuacaggcgcaugccaccaugcccagcuaauuuuuguaauuuuaguagagacgggguuucaccauguuggccaggcuggucucaaacuccugaccucaaaugaucugcccgccucagguucccaaagugcugggauuacaggugugagccgucacgcccagcccuaacaaauauaauuuuuuaugcuguauaaugaauugucaauuguuuccacuaaagaucuacaucacucagugaacauuuuccaaauagccaaugggugcuguuacaaagucaugcacuuguagaagaaucauucaaaguauaaaagaaacccauggggcugggugugguggcucacaccuguaaucccagcacuuugggaggccgacacgggcggaccacgagcucaggagaucgagaccauccuggccaauguggugaaaccccgucucuacuaaaaauacaaaaauuagccaggaguggcagcacaugccuguggucccagcuacucaggaggcugaggcaggagaauugcuugaacccgggaggcagaggcugcagugagccaagauugcaucacugcacuccacccuggggacagagcgagacuccaucucaaaaaaaaaaaagacccauggauuuuaauauaacaggguacaaaaaguucauggauaugguuucaaauuccacauuauaacuaagcuuugagaagcuacuacuuguaaaguuuugguauaauaucaaaaaaauccacugaaaaagugaucaaaauacuccuccuuuuuccaucuauauaucugaugaaguuagauuuucuucagaugcuuccaccaaaacaauauaucaaaacagauugaauauagaaagauaugagaaaguacucaucuucuuuuaaaccaaauacuauggagauacagaaaaauguaaaauguaaaaauguagaauaaugugcucucggacauuauuuaacauuuuuccaagucuccauaguaucugguuuaaaagaagauaggccgaggcaggcagaucacuugaggucgggaguucaagaccagccuggcuaacauggugaaacucugucucuacuaaaaauacaaaaauccauccuggcuagcauggugaaagcccgucuccacuaaaaauacaaaaaauuagccgggcacgcuggcgggcgccucuagucccagcuacucgggaggcugaggcaggagaauggcgugaacccgggaggcggagcuuacagugagccaagaucacgccacugcaguccagccuggacgacagagugagacuccaucucaaaaaaaaaaaaguaguuuuuuugcucuggaaaugucacuucucauaaaaaugauuauuuguuacuguauaacaggcuuuuuaaaauuuauuucuuauuuuuaauuuuguguacaauauacacugguagauauaaccuauauaaacaaaagguuuucagggucugcagaccguacaggaguccugaaaccaaaaaguuugagaagugcugccccagaaacagccuuucaaagggguagcaacaaucuauucacugcacaaagaucuaauaacuaugauuuacugagcauuuacuauuugccaugcacuguccuaauccugacacuaauacuuuaaguacuaccauuauccccaauuuacaggugaggaaacugaggcaacugaaguuaaccuaauuugcccaaggucacaauacaaguuaguugaaaccaaacacuuuuuuucuuuuuuuuugagacagaaucucacucuaucacccaggcugggguacaguggcucauucuuugcucacuacaaccuccgcccccaggguucaagcgauucuccugccucaaccuccagaguaacuaggacuguaggcacaugccaccacgcccagcuuauguuguagagaugggguuucaccauguccgacaggguggucucauggucucaaacuccugaccucaggugauccacccaccuuggccucccaaagugcugggauuacaggcgugagccaccaugccuggccccagaugcucuuuagggucugugauucaucuccuguucaaaccauuaaccaccuuuuaacacaaaacuaaucaucucaauuauugguauguuuuuauuguucaguugcaaagcagagugguauuccuucauagacacuuuuuacauuaggggagggaccauuauccuuucugguuucucagaucauguucucaaauuaaacuuguucucagaguucaauaaauugcuuuagaugacccuuagguuuaaaaaugguguuuggguauauacauuuuucagaucaaacuguacgcuuaaggccaggcgugguggcacacgccuauaaucccagcacuuugggaggcugaggcaggaagauuacuugagcauaguucgagguuacagugagcuaugaucacgccaccggacuucagccugagcaacagaggagacuguccccaaaaagcaaaacaaaacaaaaaagcuacauuugaaaggaguggaugaaugcaaauuguaauuuaguaaaaauguuuuaaaaaauuaaaaguagggcuggggcgcaguggcucacaccuguaaucccagcacuuugggaggcugaggcagguggaucacgagaucaggaguucaugaccagccuggccaagauggugaaaccccaucucuacuaaaaaugcaaaaauuagccaggugcaguggcaggugccuguuaucccagcuacucgggaggccgaggcagaagaauugguugaaccugggcagcagagguugcagugagccgagaucgcccaccgcacuccagccugggugacagagugagacuccaucucaaaaauaaaaaauaaaacauaaauaaaaaaaauuaaaaguacugaggccgggcauggugguggcucaggccuguaaucccagcacuuugggaggacgaggcaggcggaucacaaggucaagagaucaagaccauccuggacaacauggugaaacccugugucuacuaaaaauacaaaaaaaaaauaauuagcugggcaugguggcccgcgccuguagucccagcuacucgggaggcugaggcaggagaaucacuugaacccaagagacggagguugcagugagccaagaucgcaccacuguacucuagccuggaaacagagcgagacuccgucucaaaaaaaaaaguacugagggaacagccaccagaauuuuacuugauaaccaaagaaggaaagucguuuaaaaauugguaaucagcccaagugcaguggcucaugccuguaaucccagaacuuugggaggcugaagugggcagauagcuugagcccuaggaguuagagaccagccuggacaacauaacauaaccccaucucuacggaaaaaaaaaaauuagccugcauaguagcaugugccuguagucccagcuacucaggaggcugagguggauaaccugagccucaggggacugagauuaugccacugcacuccagcccgggugucagagugagacugucuuaaaaaaaaaaaaaaaaaaaaaaaaaccugguaaucagaaucaccuuuggacaaaauuucuaggcuguggauuucuuuaaaauguguauauuauaacaaaucugguauaaccucucaccauauuucuauuuguaccauaucauuuaacucuagaaguuggcuuuuauuaaucugucaacuuuuaugccuuuuauauuuacuuuaaaaagaaaacuauuacuuuucuuuggauucaggagauaauccauaucaguccuuaguaaagacagcacuuaacauuauacaauuuuuaaaaaaggaauccugaagaacaaacuguguacacacagacaagcuuuuucauuuuggcagacaaugaugucaacaagcaagacguuggguuuuuguuuuucuugcauuaugucacuuguugaaugcuauuuuacaacugcauacaaaugagugcucugcuagauacuuuguaaacaaaauuaggaaaauagcuaccauuuacugacugcuuccuaugugcauuuaacuagguaauucaaccaaaaucucaggaaaaacaagagggaacaauauacugaagcuguguggauauuuuuauacccuuacacgcaauuagccgauuuccugaggagagcaugauguucccugaaguguuaacaaguaucugccagcuuuucacccucaagcauuuggaguucaggcuuuucagugguaauuuuguuuauaugugguucucaccuuccuuccaugugaacuacaauuccaucacaccuacgcuaucuacaggaucccuaguccgaguucacaccuggagguuccggguuuacauuaaguagcuuucgcaagaccacacagcuuuuaaaagcuacaaagucuaagcagccugacucucaagcucccuuucuaagcacuauaauuccaucauccaaaauucucauuauccaauggauccagaaacuuauggauuuuuaggacuuuaagacaaaccuggccauuuuacagauaaggaaauugagguccacaaagguagagucgacuugccugaauucaugcagcaguguccagauaccuuccaacacaacguccagauaugccacacuuccucuugcacaguccccaccuguccccacccuccucgucccacccuaucuacucuucccaggcccaguuccacccggcuccacccaauuucauuccuuucucuuccccaaagagguaggagguacaaguaugugauaccccacuucuggcuuccucaaaagcuuaaggaaaagcagcuccacacucacucccaacccacagauggauucgcccaccagagaauagggccguguggaaaggguaggggcugcacggggaagccuaucacucuuaaguagacaauugaugaugggguucaggugcaacagucuuuuuggcaauggcucucuuccuagaagugcaaugcaaagcagacaagccgguugccaggugcauucagggaaggaggugcaaaaagugauagcuaaucuauggacuuugcccagcuggccugcccuggcccccacaacucuuggaagugaucugaaaagguaugaaaccaaggaggcaaggcacacucgggauugcacaggcucauccccuccucuugccugagauuagaagggcggggguaaaggcaggacauccagaggcauccagccaggaucuuagcuccaguaaagccaaggaaugaaugaauggccacaggcuacucugcagggcacucacagccucgccuucaccaaggucagccuccccgcucccccauucuuuauuucaagcauauggggucucagaacccaggucuggccucuuguccccugcgucuuaagagugagccaggaaucugggugggccaagggauggaggggcaagagaucugcuguuaugagccuggccuggucuuuagaacaaaauccuuccccaccagccucauucugggcucuagcuuaccauggaucccauguucucagcccucccuuuucuuccucucccucccaaagcaggcgcuguguucucuauagucaaccugcacaugggccaccaggucucaguaaggcuguggguucgauucuccccuggauggcuggcuccucacccagccuugcgccgugccucucugcccugcccucccugcccuggccacaccagcccgacugcacaggcugcgccugccagggccuaagggagcgccagccaucuuugcucccuccccgguggcccuggaggccagcugggcaagggcagcugccaggguuggcugguggcagccaagccuuugggcugugacuucccaaggaaauucccaccaccaaggguaguggcugcaccuugggucacaggggugggccugaggccaccaagucaauccagcccaguucaguugcucuacuggaccacguguuuggaagggaggaagagugcagcccacaaggggaagcagcacaggcucccgguugccccuuaaggugccaggaggcaaugaguggcaaaagagggagcuggcagguccggggcuccagggacgagggauccaaccugagaagcccggggaaccuggggagggaccgaggccagaccauuguguaggguggggaagggagauaggcagacggguggggguggggacagggcuggagguggagguggggguggggagaaagagagcuugaaacaaugcguccucucccucuacauacacucccagacacacauacaccacagcaucuucacggggccacuccuugaccugggcccaguagggucccgagaucaucccugaccccgcuggagccuccaaacuguacggggcacccccacccuuccuaguuuugaggaaacucgcuguuuuacugaccuggagugugacccagagcccugggggcauccacuucucgcuccaccuuccagccugggacauuuaagucacccuguggggaaaggccuucucaaguagcguccccagccgagcucg

SEQ ID NO: 17102 - RNA, 3796 nt, Homo sapiens
ccucgcggcgggguugggggcgcagccccagaccgcugugggguccccaggcgugggagagccggcgcggcccggguccggggugcugguugcugcuggcccaggggagugcuucuccgggucugcgcagguggcuggacacgccgcgacugcugcgcgcgggacggccuccuggccuccgccucggugggccuccuggggcucccccagcccggcugggcccgcuccacgggcugcaagcccgcgacaggcgcguccugcucccggaacagacuguacaccuuggcugcagccgcugccggguagcugcccccagggcgccgcagucgauucgcgucuccaccagccggcucguaucucccuacggggucccuuugggcaugacccgcgcccacgaagagagccagggugagcggcaggaagccucuccagggguuccgcagggcgcgccccgggcugcgggcuuugguccgcggccucauggcgcggggcggcuggagaguggugcgcgcgggcaccgcgaagagcuuuguggucggcacgcuggacgcccgcgggcuguucucccggccccgcccggcggccagcuucucugagucuagggggcccugaagcggccgacugggggcccggcucucggcggaacgagggcugcgcgccccgagccucgaguccgcgcuccuacuccagcugggcucgcacggcugcugcaccuucgcgccuccucccugugccugcagccgucugaaggggacccggacgguuuuauuuuuggaaaccucccccggcuuuuucgucucuuuuauccacaccaggcccccuccucggagggacagcucagcccccucauuaccggagagggagcgaggaauuccagcaacacccacuuuggcaccgggaagccagcgggcggcgagcgggcggcgagggggauuaacccgugcggagcagggggcggcgcggggcugacccaggcgcuggucgggcagauggcgccugccacgaccgggacacugggccgccuuucuccugcucugggcaaguucgaacugcagaccugccccgaaucguucucccgccccucgccucagggaccgucuuuggaucgggggacccaggcugcagccuugcaggucugaaggaagccgggaggggcgccgaggcccgcguaggggaacagggccgccgcccccuccgcuugcgcccuggccgcugggggcgcccuccgcagggccggccggagcggggguggcgcggggcggggcgcggcgcgcggagcgcagggaggucccgggcgcgcccccuggcggagcuggcggcccuggcgcuccguggcugcaaugcccuggcgccgccgccuucgcucuggaucucaauccccuuccacuggcgugagggucacgccugagccuggcgcggugauggcugccgguagaagagggguccucuuuuucuuuuucuuuuucuuuucuuucuuucuuucuuucuuuuuuuugagacggaguuucgcucuuguugcccaggcuggagugcaauggugcgaucucagcuccccgcaaccuccgccucccggguucaagcgauuccccugccucagccucccuaguagcugggauuacaggcaugcgccaccaagucugacuaauuuuguauauuauuuuauuuuuuaguacagacgggguuucuccauguuggucaggcuggucucgaacucccaaccucaggugauccgcccgccucggccucccaaagugcugggauuaaaggcgugagccaccacgcccggccaagggguccucuuuuucaccgaggcaaagacacggagccucuugaguaagucacucaaggagauagcgcaugugaaagaggggaguggaaucuaggccucccgccucuggcugaauccauucccgggaucccacccagcccuucacucucucgggaauuucccagagggggauucggugaccccgauugacccagugugugcauucacaucuuguguuagcagggaggcgggcaggggugugggaaugcugacugccgcugucugcguguccccaguaaucagcacaccauucucacccaugcucccucccuacagccuaaaggcuuggaucaacagggcugccccuggcacauuuguacagccuauuucccagagaggcagagugaaggagcuggcaugugggcaccaguucacaaccucccacaccacacaaaagacaagcccagguaauaucuacuguugaaauaaagccucgaccccuggccuuggccuacaaacccuagcuggcugcccccgcucugauuucaucuggccucuugcucucccuuacccaccacacugugcugccuuggcccucucucugcuccuugaacaagccaagugaaugcccccuucccucuacuggaagguuccucuccaggauguuagaggguaguuccucaucacugcuccucucagauuaaauaucagcuccuggaguagccaucccugaccuccaaucuagagcagcccucccucaccccagucaugacucuaacacaccacccuguuucaucuucauaaaacaguugacaucaucuuguuauugauuuguuugcucguguaacugaauuuuuuaaugggcugaaccuaaagagggacuauccagaaacugcuccacuacuaccuucaaccauauuaugguaaauuucccuuucccacccuuaaugacaucucaggcagaguccuuggcuugagaggucaucccuaccagacacgagaacuauucuauuaauauaauuaagacccauuuucagacacaaaaagucugcuccuguccagaucaaaaucucauccaaguuaaucaauaucacaucccauuuaauaguccuccucuccccugucccuuugcuagagauccugcaguggugagagugggguguggucuguuuuccugaccucccuuuucugcuguggcuccucuuugucaaggcugggagagagguguuagaggaaaaguagcaaagucuuaugugacagguacccuugguuggcaggugccaagcgcuggcuuuuucaugggcacauauguggguuuuugggagguucucuacaggaccuccacccugaguugccauagcaaauuacucucuggccaaccucucggagaccccugcauccucugucucucauaggacugucccaccuaugccaggcaaaacaaugguggguuggccgcuccucacccugcccacuucucaccuugccacacaggccacuccagcgaggcuccacgaucagaauucuccagacaggaagugcacacaagucucuucauuuauguacguccucaauuccuaaagacauauguuggguucucccaugaacugucuugcuguaguuuaaugcaccgaggugccuguaacauccagcaacauagucagcaucaguggggggacaguuauagggacagagccuccucuucuugcagaugacugguucucucugggagcucccuucauuugguuugaguuggggaguucccucaggggaaaucucagcccugcccacaaaugcagcaguguuaugcuucagugacuuucuucaaucccuuucauuuguagacuggaauugagggauguaguuugauugcuguugaaccuguucugccuuuaguaaggugucuaguacuucucuucagaaugcaagaauauuuagcccucauuguucuaucuuuguggcuucagcagauauuccaagagcagaggaaaaguccuauucaacaaccuauaaaaucauuucuugucu

SEQ ID NO: 17103 - RNA, 76323 nt, Homo sapiens
cggucgcgggcccagcucgggagcgccggcgcacuggcgcgcuccguuuacacgcuccggggccuguaggcgccgcgaguuccggcugucgccgucgccgccgcggcuccuggaggucgguugcgacgaguaacggcgccaggacgagcccugcgccuucuuuuucgauauguacccgaauuggggccgguauggcgggagcagccacuauccgccgccaccggucccaccgccgccgccaguggcgcuuccugaggccucgccggggcccggguacucgagcucgacgacucccgcggcccccuccuccucgggcuucaugagcuuccgcgaacagcacuuggcgcagcuccagcagcugcagcagaugcaccagaagcaaaugcagugcgugcuucagccccaccaccuuccuccgcccccucugccgcccccgccagugaugccggggggcggcuacggagacuggcagccgccaccgccaccgaugcccccgccacccgggccggcccucagcuaucagaagcagcagcaguacaaacaccagaugcuccaccaccaacgagacgggccuccugguuugguuccaauggagcuggaaucccccccugaaucucccccugugccgccuggguccuauaugcccccaucucagucuuacaugcccccaccucagccgccacccucuuacuaccccccgaccucaucucagcccuaccugccuccugcucagccguccccuucgcaguccccaccuucccaauccuaccuggcgcccaccccuucuuacucauccuccuccucuuccucgcaauccuauuugagccauucccaguccuacuugcccucuucucaggcaucuccuucccgccccucccagggccauucuaaaucccaacuacuagcuccaccaccaccguccgcccccccuggaaauaagacaacuguccagcaagagccuuuggagaguggggccaaaaacaagaguacugaacagcagcaagccgccccugagccagaucccucuacgaugacuccacagguaagaaagcaucugccugaaccucaucuuucaccuagagggcccugaaugagcaggccucagggcuuuaaccagugguuagucuaauuccaacacacaaugacuagcuaacacuccaaaggauuccguaagagucagagggcugacagcucagcuuuuuaauuagcuagaugugaauuaccaaaaaaacagcguuuguagauguguauggauuacauacaguggugggguggcucaaaaguuaccucucagauacauuccuugguuucuuugaccauccucuuagauuuuguugcuguugcaaauagauuuuguugcagagggucuuguuuuaaaauuguauuuuaaacgaaaguuuccauuugagagaaagcaugaaaaagaggccucgccaagggcugacacuugaauguuuguaaacuuuaugauuaguuagcuucuuuuaaaaauauuacuuaggggccagggauaguugucagcuuccugaauuaagagguuucagaaaaaggauggaaaucuugucuuaccaggagcauccuaauuaugcuuauagguacauauacaauacauagaugagucccgagacccuuuuggggaucgauugguccauuuuaggaauugacccagacauccuuuucucauauuauuuaaagauuguuuuaagauaaugagcaauuuucugcguuucauugucauuaccauucacuccaaagaaacagccuugcaauuuggccaacguaaaaaaaguuuggugauaucuuuucaugagagagucagccauucuuaucccgcagaacagacaaauugacaggguaacaguaauaaacgaguucccccuugagagagggaaggucaaacuaaagcagaauaaaucaauuguuaugauuuccuaaaguagacacuuuuucagcgauuacuaauuuaccuuagauucacuaaggaaaaaagagaaucuuguaauauaaacgcucagauuuaccuauaaaagauuuccaaaagauagggaugcaguauuauaauuuuacggugguuuggcauuagaaauuaagaacagaagcaaguuguuuuaagaaaugaugcuuggcacaucuucuggagaaaacacuugggaugcugaaauaaaguaguagaauaaugauucuguuggcuuacaucaaauuuguaccaucucaccaguuuauuuuccccagauugcucuauuauagagacagacuuucuguccucuuucccaccccacucugaagucuuuagugcuuuuguugucaaacauucucaguuagucugagccaaaauaggacauuuauauucucacucuacuagacuguuuuucugaccuuacagagagacaaaauaauuguauuuuuggcuuuuuuugggaggagugugugugucagaucaggccuuaauauguauaguuaccaugaacagugcuuuuacuuuucugccuuuguacccuuuucuguaaugaacucagugucuugaauauucagugccugcaauucuuuggugagaggcagagugguggaaaaugagacuuguggugcacauagaccagaucaagaagagccuugaagccuguggcuuucuuucuucuuuuuagaauucauccuaaccuccucaacccucuguuuccccuuagaguuguauugcuuucaaggcauaucucaaauaucaagguuuccaugaagcccugcuugugcucacccaucugguuugguucuguucuucagauuguaagucccuugcagacaggaauuaucuuacuuaucuucuuauuaccguagcaccuaggacagugccuugcaaauuguaggcucuccacagauuuguugaauaaaauacgagaguugucauguucuagacuuaggauauguugguuuauuagaugauaaauauuucuucaugccaguaccagucucuggcaauccuucuacauauuuauuauucuuugauucauauuuuguuuuuggaaugugucauucaaaauuucuuaucgugaaauauuuuuaaaauacacaaaauagagaaaaaaguaugauuccccauacauacccaucauugagauucaacagcuaucaagauuuugccauguuuacuucaccuaggccuuuuuuauuauuguugcauauauauauauugagacagggucuugcucugucagucacccaggguggaguguaguggcauagucucaguucacugcaaccucugccucccaggcucaagccaucccaaguagcugggacuacaggugcaugccaccaugccuggcuauuuuuuuuuuuuuuuuuuuuugguagagacgggguuuugcuauguugcccaggcuggucuugaacuccugagcucaaacaguacacugccuugaccucucaaagugcugggauuaugggcaugaaccaccacaccuggccucugcugaaauauuuuaaagcaaaucuuagaucuuaugucauuucaucccuacauucuuagucaaguaccucuauaaaacaaaacaaaacaaaaccaagaccuuuucuuuuuuuuuuuuuuuuuugagauggagucucacacuguugcccaggcuggagugcaguggcgcgaucuuggcucauugcaaccucugccucccggguucaagcgauucuccugccucagccuccugaguagcugggauuacaagugcaugccaccacgccuggcuaauuuuuguauuuuuaguagagacgggguuucaccauguuggucaggcuggucuugaacuccugaccucaugauccagcugccuuggccucccaaagugcugggauuacaggcgugagccaccgugcccggccaagacccuuucuuagauaaacacauuguuaacaccuaacaaaguuaacaguuucuugguaucaucuaauaccugauccguucagauuuccuuuauuguuucaucauacuaaugaacuaaaaauaauucuuugauaccauccauguuaaaauaccccaaauugacucaacaguguuguuguuuucuguccucacagucuguucccaaacaauguuuuuuugguguguucaagucagaguccaaacagaauacugaaaagauucuuaguauagaucaggguuucucagcuucggcacuauggacauuuugggcaggaugauucuuuguuguggaggggcuuguccuaugcauuguaggauguuuaacagcgucccugaccucuacccauuagaugccaguggcagcccccaguccgacaaccaaaaauguuuccacacauugccaaguauccccuggagacaaaauuacccucuguugagaacccuugaccuaggucagucccuccuauuuucuuuuucuaccucaugucuuugaacuugaugaaaaaucuguugucaguuuuccuguagaaugucugacauucugcauugucugcuuuuucauggugucacauuugacuuguuccuaugucuuccacauuuuuuuuuuuuuugaauuagaaguuaacucuggaaccuucauuuaaguucagcuuucuuuuggcaaguguugcauuccucaugggacacccgaugccugguugucccacuguuaguaaugccauuggucccucuacuguaaagcuuucuaucaaucuugcaucuaauguuucagucuacugguucaucaauugaagaaagaccuugccuaaguaaauuauuucauuagacagagguugcaaccuggugauuuuuuuuuucugccauuucuuccacaguuacuauauggaguuauguaaagaaaaacuuuugccacagauauuugauuggaaauacaguugguauaggaaggacaagauaaauacuugauauuuuuccagguguuuucuaguuuuucggguaaaguguugaugauuuaauggaauguguuuuuuuguuuguuuguuucugagagagagucucacucugucgcucaggcuggagugcaguggugaaaucucggcucacugcaacuuccacuuccuggguucaaacaauucugcccuagccucccaaguauaugggauuacaggugcaugcuaccaugccuggcuaguuuuuguauuuuuaauagagaugggguuucaccauguuggucaggcuggucucgaacuccugaccucaagugauccaccugcuucggccucccaaagugcugggauuauagacgugagccacugcgcccggucggaaugugucuuuuugaauaauuaauuuuucuauguguuuaaaggacugauuuauuuaguuaaagcuguuggcuuugauuaguuuuuagagguaucauuuauuuaauguuuaaauacuuacggacuagcaacuaugugccagguacuaugaguacugugcuuaauacuggagaugaaaugguuaacaagauagacaugggaccugcccucauugacuucuuguuucaguugugggggaagggagaagacauuuaguaaguaauuaagaggagacguacagagugcuaugggauuauaaaauaucacuagauuauuccccaaggaacuggcaaaggcaaguuuuuuguuuuuuguuuuuuuuuuaaguuaccacuguauucacaguaccuugcauaggaucuagcgcauaggagguggagaacaaauauauuuuaaauaauugaauauagcugggagcgcuaaccuaauuaaagaggauucccuuuguaaagugauauuuuuuauuuuuuauuuguuuuuauuuuauuuuauuuauuuuuauuuuuuugagauggagucucgcucuguugcccaggcuggagugcaguggcgcgaucucggcucacugcaaccuccgccuuccggguuuaagcaauuuucugccucagccucccuaguaacugggauuacaggugccugccaccacgcccggcuaauuuuuuuguauuuuuaucuuuuuuuuuuuuuuuuuuuuuuuuuuuuuggagacgaagucucacucuuguugcccaggcuggggugcaauggcacgaucucggcucacugcaaccucugccucccggguucaaacaauucuccugccucagccugccucagcuacucccaggaguagcugggauuacaggcgccugccaccacgcuuggcuaauuuuuguauuuuuaguagagacgagguuucaccauguuggcuaggcuggucucgaacuccugaccccaggugaucugccugucucagccucccaaagugcugggguuacaggugugagucagagugcccggccauuuuuuuuuguauuuuuaguacagaagagguuucaccaucuuggccaggcuggucuugaacuccugaccucgugauccaccugcuacggccucccaaagugcugggauuacaggcguaagcugccacgccgggccuguaaagugauauuuaaaugaacucuaaagaauaaguaggaggacugggugcucacaccuguaaucccaguucuuugggcucauuagaggccgggaguucaaggccagccugggcaacaaagugagacacccccccccccgccccccgcccacaaaaaguuuaaaaaacuagccagguggccgggcgcaguggcucacgccuguaaucccagcacuuugggaggccuaggcgggcagaucacgaggucagaagaucaagaccauccuggcuaacauggugaaaccccaucucuacuaaaaauacaaaaaauuagccgggcgugguggugggcgccuguagucccaacuucucaggaagcugaggcaggagaauggugugaacccgggaggcggagcuugcagugagccgagaucgcgccacugcacuccagccugggcgacagagugagacuccgacucaaaaaaaaaaaaaaccuagccaggcaugguguugcaugccuguagugccggcuacuugcggguggcugaggugggaggauuguuuaagcccaggaguucucgugccacugcacucuagccugggcaacagagugagaccuaaaaaaaaaaaaaaugaguaggccaggugcaguggcugaugccuguaaucucagcacuuugggaggccaaggcaggcggaucacuugaagucaggaguucaagaccagccuggccaacauggugaaauucugucucuacuacaaauacaaaaaauuagcugggugugguggugcacgcuuuuaaucucagcuacuugggaggcugaggugggaggaucacuugaacccaggaggcagagguugcagugagccaagauugccccacugcucucuagccugggcgacagagugggacuccaucucaguuaaaaaaaaagaaaaagaguagaaauuaaccagaaguuagaauucaaagaauuaaguucaauaaggcucacugaaagcucagggugaggaugguagguaugaacuagaucagggaaggccuguaaggacuucauucuaagggcaguuggaagccauugaaggauuuuacauaggugaaugugacagauuggcauuuuugaaagcucacucugcuugcaguguggagagcagaauuaaaaggagcaagagugauuuagagagaauaguuauugaaguaauccaggcaagagauaauagugguuuagacuuugaugguauuaguugagauggagagaagugggaagaguggagaaauauuuagcugcuagaauucacuuugagguugaguaguuauggagagggaggcaucaagaaugauucuuagguuucugggcugggccguaggguggaugguggucaaauuuacuaaaacagaaaaaccuaaaggaggaggaggaagaacauuucugggggugaggagaaaaucaugaguuagguuucagacauacugaguuugggguucuugagacauagauuccaaauggagauguccacuuggaaguuagauauagcucuggagucuagauguaagaucugggagacauagauuuauaagucaucagcauaaaaaugguauuugaagacacagaaauagaugaagccucucaaggaauguguguagaguaagaacugagguuaaaggacauuaagccuagcuccacaaauagcaguaucuaagggaaccaaugaaagaauggccaaauagguauucauauuagguuggugcaaaaguaauugcaguuuuugcuauuacuuuuaauggcaaaaccacaguuacuuuggcaccagugugauagguggaaaaucaagauaguggauagugcguugccaugaacgucaaggaacagacucuaggaggagggagucgucagcugugugaaguacugcugagacgucaagcaagauaaagacugcgaguuaucuuuugcaccuacugacauguagauuauuguugaccuuggcaggagcaguuucauagugacugaagccauauugcauugauuugaggagugauggaaggugaggaaauggggauggugaguacagacaacucuuucaagaaguuugacugaaggagagagagaaugagggaaggagcuggaggaauagaugaaguaaaugagcauuuaaaauaaaaauagguggggacuaagcuuaucuggugacccugauucuuacaguagaaugugaaucucaaaaauauuuaagccuauuuuaaauaaauuucuaaaauggaaacccaauucauuauuuuaccagguguccucccugcccccugcuuuagaauauaagacauagaacauugucuuauaggcauuuaugauaaccuggauagggaagguaaucuucuaaaauuaaucuuuaaaacauuacacacaaacacucaccuccuuuauaguucuccacuuggaaaaucauuuaguaucuaguucauuacuagcagcaguggucaguaagugcuuccugaguaaauuaaaaucaacaucuuucuuuuuuuuuuuuuuuucucagagagaugggaucuugccauguugcccaggcuggucugaauuccugggcucaagcgauauucgugccucggcagcaucuuucuuaauaacaguauuugugacaaauaguucuauauucuuaauuuuuuuuuuuuuuuugagauggagucucgcucucacccaggcugaagugcaguggcgcgaggaucugggcucacugcaaccuccgccucccagguucaagcgauucuccugccucagccucccgaguagcugggauuacaggcaugugccaccacacccagcuaaguuuuguauuuuuaguagagacaggguuucaccauguuggucaggcuggucucgaacuccucaccuugugauccgcccgccuuggccucccaaagugcugggauuacagaugugagccaccgcacccagccaauaguucuacauucuuuauguuugaaaucccuucauucaaucucguuuuaaaugugaccuauauuaugauuucccucuaccuauaaaacaacaucccauaugaaauggaguuaucugauaugaugggacauucagaagagcuggcaucauuagcaaguucaggcauuuuuuuucuuucuaaaauagggaugaucacacuucucuuagggucaguaaggacauuugugagugauaucauuauuauuuauuugcagagcuucaaaaaugugcugaagccuaccauaggauugaauuagaucugguuacuacuuauaggguucauauuaaauagaaauugaccuacaaggcggccgggcacgguggcucacgccuguaaucccagcacuuugggaggcugaggugggcggaucacaaggucaggagaucgagaccauccuggcuaacauggugaaaccccgucucuacuaaaaaauauaaaaaauuagccgggcgugguggcgggcgccuguagucccaacuacucaggaggcugaggcaggagaauggcgugaacucgggaggcggagcuugcagugagccgagaucgcgccacugcgcuccagccugggcgacagagcgagacuccaucucaagaaaaaaaaaagagaaauugaccuacaaggcauacugucagugaaucaacaaguacuucagcccuuaacaaguucuuaacccuggucuggaucuaagacaaagcaugagaauaggugaugaagaagcugauaaagaaucuggaccuguacaguuuucauucuguacagucuucauaucuguagcauuggcuuaguuugugaaagauaguuugcaucuuuguaucuuuuaauaaugcuuucaaagcaacuuuaaaaaaggaaacuuuuaacuucuacuugaaagagaauguacuaauuuuuuuaaaacugaaggauaagucuguugauguuuucaguauuaaaauaauggaaggaaguguuuuaaugcuacauuauuauuauuauuggcuuuggcuuucauggucagugugcuguuuucuuucuuuuuuuuuuuuuuuuuuuuuuuuuuugagacagagucuuucucuguugcccaggcuggagugcaauggcacgaucucggcucacugcaaccuccgccucccagguucaggggauucuccugccucacccuccggaguagcugagauuauaggugugugccaccacacccuacuaauuuuuguauuuuuaguagaggcgagguuucaccguguuggccaggcuggucucgaacuccugaccucaggugaccugcccgccuagaccucccaaaguacugggauuacaggcaugagccacugugccuggccaagugugcuguuuucuuacguugaauaguaaaaguacagauacucuuugacuuacagugggguuacaucucaauaaacccauuguaaguugaggauaauguaaguugaacauuuaauacaccuagccuacugaauaccauaguuuagccuagcuauuaaaugugcucagaaaguuuacauuaggcaaagucaucuggccacacaguacacaguagaguauugguuuuuuucuuguuuuguuuuguuuucuuugagauggagucagugaguggugcgaucuuggcucacugcaaccuccaccuccuggguucaagcgagucucccgucucagccucccaaguagcugggauuacaggcaccugcgaccauggcccagcuaauuuuuuuguauuuuuuuuguuuugagacggagucucgcucugucgcccaggcuggagugcaguggcgugaucucggcucacugcaaccuccgccuccuggguucaugccauucuccugccucagccucccaaguagcugggacuacaggugccugccaccaugccagguuaauuuuuuuauauuuuuaggagagaugggguuucaccguguuagccaggauggucuugaucuccugaccucaugaucuaccugccucggccucccagagugcugggauuacaggcgugagccacugcgcuccgccuuuuuuuuuuuguauuuuuguagagacgggguuucaccauguuggccaggcuggucuugaacuccugaccuuaggugaucagcccaccuuggccucccaaagugcugggauuacaggugugagccacugcaccuggccgaggauugauuguuugcccucaugauguguggcugacuaggagccuagggcucgcugcugcuguccagcaucacaagagaguaucauacugaauauuuugagccugggaaaagaucaaaauucaugguaugguuuccagugaauacauaucacuuucacaccaccauaaagucgaaaaaucauaaguugaaccauuguuaagucagggaccaucuguaauuauauccugggagcugaugauuauauguauaauaguuaaaaacaaaaaauccagucauggguuaaacgucaagauggaguuuaugagauggaauuuauucuucccaauagauuggaacaaguuucagguaauaguaaugagugaccgagagggaagggcuucaguugaucaauaaccauuuauugacauccuacugugugcucuagcacuaugcuugacuaccagauaggauauaaaaagaggggaaggcagcuguccccuaagaaaaauuacauucuuugagugaaaaguagguaacaaaucaguauguuuggugagaaaaagguauguauuauguauauuuaaugcaucuguuugcauauggaaaauuaggggagguuauacuauaaaauauuaacaguguaggaaauccuaguuauccagagauaauuggauuagaaaauaggcaaguaaagugaauucauuuaacacaggaaccaaaaguuuauuguaaaacauaaaacauuugauugggacccagucuggaaaaacaaagcucaaagugauaaggauaagcagauuuuauauuugauggaauuguuauaaaugaaaucauagccaaguuuuagaaugaacaaagaauaaacuauagauuggguuucuuugcuguaauuuuugugggaaaauuauauaacaacauuauagaucaucuuuuauuucauuuuuugacauguugaaaaaauauuuuagggauuuaucgauuuuuauacggacuguuuuucaaccuuugguauucaggccauucucuuuuauaguuuuuacuguaaaguacuguucgguuguuaacugguaggacuucuagcagauccucagcugccaguaauaaguuccaauguucuccaacaucacuuucuugaaauacuacauccauacaauuguaguagaaucauaugcuuuuguuagucauauaaguauacagggcaguucaucagugaauauuuuaguguuaugauaacuuuugguuuucuuuaugcaaccuuguaaccaugggaaauuauauaauacuaggauaaugacacuccuguaguuuuuuucugaguggugagauuucuuuuauugauuuuaauuaauuaguuauuacuuaccuguguagucaguuuucuuuauuugagauuuuuaaacucaccacagacacugaauuagugaauacugaaccagugcuccucggggaaauacaggguuagguuccugugagucucuugucacauuuuuaucaacugaugaacacauagccuuguuuauguguguuucuguuuaaagaaccuuauuuaguacauauuguugauuuauuaacauuguacucauggccaacagcacuguagcacuuguccgaacaaagcugaccuaacacagauauuuucucugugagacauaagaccgcuuucuugcucuugggacacuaaacagcaucucagcucuaugccugggggccauuuuaaauagugaaaucaacaaaaaagcacaaaaguuugacaaaugugucucuaaauagacugaaaaugacacuuauuuauaguauagagcuggaacaagaaggcagagcaucaccuugcacuucaucucggcugggaaugcacacaugagucaggggacucauguuuuucacugcuguccacauguuugugaaugacugggaaagcucagugaguauggauuuuggguuuagaaauaaauuuuaggucgggugugguggcucaugccuguaaucccagcacuuugggaggccaagguggaucacuugaguccaggaguuugaaaccagccugggcaacauggugaaacuugucucuacaaaaaauacaaaaauuauccagaugguggcacauaccuguggucccaguuacucgggagguugaagcgggaggaucauuugagcacaggaggcggagguggcagugagcugaaacugcaccacuacacuccagccugggugacagagggagaugacccugucucaaaaaaagaaaaaaaaauuuuagcaaguaggcaaauuugcaaauacagaauccaagaauaaugaggauuggcuauauuuucuaauauuuccauacuaagcuuauuguuguaauuuuuaaaugaaagcacaaaauaagcuuucagaaaauuaaaguacagcauaauuuggaagauaaagcuaaggcuuuuaaaauaaauagaaagcauuuuaaaacacaguauauuggccaggugcgguggcucacaccuguaaucccagcacuuugggaggccgaggcucguggaucaccugaggucaggaguucgagaccagccuggccaacauggugaaaccccaucucuacuaaaaauaaaaaaauuuagcugggcuugguggugggugccuguaaucccagcuacucgggaagcugaggcaggagaaucacuugaaccugggagguggagguugcagugagccgagaucacaccacugcacuccagccugggugacagagcaagacuccaucucaaaaaaaaaaaaauaaauaaaacacagcauauucucuuauauguguguacagcauauucucuuauauguguguacaucugaguauggguagacuaaugcuacaacagguguuucaaagugggaggaggcugggugcagugguucacaccuguaaucccagcacuuugggaggcugagguaagagaauugcuugagcccaggaguuugagaccagccugggcaacacaguaagaccuugugucuauaaaacauaaaaaaauuagcugggcgugauggugcaugccuacgaacccagcugcucaggaggcugaggugggaggauugcuugagccugggagguugaggcuucagugagccauguucaggccauuguacuccauccugggugagagagugagaugcagucucaaaaaaaaaagaaagaaaagagggaggagugcuugaggagaaagagagaaggcagagaagagagguaggacuguucaguuauauucauuaauuacaagaccccugucaauaaaucggaacaaacugaagccagguuaaaaauaaguaguugugaauacugaagagauuuacccugaucauuuaucaaaaagauggcucuuaccuccaaaagcauguguuuuauuagaguacagaagcauguugaauuaauauguaugguuuaauuuaaauguauaaauuugggggaggaacugaaauuuuucuguagccuguguuuaagaucuuguuaacuuauuugucuuccucagucuagcuuugccuuuuuuuacauauagacacaugaacacagacauaaagauagguccuugucaacaccaaguugcagagauacaugauugucaaucaaaauucucaaaaauuguuucuguuguaggaacagcagcaguauugguaucgacagcacuugcuuaguuugcaacagaggacaaaaguucauuugccaggacacaaaaaggguccugugguagcaaaggauacaccagagccgguaaaagaagaaguuacaguaccugccaccagucaaguuccagaaucuccuucuucugaggagcccccauugccaccuccaaaugaggaagugccaccuccucucccaccugaggaaccccagguaaccauauaauuaauuguuuguguuuauuaaauuauuuagcuuuuuucugauucauuuaguauacuuuuaucauaaauggauauauauuuuuguuuuuuuagguaccuauaaaguugcauuugugaaaucagaugucuguuguaucagguuuauuuguuuguuuauuuauuuugagacagggucucucucuguuuaccaggcuggagugcaauggugcgaucuuggcuuacugcaacuucugccucccagguucaggcaauucuucugccucagccuccugaguagcugggaugacaggcaugcaccaccaugaccggcuaauuuuuguauuuuuuaguagagaugggguuucaccauguuggccaggcugguuucgaacuccugaccucaagugauccaccugcuucggccucccaaagugcuuggauuacaggcaugagccaccaugccuggccuguuguaucagguuuagaaaaggaaauuuuuccuaguuugagugaagaguuggauacucuucugaauugagugccucuaagcacuaaaggaagaugccagcauauguucauagugacagcacagggcaauaguugagugcuugagcuuuuagagucaagcuacccaggcuauaauccagguacugccacuugccaguagugacugggcaaauuuguuaaccauucugugcuucaauuuacuccucugcaaaauggguauauucaauaguagcuaucauauagagguauucaagcauuaaaugugauaauucuugucacucagcuuagugacuggcacaugggagguucucauauugguccaaaggucauuguucucccaagagccuuauaugaaggguuuaaucaaaccaugaugguuauauuguaguccauuggugaaaagugacaaaaaaagaaacggauuuuucauagagugaaaaggucuauaacuuaagguucacuuuuuuuuuuuuuuuuuccagacagggucucacucuguugcccaggcuggagugcaguggugugaucucaacucacugcagccucagccucccaggcucaagugauccuccuugccucagccuuccaaguagcugggaccucucuucccuccccuccccuccccuccuuuuuuuuuuuuugagauggagucuugcucugucgcccaggcuggagugcagugacgcgaucuuggcucacugcaaccucugccuccaagguucaagugauucuccggccucagccucccaaguaggugagauuacagguaccugccaccaugccuggcuaauuuuuguauuuuuaguagagacgggguuucaccauguugaccaggcuggucuuggacuccugacuucaagugauccacccgccuuggccucccaaaguucugggauuacaggugugagccauggugcccggccugggaccacuuuccacugggaaaauuguugucauauuuaggaauaauaagauuauuauuccagugaagacuauggaauuuauaaacuccuuuguauuaguauccauaauaguauagauagagcuauguguuuuaucuaaagauagaauagcuguucucaauccaaaaagaacugaagauacuguguuugacaguuggauauuucugaguuguagggauucuggacuuuauaauacauuuauaaaauauuuuugcuugcuguuuuaugacuuacauaaagauguguccucuuuuaucuuuagucugaggacccagaagaagaugccagguuaaagcaguugcaggcugcagcagcacacuggcagcagcaccagcagcaucgagucgguuuccaguaucagggaauaaugcagaagcacacucaguuacagcagauucuacaacaguaucagcagauuauacagcccccaccacauauacaggcaagugcuuccauaguccacaauaggaaguugccccaagacauugaaaggauuuguuauucuugaaagauuuaaguguaaaaaacaaaagauaccaacuguugacaauuaguuguuucccaaggggugcccaaguaguuaucugccacauuaccugggggacuggggagggguugguuauaguagaguuuccugaucaugucaacccaggccagauguuagcuuacuauugcuaagggucuuaagagcuggggauuuuuaccauauagcuacagguuaaccuguguuuugccuguaaacuacaacaguaacagauaagcaaagaggccaaaaacagccaucacaaaaaaccuaagcaaauauaccguaaaagauaaagugacuuagauacuuguuuguguuguaucuuugagggguaauguugugucuguauaucuauaauaacagaucauuuuucaaguucuugaaauuauccauauuaaaaacuugaaaaauacuuauugcuaagauagguauuugcuuuauuguuugguugguuuuuccaacucuguaguaaguugucuaagccaaaggaaggaagaagaaugaucaucacucaaagaacuuaacgaacuuauucuuagccucccaaagucuuuaguguucuaauuuccuaaagcgucaaaugcccuugauucauuaauauuuuaaccuaugauuaauuaucuuauaugaaugguuuuaaauaguuuuuaucccuuuauuuguagaccaugucuguagauaugcagcugcggcauuaugagaugcagcagcaacaguuucaacaucuuuaccaagaaugggagcgagaguuucagcuaugggaggaacaacuccauuccuauccucauaaagaucagcuucaggaguaugagaagcaguggaaaacauggcagggacauaugaaagccacucagagcuaucuccaggagaaagucaauucauuucagaacaugaagaaccaguauauggggaacaugucaaugccaccuccuuuuguuccauauucucagaugccuccaccucuaccuacaaugcccccuccaguguugccuccuucauugccaccaccagugaugcccccugcccucccugcuacagugccaccaccuggcaugcccccaccuguuaugccaccuucucuaccaaccucuguucccccaccagggaugccuccuucucucucuucugcagggccaccaccaguucuccccccaccuucccugucuucugcagggccaccaccaguucuucccccaccaucucucucuucaacagcaccuccaccugucaugccccucccaccauugucuucagcuacaccuccuccaggaauaccucccccuggaguuccacaagggauaccuccucaguuaacagcagccccaguuccaccagccuccaguucacagagcucgcaaguuccagagaaaccuagaccagcacugcuuccuacuccugugucuuuugguucugccccaccgacaacuuaccauccuccguugcaaucagcugguccaucagaacaagugaauucaaaagcuccuuugagcaagucugcucugccauacaguucauucucaucugaucaaggacuuggggagucuucagcugcuccaucucagccaaucacugcagugaaggacaugccagugagaucagguggccugcuuccagauccuccuagaaguaguuacuuggaaaguccaagaggcccaagguaggucugcuuuuuuuucucuuuuuuuuugguuuggcuauuuuauugacuuaggcuauuugguucucgaugguauaaaaagcuucauuuauacaauguuuauacucucuuuguacuuauauugucugcuuguuaagacaucacguauguaaucuagaaaagguaacaugcccccauuucuuugaugucucugcuuuuguccuauauguagagauuauaauccagaaugaauguaguauuguagaguaaugcuaaucauuuuguauugacuuauuagcuuuaaaaauaauauuaaacuuuaucuuuuguuugcuuuuucauucauuugacaaauaauugaauuggcaauuacuauuuguuagauaauuuguuaguuguuagagauaaagaugaauaagccaauauucuacuggcuugaggcagugaaauuuagcauaagguaaguaggacuuuuauuuuauccauucagcaaauauuuaaguuccugcucuuguacuuagagcagugaauauagcagaacacauaaaauuccugcccccauggagcuuacauccuuuauauuuuccccaguuaaggagauacuucuguuuauccugaacaacauauuuagaaagaaaaaaaauugcugguguguaaguuuuuucucuuuaccuucuaaaaacuguuaaauucauuuuuuccaaguuuguaaaaauagauuuuucuccccaaguugaccuaaaugauaacuuuucuauggaaauuauuauuauuuuuugagacagggucucgguuuuucacccaggcuagugugcagugauagaauuauggcucagugcagccucuuccuccuggguucaagcaguccucccaccucagccucccagguggcugggaccagaggugcgcaccaacacaucuggccaguuuuuaaaaaauacuucguagagauggggaucuuccuauguugaccaggcuggucucaaacuccugggcucaagcgauccuccugccuuggccucccugccugccguggccucccaaagugcugggauuacaggugugagccaccacgcucagccagaaaaauacuuuaaucaguuuuuuucucaguugggaauuguaguagaaauggguacuccuuauacaaaauucaaacauuacagaaaaguguagaaaaaagugaaagucaccuaauuccaccaucuggagagaaucauuuuaaaaauauauguugcagaaaugggaucauacugaguagauuaucuuauaacuuauuuuuccaccaaucugcguauugcuuagauuuucaucucaguaucaguggaucuacaucaucauuuuuuucaaccucauuuuaacauuugaaaacaaaauauaucuuuuauuccccaagcuuauaauucugaaagcaguguggcacaaaacuccauccacaaucaaaguuaagagaaagggcaauuaacaugaauuccucuguguaccaagaagccuugcuagagacuuuacacacauuauuaucucauggaagucuucucaacaaccugugaaguaggcagauuauucuccauuuacucuuaacaaaauggcacugagaggacugcguaacuugcucagucaggauuauuuagcagagugaguagaaccccagaauagguacaguugagucuagaggguccccaaagcaaaaguacuauuuaagcucuguuuacugccaugauucaagccuauacugucagugcuuauuuggcauguguaucaucuugauuugaauucguucuuaaucuccuggaaugagcauugccuuuuagaucugguaacuaauuugcuaucagagaaguacauucuuaacaccucaugaaacauacauuuccugcucccuugauuuccgucauguuaauauuuucucucuuugccuacuaaaucuuggcugugugaauuuaggaccuauuuuaaguuuugucuucagaagaaaauaacuucucaaguuaauaaucucugugcugggaggauauuagcaauuaucuaauauaucugucuacggcaacgcacguuuguauuccauuucaguuugucacaaugagucuugcacauaucaucuuauuuauuccucuuagugauaucaggagguaaauaaauacauaagaaaagcugagauucagagagguuguaaauaccuugccucauauaacacagcuaguaaauggucaagaugagauuagaauccaaggacuucugacccacuuuaaguccauuguacuuucugugaugagcaguuguaugcuuaacauuggcauugugauuaggaacacugccauauaaggcauugauucuagaaaguuuguuuuuuacauugaaccuaaaugugauucuuuaacuuuuaucuguugauucuagauuugccucuggagcaacacagaaugaauuauccuaugccucuucuacagcaugucacuacaguuauuuaaaaacuauuacccucaugucucccucacccuaccucacccaguuugcucugccaaucacaacucagauucuuuucaucuuaacauuguuucuaaccucauccugcuguacugcucacuguccuuugaagggccuuuaguuuguuagucuccuucagaaugaacacuuacuucagaugcagaggagcaugggccuaguaccaacuucauuauaaauaaugugcuuauauuguauagcuuaacaaauugcuuuuuuguuuguuuuuuucagcacucucacaguguugacucuuguugaacuuaacaucaaucuagcuucccaggucuuuuucacauuagcuuuuauuaagccaagucucucuuauccugaacuugugugguugguuuuuuguuuuuguuuuucuuguuccuuuuucuaagacuuuacauuucucuuuagauuguuuucuaguuagguuugcaccaucauuucagucugcugaaaucuuggucaaugaugauuauauuguuuuagguaugugauaucccucuucagcauuuucaucugcagcuuugauaaggauggcuuuuuaauccuugaauuggauccuacucacauuauccaccuuguuuugaaaacguuuccccuaacuagcuuaugucauugccauuucagucacccccugcugcuuuugcucacucagcccuuauagaguauaguuugggacuguuacccaggcauaguucuuuuucuccaguguaacuagguaaaaaaucagugggaagcugguuagugagugaacaagacugagguaagaauaaucuauacuauuaaggaaaccugugaacuucuuguauuucuaauucagauuuugcuaucaaacauauaacugauaugagaagccacuuuuuuuaaauaaucaaagcugauuagaaaaacaagaguuuagaacacaacuaaacaaauuuacugauaacaugcuguuacaaauaaaguacuguaaauggcuuugaguuuuugcaaaauccagauuuaagcugcuuuauaaaaacgagauuucuaaaaagucaugugacaaaacugcaugacauguaaauaacauaucacauuguugagagucuaggggagcuguuuugacacuguguauaucauuggauucacucagucuuccagaagacuaccguugguccagaaaacugucauaucaauggauguugguuuuccaggaccuuuuuuuucacauauaauaaaacuuauugaaacguaacagagaagugcacaauuuuaaguguucagcuuagugaauuuucacaaaauaaagacacacauuggccaggugcgguugcucaugccuguaaucccagcacuuugggaggcugaggggggagcggaucaugagguuaagaguucgagaccagccuggucaauauggugaaaccccaucucuacuaaaaaauacuaaaauuagcuggcaugguaacaugcgccuguagucccagcuacuugggaggcugaggcaggagaauugcuugaacccgggaggcggagguugcagugagccaagaucgugccacucuacuccauccugggugacagagugagacuccgucucaaaaaaaaaaaaaaaaaaaaaggcacacaugguaucacuacuagaucaagaaauaggaauuacuggugcccaagaaaucucccucaucccccucaguuauuuucuaauaccccaaagauaacugcuauacugagccauagauuaguuuugccuauuuuugaacuucaugugagugaaauaauacuguauguacucaugagucuggcaucuuucacuugacauuguauuauugugagagucauccauguuguguguaguaguaguuuauucccguuccuguacaauaguucauuguaugaauauaacacaaucuguuuauccauuuuaauauuaauggucauugaaguuuuuugguuauuaugaaaagugcugcugugugucuuuugaugcuguaugugucccuuuagauguauguguuuguuuguguguguuuaauuuuguuuggauaucuauuaaggauuggaauugccugauuauagaguauauacauguucugcguuaauggguauuguuaaacauuuuuccaaagugguuguuucaguuuauauucucaccagcaguguuucaguguuucaguuuuuuugcauccuuaucaacacuugguauuguuaaacuuuuaagguuuagcaauccuaguggauguuuagugguaucaugauaauggauuuaauuuacauuucccugaugacuaaugagguuucacuuuuuuuauuugauuauuguuaauuuguauuuccucuuuuaugaaaugcugauucaagucuuuuucccauuuuuugacuagguuuuaugucuuacugauuuuguaggaguucuuugugaauucuacacaucaguuuuuuauccauuauauguauuacaaauuucucacugcaggacuuuuuauuuucuuaaugagcacuugaauguaaacgcugcaugcuggguacaguggcucaugccuguaaucccagcacuuugggaggcugacgcgggcagaucacuugaggucaggaguuugagaccagcguggccaacauggugaagccccagcucuaccaaaaauacaaaaauuagcuaggcaugguggugcacgcuuguaauuccagcuacucgggaggccgaggcacaagaaucacuugaaugcagagguggaggaugcagugagccgagaucgagucacuacacuccagccugggcgacagagugacagagcgagaacgagauuccgucucaaaaaaaaaaaagaaacuaaacgcugcaguaagacaguuugaucucaguauaguagaaaaguagucuuuaccguuuaccuuuuagguccaauggacccuuuguauuuuaaaguuuaaaguaauuuuacaaauaauuuacagaauuuaagaauaaaggggccgggcaugguggcucacaucuguaaucucaguacuuugggaggccuaggcgagcggaucacuugaggucaggaguuugagaccagccaggccaacaugggaaaacccugucuuuacuaaaaauacaaaaauuagcugagcaugguugugcacaccugcaaucucagcuacucaggaggcugaggcaugagaauugcuugaagcuggguggcagagguugcagaacugcaccacuguacuccagccugggugacggagugagagucugucucaaaaauaaaaauaaagggauagugaaaaaaauguuaaagacaaacucuuuucauccauuaaauuugggcacacaaacaucuuaaaagaugaaauaauucugucacauacccuuuuuuuuuuucuuuuuuuuugagauggagucucgcucugucgcccaggcuggagugcaguggcgcaaucucagcucacuacaagcuccaccucccagguucacgccauucuccugcuucagccucccaaguagcuggaacuacaggugcccaccgccacgccuggcuaauuuuuugcauuuuuaguagagacgggguuucaccguguuagccaggauggucucgaucuccuggccucgugauccacccgccucggccucucaaagugcugggauuacaggcgugagccaccgcgccuggccuucugucacauauccuuuuagcaaauugagaugguccagguucuugccacaaaauaugugauaagauaagguccuuccuguuuaauaacuaagugaauuaccacaccacauuuccuuucuguucuuagaaauauauugucagcugggcaugguggcucacacaccuauaauuccagcccuuugcggggcugaggcaggaggauugcuugagguuaggaauuugagaccagcuugggcaacauagugagacccugucucuacaaaaaguaaaaaauuagccaggcuugguggcaugugccuguggucccaguuaugugggaggcugaggugggaggaucgcuugagccugggaggccaaggcagcagugagcugugcacugcacuccaacguaggcaacauagugagauccugacucaaaaaaaaagaaagaaaagaaaccguaaggcuacaaguauuauuauuuacuuuuucuucuuuuauuucuuuaaccuuuuauuuuuaaaucaauacuccauauaaaacugauuuuauauagcgugagguaggggucaauguuuauuuuuuccgaauaacuauccaguucaccccaacaccauuuacugaagaagucaucccuacuacuuugcagugacuucaucauaaauucaauguuuaaaugaguuuguuucuggacucuccauuccuguggucuauuugucugucuuugcauuagugucauauuuuaauuacuguagcuuuacaauaaauuuaucuguuaguguagguccuccaauucugugcuucuagauaagggauuggcaagcuuucuuuuuuauuuuuucuugagacggagucucagucugucacccaggcuggagugcaguggcgcucacugcaaccacugccuccuggguucaagcgauucuccugucucagcuucccaaguagcugggauuauaggugugcaccaccaugcccggcuaauuuuuguguuuuuaguacagaugggguuucacuguuuuggccaggcuggucucgaacuccugaccucaggugauccaucugccuuggccucccugggugcugggauuaccggugugagccaucaucccuggccuggcaagcuuuuuauaaagggccaggugguaaauauuuguaggccuugugggucacauuuggucucuguuaaauauuuuucuuucuuuucuuuuuuuuuuuuuuuucacauuuaaaaaaaauuuuauugaggcagggucuuuacucuguugcccaggcuagaaugcaguggcaggaucacaacucauuacaacuuugaccuccugggcucaagcaguccucccacaucagccucccauguagcuggaacuguagaugugucccaccaugcuuggcuacguuauuuuuuguagagaugggaucugccuguguuguccaggcuggucucaaacuccugggcucaggccaucugcccaccuuggccuuccaaaguguugguauuacagacaugagccaccaugugcagccuuuuuuuuuuuuuaaaccuucaagaauguaaaaaagaucacuuuuaacuguauuuggaacauaggccauaguuugcugaccccuguucuagauugucuugauuauucuuauuagaaucagcuugucaguuuucaaaaaccugcuagaauuuugaugagcauugcauagaauccauugaccauuuggaggaagaauugaaaucuuuauaauaucaaggcuucugaucagucacaacuauguuuugacuggcuuuaggauuggaauuguggacuuuuuccauucuauagcuaucuuacuaggauuaguaagggacugugagugcuauagguuuucuuuauauuuccauuuguuaugguuguucuuguuuauagugauaacuuaucuuugggaauuuuaauuuuaggaccuugguuauacauauuuagaaaacaggugcuauuucacgugaaaagaaaacaggaaggaauuuaauuccaaaauuugguaucuuguaauucccaugguuuguuaauuuuaauauguuucugcaaauaguauaauacauaaaauaccuucuuuaaaaguauuuguauaacugcaucauaccucuuagguuuuuacauuuuggaguuuuauaucaaauuuugaaauuuuuauaauucuaagguauuuauaccuaguuuuagggguuuuuuaagagauuuauaacacacuuaacuauacaaauaaacacuuucuaaauacuuaaaaccagauauuugcuuauuuuucuuuuuaucuuaccaagguacaaugcaugcguuuuuaugugauuguauuuagugaauuuauguaauguuucuacuauauuuuaaauacauguuuuuauaugucaaaagggucauaguauuucauuauauuuaaagguggcuuauuuucauacagauuuuuaauaugaguaucucuugauauauuuguuacaaagccuuaaaaggucucuaguuuuauaaaugaaaacgguuuugagucugucauuuuguaacaucuuugaacuuugaaaauuugaaaguccaguaauagacaggugcaguggcucaugccuguaauccuagcgcugugggaggcugaggcagguggauuacuugagcucaggaauuugagaccagccugggcaacuuggugaauccgcaucucuaccaaaaauacaaaaauuauccgagccuggugacauaaaaaauuagccaggcaugguggcaggcaccuguggucccagcuacucgggggacugaggugggaggaucacuggaacccaggaagucuaggcugcagugagcuaggaucaugccacuucauuccagccugggugacagagugagacccugucucagaaaaggacaaaaaaaaaucaaauagugauaaauauuugccauuuauauguaguguugaaaguguauuucaaaugguuucaacaauuucuggcccccagaaugaaaauaaaaugaugggccuuggcuguugaucagcaauuuggucugaaaacaaagcacccuacccuuucaacccuucugccauguccucuuaucugcacaccuuuuaaugccuccuacuuccuuuguccuuucuucuggcuuuuacacaugcucuuuucuuugucuggaauucccuucuugccauucuuugcuuuauuuauuccuauuuuuccugcccuggggcagcacuucaguaauuacagauugggauuauuuaaugaaaucagacauugggaauacuuugguuagcaagacaaacauguuccauauuuaucaaauucuguucuaauuguugaguuaauugucucacucuuccuguggacagugaacuccuugagguuaggcaugacucucuuuuuagcaccagcucauuaccugacaaucaguauguguucagugaaaguugcuucuuccaaaaugucagucauggauaaaauucucaaggcauucacaauuuuguuaggaagggacuuugcucauauuuagaauuugauuagaauacuagauaacauguuaauaaggucucucauggacucuuguacauuguggaagauagucuucuuuuaucacuuaugugaacaaauaauugcuacauuuaauacauagcaaaugauuuuauacaacuuuaaugaucugauauauuauugaggcacuuuaaauuaauaaguguaauuccgagaaaggaaccacaccuucacaagcccuaaagcggcauacuuuuuuuuccuucuguaaauauauacucuccauccuuagcauugugauguauauacuuugacaaguuucuggucaccuucuuucgccuuugcccauuauagcucugccaagccuucacuacuucgcauagaccaucuacucuagugcugcuuucucaaucuuagcaaacauuuuuauuuugcauuauauuuauaauuuagcuuccugccuuacaggaaaucaaguuuaccuaucaagcccaguaaaacaucucacuucuaacccuuagcuuuacuuagcaugcucauaaucuuguagucucaggagaagcggcccuucugaugagagcuaauccucucucugugcccuuuaaagagauacaguuuacauuuuuaucaaagugauucauaugcaugguuuaaaaaaauugggccaaauggccacccacugcuccaugcccuccaaauguuuuugccaauggcauccucuuucaauuauuuagcuguuucuuuuggucgccaucuucauagcacuaaauaauuauguugcccuuuucacuacuuaaacacuuacacauuuuagauauuacauauuuauuuaacuguccugaaaaauaaaguuuucguucuuccucaacacucugccauauggguguuaacuacagcauuccccuugcugacccuccggaaugugauuugcuguuuaucgaaucucauggcuuccuguuaccauucaguaccuccauuuccuggagugcaugcucaaguaacuugcuaaggaagugugggugagggguaaauuuucugagucguccuguaucugacaaugucuuuauucuaaucucacacuuacuugcuaauuuggauauaaaauaugauguugaagauaauuauuccucaagguuuuaggaucauuguucuauuuuguucuaucacauuguguagguguuauacuguucugauucuuuuccuguuuuggugaccuccucucucccaaacuuaaaaaaucucugguauucugaaauuucaguguuuuuuguuugcuuauuuaguuuuauuauuaauuguacugaguagucaguaugcuggccccuuucugucuagagauuggaaucucuuaacuuugggacauuucuuugugcuauuucuucauucauuuuuuuucucucguuuucuguuucuggaacucuucauuaguaggauuuuggaucuguuggauugauuaucuuugugccuuuuaucuuacauuuuguuguacuuccugagauacuuuaacuucuaguccuuuauugcaucuuuuauuuugagaauuggaaauuuuuuuuucugugguucuucuggcguugaucuuuuuuauaaauagcacauuguucuugauuuauagaugcagucucuuuaagaaucucucugaggauaacaauuugaguugaaaguucuuuucugcuuuuugcauucuguuuucuccaaauucagauccuauuuauuuaucuuuaguuuuucuuucauuuuggacguguuccucaaauaucuagcaauccuuggcugugcauuuauguuuaagcauggaagacacugacaaacugauugggagcucuguguauaugagaggggcuuguuaccugucagguuucugcuuuaugugaauaggguaaggaacuguuacuacugcuaggggacucucaaauucaaggauuuaagagacauucagccuaaggaaaggcugguugaugguuccgaauauagauuuacguauuuuuagccccaaguuuuacuccuuuccuucccuagcacccccuagugucugagaauccugaccuucucugagguucucugggcaagccagccuucuuuugauuuuaucccuuucugccaucaguacucuaaacugguuucuuccugcucuguaaguuaccacucauauuuguucuuugucuuucagaauguacaaacaagauuuucaucuucugauuaccuccucucucuguuuauuauggguuuguguauuuuugaguuccuugcaauggguuuguaaaaggucaacuuggcugagcuaaacuccauuucccaaaauucccuuucucucucuuuuuuuuuugagacaaagucucacuuugucacccaggcuggagugcaguggcaccaccucaggcucacugcauucuccaccucuuggguucaagugauucuccuaccucugccuuccgaguagcugggauuauaggcacacgccaccaugcccagcuuaaguuuucuauuaguagagacaggguuucaccauguuggccaggcuggucucuaacuccugaccucaagugauccacucgccuccgcgucccaaagugcugggauuacaggcgugagccaccgugccuggcagucuuucccauauguuucugauuagguugggucacagggagauuuucacaccuaacaugagacauuuauugcuggacaaccaaaaacauucucuuuccccagaaaagcacacaaagucuuuuuuuuuugucuuuaagauaauauuaguucauccuucuccaccugauucacacucccucuuucauguucuguaacuuaaauacugaaauauaagguuaacucuuauuaacacauguuagauaauaaggaagaaaacuaaugaaccaaaaaauauuugguuaauacacacacacacacacacacacauauuuaaacacaaauauaucaaauuaaggaagaaauauuuguaacuauuguaguccauauuucugcaauggucauguggucauagcugguauauauguucuuccacuacucauuccauauucccuuugcucuaaguaaguacuucagccaguucggauuccuugccucauggggugacccaggcuuucauucuugaaagauaugggcuauuagcaguucuuucugaauuacuucugcuguuugcaguucuacaaaacccuuugcaauuuuccguggacuugaaucucaggacaugggaaauacuaagagauguccuagaggaucucuugcauuucagacacacuucacuucaccuguauugugcaauagucacucaaauuccucuugaaaguuagggucaguuauccccagugaauacaguaacccucuccauugccucuugauuuggaacuucagaguaaaguuggggucucaacuucagguuaguggaaucauuuguuguguccccuaguggauguguucgucucuuugaaacuagacuuuuagaacaacaaagccuaaagucacagggauaggaaauaaauauuuugccaacacugaauuuauuagucuucauugauuucccaaagaaaugaaagaaaaagccuccuagcacucauuaaaagucaugaaaggcaucacugucuacuacucagucaccuaagccagaaaccuuggaaucaucuuaaauucuucccuuacaacuaucauuuuauuucuacuggugacaaaauccuaucaauucuaccuuauuuuacaucucucacuuuuauccccuccucuacauucucauaucagucacugccuuagacuaggcaucaccuucacuuacccaaauuguaaagaugaucuuuaaacuuuuugucucuguccacuauuuuucugcuaaagcaaucuuuuaaaaaucagacuauauuuaguggcucuaagugcuuauaagguaacaccaaacuccuuaaccagcugaauuaauuuaucuguuauaaucgagauccaagucagauggcuuuaacaaguuagaaguuuauucucucuuaggacuuaggugaugguucaggaauccaguuccuucugauuuaccuggucuuggauauuucaccaccaugucagaaccagcaugaaaaaggaaauggagaagaggaggaugugcccuuuccuuuaaggggacaacccagaagaugugcaaaucauuuucacucucagcuccuuggccagaacuuggcugccaguucuagcugcaagagauauugagaaagagagucuugucuggggggccuugugucuagcuacaggaggccuguuauuguagauaaguggggaauggguauuggaagaccaccaguagucucugccacaugaggcauacacaaucuucuggagagugauccucgcuuacuucuuuaccuuauuuuuuagugugcugcuuuuccacauuucccucuuuaucagcucucuugacucuguuuccccuuugcauuagccaugcuaaacuauuugcacuuccaaacaugcucugcugauacacguuucuccgccuuuccucuugcuuccuuagcuugaggugcccuugccacauacuuuccucaucuccaacucauucugucagcuugauuucagagaaguugucuuuuaaaacucaacauaagccucuccaauucuguuuuccuuauuguguacacauagacuugagacauuacaucucuugguacuuauuuacacuuagauuaucuuuauauuuuguuguaaacucuuugagggcacauaugacauuuuauucuuguaucucuuggauguaauguaaugccugacagauaaaggauguguacuuucuuuuuacuggaugagcaaguggguuuauagcaaaaauaacugugcagacuuuuuaaaaugucagaaccuacucuuaagauagggcuacuguuucuuuuuuuuuuuuuuuuaacuuuugucaaucaaaauguuagugcuagcucuaacaauauuuauaaucauccuauauuuucuuguuagucuuuucauauuuaguuuuuaguuacaauuuaauuccagaagugcucagaguuaguuauggaauuuguuaauuuuuuucucuuuaaaaugagcagccuuuucugucuccuaaggcacaguauuuauaauugcuuuuuuuuuuuuuuuuuuuugagacggagucucacucuugucacccagucuagagugcaauagcgugaucucagcucacugcaaccucugccucccagguucaagugauucuccugccucagccucccaagcagcugggauuugcaggcaccugccaccacaccuggcuaaauuuuuguauuuuuuuuuuuuuuuuuuuuuuaguagagauaggguuucaccauguuggccaggcuggucuugaacucuugaucucaggugaucugcccaucucugccucccaaagugcugugauuacaagugugagccacugcgccaggccuguaauugcuuuuuaaccguucaguauaucagugacuugcggcaggagauguguugaaguaaguuagauaauacugacaugauuuccaaagccuguccuaagaccuucugagcacugccaccuuaacauacugguucuaagauauuggugacucaggauuaauuuaaugacugaaaagagucauuguuguaaacaaauucuaaggcaagagugccuuaaauauucuuacauggagaauuuuuuuuuucugcuuuacugucuugaguaauaucuuuuguuuuacuuguagauuugaugguccucgaagauuugaggauuuagggucaaggugugaaggaccgagacccaaagggccucguuuugaaggaaaucgccccgaugggccaagacccagauaugaaggucacccagcagagggcacuaaaagcaaguggggaaugauuccccgggggccagcaucucaauuuuauauuacccccaguacaucccuaaguccucgacagaguggaccacaguggaaaggccccaaaccagcuuuuggacagcagcaucagcagcaaccuaagucacaagcagaaccucuuucaggaaacaaagaaccauuagcagacaccaguaguaaccagcagaagaauuuuaaaaugcaaucagcugcauuuuccauugcugcagauguaaaggaugucaaggcggcucagucaaaugagaaucuaagcgacucucaacaagagccaccuaaaagugaagucucggaagggcccguagagcccucuaauugggaccagaauguucaaaguauggagacucaaaucgacaaagcccaagcuguuacucagccuguaccccuugcgaauaagccuguaccugcucaaucuacuuuuccuucaaaaacaggggggauggagggaggaacagcaguagcaacaucaucauuaacagcagauaaugauuuuaaaccuguggguauuggucuaccccauucagaaaacaaccaagauaaaggccugccucggccagauaauagagauaauagauuagaaggcaauagaggcaacagcucaucuuacagagguccugggcaaagcagaauggaagacacacgggauaaaggucuaguaaacagaggucgcggccaggcaaucagucgaggcccaggauuggucaagcaagaagacuuucgggauaagaugauggguagaagagaagauagucgagagaagaugaacagaggagaagguagccgggacagaggguuggugaggccuggaagcagucgggagaaagugccagguggucuucaagggagccaggacaggggugcagcuggcagccgagaaaggggaccaccucggagggcuggcagucaggagaggggaccucuucgaagggcugggaguagagagagaauaccaccccgaagagcugggagcagggagagaggaccaccucgagggccuggcagucgagaaaggggacugggaagaucagauuuuggucgugauagagguccauucagaccagaaccaggagaugguggggaaaaaauguauccauaucaccgggaugagccuccuagggcuccauggaaccauggagaagagcgagggcaugaagaguuuccauuagaugguagaaaugcuccaauggaacgagaaagacucgaugacugggauagagagagauacuggagagaaugugaacgugacuaucaagaugauacacuagagcucuauaacagagaggacagguucucagcaccaccaucucggucucaugauggagauaggcgaggcccuuggugggaugauugggagagagaccaggauauggaugaggacuacaauagggaaauggaaagggacauggacagggauguggaucggauuucaagaccuauggauauguaugauagaaguuuggauaaugagugggacagagauuaugggagaccacuggaugaacaagaaucacaguuucgugaacgggauauuccaucucuuccaccuuuaccgccccucccaccucuuccaccuuuggauagauaucgggaugauagauggagagaagaaagaaaucgagagcauggguaugaucgagauuuccgugauaggggugaguugaggauucgagaguauccagaaagaggagauacauggcgggaaaagcgagauuauguuccugacagaauggacugggaaagagaacgguugucagacagaugguacccaucugauguggauagacauucccccauggcggaacauaugcccuccucacaucauuccucagaaaugaugggguccgaugcaagcuuagacucugaccaaggccuuggagggguaaugguucucagucagaggcagcaugaaaucauuuugaaagcugcacaagaacugaaaaugcuucgguaaguugacuccuucagauccuuucuuuuaauaaaaaccacauucagacugcucuuuuuaaagugauaugauauauuugaauggaaucauuuuacuucaaguucuuaucacauacuuuuaauuuauauuucuggucauucagugcuguuuuaggguuagaauggguauuuaggaacuguguuaaugauaaacuuaugcccuaagaugugaaaauugauugcugucuuggccuuuguagaaguguugcuggcaugccaugccugugcauguuucaagugucaaacuucaacuuuucagugcucuggauuucacaggguucauguguaaccuucauuuuuuccaguaaucaguuuguucuuugguauuagaucugauagacuuuauauucacuaaucauugauaaaacuuuggaaagugcuguauuuuucuuuguugaagcuaagaaugguuugcuuaggagcauccucagauuugucuuaacuauugauacuuucuuuuggggauguuuuaucuuucauuauaacuaaaagcagauauuucuccuugaggauguuauuuguuucuacauaaccaaauguuuucuuugugaaauggaaaauaggauuucuugacuuacaaucaacuguguauagguaucuacauaauuuuccucuuuucuugugguaacaacaauaacaaaagcuaacauuuauugcaugcuuacuccgggccaggaacuguacuaaguguguuguguauaauaaacucauuuaauccuuaaaccagcuguaucuugggauaggaauuuagaagucagugacagauugaaaacuuuuuuaaagcaauuuuuuugagaaagucaauuaaugauuagguuuugauaaauuccaauguauuucuuccauuuuucaauucugguuuacauuuguggaucuuaacaauaaauuauaacuuaaacuuuagaacuaggaaagaaaaauacggugaagaaaagguaaugaugaaagaccagauacggcagguuuguauggucuauagcuaagagguuuauuuuuuccagauuacucaugaagaaaauguggaaagcaugcuauagaauauuuagcuacuacacuauucacuuuuaaguuauagacaccuuuaauuuuaacaccuaccguguaacugggcacuugcuaauaauugaguguauauuaugucagucugucuaucucaaaggccugcaaagauaagguaguauuauccccacuucacaaaugacacuaaaguucaaagagguuaaguucccuuggcuaguaaguggcaaacccggccuuugaacucaaucugucuaaaacucuaaaaucuguguuauuuauggagaauaccaagcugauugguguuguuaagcugccaagguuucuuuuuuuuuccuuuuuaaauuucuuuuuaauucguuauugcuuugcaugguaaugcuggauaaaaggugcugcugcugcuucauccuuuuuuaaagcuuucuaggcaacaugaacauaauuaaacaauauauagggagugauggauaaugucauagccgaauacaagucguuuauguugugucaguguaaagucguaaggaguaucauaagggaugugaugaugggauuuaccugagcaguaaauaaucuuacacacuugacccuuacuuuguggucccucauuuguggacccucauuugggucacuuuaauguaaggagaaaauuguaaaaggucuuaagaaauuguaguggauuuuaccuauguuuaagguaggcauugugaaaaaaaguaaaaggaauuucgucaguuuaaagaaaaaaccgaaggauuacauaauuaucuucaggaauaugaaauguuguuuuuaaagguauagacugacaguuguucucaccaucuacagcaggggccauaaauuaaaauguccccaagaaucagauaacaaaaaugagugaaagugggccaaguauaacucuguagaguacggugaagauugugacagguuguuucaucuaacaugggcagccucuacugcacucagcugauuguuggcaugugggaauguaggccugguguuaccauaucucuuuaagauuugaauuuauauaugaaauauuuugcuuuguaaauaugacagcuaauuucaaauuuuaaaaacugaugugaaagccacauuuugaaaaccuuuuuaggccauauuuggcccaugggccaccauuuugcaaccucuggucuaaagaguugaaaaaaauaggccgggcgugguggcuuacgccuguaauccuagcacuuugggaagcugaggcaggcggaucaugaggucaggaguucgagaccagccuggccaauauagugaaaccccgucucuacuaaaaaaauacaaauaauuagccgggcgcgguggugcaugccuguagacccagcuacucgggaggcugaggcaggagaaucacuugaacccgggaggcagagguuguagugagcugagaucgcgccauugcacuccagcccaggcgacagagugagacucugucucaaaaaaaaaaaaaaaaaaauagcaagagagcuuuugguuggauuaaagaaaaacauaacaaguagaugagauaguagaaaacaacugaggcagguuguagaaucuauucuugaauaucuucaauaauuuauaauuauuuauaugucuuaaaugacugaugaguuagcuacauaaaagcaaaagaggguaauccuggagcugcucaguguauggccacugcagagaauuuuaggacaaggauuuuuuaggucuccuuuuuuuaauuaaauauuaauuguagucacuuaggaauggaauaagcaugcuuuauguacuaugucaauuuuauuuguuugcagggaacagaaagaacagcuucaaaagaugaaagacuucgggucugagccacagauggcugaccaucuaccaccucaggaaucaagauugcagaauacaucuucaagaccuggaauguauccgguaugggagaaugugugcucagaaaaugaaaugguuucuacuuuguauguuucuauguuguuugauuuuuuuuagaaguugaauaaauaacaaauuuccucuauaaaauguaaauuuuggaaacuuaaaaguuuaugguaauugaacuuugaacaccuuaaaagcauguucaaaagugugguagagaugcuccuuuuccccagauuuugauaaguacaccaaguacaccugaacuacauagcuucuguucacaaaaugguagaauuuuucuaauaauuuuuauguuaaaauaguccuguuggcugggcauaguggcucacaccuguaauucuagcacuuugggaggcuaaggcgagaggauugcuugagcccaggaguuugacaccagccuucgcaaaauggugagaccccuaucucuaccaaaaaaaaaaaaaaguccuguuuuccaucuaggcagggcuagaugugggccucgugaugcuuccuaccucuucaggcuacuaguccuucagauggggaaaugucauaccccaguacauacuucagaacuguucaggcaguaugaaaagggguguuuauguuaaagacuugaguaauuaaguucuccuuuuuuucccaagagcaugccaggacuucuuuuauuuuuguuauuuuaccuuuaagccaguaaugggcuuuucaaauguuuaaaauguuaucuugcagguaguuuuaugacagcauaaugaagaaaacagcucuacugaaccucuacugaaccauuucaucaaauuaacacuuuucauuucucaguguucccuuccauccuggucuaauacuuaacaguaagacauaguuguugacaucagugaccaccaugguguuguugacuccccagaucggaucuccugaccuuuguacgcaucuaccugucugcaggguuucugucuguggaugugacuccugucaaaugcagcauauucaaaauggggcucguuaucauaccccauuaaauugucuuuuuuccucaccaucaccuagucacccuaacuugaaaccugaaaaucaacccuccaucuugcuccaucuugcugauuuguccuacccugcugcugauugauuuuaccuccuuugaaucaaauucucaaguauaauuacacccauuuuaagccuauaguucgaguuuugacagauguauaccaaaagauaaaaaaauucucggccaggcgcgguggcucacaccuguaaucccagcacuuugggaggccaaggcggguggaucacuugaggucgggaguuugagaugagccugaccaacuuggagaaaccccgucucuacuaaaaguacaaaauuagccgggcgugguggcgcaugccuguaaucccagcuacuaaggaggccgaggcaggagaaucacuugaacccgggagguagagguugcggugagccgacaucgcgccauugcacuccagccugggcaacgggcgaaacuccaucucaaaaucaaaacaaaacaaaacaaaauucucaucacccuaaaaaguucucucaugcccuuuugagauugggacuaccccuauacuccacuucaggcagcgucgaugugauuuguggccagauggacauuuuaaaacaaaucucaccauguggcuaccuggcuuuaaaacuucaauguucucccaugccuucaggaugaaauuuagaaucucuugcaugacuuucuuguucuuccugagcuggccugaccucugcugaccauugcuugcuacuccacucucugaugcuucauuuucccuccacauagagcuacuuaacaauuuugugaaugugcuagauucuuuuacuucuucauuccuuugcguaugcauguuguucucuaagccuagagucuuuucuuugccuucccauccccuccugcaacuggcuaauguuuguuuaucuuuuacaacucagcucuacuauuuucucuuccaccuauguagggcaauuacccuuguacauacccuguaacaucuuguacuagucuuuguugucaucuuuauuauguugcauuuugagugucuguuuucuugucuuucuuucuaaauugaguccauaagauaauaacuauaucuuucaucuuugugugucuuaguaaauagaagcgccagauuguacauccacauuucugcuuuauuugcuuaacaaaucauaaucaucuuuccauauuguuauaugcuauauuauuuuuugauuuacaauaauuuauugaauuaauucaauuucuguuggaauuuguuucuaaucuuucacuguuauucuuaauauuacccuaaugaaugucuuuguauuggguucuuauuuuagauaacuccuuuucuuuuuuccuuuuuuuuuuuuuugaaauggagucucacucuguuguccaggcuggagugcaguggcaugauuucagcucaccgaaaccuccaccucuuggguuuaagcgauucuccugccucagccucccaaguagcugggauuacaggugccuggcaccacaccuggcuaaauuuuuuguauuuuuaguagagacaggguuuuaccaauuggccaggcuggucuugaacuccugaccucaggugauccaccugccucagccuccgaaagugcugggauuacaggcaugaaccaccgcacccggccaauaacuucuuaggaguaaguuuuauguuuuuguuuugucucuuuuuuuuugcucuguugccugggaggcuggaauacagugguacaaucauagcucacuggagccucaaacuccugggcucaagugauucucucaccucagccuccugaguaacugggacuacaggcacacacccuacgccuggcuaauaauaaaaaaaaaaaauuguuaguagggacagggucucgcguuguugcccaggcuggucucgaacuccugggcuuaagugauccucaugccuuguccucccagagugcugggauuacaggugugagccccugcacccagccaacagugauuuuaacgucccaaagugggacacuucagucaaagaauaagcauacuuuuuuuuuuuuuuuuugaaacggaauguagucugucacccaggcuggagugcaguggcacaaucucagcucacuguaauauccaccucccggguucaagugauucuccugccucauccuccugaguagcugggauuacaggugccugccaccauuccuggcucauuuuuuuuguauuuuuaauagagauaggguuucaccauguuggccaggcugguuuugaacuccugaccucaggugauccaccugccucagccucccaaagugcuaggauuacaggcaugagccaccacaccuggcccagaauaagcauacuuuuuaaaugauuccugucacauagccaaacagcucucuauaauaguuguauaauggccgggugugguggcucaugccugcaaugccagcacuuugggaggccaaggcagguggaucacaagaggucaggaguuccagaccagccuggccaacauggugaaaccccgucucuacuaaaaauauaaaaaucagcugggcuugguggcaugugccuguaauccuaguuacaggugaggcugaggcaggagaaucgcuugaaccugggaggcagagguugcagugagccaagauugcaccacugcacuccagccugggugacagaucaagacucugucucaagugcaucaccugaggucaggaguucaagaccagcuuggccaacauggugaacccucgccucuacuaaaaauacaaaaauuagccaggcacgcgccagguggugcgcaccuguaaucccagcuacuagggagacugaggcaggagaauugcuugaaccugagagguagagguugcacauagcgccacugcgcuccagccugggcaacaagagugagacucugucucaaaaaaauauauaaauaaauaaaugaaaaaaaauaauuguauaacaucuauacuauagccucguaagcauuagcuacuuaauauuuuugguauauuuaauaauuuuaauacagcauuuuugauuacuagugaacaugaauauuuucccauauuuguuaauuauacuuuccucuuacagaaauucuguuuguguccuucacccauuuaucuguuugagucagguuuuuuuuuuuuaaauuaacucauuauccuuaauauaauauagauauuaacccuuucucauauaaacaauaauuuuaaaaaauguaucuuuuacuuucacuauauagaaugaagaaagcaguuuuuaaaaaauuuauaaguauacaucuaugagaucuuaagauauuuaaaacuugucuugauagaucuacccagacugaauagcuucauccuauauuggcauuuucuugacaaaguuuaccaugccauacuuuaaaaguuuaccuuuagguaauagccauuugucuuuaacuguagccaguaguuaccuccagucaaauaauguuccuucuguauuagucaacuccauuuuauuauucagaaaguuuauuuuuaaaguacuguguauauaugggcaaauauauaaauaauguauauugugggcucuccaggaucuaaaauagcgucaauaaagaaaaaacauccuagaauaacagagaaguaaaaaaccaaaacaaaacaaaaaacaaaaaaauaaaaccaaaccagccagacacagugaacuaagaaaugggaaguaaguguuugaaucacacuuacaaagauuaaaauagagacuaggcaugguggcucacaccuguaaucccagcacuuugggaggcugaagcgagaagauuacuugaggccuggaguucaagaccagccugggcaacauagcaagaccccgucuuuaccaaagaaagaauaaaaauaaaauguauuuggcaacuggguuucaauauugaguagauaggaccaauuugcuaagaaguccuaccaucuccaucauagacauuucugaugguaacuggugaugcuuugggaaaacaaauggaaggagggcacacaacaguggcacuccuuagauuacuagauguucauuuaguuuauuuuguuguuucauaguacucauguucucuguuggucucagcuucaccacagaugacuauugucaaccagauaacugaaaggaacagaaguguggaggcuaucuaggauuucucucacugaaaauuuacuguuuuuguggaggagauaggucucuagaguaggaagauaguucuuauuuauuuauucauuucucuccuuccugcacacugagcauaggaagauaguucuuaaccgaggguuauaaaucagaauuauucauggaggguuuuuuuaaaauuuugaauuacuggugggaccccaccuacagaaguucaguagauuugguauuggccugggacauuugaaucuuacguggcuaccacccuaauuuggaguauggaaauuuuaaaacguuuucauuaccccuguaagaucacugcaccaguuuacaguuaguuaauccucauuccuaccccagucccagcacuuucugucuauauagauuugccuuucugggcauuuuguauaaaugaauuauauaauauguagucuuuugugucuaucuucuuuucaaaguuuacccauguuguagcaugacucaguacuucauuucuuuuuacugcuuuuuaaauuucuuuuuauuuauaaccuguuacaugaauauaccacauuuuguuuaaccauucaccaguuguuggacauuaggguuguugaauaguacggcuaugaauguuugugugcaagucuuuggauggacauauguuuuuauuuuucuuggauagauaccgagaaaugaaauugcugagccauaugauaaauuuauguuuggccgggugcgguggcucaugccuguaaucccagcauuuugggaggcugagguggguggaucgccugaggucaggaguucgagaccagccugaccaacauagugaaaccccaucucuacuaaaaauacaaaaaaucagcugggcgugguggcgggugccuguaaucccaguuacucagaaggcugaggcaggagaaucacuugaaccugggaggcagagguggcagugagcugagaucgcgccauugcaguccagccugagcaacaagagugaaacuccgucucaaaaaaaaaaaaaaaaaauuguguuugacuuuuugagagaaauuggcaaagcauuuucuauaguggcaccauuuauucccacuaacaaucuaaaaggguuuuucuuuccuauauccuugccaucauuuguuuuugucugucuuauuaauuauaaccauuccagugcauaugaaaaugguaucucauugggauuuuaauuuguguuucccuaaugacuaaugauggugagcaucuuuucaugugcuuauugggcauuuauauauuuucuuuggagaaauaucuauucucaucuuuuggccauaguuuuuuuuuuuuuaugauuugucuuaccgaguuuaaguguuuuguauauucugaauucaaguucuuuaucaaauauaagauuugccuauguuuucucccuuucuguggcuuguccucauuuuuuuugaugguauguuuugaagcacgaaauuuugaaugaguccaagguguuaacuuuuuucuuauaaauugagaaccagauuuuaauuuccacugaucuauaaaaacauagugguauacuuguccacuaagcuauuuauucuguucucuagccuccagggucguauagaccucccccuccuaugggcaaaccaccagguucaauuguaagacccucugcuccaccagcaagaucaucuguuccugugaccaggccaccugucccaauaccaccaccuccaccuccuccaccucuaccuccuccuccuccagugauaaagccacaaacuucagcuguagaacaggaacgaugggaugaagauucuuucuaugggcucugggauacaaaugaugaacaaggacugaauucagaauuuaagucagaaacugcagcaauuccaucugcuccaguauuaccacccccaccuguucacucuuccauucccccuccuggcccagugccuauggguaugccaccaauguccaagccaccaccaguacaacagacuguugauuauggccauggccgaggugaguaaugauagugcacuuguauuugggauucuacaggaauuguuagcuucagcuuuagcuuucucuagcuucacucuuacaguacuuuaucucugauuuuguuuaccagauauauccacuaauaaaguugaacagauaccuuauggagaaagaauaacucuacgcccagauccacuaccugaaagaucaacuuuugagacagguaggauucccagagaggucaguauuuuuaaacauuuuagggccuaauuaucacaugauuuuccuuuuggugagauuaucugagccuccauuuaauacagcuaaaagauucuuaguugaauuuauggcaaaaauuuauaccagcucugaaguuagauuuauaguuuucugcuuuuauuucuauaaaagggauauaguuauuuuguacuaauuguuuuuguagagcaugcaggccaacgugaucguuaugauagagaaagagaucgugagccuuauuuugaucgucaaaguaaugucauagcagaucaucgagauuuuaaaagggaucgugagacacauagagaucgagaccgggaucgugguguuauugacuaugaccgggaucgauuugacagagaacgccgaccccgagaugauagguaugcuauaaaacaaucuuugcuagguguacaaauuacuguauacuuaacaguaaaaguuuaagagaaauuuaauaaguaacauauucuucucaugcauguguauauguaauuuggagggggaagaacaauucuggaccaguuuucaggaaaguagguccuugacuugguagcuugaauuccagagaauuaaaugggagauggagauagccagaagggaauggaaaugguauugucaauaaaggugcagucauacucaguaggcaagcaauuuauuuuugcaauucaugagcuuuuuauuuauuauuauuauuauuauuauuauaccuaagggcauucuggcagccagccaaggaaaagggaaaggggggcaagcccaugaacuauuuauuuauuuauucauuacuauuuuguauggagacggggucucucucagucugucacccaggcuggaaugcaguggcgcagucucagcucacugcagccuccaccuccugggcucaagugauccucccaccucagucuccugaguagcuggggccacaggcaugugccaccaugccuggcuaauuuuuuuuuuguuuuugaugacgaugugguuucaccauguugcccaggcugaucucaaacuucugagcucaagugauccaccugccucggccuuccgaagugcugggauuauaggcgugagccaucaugcccagcuuucccaugaacuucuuagauguauguauauaaaguaaaucuaaaugaaaaagcaaagucaaaauguaaauauuggccgggcguaguggcucacgccuguaauccuagcacuuugggaggccaaggcagguggaucucuugagcucaggaguucaagaccagccuggccaacauggcgaaaccccaucucuacaaaaaauaacaaaaguuggcugggugugguuaugugcaccuguagucccagcuacucaggaggcugagaugggaggauugcuugaacacuggagaucaaggcugcagugagccgagaucacgccacugcauuccagccugguugacaaaguaagaccccaaucucaaaaaaaaaaaguaaacauuuacuguguggaguaccuuccuauagagaaaauugggcaguuaaugcuguugcguuauaaagcagagaaccccaaauauuuuuuauuugcugaagcgcuuccuauuacaccuucuagagcucagucauaucgagacaaaaaagaccauuccucauccagaagaggggguuuugauaggccauccuaugaccggaagucugaccgaccagucuaugaaggaccauccauguuuggagguagagugaugccuuauuaacuacaaggauguugagaauguaaagcaugggagaugcuuuccauuguagcuaugaauuuaaacuuuuagaguaaaacguauucacagauuucuuagagcugguggcauuguccuaaaaaauagcaguguaauuaaugaaauaaagcauguuuauuuuuaaaacaaaguagaaucaaaauuacugauagucucacuaccuaccauacuacagcuauuauaauuuuguagcuuuccucucauucgcucuuuacagacauauuuaugaaguuguaaucaaaguauaauaauacaauuucuuuaucgugauuguucugauugauauugcaccauacacauuuuucauauguaaaccuauuuuauuaauggcucugugacauuccauugaguggauaaaauauaagaccaagacccuuauucuuaguuauuuagguugcuuuuaguuuuucacugcuaugauuuacacuuaaacuagaaacucauaccuauuuuuaggaacaggcucuccuaagaugguauaacucuuacucuuaaaaccauaaagcagaaguuacagaacuuaggacuauccagcaaagcauuuauuauucuuccauguccuguugcuuaacuuuccuacauuuaauacaaacaaggaugaauucaguguuuugcagaacauucuauuugccugaaaucauacuuaaaucuucucauuuucuugacuucaguagauuuuacauuaccuuaaauuuucucuaauuaaaguuaaaaguggccccaaaaucacuggacuugguuugaauuauauuaccuuaggauguguggggagaguugaauuucaaaauaauuacucuacaaauaguaauuuuguucaacugcuggaauccuaggagaacgaaggacuuauccugaggagcgaaugccucugccagcuccuucacugagccaccagccuccuccagcuccacgagucgagaagaagccugaaucaaagaauguggacgauauuuugaaaccaccgggccgggagagcagaccugagagagugaguccuaugaaguugauucgucuucgugcaaaccagaagauaagagaucuuguuaauauccugaaaagaauuucuuuauuuuucugcaacauaguaauaauaucagauucaagacguuuuacuaucucuaaaucaccauauaaucucauaaauggccuacacuauagaaucuuuaagaauuuagcacuaaaguacuuggcaaaaaagauguugaauuuuaaaacauauuaaugagaccucaauuaauugcgcguugaagagaggaaaaguggauuugguuuuaugguguguggaauagaaagggagaauuaggagacuugauuagcuuaggcuuaauuuccuagugaccuccaaaugugcgcauucuauuaaauuugucuuauuacagaauaauuagacugacuccauuugaauuaacugguacuggagauuucagccagauauuuuaauuccauauauacagaauuaauagauuguuguuuuaaagucuuuuugccuacuauuacuauauagcuacuugaccuuuccugugguugcuguuugcaugauaaaucuuuuaccauuuccuuccuuucauucuauuuguaucuuuuaauguaaagugugucuccuguaguaugccuaugguuggaucuuuuuuuuuuuccauucagguucccuuuauuucugacauuucuucaccauccuugcaaggguaacucccuaaucacucuagaaauucagauuccuguuucugacuccguaggacacagcggaucguguuuuuuaaugcagucugaaaaucucugccuuuugauuggauuguuuaauacauucacauuuuuuuuuuaaauuauggauucaggauacaugugcagguucauuacacagguauuuuguguaaugcuggaguuugggcuucuaaagagccugucacccaaaaagugaacauaguacccuguaguaaaguuauuauugauggcuuaauuucauuuuuggauuguuccuugcaaauauauggaaauaugguuuauuuuuguuuauucgucuuguauccugcaauaccacugaauucauuuauuacuuuuaguagguuuuuaguugauucuuaagguuuucuauguauaagaucaugucaucugcaaauauacuuuuacuucuuucuuucugaauugaaugccuuuuauuucuugccuaauugcccuggcuagaaccuccaaugcaguguugaauagacauggcaagaguggacauucuugucuuguaucugauuuagagagaaaaaaauacaaucuuuuaccauuaagaaugauguugcugggugugguggcucacgccuguaaucccagcacuuugggaggcugagaugggcggaucaugaggucaggagauugagaccauccuggcuaacacggugaaaccccgucuguacuaaaaauacaaaaaauuagcugggcgugguggcaggcaccuguagucccagcuacucaggaggcuaaggcaggagaauggcaugaacccaggaggcggagcuugcagugagccaagaucgcgccacugcacuccagccugggcgacagagcgagacuccgucuuuaaaaaaaagaagaaugauauuagcuguggaauuuuuuuguagaugcacuucauuagguugagaaaguucccuucuauuccuaguuuguugaauguuuuuaucaugagaggauguuggauuuguugaaugcuuuuucugugucaguugagaugaucgugugauuuugguuuuuagucuguugauaugauguguuacauuaauugauuucauauguuaacuugcauuccugggauaaaucccacuugaucaugguguguaauaauuuuuauauguugcuggauucagcuugcuaauauuuuguugaggauuuuugcauccauauucauaggagauauuguaguuuucuugucuguaugugguuugguguaaugcuggccucauaaaguaaguuagaaauuauuccuuccuauucuauguuuuugaagaccuugggaagagucgguauuuaaauguuuggugaauucaguaaugaagucauccaggcuuaggcuuuucuuuguguguaguuuuuuaaaauuauugucuuagauucuucacuuguuauaggucuauucagauuguuuauuuguucuugaguaaauuuuaguagucuacaucuuuccaggaauuugucuguuucaccuaaauuaucuaauuuguuggcauacaauuguucauaguauuccuuuguaaucuuuuuuauaagguugguaguaaugucuccuccuucauuucuuuuuuacucgaggcagagucucacuauugcccaggcugggguugcacuccugggcucaagugacccuccugccucagccuccugaggaacugggauuauaggcacaugccacugagcccagcuuucauuucugauucugguaauuugaaucuucuuuuuuuucuauucagccuagguaagaguucaucaauuuuguugaucuuagucaggcgugguggcucaugccugucaucccagcacuuugggaggcugaggugggcggaucacuugaggcuaggaguucaagaccagccuggucaacacggugaaaccccaucucuacuaaaaacacaaaaauuaggcgggcgugguggcaggcaccuguaaucccagcugcuugggaggcugaggcaugagaaucgcucaaaccugggaggcagagguugcgaugagccaagauugcaccacugcacuccagccugggcaacagagcaagacuccaucucaaaaaaaaaaaaaaaaguuggucuuuuuaaagaaccacugccaccguuugguuuuauugacuuuuucucuuuuguuuuucuguuuucuauuuuauuaacuucugcuuuaaucuuuauuguuucuuuccucuguuucuuuaguuugcucuucuuuuucaagugucuuaaaguggaugguuaaguuauugauuugagaccuauuucuuuccuacuauaggcauuuauagcuaucaauuuccuuuuaagcacugcuuuagcuguauccuguaagcuuugguguguuguguuuuuuucauucaucucagaguauuuucugguuccuccugguuucuggcuccucuugauuucugguuccucuucauuuuuucuuugauucauugguuauuuaggaguauguuguuuaguuuucacguauuugugaguuucucuaauuuuuucuuacuauuaauuucuaauuucauuccacugugguccagugacauacuuuauauuauuucuguccuuucaaauuuaugaagguuuguuucauggccuguuguauagucuauccuggaaaaugguaggucauuguuaacuguuaucucauugcagaaaauuuucucucagugauuuuuuuuuuuuuuuggucuauucuguuucagauuguuguuauaaugagaggauuaccuggcaguggaaagacacauguugcaaaacuuauucgagugaguauggggaagcugaaaaaucagcugcuugugcugcuuguguuaguagucacuugccuucuuauuaauagcaagcaacauaaugccaauagaauugucuuccauuugauccauuacaguuggcccaugugguagauguugucccauauauauuuuuaucuacucagagaaacauuuuugccucugcuugauuugaaaccaccagaagauuguauauuauuuagccacaagagggaacuuuggugugaacauuaauuuauuccauaaauucguuuuaaccuucuugacuguaugauucuuaggauaaggagguagaauuuggaggaccugcacccagaguucuaagccuggaugauuacuucaucacugaaguggaaaaagaagaaaaagauccagauucuggaaagaaagugaaaaagaagguaugguauucaucucagaucucguucugauucauuaauaguauuuaaaggaaaauguguuuggagagaaauguggcuuuuuugagggcagggaccucucucuuuuccgaacacaguacuuuaguacuugggugugaaggaaagacuacaaagucaucucuauccaaauacuaaccaaggaaaagguuuuggaugauucuuugcuuuugcuaauuccauaucucuuuugggggaccuuagguaauggaauaugaauaugaagcugagauggaggagacuuaccgcaccagcauguucaaaacuuucaaaaagacucuggaugauggcuuuuuucccuucaucauccuggaugccaucaaugacagaguuaggcauuuugaccaguuuuggagugcagcaaaaaccaagggauuugagguagaagcuuaaagaacuuuaaaguacuuuguguugucauguaaauguuauauaucuuugccuaauuauuauucauucuugcuuagguauauuuggcugaaaugagugcagauaaccagacuuguggcaagagaaauauucauggaagaaagcuuaaagaaauaaauaaggugauuuuaagaaacauagaauaauagaguacuaucaugcgcugcauaaugauguuuugguuaaggaaggacugcauauaugguggucccauaagauuauaauguauuuuuauuguaccuuuucuguguuuagauauguuuaaguacacaaauacuucauuguguugcaguugccuacaguauucaguacauuaacaugcuguacaaguuuguaaccuagaugugcaguaggcuuuaucaucuagguuuguguaaguauacuccaugauguucacacaaugacaaaauugccuaaugacccauuccucauaauauaugcccauugcuaagugaugugugacuguacucuaaaccucauauuaucuguaucagcacucuugucuggaagcucuuguuuaucuccuuuuuuuuucauaauaacuuuccuaucugcuuuaguaaauguuucucuuccuuuguuucuuuuccuagcucuucuugaaauuagccuguuauggccuggcaugguggcuuaggccuguaaucccagcacuuugggaggcugaggugggcggaucgcuugagccugggaguuugagaccaaccugggcaacauggcgaaacccugucucuacaaaaaaauacaaaaauuagcugggcauggugucaugugccuguggucccagcuacuggggaggcugaagugggaagaucacuugagcccaccaugucaaggcugcagugagccauguuggcgccacuacacuccagccugggugacagaccgagauucugucucaaaaaaaaaaagaaauuagcccauuagacuuuacaauauuaaauuaauauuuaacaaauauuuaauuaauauuuaacaauauuuuaaaauauuguuaaauguuguuuaucuuggaugcuuacuuggucuuugaguaguuucuagagauaacucaaccaucugaauuuuucaauagauggcugaucacugggaaacugcaccucgucacaugaugcgucuagauauucguucuuugcugcaagaugcugcuauugaagaggugaguauccuuugguucaaaugcaaugcaaagugauguuacuuuuucaccuuuuuacuuugaaaaacuuaaaaccuacagaaaaguuauaugaauaguauucauacaagaacaccuacugauaugccuuucauugagaucacgguuaguauuuugccacauuuuucucugaaugcauguauucuuauuaacauucuuguuaaugaugucacuguuuuuguggaaccauuugagaguuaaguugcagaucuuauaaaccuucacccuuaaauacaucaguagguaucuuguaagaacaaguacauucucuuuugauuugaugacaguuaucaaaugcaggaaauuuaguauugauaaaauacuauauuaaguaauauaaauuuccugaauuaaauuucuugaauuaucucacauauaguuuauauucacauuuuaccaguugucccuauaacgugguauauagaaauuuucaaaaaucuaagauucaauccuuuaauauaaaauauaguuucucagccuugucauugucaugaaagauaaagaauuuaugaagaguauaggccuguuuuguagaaugccccucaauuugaauuugucuguuuguuuccacaugcuuagguucagguuaaacauuagcgggaaugcuacauaagugauacugugcccucucagugugucacaucaggagccauaugguguuaauuuaucucauuauuggugauuuaagcacugauuacuugguuaaggugauauccaucaaauuuuucuaccuuuuucucuuugugauaaguaaucuguagggagauacucuuaauaucuuuuccccaacaaauuuucauucacugguaauucuugccugaauuaauuauuuauuugauggaaggaaaaauuuucuauuuuuuaccaguuguagguuucuguuuguuugaccucuuccauacucaauauugucauugugcuuuuuuuuuuuuuuuuuuugagguggagucucacucugucaccuagauuguagugcagugguguaaucucggcucacugcaaccuccgccuccaggguucaggcgauucuccugccucagccuccuuauuagcuggaacuacaggcaugcgccaccaugccuggcuaauuuuuguauuuuuaguagagauggaguuucaccauguuggccaggcuggucuugaacuccuggccucaaguaaucugcccaccucagccuccgaaagugcugggauuacagacgugagccaccaugcccaaccgucauuguucuuuuauguguuuuuaauucccaugccauuucucaacccauuuuuuucuggcuucugccacuaccauugucuggcaacucuuucacuaaugauuuccguggcaguggacaguucucauuuccucuauugauuaauuuuguagccacauguaauauaguugaccaugcccaccuucuuaaaaaacauauuuuucucuuggcuuuugugaauucacauuuuucugguuuuccuuuuacuuuuuuggcuaucucuuuucagucuccuucacuggcuucuccugcuucucacucuuuaaaagggcccccuuagggcuccauccuaggcucuguuuuuauuuuguacccucuguauagaucaucugaaucuuuccgguagcuuagauugucacuuacgugccauuaauguuauaaagucuagauugaauuauauuacuaucuaaauaguaguguuucugaauggagggaguauaggugauuuuuauaaucuucuuuuuacuauuauuuuccaaauucucuacaaaaaauauauauuaucuuaguauaccucaaacucaaccuauccaaaauauuguucguccaaaccuguuuuucauuuaguagucucuguuuuaguaauuagaacccuaaccacuugauugcugaaaccggugcucugggaguuaucccugacucuuuugucauuguugagacagagucugacucuauugcccuggcuggagugcgguggcaugaucauagcucauugcugccucaccuccuggguucaaaugauccucucaccucagccuccugaguagcugagacuacaggcgcaugcccugugcccagcuaauuuuuuauuuuuuuuuagagauggggucucacuauguugcccaggcuggucuugaacuccuagacucaagcgauccuccugccccaaccucacaaagugcugggauuauaggcgugagccacugugcccaggccugacucuuuacucugcccuugugaccugucauguagucaagaaaguuuagucaguuguaccuuuuaaugaccucuguaacucaucugcuuauuugcguugcuaccacucugggccaagccaauaucaucccacuuuucacuauacuuuuucuuauauuuugaaauuugaaucauugacauguuuuuaccugauuggaaaaauacucguuaaagauuuuuaaaagucuaguaauccauaggcauucaaaauagguaaccaucuacuuagcacuuauacuuaacuuuacagggaauuguacagauggauauucaaggaaaauuaaaggcaguaguauccugucuuuuaucaguucuguuucaaaauuuaggguguuaaaaauuacuugguauguaacagugagccugucuugcucugggcaacuguauucauuccagaucucaaugagggagucaauauuuugcuaaauguuaacucagucuuuuuuuuuuuuuuuaaugguugguauagguagagauggaagauuuugaugcaaauaucgaagaacagaaagaagaaaagaaagaugcagaggaagaggaaagcgaacugguaggagacagaccaaccacuuugaacagugucucuuuauuaaaauucuuaaagaagguuuaaauucagaucugugguuagacaacuacuguugauauacacuuuagugguaaaaguuuccauaaucaucuucaaggagacuuuuggauacucuuuauuuuuccccagaccaaaagaacccucuaaugugguguuaagagaaaguuuuaacagagugcuaagaaacuuacccuuguacucaucuauuugugggugguuuuaggggaguauaccuuuuaagaaaaucaauuacauaugaaagggcauucuuacauuccagcagauauguggcacagccuacccaacauaugcauaauugucucuucuuugcuacaagaucuccaaauuugaguuucugucaacagaggcagaagaacuuauugaauggggaggcagaggguugccacuggcugcuagauuuguucuucugcauuuuauccuaagugacggggaaaaauuaaaugacuguguaggcaauggauuuugcucaggcugauuagaggcuuacauagugugaguuuaaaguuucuguguaccuaauguaaaaugcuuucgaucacaccucuguagagauguuugccuuucccugucauucaagaauaugcgaccuauagaguuacguugacuuuucaguguuuacugaaguacagagauuagcaaugccuuggaauaguguugcuuuuuaaauccagaauauuacucgguuuauuuaauacuugagcccuugcuaaaguugcuccucauauucuuuugaaaauguacaaaaugagaacucugauuccuacccccuagaguauacagaaucuccagggaguggucccaucgaacccgugugugauauagaggacucuugauaaaaacuguguuuauauaaagauggugucaaccucuacauuccaagauuucaaauguggauuaaaaaauaaguuuuaaaguuaauggcauuugagucucaguauguguuuuuuuuaaaucuaguuuucuuaaguuguauuuuggcauauauaauuuaaaauguaggcaggauauucacuacaagguccacgcucuucuggaauauggcuaaugacuucuuuagccauuugcagcguguguacuagaaacugauuacgugagaagucuauaauguuuuagcuuucugaagcuccgucuuucuuuuguggagauuucagugguucauaacaucugacuugcuuagguguaggucaaaacuugggaacuuuuaauugaauguacuauuacuuuuuaaagugaaacacacuguaauacuauauuuuuacaucagagucauggcaaggaggccuuaaaauucuacccugcuggauuaucuguuuuauuuccaaguggccuacaauuucaagcaaugggagaguaauauaguuuaaaggaagcacaggaugauuccagcagggggaaaugaauacacuugucugccugacuugauuauaaaacuucucuuaacccauucaaagaugcagaauugaaaucuuuuacuauuggaguccauuccaagaguaaaagauucuuggagaauauguuaaccaaggguuaagagcaaguuucauaccaaccacucagaucauuuaaauggaauucucaguaaaccuugcauuuuccacucugcacuaauuaauauagcuggaugaaauccaaaguuuuguugguaaagauaaucguuuguaggggaucauugguaugauaguuugccuccuuuagugcuucagugaaccuaguagauaaaauuuauaaauauauuauuccagugaugcuuaaaguuuucagaugauuuuuaagauguaacuugucuucaguacuuuuagcacuaucacuucaguauagcuuugucuugguuuguucuaaaaaauguauuugggaaauauauaauuuguaauccaaaauacuaccuaguaaguugaaauugaauuauuaguucuggcugguagacuagaaauguaugaaacccauaggauuaugcucuaguaaacucuuacacagaagcuaucaucaugaaaucuucaaaaugcuuugugacuuacuuuaccugugugucaguuuguuucaugaacuugaacauucccaacaguagagagauagauugauucauaaaagaggauacugacaccuuugaugaaucuguccuauuuacuagguuccaauauuaacauuucuguauguuaggucuaauggaaaacagucuaaaugaagguaaaggggaauaaugauaaaucacaugguaaaagcauauacuugcuaggugaauaaacagaaaugauuacugcauaguucaauaggcacacugggaaauuugaaaaucuuuugggagugacuuugaaauaagccacccaguuauuuuaugaaauauaagauguaaguugccaguggagauuucugguuuuucauguaagaggaaaacauaauuuuaaaaaacaucagaaauaauaaucuaguuuucaacugauaaaaauguucugaauuugauucaguaaaauuagccguuguaugcucuaacugguaaaugaauugagucauuuuaaaaugaaguugaacuuccuaaucggguaauuggguuaagugccaccaauucuuuuccuuucuuuugaguacuuaagauuacugaaauauaaaguaacuaucuugaagaacacuuuuugcaucuuauagcuacuaucacuugagaauagcaguuguauuuagaagauaaccuagcuaguauuacaaauucucugauacucugaguaauauuaauauuagcacaguaacuaccuguacauucuuaucauauuugcuauacagcuguuguucagacuacaauugugaguccugaacuguagcugccucaaagcgccuucaugauacuauucugaagugacuacucugaaauguggacagugaaguuuggugaauuuggucauuuaguuucuucaaagauaaugagauuguguuuccccuaaggauguauuuacagcuagucaguggaaacugaauccauucccaguuuuaaugcuuuuccaguucaaacgugauaugcauguaugugucucuuucuaacccuucgagcuucucucuguguacgauuuaggguuacauuccgaaaagcaaaugggagauggacacaucugaggcaaagcuagguggguauuuccuuuuuccuguuuuuauaugugauaccugaugguaauggucauagaucuuucugcuauaagaggaacaaauuuccuaaaacuucuacuugaacagagauuucuggccuaccuuauauccuccaaucuauuuugcuaguuuuuauaucuuguaacaaagugauaaguauuuuaaaagaacugcuuucaauacuauuuaaaguuuuuagagucaacagaaauauuugauaauuuagcaacaaaauauugucacuuauaaaaucuauucuuuuauauuaaucagaaauguuggugcugaugagauuucuuuuuuaaagaauauuuaaaugcaguccaaaguuaaaccugauuaugaauacuuuagauaauaaaaauaauauaaaguuuaaaauuaauuaaaaggcauuuauucuccuuguauaauaaaugagaguuucugaguagagaggaguagauauauaauucagguuuuugaggagccugcuuuauaagauucaguuuaaauuuuucuucaaauuguuaaugccaaauuccaagguaaaccaguuuaaaugauugucuaaaucagaauuuggaguugcuuaaugugaaguuaucugucaaacaaaaaagucauacauauccaauggauucccucuauuauuuguuggugaaaacugcaaaauauuuuuucaguuuuacuucgcuuaaagagaaccauuuaacauguugauuaagauguauuaauaaaaaucuaaaacaaugugcuaaggacuuuuugagaucagccuuacugauguaugaaguaugacugucaguuuauguuucuuuuccugguauuauacuccaaaacuaaaggaaccaucuaaguaucuuaaauugauacaggaaguuugagucacugagcugcuucauugcuugggacauguguuucugacaucagaggagugcauuuuacaugcaauuacauaaguugugccuuuaauuugccccaacuacuuguguuaguaguugguauugacuagguucuguguuaaaagacaguuccacggacuuuauuauuacauuacugguauaggugcuuuguugucaagucuaaaagauuuuuuuuaguuuaugucaugugaaaauuauaugugguuuuugacauauucuucuaguagucuucccucugugggaaaucuuaauaauaaccaauugucaucuuccagagacccuuaaagcacuuauguguuuaaaugcaauuaaauauguaggaaaauaaaaauuacaaaauacuuuuaaaauaauaauaaugcuuuaguucugcuuauuucgacguuagauuaacucucugugaaguucuguacauuagaaugacccauaauaugccaagaucauuucucucuucugguucucuuaaauauugauuauccuuuagggcaaagagagaucauaaauaaagauaguuaaggggaauguaaaagugauaaauauuaacuuguaaucucuagaggccucauguaauacaugaucugggguaaugcuguuuuaaacucaagccaguccaucuuuuacuuuucuuucuguuuuuaaaaggaaaagggaauuuaguugugaugauuauucaagaauauauauuaauauugguauuucuuggaauuucuggaaaacauucuggcccgucuaccauuugcuucucagaaaaaaacauuuuauacaaauuuucaguuuuaaagacagaauaguagacaaugaauuccagaaauggauuuuuaaaacaaaccauuucagugaaaggcacugaagaucugguaauaaaucuaggaaauaaauuuuaacauauuuacagucggguuuuuauuuuuuaacaagagugauagugauguuguauauaaggacuuguaucuugcaccacuguauugagagcuaaucccaccacagaggaaggcaaauuuagugugcauucuugaaagugcuuaguacuuugagguugguccauugagccaacugagaagauucuucucuaaaacaugaggaucuugugucggaucuuguagccuauuuauguugccuuccuuaucauaacaaauuuaauauaauuugauuaccaaguacaauuuauuuuucugaguacuuuaccaacauucuccaauuacucuuggaaaaugauuauacuggguggaaauguauuaaguuuuagcagugucacauguugagcaaaaacaguugaaucugaaacagaggaauuuugauucacaaaugagucugccagugagaacauacuuaccuauagucuuugaagcagcugguuagagcuuauugcagauucuuggucuaugcucauuaaguuuaguacacaguucagccugugccugaauguuaaauuggaagugaugugauuuuuagaacaguucagaacaggccugagcuaccucuggcauggaguuguugaaggcugccuguggcccaccuucagucccaccagacugguucuucccugcugggacacaggcaucauaaugcaagggcagguuguuacuugccacaucagguggugggauucagcauugaagcuacuuaaacuccagugacaugauuuuaguuucucauacugugaagcuagaauauuugagacuguuaccauccuaauuuagguuucuucauauaaaguacuuuugcuuuucucaucucagugucauuugucucuacucuugaguuguauauugguuuucuacaugucagacagauucaucucuucagaguuggaauauaauuauuauuuguauaggugcauaaucuuguauguuuacguugaacagauuuucagaaauaccauuuacauuuagaaaauacauagauguaucuaaggaauuuuucuguugugcuauaauacauacuguuucaaauaugugguaaaauucugugaccugccauauuggauuuaaaacuucaucuucaucuuaaaacuucaucuuuugaaaucucugaaaaucauuagugugcauguauugaacaccagucuuuauucuguaauuaacaccccagauuucuuuccccucaccuuaugccauccaucuguguguuugguuuccaguaugccauguggaagaggugugagccuuucuucagcccaagaaggaaacuuuaaacauauuugcacaauaaaauuucaaauuaaacauuucaaaaagggugcucagacuagaaauacaugcucuucugaaauuccauguugcaacuguaacuccugucauauauacccaguguaugaggaaaaguucuugcaguuuucacacugcccuucuguauugcugccuggcugugcucuguuguuggaacugaaauaugaaauuuuuacuuugaaguauguuaaugucaaaguugaucguauuaaguuuggaaauccuuugagguuuaucuaauaaguguguuggagcuucugucucuucugguaauacuguacccuguugaaccaagaacaguuuuauuguuugugggacuucguugguuuucuaauaccauaaccugugucccugugcagucagggggucacuucuuuaagaucauguauaauacggcccgucauauacacguagauagagccaugugauuccagaaauuagaagacuggaucuguggaauccauacauguuaaaauuuugccaaaaugagaugauuaaaauuuuugugaguuuuauaaacuguugcaguucgccuuacugauuuuucaaugauaaucacuuuuaugggaagggggcuuaggaacaaaaaacuuugccaagaaugcaaaaucuuacugguuuuuaaagcuuguaacaguuguguguaaaacuuuuauauuugaaacguaaacucacccuuucugccacugcuuucauugcacuuuucauaccaaguucucuccaacguggugucugaaagauuuuuauuauauacacucuuuauggaauucaaugaagugugguuaugcuguguuucugaaguuuuuaggcuuuucuucauuggccugccuaauacuaguguguuucuauaacuucagaugauucaaaaguuuagugcuucauuguagcaaaaaauguauauaacucauaauauccuacauguaguauucaaaaucaauuauuaauaaccaauaaaagacucaacacauuuucauugcguguucuucuuuaagacaccuaaacucauaucucauaauuucugaauccgcaaucccuauucauuaauugauuacaguuuuugaguuguuggaaagccuagcccucucagauucaggguucagaaagaauuaccaggucugguaaaauugucugacuagcccuuagccucagaauggucaacuucauaguauaagcaaagaaaguggugaucucauauagucagcuuuuucaugaacauuaauucauggugaaugcacucacagcaaccaaaauccaaaaaaaaaaaauguucaucuaaaaccuuaaacauuagcuuggcucauugaguucuugguacaaccugcuuuucauaugacacaguaucaaacaugauuucagaugaaaugggugguguuaauauuguguuaaagaaaaaaagaauggaagacacugucuagaaaagcccaacuuugcauuugccaucagaaaaugagaacuguggugggugggaggacaaggaggccaggagccaagugccuuuucuugccuugcccauauuugcucuuaaaccaacaucguaaacauaauggcuaccagugugaauaccaaacaauggaaauugcacagaacuugauauuaucucagccaagaagauaguuuggaucugcaagugaugcugcacucaaaaauguggauaugcccucugaaagcguuccagccuucuuuuccccugugugugugucgugugcaaacucacacucuuccuuaaugcuacggcucuguguuugucccucagacaaguuggauggcuugaggacugguacuaaaaggaaacgugacugggaggccauugccagcagaauggaggauuaucuucagcuccccgaugauuaugauacucgugcuucugagccugggaagaagaggguaagagacuuugucaauaacugccaacaaaugaagggcccauuuaggcaucugguuuuaggaaguuacaggcagaugaucacauggaugcuauuuuuagaaugauuuaguuuacgcuaugucauguaucccaagaaggagucauaccuuauaaauuaucucaucaaaauguacaaguagcuuaaaaaauuggagaacagaaccucacauggcuagcacguugucaaccuuaaaggcauugggaguggccagucacuugugcuauuuugucauggggcaaaaaaagccagguacagaguaggguauugaagagaaccuguggaacuucuuaauggaugggauguggaggguccaaagguagaucaagggugaccccuugguacucuggccaugagcacugcauguguguaguaccauuuagugagagagaaaacugggggagucauaggucauaauuuuuggaacugagagaaaugauuuaaguucugugagagaaauucuaauuuuucuucuaauuaaguuagaaauauaagugaaaaugucaaaaugacuguuggauuuauuaguauaaaacucaccagagagaucagacugaacuaacaaauuucaggaaaugguauuuaaaaccgugggacugaaugaucuugcccaaggaaaaaguauaaauggaaaagguaauaggacgccagaccuccaaaauuuaguucagauagagguguuucaagaaggaaagaguauagucaguuuuuaaaugaugcagaaaagacaaguaaguuuggaacagauaaauggcugcuagauguuggcaacauggaggucacugaugauuguaguuugucaucagucuacagugaugaggcagcagaaaccaguuuggagcagauuaaagaaugaauaagaaaugaugaaguacaguacagcauauauaggcaacuuuuugaaguuuugcugugaaagggaauagagaaaugaagcuaggauauuagauaggucuuuacauaaauguugaauucgauagugauagauguguauauccuuuaaaacaaaauaaagcaaagggaucguauuauauauacuguuguguagaagucuuuuucagcuaauccaucuugaucuuucuauauaagcauauacagaacuaccauucuuuuuaaagggcuacuuggugucccauuguuugguuguacaaucaguuauuuaacuagucccuuuguguuaguccguuugcguugcuauaaaggaauacgugagauuggguaauucaugaagauaaaagguuuauuuuggcucacuguccugcaggcuguacaagaagcauggugcuagcaucagcuccuggugaggccucagaaagucuucaauuaugguggaagacaaggggggagccagcaugugacguggcgagagaggaaccaaggggagggggucccaacuccuuuuaacaaccagaucucacaugaacucagagugugaacucgcucauuaccgucaggagggcaccaagacauucacgaggauccuccuccaugacccaaacaccuucaguaucggggauuacaauucaacaugagauuugaaggggacaaacauccaaaccauaaugucuuuacugauggaugcuuacaguguuuccauuuauugccaguacagaugugaagguugugguguguaugucucucuuuacacgcuuacaugcaaauaauugccuguuuuucuacagcagugcuguaaucaaacucuuuaacuuuugacaaucugauaggugaaaaaaauaguaucucauuuuucauuuauuuacuaagaaugagguugugcaucauuuaucuuuaugcaucauuucuuuguauuucuuucuuaacgaauuuucucagugccuuaaugugcuuaguguacuuaguaaugggcaccauuacaaagaauccagguuucaaagcuuuuuaaaauacugcagauacuccaaagccugcccuugucuguguagcuucaaaggauggguaagggagagcccacugccauuugcacccagccucaccaaaggacugcuuauagugauaccucuuacuccaguuuuaaggcuggagccaacagaggcagaaguggcccuuccuugcaaauaauaaaguguaguucugguaacaauuaguaaucuaaaaugagaaauauuuucucuguuuuuacucagguaacuaucacugucuucacugaggaguauguaaucccaugcaguuuauuuuauuagguugggugaccaaagagaacugaguggugcacauucuaguucuuuaaaguugcuccucuuuaagucuccuccccugccuuauaccuugacuucagauaguuuuuaacucuugaaccacucaccaaaaccaacauuagagcacaggagauccuacagguagcaaagaauacagaaugcuguacauuacucauuccuucuuggguuucuuuguuucugugauucagcuuguuacagauaucagauggguucuugggauuaacuuccucuauaacaaaaacgugguucuguagaguugguuauauuagaauuuugccuaaauggcuaggcuuuaaaauauaauuuacuuuuaaaauauuugcuugcuuggguauaaaaugguagcuuacuuggacuuuaauuuguauuucuuugaugacuauggaaggugaaccuuucccuuguuuguuugcugaauuuguauauuuuagaaauacuuauaguuacaguggaugaaauauaaguaccucaaaccuuugagggcuaguuaagauuuuucuguauuauaacaaauuuauuuuuacaggaaaaaacaacagcaaaaaugucguaagucucaaaaguaccucuaggaaaauuaaaagggacacugauauucaagaagccauuucaagcugaaagucauuauucugcuccuuguauguuuagugguucgguaaucauuuauucauuccauauguugaaugucuuuguacgaagucuaugaaugaguccucuuaaggagcugacauccaguggaggaauucaacauguaaauaaauaauuuuacuauagcaucaguauaaauuagagauauuaacaaaauacaauaguuuccaaaauauuuuaauuccaacuucauuuguuuuuuguuuuuuuguuuuuuauuuuugagacagagucucacucuguugcccagccuggagugcaguggugauuuuggcucacugcaaccucugccucccagguucaagccauucucaugccucagccuccugaguagcugggauuacaggcacccaccaccacguccggcuaauuuuguuuguauuuuuaguagagacgggguuucgccauguuggccaggcuggucucaaacuccugaccucaggugaucugucugcugcagccucccaaagugcugggauuacaggcgugagccacugugccuggccuaauuccaauguuaaaaucuugaacauuuauucgcaaacauacuacucauuucaaaaacaccuacacauuuuuucuucuaauccuauauucuuuauuuuaucugaguuuaaaacuuagaauuuaaacuguagauuuaaaaguagcaaggugagauugaucaguauauuuaacuaugugcugagguugauaaguauauuuaacuaugugcugaggaugccgugggaauggauuuaaauuugcugugggcuguuuacuuuuucuuuauucaaugagccuuaccauauaaggggcaaacuguggccacugaacaaagaaaaaguaaccagcccacagcaaauuuaaauccauucccacggcauccugagcacaguauuguguuuucacauaaaugcccaagacuuaguucguaaugaucuuucgcuaaaauguguauccuugauccagguggagcugagagaauauacaugaauuaaauuuaauuaauuaauuauuauugagguagggucucucugucacccaggcuggaguacaguggugugaucuuggcucacugccacuucugccucccaggcucaaacaauucucccaccucauccucccuaguagcuaggauuucaggcacccaccacacaccaugcccagcuaauuuuuguauuuuuaguagagacacgguuucgccuuguugcccaggcuggucuugaacaccuaggcugacgugaucugccggccucggccucccaaagugcuggaguuauagguguaagccacugugccuggcuguauauaugaauuaaucaaaauagguacuucagcauugaugagcagaaugcccaaagauuuuucuauauugaagcccacauuauuuauuaggcuucuuacuaaagcccaugaaagacauugagccauagguuuucuauacacuaaaaaccuacuuucuggaaagucagauguuaccaguuucuucccacugcuauuacuuuggcuccucccuuugaccaggugauacuguuaaaagccuaguuauuucauugcuagucaugcaaaugguaauuaguguacauuagagcaauaaugcauucccagguucaguguaaagagcaugguguuuccaugcucugguucucucuccuugucacagauaauaaaucacaagccauguuuaaaauacauucucugcagucuuugauacuguguagugcaagcaacagauucauaguuucuuuuuaagaaucugaacuuuuacagaauauguauaucuccauauacuuuuaaaaacauauuaacauaauauguggcugggcaugguggcucaugcuuguaauccuagcacuuugggcggccaaggcaggaggauugcuugaguccagcaguuugagaccagccugggcaacauagugagacucugacucuaaaaaaaaaaaaaaaaauuacaaaaauuuuuaaaaagcauaauauguaagaauauauauauauuaaaaaucagaauaccaauaggaaauaucccugauccauauauuuguaguuguaaucuugccaugaauuauaucaguugagucuguuucuuggucucuuuaucucaugaaugaaaguaauaauaccagcuuacuguuuucucuaagauuaaauuucaagaaauauuuuuguguagagauaaauaaaauucaguuauugaucuaggguguugauagucuguuagggaagacagaucuguaaguggauaauuauacuacgguguggaaguucaaaagcagacauaucaaaauccggaaguuaacuguggaaagcagugauuauuugauuggcaaaggaaaaagggguaagucagggaaggaugacuagacucaugccaaguggauaagguuagggaaaagacauuucaggaagaaugacuaguacauauaugcagaguuauagagacaugaaauggugcgaugcgcucugagugcuagaaggaagucuguauuguuuguauaaaaugccauaggcacuggccagagauguugcaggaaaguguaguuggggccagaucaagagggaccugaguucuuggacuuugccugguagguaggggaaggaguuaaagcaaaugaaucacaacuguguguuuuaggaagaucacucuggcagcaugaaucuggagcgggugaguacagacaggaagacuagguagagauuagugcuuugcuuucaggugaaaaaaaaaugaggucagugaauuauuaaauaaaaaggaauggcagaggagaaagagaggacaggauugagcugaacuguucaggagcuggaaugguuaggacuuggauuguccagagaguuuucucuuugugacuuaaaauauauggcuuuucccaguuuuccuggguuaguuuuuaauuuuuuaaacuugcgguuucaaaugagucauucuaccccuuagacuguccagagagggagggggcucuuugcauauuuauuuuuccuaaagcucagccuaaugcuauguucuuuuuaggucagaugggcagaccuggaagagaagaaggaugcagauaggaaaagggccauagguuuuguggucggacagacugauugggagaagaucacagaugaaaguggucaccuggcugaaaaagcccucaaucgaaccaaauauauaugagacuuaguuuuugaacggagucauuauuccucuaagguaagaguacacagucauauaaauagccuacugugugguugcuucaaaggguuugagauaaagaagacagcauauuuugcuaaaaaugcucucuucuuguguuauuuuauaguucugaaagaguaaguauguacuaguuguuaacauuuacaauacuauuagaaaaggaagccauuuucugcaagcuggcucacuuauaaaaauaaaaaccuugagaaaaacuugaauucuauagauuugggaaggacugaaaugauguuauacuaagggcuacugaacuuuuugccuguucuuuccaggugugacagccuuuucuuuucuuuccaggugguucgcuuugagguggucugaagccaaggccucgcggagcuucuuugugugucaccuugcuuccacguuucaguucuuguuuuguuucuacugcuuuaguuuuuuuuaaaguucuccaguguccccaagagguauuagaaucuugcuguacccaagcaagacguuaauuuuucuuuuaacuguuuuggggagggagggagugauagcuuaacugcugaagccaggcgggggucugcuggaggauuccaacagagaguauuuccuccacuguacaaugucacagacuaucucuaucaucauugcuuuguggcuguuucuguuuuuuacuguauguaacugguagcugauuguacuaggauuaaaaacaauaaacuuucaugauaaagccgaugagauucaugggcuauacagcaugggcccuuuucucuuguuuucuuaauuuuauuuuuaauugcuuuuuaaauaugguauguccuaauuaaaugcuagcugaacaucccaaaaccuuuuuuucauugaauauuauauggcucaaugauuccguagcacauguuguaaaacacaggguucaaaugauguucaaaacacucaucuuuguuuuauagcugauuucucuaucuuugugucuugaagacugaccaaguucaaauauucaucaguucccuggagcauauccauucuguaacaugaugcuuuauuuaaaaauuuuuuuugauccucucucuguucuucccucucuucuuuccuuccuucuucuuuucacuuucugccuuuaugcuguuagguuuuuauuuuuuccugaucuggcuuugaauucugguagacagaacugauguauucuguggaacucaagcuuguugccuucauuugaacuugaauuguggauuuuuaaaugaagauugcagggaaagaguauaaagaugcagagcacucuggcauguaaccuuuaagccugucagguuuucaaguucuugccagauuguucauuacuggaaagcauggccuucugcacagaauuuccucucuugugguuaauaccagguggaacccagaaacauacagagauaaaacccaaauauuauuucuauguaaacacagaaaagggacucuucccuuuuucauccugcaaagaaaaaagucaucuuuuagcaugaaagaagaugagagagccuucuuccucaagcauaauuugcauuuuguaauccaacucaguaauuuguaaauguguucacugaagacuucaauauuuugaaauauucucuuucaggccacagaugaaaauccuuuacuuuuaugaccuacauuaaagacuguaugaauagagcuaauaguuacuagcauuugaauaguaucacuuuggguucaacaaauugauauuauaguacugaauaccccuaauuuaauggaaauucuaacaacuuucuguacuuuuaucuucccugaaaaucugaauuuuuaagcaagugacuuuaaguucauuaagucaauauugaauguauaaauugcuacauuaaauaacuucugcuguuuguaguauuuaauaagcuauuuucauugcuuauuggccuacaauacauuucuguguacugaccuuucucagcagccuuuauuauguagagugaagauaugucgcaaaaauagccaaauagaauuauuguuuguacaaagacucauuuacuacuuucuaaagccacccaaugccuauuaucaaaaacaaaacuuccauaauguguucucuaguucagaugaaauggaggccgauauguucuucugcaggaugcuuuauuucaguuguccuuaaccuugugauguucugacaguaguuagaaugccaaugaaaugaguggugauuauccgugagucacuuggaaucauggguaauuuugcauauguguguuuucaccuuacagccauggcuuuaugucugugcucuuauaccagggcagggugggaagcuggggaagaguuaacauagucagaaacggccucugccaauuuucagaagauauagauuacgugaccuuagagaaugaacauagagugcuccuacuuuagaaaauggguauaacaaccuucaugcaaggagauuaaugaaaaaagauuuggcaccaaaaagaguaauagagacagccagcugauaauugauuuugcuaguccaaugugggacuuaacaaaauucuugcacuuacauuacuauuagaagcaguaucguauaggaagcccaagguaucuugaagaagaaauuugguguggguagaaaaugccuugauaauacaaauauuuuaaguuuguuaagagguguccuggaaaugcagaggacuaauuuuggauuccauuauuugcuagcauuuuauuuuaauuuuauuaacauugucuucucuuagaaaguugcugguuuaaaucauaugaguuuuauuuuaaaucuuuuguggugucauguuacuuaaaauaaucuuauguugggaaagguuucugauaccuugguggguauuucagcuuuuuuuuuuuuuuugucagcucuguaaaggaugauuucagacauuuuaaacugaaagugaaaucucucacuuaagugaucuaacuuuacuuguaaacuuccugugugaggaauucaguagacgagacccagaaauguuucuguuugagaauauuuagaguuaagugccguauuugaaauauucagggacugauuguagaaucagaagucauuaauaauaauacacaaguagucuauugacaguugauucauauaauuuucuagaaguuugaguuugauucagauaucaguguuaaauccagaaguuuauugacaaagauaaaaucuuaaauuuucugguuggauuuguuuuccucgugaaagaguuuugaucauugagcaaaccaaaguaggugccaugucaucuagagaucgacuauuacauuuuuuauuagauugacuaagaaucucaacugagguuuucuuauuuuguaggccccucaguuuuuguguuaaguauuuuauccugcuaacugugcaaauugcagauauuuugguaaagaugucuagagccuggcuuaauuacuaggauuauaaaagcaacagauucucagcugagauaaguuuugcuaagccauagaaggagaaugauuucucauuuuuaguauucacagacccuaauacaaguucagauucuucuagaagcuguaugaccuuaagcaacuuuuuuuuuuuuuuuuuuuuuuuuggagacaaggucucacucuguuggcuggagugcagugacgcgauauagcucacugcagccucaacuuccugggcucaggugauucucccaucucagccucccagguagcugggacuacaagugugcaccaccacacccagccuuuuuuuuuuuuuuuuuuuuuaagagauugguuguugccauguuucacaggcuggucuugaacuccugggagcaaaugaucgccuaucucagccucccaaagugcugggauuauaggcgugagccaccgugccuggcugaaauauuuuaaccuaucugagcuucaguuuccugccuauaaaaugaaaauaacaaaacacaccuauuaaacauugagauaaugcauguaagcuacuuggcacaguacugagcacauaguaaaagcucaaaaaucaguagucaccaucaucguuacuuuuugacuuguucucauguguucuuuuugaaauucaaaauauccagcuggcuugaagauaguugucacguuuuauagucagcuaucauagacugagcuaugucauauguaauaguacaguguguugaaagaguaauuauucagaagcauuuucagguaaccagugacauugauuuucagaacuaguacggaggcuugagaggcuc

SEQ ID NO: 17104 - RNA, 76323 nt, Homo sapiens
gagccucucaagccuccguacuaguucugaaaaucaaugucacugguuaccugaaaaugcuucugaauaauuacucuuucaacacacuguacuauuacauaugacauagcucagucuaugauagcugacuauaaaacgugacaacuaucuucaagccagcuggauauuuugaauuucaaaaagaacacaugagaacaagucaaaaaguaacgaugauggugacuacugauuuuugagcuuuuacuaugugcucaguacugugccaaguagcuuacaugcauuaucucaauguuuaauagguguguuuuguuauuuucauuuuauaggcaggaaacugaagcucagauagguuaaaauauuucagccaggcacgguggcucacgccuauaaucccagcacuuugggaggcugagauaggcgaucauuugcucccaggaguucaagaccagccugugaaacauggcaacaaccaaucucuuaaaaaaaaaaaaaaaaaaaaaggcugggugugguggugcacacuuguagucccagcuaccugggaggcugagaugggagaaucaccugagcccaggaaguugaggcugcagugagcuauaucgcgucacugcacuccagccaacagagugagaccuugucuccaaaaaaaaaaaaaaaaaaaaaaaaguugcuuaaggucauacagcuucuagaagaaucugaacuuguauuagggucugugaauacuaaaaaugagaaaucauucuccuucuauggcuuagcaaaacuuaucucagcugagaaucuguugcuuuuauaauccuaguaauuaagccaggcucuagacaucuuuaccaaaauaucugcaauuugcacaguuagcaggauaaaauacuuaacacaaaaacugaggggccuacaaaauaagaaaaccucaguugagauucuuagucaaucuaauaaaaaauguaauagucgaucucuagaugacauggcaccuacuuugguuugcucaaugaucaaaacucuuucacgaggaaaacaaauccaaccagaaaauuuaagauuuuaucuuugucaauaaacuucuggauuuaacacugauaucugaaucaaacucaaacuucuagaaaauuauaugaaucaacugucaauagacuacuuguguauuauuauuaaugacuucugauucuacaaucagucccugaauauuucaaauacggcacuuaacucuaaauauucucaaacagaaacauuucugggucucgucuacugaauuccucacacaggaaguuuacaaguaaaguuagaucacuuaagugagagauuucacuuucaguuuaaaaugucugaaaucauccuuuacagagcugacaaaaaaaaaaaaaaagcugaaauacccaccaagguaucagaaaccuuucccaacauaagauuauuuuaaguaacaugacaccacaaaagauuuaaaauaaaacucauaugauuuaaaccagcaacuuucuaagagaagacaauguuaauaaaauuaaaauaaaaugcuagcaaauaauggaauccaaaauuaguccucugcauuuccaggacaccucuuaacaaacuuaaaauauuuguauuaucaaggcauuuucuacccacaccaaauuucuucuucaagauaccuugggcuuccuauacgauacugcuucuaauaguaauguaagugcaagaauuuuguuaagucccacauuggacuagcaaaaucaauuaucagcuggcugucucuauuacucuuuuuggugccaaaucuuuuuucauuaaucuccuugcaugaagguuguuauacccauuuucuaaaguaggagcacucuauguucauucucuaaggucacguaaucuauaucuucugaaaauuggcagaggccguuucugacuauguuaacucuuccccagcuucccacccugcccugguauaagagcacagacauaaagccauggcuguaaggugaaaacacacauaugcaaaauuacccaugauuccaagugacucacggauaaucaccacucauuucauuggcauucuaacuacugucagaacaucacaagguuaaggacaacugaaauaaagcauccugcagaagaacauaucggccuccauuucaucugaacuagagaacacauuauggaaguuuuguuuuugauaauaggcauuggguggcuuuagaaaguaguaaaugagucuuuguacaaacaauaauucuauuuggcuauuuuugcgacauaucuucacucuacauaauaaaggcugcugagaaaggucaguacacagaaauguauuguaggccaauaagcaaugaaaauagcuuauuaaauacuacaaacagcagaaguuauuuaauguagcaauuuauacauucaauauugacuuaaugaacuuaaagucacuugcuuaaaaauucagauuuucagggaagauaaaaguacagaaaguuguuagaauuuccauuaaauuagggguauucaguacuauaauaucaauuuguugaacccaaagugauacuauucaaaugcuaguaacuauuagcucuauucauacagucuuuaauguaggucauaaaaguaaaggauuuucaucuguggccugaaagagaauauuucaaaauauugaagucuucagugaacacauuuacaaauuacugaguuggauuacaaaaugcaaauuaugcuugaggaagaaggcucucucaucuucuuucaugcuaaaagaugacuuuuuucuuugcaggaugaaaaagggaagagucccuuuucuguguuuacauagaaauaauauuuggguuuuaucucuguauguuucuggguuccaccugguauuaaccacaagagaggaaauucugugcagaaggccaugcuuuccaguaaugaacaaucuggcaagaacuugaaaaccugacaggcuuaaagguuacaugccagagugcucugcaucuuuauacucuuucccugcaaucuucauuuaaaaauccacaauucaaguucaaaugaaggcaacaagcuugaguuccacagaauacaucaguucugucuaccagaauucaaagccagaucaggaaaaaauaaaaaccuaacagcauaaaggcagaaagugaaaagaagaaggaaggaaagaagagagggaagaacagagagaggaucaaaaaaaauuuuuaaauaaagcaucauguuacagaauggauaugcuccagggaacugaugaauauuugaacuuggucagucuucaagacacaaagauagagaaaucagcuauaaaacaaagaugaguguuuugaacaucauuugaacccuguguuuuacaacaugugcuacggaaucauugagccauauaauauucaaugaaaaaaagguuuugggauguucagcuagcauuuaauuaggacauaccauauuuaaaaagcaauuaaaaauaaaauuaagaaaacaagagaaaagggcccaugcuguauagcccaugaaucucaucggcuuuaucaugaaaguuuauuguuuuuaauccuaguacaaucagcuaccaguuacauacaguaaaaaacagaaacagccacaaagcaaugaugauagagauagucugugacauuguacaguggaggaaauacucucuguuggaauccuccagcagacccccgccuggcuucagcaguuaagcuaucacucccucccuccccaaaacaguuaaaagaaaaauuaacgucuugcuuggguacagcaagauucuaauaccucuuggggacacuggagaacuuuaaaaaaaacuaaagcaguagaaacaaaacaagaacugaaacguggaagcaaggugacacacaaagaagcuccgcgaggccuuggcuucagaccaccucaaagcgaaccaccuggaaagaaaagaaaaggcugucacaccuggaaagaacaggcaaaaaguucaguagcccuuaguauaacaucauuucaguccuucccaaaucuauagaauucaaguuuuucucaagguuuuuauuuuuauaagugagccagcuugcagaaaauggcuuccuuuucuaauaguauuguaaauguuaacaacuaguacauacuuacucuuucagaacuauaaaauaacacaagaagagagcauuuuuagcaaaauaugcugucuucuuuaucucaaacccuuugaagcaaccacacaguaggcuauuuauaugacuguguacucuuaccuuagaggaauaaugacuccguucaaaaacuaagucucauauauauuugguucgauugagggcuuuuucagccaggugaccacuuucaucugugaucuucucccaaucagucuguccgaccacaaaaccuauggcccuuuuccuaucugcauccuucuucucuuccaggucugcccaucugaccuaaaaagaacauagcauuaggcugagcuuuaggaaaaauaaauaugcaaagagcccccucccucucuggacagucuaagggguagaaugacucauuugaaaccgcaaguuuaaaaaauuaaaaacuaacccaggaaaacugggaaaagccauauauuuuaagucacaaagagaaaacucucuggacaauccaaguccuaaccauuccagcuccugaacaguucagcucaauccuguccucucuuucuccucugccauuccuuuuuauuuaauaauucacugaccucauuuuuuuuucaccugaaagcaaagcacuaaucucuaccuagucuuccugucuguacucacccgcuccagauucaugcugccagagugaucuuccuaaaacacacaguugugauucauuugcuuuaacuccuuccccuaccuaccaggcaaaguccaagaacucaggucccucuugaucuggccccaacuacacuuuccugcaacaucucuggccagugccuauggcauuuuauacaaacaauacagacuuccuucuagcacucagagcgcaucgcaccauuucaugucucuauaacucugcauauauguacuagucauucuuccugaaaugucuuuucccuaaccuuauccacuuggcaugagucuagucauccuucccugacuuaccccuuuuuccuuugccaaucaaauaaucacugcuuuccacaguuaacuuccggauuuugauaugucugcuuuugaacuuccacaccguaguauaauuauccacuuacagaucugucuucccuaacagacuaucaacacccuagaucaauaacugaauuuuauuuaucucuacacaaaaauauuucuugaaauuuaaucuuagagaaaacaguaagcugguauuauuacuuucauucaugagauaaagagaccaagaaacagacucaacugauauaauucauggcaagauuacaacuacaaauauauggaucagggauauuuccuauugguauucugauuuuuaauauauauauauucuuacauauuaugcuuuuuaaaaauuuuuguaauuuuuuuuuuuuuuuuuagagucagagucucacuauguugcccaggcuggucucaaacugcuggacucaagcaauccuccugccuuggccgcccaaagugcuaggauuacaagcaugagccaccaugcccagccacauauuauguuaauauguuuuuaaaaguauauggagauauacauauucuguaaaaguucagauucuuaaaaagaaacuaugaaucuguugcuugcacuacacaguaucaaagacugcagagaauguauuuuaaacauggcuugugauuuauuaucugugacaaggagagagaaccagagcauggaaacaccaugcucuuuacacugaaccugggaaugcauuauugcucuaauguacacuaauuaccauuugcaugacuagcaaugaaauaacuaggcuuuuaacaguaucaccuggucaaagggaggagccaaaguaauagcagugggaagaaacugguaacaucugacuuuccagaaaguagguuuuuaguguauagaaaaccuauggcucaaugucuuucaugggcuuuaguaagaagccuaauaaauaaugugggcuucaauauagaaaaaucuuugggcauucugcucaucaaugcugaaguaccuauuuugauuaauucauauauacagccaggcacaguggcuuacaccuauaacuccagcacuuugggaggccgaggccggcagaucacgucagccuagguguucaagaccagccugggcaacaaggcgaaaccgugucucuacuaaaaauacaaaaauuagcugggcaugguguguggugggugccugaaauccuagcuacuagggaggaugaggugggagaauuguuugagccugggaggcagaaguggcagugagccaagaucacaccacuguacuccagccugggugacagagagacccuaccucaauaauaauuaauuaauuaaauuuaauucauguauauucucucagcuccaccuggaucaaggauacacauuuuagcgaaagaucauuacgaacuaagucuugggcauuuaugugaaaacacaauacugugcucaggaugccgugggaauggauuuaaauuugcugugggcugguuacuuuuucuuuguucaguggccacaguuugccccuuauaugguaaggcucauugaauaaagaaaaaguaaacagcccacagcaaauuuaaauccauucccacggcauccucagcacauaguuaaauauacuuaucaaccucagcacauaguuaaauauacugaucaaucucaccuugcuacuuuuaaaucuacaguuuaaauucuaaguuuuaaacucagauaaaauaaagaauauaggauuagaagaaaaaauguguagguguuuuugaaaugaguaguauguuugcgaauaaauguucaagauuuuaacauuggaauuaggccaggcacaguggcucacgccuguaaucccagcacuuugggaggcugcagcagacagaucaccugaggucaggaguuugagaccagccuggccaacauggcgaaaccccgucucuacuaaaaauacaaacaaaauuagccggacgugguggugggugccuguaaucccagcuacucaggaggcugaggcaugagaauggcuugaaccugggaggcagagguugcagugagccaaaaucaccacugcacuccaggcugggcaacagagugagacucugucucaaaaauaaaaaacaaaaaaacaaaaaacaaaugaaguuggaauuaaaauauuuuggaaacuauuguauuuuguuaauaucucuaauuuauacugaugcuauaguaaaauuauuuauuuacauguugaauuccuccacuggaugucagcuccuuaagaggacucauucauagacuucguacaaagacauucaacauauggaaugaauaaaugauuaccgaaccacuaaacauacaaggagcagaauaaugacuuucagcuugaaauggcuucuugaauaucagugucccuuuuaauuuuccuagagguacuuuugagacuuacgacauuuuugcuguuguuuuuuccuguaaaaauaaauuuguuauaauacagaaaaaucuuaacuagcccucaaagguuugagguacuuauauuucauccacuguaacuauaaguauuucuaaaauauacaaauucagcaaacaaacaagggaaagguucaccuuccauagucaucaaagaaauacaaauuaaaguccaaguaagcuaccauuuuauacccaagcaagcaaauauuuuaaaaguaaauuauauuuuaaagccuagccauuuaggcaaaauucuaauauaaccaacucuacagaaccacguuuuuguuauagaggaaguuaaucccaagaacccaucugauaucuguaacaagcugaaucacagaaacaaagaaacccaagaaggaaugaguaauguacagcauucuguauucuuugcuaccuguaggaucuccugugcucuaauguugguuuuggugagugguucaagaguuaaaaacuaucugaagucaagguauaaggcaggggaggagacuuaaagaggagcaacuuuaaagaacuagaaugugcaccacucaguucucuuuggucacccaaccuaauaaaauaaacugcaugggauuacauacuccucagugaagacagugauaguuaccugaguaaaaacagagaaaauauuucucauuuuagauuacuaauuguuaccagaacuacacuuuauuauuugcaaggaagggccacuucugccucuguuggcuccagccuuaaaacuggaguaagagguaucacuauaagcaguccuuuggugaggcugggugcaaauggcagugggcucucccuuacccauccuuugaagcuacacagacaagggcaggcuuuggaguaucugcaguauuuuaaaaagcuuugaaaccuggauucuuuguaauggugcccauuacuaaguacacuaagcacauuaaggcacugagaaaauucguuaagaaagaaauacaaagaaaugaugcauaaagauaaaugaugcacaaccucauucuuaguaaauaaaugaaaaaugagauacuauuuuuuucaccuaucagauugucaaaaguuaaagaguuugauuacagcacugcuguagaaaaacaggcaauuauuugcauguaagcguguaaagagagacauacacaccacaaccuucacaucuguacuggcaauaaauggaaacacuguaagcauccaucaguaaagacauuaugguuuggauguuuguccccuucaaaucucauguugaauuguaauccccgauacugaagguguuugggucauggaggaggauccucgugaaugucuuggugcccuccugacgguaaugagcgaguucacacucugaguucaugugagaucugguuguuaaaaggaguugggacccccuccccuugguuccucucucgccacgucacaugcuggcuccccccuugucuuccaccauaauugaagacuuucugaggccucaccaggagcugaugcuagcaccaugcuucuuguacagccugcaggacagugagccaaaauaaaccuuuuaucuucaugaauuacccaaucucacguauuccuuuauagcaacgcaaacggacuaacacaaagggacuaguuaaauaacugauuguacaaccaaacaaugggacaccaaguagcccuuuaaaaagaaugguaguucuguauaugcuuauauagaaagaucaagauggauuagcugaaaaagacuucuacacaacaguauauauaauacgaucccuuugcuuuauuuuguuuuaaaggauauacacaucuaucacuaucgaauucaacauuuauguaaagaccuaucuaauauccuagcuucauuucucuauucccuuucacagcaaaacuucaaaaaguugccuauauaugcuguacuguacuucaucauuucuuauucauucuuuaaucugcuccaaacugguuucugcugccucaucacuguagacugaugacaaacuacaaucaucagugaccuccauguugccaacaucuagcagccauuuaucuguuccaaacuuacuugucuuuucugcaucauuuaaaaacugacuauacucuuuccuucuugaaacaccucuaucugaacuaaauuuuggaggucuggcguccuauuaccuuuuccauuuauacuuuuuccuugggcaagaucauucagucccacgguuuuaaauaccauuuccugaaauuuguuaguucagucugaucucucuggugaguuuuauacuaauaaauccaacagucauuuugacauuuucacuuauauuucuaacuuaauuagaagaaaaauuagaauuucucucacagaacuuaaaucauuucucucaguuccaaaaauuaugaccuaugacucccccaguuuucucucucacuaaaugguacuacacacaugcagugcucauggccagaguaccaaggggucacccuugaucuaccuuuggacccuccacaucccauccauuaagaaguuccacagguucucuucaauacccuacucuguaccuggcuuuuuuugccccaugacaaaauagcacaagugacuggccacucccaaugccuuuaagguugacaacgugcuagccaugugagguucuguucuccaauuuuuuaagcuacuuguacauuuugaugagauaauuuauaagguaugacuccuucuugggauacaugacauagcguaaacuaaaucauucuaaaaauagcauccaugugaucaucugccuguaacuuccuaaaaccagaugccuaaaugggcccuucauuuguuggcaguuauugacaaagucucuuacccucuucuucccaggcucagaagcacgaguaucauaaucaucggggagcugaagauaauccuccauucugcuggcaauggccucccagucacguuuccuuuuaguaccaguccucaagccauccaacuugucugagggacaaacacagagccguagcauuaaggaagagugugaguuugcacacgacacacacacaggggaaaagaaggcuggaacgcuuucagagggcauauccacauuuuugagugcagcaucacuugcagauccaaacuaucuucuuggcugagauaauaucaaguucugugcaauuuccauuguuugguauucacacugguagccauuauguuuacgauguugguuuaagagcaaauaugggcaaggcaagaaaaggcacuuggcuccuggccuccuuguccucccacccaccacaguucucauuuucugauggcaaaugcaaaguugggcuuuucuagacagugucuuccauucuuuuuuucuuuaacacaauauuaacaccacccauuucaucugaaaucauguuugauacugugucauaugaaaagcagguuguaccaagaacucaaugagccaagcuaauguuuaagguuuuagaugaacauuuuuuuuuuuuggauuuugguugcugugagugcauucaccaugaauuaauguucaugaaaaagcugacuauaugagaucaccacuuucuuugcuuauacuaugaaguugaccauucugaggcuaagggcuagucagacaauuuuaccagaccugguaauucuuucugaacccugaaucugagagggcuaggcuuuccaacaacucaaaaacuguaaucaauuaaugaauagggauugcggauucagaaauuaugagauaugaguuuaggugucuuaaagaagaacacgcaaugaaaauguguugagucuuuuauugguuauuaauaauugauuuugaauacuacauguaggauauuaugaguuauauacauuuuuugcuacaaugaagcacuaaacuuuugaaucaucugaaguuauagaaacacacuaguauuaggcaggccaaugaagaaaagccuaaaaacuucagaaacacagcauaaccacacuucauugaauuccauaaagaguguauauaauaaaaaucuuucagacaccacguuggagagaacuugguaugaaaagugcaaugaaagcaguggcagaaagggugaguuuacguuucaaauauaaaaguuuuacacacaacuguuacaagcuuuaaaaaccaguaagauuuugcauucuuggcaaaguuuuuuguuccuaagcccccuucccauaaaagugauuaucauugaaaaaucaguaaggcgaacugcaacaguuuauaaaacucacaaaaauuuuaaucaucucauuuuggcaaaauuuuaacauguauggauuccacagauccagucuucuaauuucuggaaucacauggcucuaucuacguguauaugacgggccguauuauacaugaucuuaaagaagugacccccugacugcacagggacacagguuaugguauuagaaaaccaacgaagucccacaaacaauaaaacuguucuugguucaacaggguacaguauuaccagaagagacagaagcuccaacacacuuauuagauaaaccucaaaggauuuccaaacuuaauacgaucaacuuugacauuaacauacuucaaaguaaaaauuucauauuucaguuccaacaacagagcacagccaggcagcaauacagaagggcagugugaaaacugcaagaacuuuuccucauacacuggguauauaugacaggaguuacaguugcaacauggaauuucagaagagcauguauuucuagucugagcacccuuuuugaaauguuuaauuugaaauuuuauugugcaaauauguuuaaaguuuccuucuugggcugaagaaaggcucacaccucuuccacauggcauacuggaaaccaaacacacagauggauggcauaaggugaggggaaagaaaucugggguguuaauuacagaauaaagacugguguucaauacaugcacacuaaugauuuucagagauuucaaaagaugaaguuuuaagaugaagaugaaguuuuaaauccaauauggcaggucacagaauuuuaccacauauuugaaacaguauguauuauagcacaacagaaaaauuccuuagauacaucuauguauuuucuaaauguaaaugguauuucugaaaaucuguucaacguaaacauacaagauuaugcaccuauacaaauaauaauuauauuccaacucugaagagaugaaucugucugacauguagaaaaccaauauacaacucaagaguagagacaaaugacacugagaugagaaaagcaaaaguacuuuauaugaagaaaccuaaauuaggaugguaacagucucaaauauucuagcuucacaguaugagaaacuaaaaucaugucacuggaguuuaaguagcuucaaugcugaaucccaccaccugauguggcaaguaacaaccugcccuugcauuaugaugccugugucccagcagggaagaaccagucuggugggacugaaggugggccacaggcagccuucaacaacuccaugccagagguagcucaggccuguucugaacuguucuaaaaaucacaucacuuccaauuuaacauucaggcacaggcugaacuguguacuaaacuuaaugagcauagaccaagaaucugcaauaagcucuaaccagcugcuucaaagacuauagguaaguauguucucacuggcagacucauuugugaaucaaaauuccucuguuucagauucaacuguuuuugcucaacaugugacacugcuaaaacuuaauacauuuccacccaguauaaucauuuuccaagaguaauuggagaauguugguaaaguacucagaaaaauaaauuguacuugguaaucaaauuauauuaaauuuguuaugauaaggaaggcaacauaaauaggcuacaagauccgacacaagauccucauguuuuagagaagaaucuucucaguuggcucaauggaccaaccucaaaguacuaagcacuuucaagaaugcacacuaaauuugccuuccucuguggugggauuagcucucaauacaguggugcaagauacaaguccuuauauacaacaucacuaucacucuuguuaaaaaauaaaaacccgacuguaaauauguuaaaauuuauuuccuagauuuauuaccagaucuucagugccuuucacugaaaugguuuguuuuaaaaauccauuucuggaauucauugucuacuauucugucuuuaaaacugaaaauuuguauaaaauguuuuuuucugagaagcaaaugguagacgggccagaauguuuuccagaaauuccaagaaauaccaauauuaauauauauucuugaauaaucaucacaacuaaauucccuuuuccuuuuaaaaacagaaagaaaaguaaaagauggacuggcuugaguuuaaaacagcauuaccccagaucauguauuacaugaggccucuagagauuacaaguuaauauuuaucacuuuuacauuccccuuaacuaucuuuauuuaugaucucucuuugcccuaaaggauaaucaauauuuaagagaaccagaagagagaaaugaucuuggcauauuaugggucauucuaauguacagaacuucacagagaguuaaucuaacgucgaaauaagcagaacuaaagcauuauuauuauuuuaaaaguauuuuguaauuuuuauuuuccuacauauuuaauugcauuuaaacacauaagugcuuuaagggucucuggaagaugacaauugguuauuauuaagauuucccacagagggaagacuacuagaagaauaugucaaaaaccacauauaauuuucacaugacauaaacuaaaaaaaaucuuuuagacuugacaacaaagcaccuauaccaguaauguaauaauaaaguccguggaacugucuuuuaacacagaaccuagucaauaccaacuacuaacacaaguaguuggggcaaauuaaaggcacaacuuauguaauugcauguaaaaugcacuccucugaugucagaaacacaugucccaagcaaugaagcagcucagugacucaaacuuccuguaucaauuuaagauacuuagaugguuccuuuaguuuuggaguauaauaccaggaaaagaaacauaaacugacagucauacuucauacaucaguaaggcugaucucaaaaaguccuuagcacauuguuuuagauuuuuauuaauacaucuuaaucaacauguuaaaugguucucuuuaagcgaaguaaaacugaaaaaauauuuugcaguuuucaccaacaaauaauagagggaauccauuggauauguaugacuuuuuuguuugacagauaacuucacauuaagcaacuccaaauucugauuuagacaaucauuuaaacugguuuaccuuggaauuuggcauuaacaauuugaagaaaaauuuaaacugaaucuuauaaagcaggcuccucaaaaaccugaauuauauaucuacuccucucuacucagaaacucucauuuauuauacaaggagaauaaaugccuuuuaauuaauuuuaaacuuuauauuauuuuuauuaucuaaaguauucauaaucagguuuaacuuuggacugcauuuaaauauucuuuaaaaaagaaaucucaucagcaccaacauuucugauuaauauaaaagaauagauuuuauaagugacaauauuuuguugcuaaauuaucaaauauuucuguugacucuaaaaacuuuaaauaguauugaaagcaguucuuuuaaaauacuuaucacuuuguuacaagauauaaaaacuagcaaaauagauuggaggauauaagguaggccagaaaucucuguucaaguagaaguuuuaggaaauuuguuccucuuauagcagaaagaucuaugaccauuaccaucagguaucacauauaaaaacaggaaaaaggaaauacccaccuagcuuugccucagauguguccaucucccauuugcuuuucggaauguaacccuaaaucguacacagagagaagcucgaaggguuagaaagagacacauacaugcauaucacguuugaacuggaaaagcauuaaaacugggaauggauucaguuuccacugacuagcuguaaauacauccuuaggggaaacacaaucucauuaucuuugaagaaacuaaaugaccaaauucaccaaacuucacuguccacauuucagaguagucacuucagaauaguaucaugaaggcgcuuugaggcagcuacaguucaggacucacaauuguagucugaacaacagcuguauagcaaauaugauaagaauguacagguaguuacugugcuaauauuaauauuacucagaguaucagagaauuuguaauacuagcuagguuaucuucuaaauacaacugcuauucucaagugauaguagcuauaagaugcaaaaaguguucuucaagauaguuacuuuauauuucaguaaucuuaaguacucaaaagaaaggaaaagaauugguggcacuuaacccaauuacccgauuaggaaguucaacuucauuuuaaaaugacucaauucauuuaccaguuagagcauacaacggcuaauuuuacugaaucaaauucagaacauuuuuaucaguugaaaacuagauuauuauuucugauguuuuuuaaaauuauguuuuccucuuacaugaaaaaccagaaaucuccacuggcaacuuacaucuuauauuucauaaaauaacuggguggcuuauuucaaagucacucccaaaagauuuucaaauuucccagugugccuauugaacuaugcaguaaucauuucuguuuauucaccuagcaaguauaugcuuuuaccaugugauuuaucauuauuccccuuuaccuucauuuagacuguuuuccauuagaccuaacauacagaaauguuaauauuggaaccuaguaaauaggacagauucaucaaaggugucaguauccucuuuuaugaaucaaucuaucucucuacuguugggaauguucaaguucaugaaacaaacugacacacagguaaaguaagucacaaagcauuuugaagauuucaugaugauagcuucuguguaagaguuuacuagagcauaauccuauggguuucauacauuucuagucuaccagccagaacuaauaauucaauuucaacuuacuagguaguauuuuggauuacaaauuauauauuucccaaauacauuuuuuagaacaaaccaagacaaagcuauacugaagugauagugcuaaaaguacugaagacaaguuacaucuuaaaaaucaucugaaaacuuuaagcaucacuggaauaauauauuuauaaauuuuaucuacuagguucacugaagcacuaaaggaggcaaacuaucauaccaaugauccccuacaaacgauuaucuuuaccaacaaaacuuuggauuucauccagcuauauuaauuagugcagaguggaaaaugcaagguuuacugagaauuccauuuaaaugaucugagugguugguaugaaacuugcucuuaacccuugguuaacauauucuccaagaaucuuuuacucuuggaauggacuccaauaguaaaagauuucaauucugcaucuuugaauggguuaagagaaguuuuauaaucaagucaggcagacaaguguauucauuucccccugcuggaaucauccugugcuuccuuuaaacuauauuacucucccauugcuugaaauuguaggccacuuggaaauaaaacagauaauccagcaggguagaauuuuaaggccuccuugccaugacucugauguaaaaauauaguauuacaguguguuucacuuuaaaaaguaauaguacauucaauuaaaaguucccaaguuuugaccuacaccuaagcaagucagauguuaugaaccacugaaaucuccacaaaagaaagacggagcuucagaaagcuaaaacauuauagacuucucacguaaucaguuucuaguacacacgcugcaaauggcuaaagaagucauuagccauauuccagaagagcguggaccuuguagugaauauccugccuacauuuuaaauuauauaugccaaaauacaacuuaagaaaacuagauuuaaaaaaaacacauacugagacucaaaugccauuaacuuuaaaacuuauuuuuuaauccacauuugaaaucuuggaauguagagguugacaccaucuuuauauaaacacaguuuuuaucaagaguccucuauaucacacacggguucgaugggaccacucccuggagauucuguauacucuaggggguaggaaucagaguucucauuuuguacauuuucaaaagaauaugaggagcaacuuuagcaagggcucaaguauuaaauaaaccgaguaauauucuggauuuaaaaagcaacacuauuccaaggcauugcuaaucucuguacuucaguaaacacugaaaagucaacguaacucuauaggucgcauauucuugaaugacagggaaaggcaaacaucucuacagaggugugaucgaaagcauuuuacauuagguacacagaaacuuuaaacucacacuauguaagccucuaaucagccugagcaaaauccauugccuacacagucauuuaauuuuuccccgucacuuaggauaaaaugcagaagaacaaaucuagcagccaguggcaacccucugccuccccauucaauaaguucuucugccucuguugacagaaacucaaauuuggagaucuuguagcaaagaagagacaauuaugcauauguuggguaggcugugccacauaucugcuggaauguaagaaugcccuuucauauguaauugauuuucuuaaaagguauacuccccuaaaaccacccacaaauagaugaguacaaggguaaguuucuuagcacucuguuaaaacuuucucuuaacaccacauuagaggguucuuuuggucuggggaaaaauaaagaguauccaaaagucuccuugaagaugauuauggaaacuuuuaccacuaaaguguauaucaacaguaguugucuaaccacagaucugaauuuaaaccuucuuuaagaauuuuaauaaagagacacuguucaaagugguuggucugucuccuaccaguucgcuuuccucuuccucugcaucuuucuuuucuucuuucuguucuucgauauuugcaucaaaaucuuccaucucuaccuauaccaaccauuaaaaaaaaaaaaaaagacugaguuaacauuuagcaaaauauugacucccucauugagaucuggaaugaauacaguugcccagagcaagacaggcucacuguuacauaccaaguaauuuuuaacacccuaaauuuugaaacagaacugauaaaagacaggauacuacugccuuuaauuuuccuugaauauccaucuguacaauucccuguaaaguuaaguauaagugcuaaguagaugguuaccuauuuugaaugccuauggauuacuagacuuuuaaaaaucuuuaacgaguauuuuuccaaucagguaaaaacaugucaaugauucaaauuucaaaauauaagaaaaaguauagugaaaagugggaugauauuggcuuggcccagagugguagcaacgcaaauaagcagaugaguuacagaggucauuaaaagguacaacugacuaaacuuucuugacuacaugacaggucacaagggcagaguaaagagucaggccugggcacaguggcucacgccuauaaucccagcacuuugugagguuggggcaggaggaucgcuugagucuaggaguucaagaccagccugggcaacauagugagaccccaucucuaaaaaaaaauaaaaaauuagcugggcacagggcaugcgccuguagucucagcuacucaggaggcugaggugagaggaucauuugaacccaggaggugaggcagcaaugagcuaugaucaugccaccgcacuccagccagggcaauagagucagacucugucucaacaaugacaaaagagucagggauaacucccagagcaccgguuucagcaaucaagugguuaggguucuaauuacuaaaacagagacuacuaaaugaaaaacagguuuggacgaacaauauuuuggauagguugaguuugagguauacuaagauaauauauauuuuuuguagagaauuuggaaaauaauaguaaaaagaagauuauaaaaaucaccuauacucccuccauucagaaacacuacuauuuagauaguaauauaauucaaucuagacuuuauaacauuaauggcacguaagugacaaucuaagcuaccggaaagauucagaugaucuauacagaggguacaaaauaaaaacagagccuaggauggagcccuaagggggcccuuuuaaagagugagaagcaggagaagccagugaaggagacugaaaagagauagccaaaaaaguaaaaggaaaaccagaaaaaugugaauucacaaaagccaagagaaaaauauguuuuuuaagaaggugggcauggucaacuauauuacauguggcuacaaaauuaaucaauagaggaaaugagaacuguccacugccacggaaaucauuagugaaagaguugccagacaaugguaguggcagaagccagaaaaaaauggguugagaaauggcaugggaauuaaaaacacauaaaagaacaaugacgguugggcaugguggcucacgucuguaaucccagcacuuucggaggcugaggugggcagauuacuugaggccaggaguucaagaccagccuggccaacauggugaaacuccaucucuacuaaaaauacaaaaauuagccaggcaugguggcgcaugccuguaguuccagcuaauaaggaggcugaggcaggagaaucgccugaacccuggaggcggagguugcagugagccgagauuacaccacugcacuacaaucuaggugacagagugagacuccaccucaaaaaaaaaaaaaaaaaaagcacaaugacaauauugaguauggaagaggucaaacaaacagaaaccuacaacugguaaaaaauagaaaauuuuuccuuccaucaaauaaauaauuaauucaggcaagaauuaccagugaaugaaaauuuguuggggaaaagauauuaagaguaucucccuacagauuacuuaucacaaagagaaaaagguagaaaaauuugauggauaucaccuuaaccaaguaaucagugcuuaaaucaccaauaaugagauaaauuaacaccauauggcuccugaugugacacacugagagggcacaguaucacuuauguagcauucccgcuaauguuuaaccugaaccuaagcauguggaaacaaacagacaaauucaaauugaggggcauucuacaaaacaggccuauacucuucauaaauucuuuaucuuucaugacaaugacaaggcugagaaacuauauuuuauauuaaaggauugaaucuuagauuuuugaaaauuucuauauaccacguuauagggacaacugguaaaaugugaauauaaacuauaugugagauaauucaagaaauuuaauucaggaaauuuauauuacuuaauauaguauuuuaucaauacuaaauuuccugcauuugauaacugucaucaaaucaaaagagaauguacuuguucuuacaagauaccuacugauguauuuaagggugaagguuuauaagaucugcaacuuaacucucaaaugguuccacaaaaacagugacaucauuaacaagaauguuaauaagaauacaugcauucagagaaaaauguggcaaaauacuaaccgugaucucaaugaaaggcauaucaguagguguucuuguaugaauacuauucauauaacuuuucuguagguuuuaaguuuuucaaaguaaaaaggugaaaaaguaacaucacuuugcauugcauuugaaccaaaggauacucaccucuucaauagcagcaucuugcagcaaagaacgaauaucuagacgcaucaugugacgaggugcaguuucccagugaucagccaucuauugaaaaauucagaugguugaguuaucucuagaaacuacucaaagaccaaguaagcauccaagauaaacaacauuuaacaauauuuuaaaauauuguuaaauauuaauuaaauauuuguuaaauauuaauuuaauauuguaaagucuaaugggcuaauuucuuuuuuuuuuugagacagaaucucggucugucacccaggcuggaguguaguggcgccaacauggcucacugcagccuugacauggugggcucaagugaucuucccacuucagccuccccaguagcugggaccacaggcacaugacaccaugcccagcuaauuuuuguauuuuuuuguagagacaggguuucgccauguugcccagguuggucucaaacucccaggcucaagcgauccgcccaccucagccucccaaagugcugggauuacaggccuaagccaccaugccaggccauaacaggcuaauuucaagaagagcuaggaaaagaaacaaaggaagagaaacauuuacuaaagcagauaggaaaguuauuaugaaaaaaaaaggagauaaacaagagcuuccagacaagagugcugauacagauaauaugagguuuagaguacagucacacaucacuuagcaaugggcauauauuaugaggaaugggucauuaggcaauuuugucauugugugaacaucauggaguauacuuacacaaaccuagaugauaaagccuacugcacaucuagguuacaaacuuguacagcauguuaauguacugaauacuguaggcaacugcaacacaaugaaguauuuguguacuuaaacauaucuaaacacagaaaagguacaauaaaaauacauuauaaucuuaugggaccaccauauaugcaguccuuccuuaaccaaaacaucauuaugcagcgcaugauaguacucuauuauucuauguuucuuaaaaucaccuuauuuauuucuuuaagcuuucuuccaugaauauuucucuugccacaagucugguuaucugcacucauuucagccaaauauaccuaagcaagaaugaauaauaauuaggcaaagauauauaacauuuacaugacaacacaaaguacuuuaaaguucuuuaagcuucuaccucaaaucccuugguuuuugcugcacuccaaaacuggucaaaaugccuaacucugucauugauggcauccaggaugaugaagggaaaaaagccaucauccagagucuuuuugaaaguuuugaacaugcuggugcgguaagucuccuccaucucagcuucauauucauauuccauuaccuaaggucccccaaaagagauauggaauuagcaaaagcaaagaaucauccaaaaccuuuuccuugguuaguauuuggauagagaugacuuuguagucuuuccuucacacccaaguacuaaaguacuguguucggaaaagagagaggucccugcccucaaaaaagccacauuucucuccaaacacauuuuccuuuaaauacuauuaaugaaucagaacgagaucugagaugaauaccauaccuucuuuuucacuuucuuuccagaaucuggaucuuuuucuucuuuuuccacuucagugaugaaguaaucauccaggcuuagaacucugggugcagguccuccaaauucuaccuccuuauccuaagaaucauacagucaagaagguuaaaacgaauuuauggaauaaauuaauguucacaccaaaguucccucuuguggcuaaauaauauacaaucuucuggugguuucaaaucaagcagaggcaaaaauguuucucugaguagauaaaaauauauaugggacaacaucuaccacaugggccaacuguaauggaucaaauggaagacaauucuauuggcauuauguugcuugcuauuaauaagaaggcaagugacuacuaacacaagcagcacaagcagcugauuuuucagcuuccccauacucacucgaauaaguuuugcaacaugugucuuuccacugccagguaauccucucauuauaacaacaaucugaaacagaauagaccaaaaaaaaaaaaaaaucacugagagaaaauuuucugcaaugagauaacaguuaacaaugaccuaccauuuuccaggauagacuauacaacaggccaugaaacaaaccuucauaaauuugaaaggacagaaauaauauaaaguaugucacuggaccacaguggaaugaaauuagaaauuaauaguaagaaaaaauuagagaaacucacaaauacgugaaaacuaaacaacauacuccuaaauaaccaaugaaucaaagaaaaaaugaagaggaaccagaaaucaagaggagccagaaaccaggaggaaccagaaaauacucugagaugaaugaaaaaaacacaacacaccaaagcuuacaggauacagcuaaagcagugcuuaaaaggaaauugauagcuauaaaugccuauaguaggaaagaaauaggucucaaaucaauaacuuaaccauccacuuuaagacacuugaaaaagaagagcaaacuaaagaaacagaggaaagaaacaauaaagauuaaagcagaaguuaauaaaauagaaaacagaaaaacaaaagagaaaaagucaauaaaaccaaacgguggcagugguucuuuaaaaagaccaacuuuuuuuuuuuuuuuugagauggagucuugcucuguugcccaggcuggagugcaguggugcaaucuuggcucaucgcaaccucugccucccagguuugagcgauucucaugccucagccucccaagcagcugggauuacaggugccugccaccacgcccgccuaauuuuuguguuuuuaguagagaugggguuucaccguguugaccaggcuggucuugaacuccuagccucaagugauccgcccaccucagccucccaaagugcugggaugacaggcaugagccaccacgccugacuaagaucaacaaaauugaugaacucuuaccuaggcugaauagaaaaaaaagaagauucaaauuaccagaaucagaaaugaaagcugggcucaguggcaugugccuauaaucccaguuccucaggaggcugaggcaggagggucacuugagcccaggagugcaaccccagccugggcaauagugagacucugccucgaguaaaaaagaaaugaaggaggagacauuacuaccaaccuuauaaaaaagauuacaaaggaauacuaugaacaauuguaugccaacaaauuagauaauuuaggugaaacagacaaauuccuggaaagauguagacuacuaaaauuuacucaagaacaaauaaacaaucugaauagaccuauaacaagugaagaaucuaagacaauaauuuuaaaaaacuacacacaaagaaaagccuaagccuggaugacuucauuacugaauucaccaaacauuuaaauaccgacucuucccaaggucuucaaaaacauagaauaggaaggaauaauuucuaacuuacuuuaugaggccagcauuacaccaaaccacauacagacaagaaaacuacaauaucuccuaugaauauggaugcaaaaauccucaacaaaauauuagcaagcugaauccagcaacauauaaaaauuauuacacaccaugaucaagugggauuuaucccaggaaugcaaguuaacauaugaaaucaauuaauguaacacaucauaucaacagacuaaaaaccaaaaucacacgaucaucucaacugacacagaaaaagcauucaacaaauccaacauccucucaugauaaaaacauucaacaaacuaggaauagaagggaacuuucucaaccuaaugaagugcaucuacaaaaaaauuccacagcuaauaucauucuucuuuuuuuuaaagacggagucucgcucugucgcccaggcuggagugcaguggcgcgaucuuggcucacugcaagcuccgccuccuggguucaugccauucuccugccuuagccuccugaguagcugggacuacaggugccugccaccacgcccagcuaauuuuuuguauuuuuaguacagacgggguuucaccguguuagccaggauggucucaaucuccugaccucaugauccgcccaucucagccucccaaagugcugggauuacaggcgugagccaccacacccagcaacaucauucuuaaugguaaaagauuguauuuuuuucucucuaaaucagauacaagacaagaauguccacucuugccaugucuauucaacacugcauuggagguucuagccagggcaauuaggcaagaaauaaaaggcauucaauucagaaagaaagaaguaaaaguauauuugcagaugacaugaucuuauacauagaaaaccuuaagaaucaacuaaaaaccuacuaaaaguaauaaaugaauucagugguauugcaggauacaagacgaauaaacaaaaauaaaccauauuuccauauauuugcaaggaacaauccaaaaaugaaauuaagccaucaauaauaacuuuacuacaggguacuauguucacuuuuugggugacaggcucuuuagaagcccaaacuccagcauuacacaaaauaccuguguaaugaaccugcacauguauccugaauccauaauuuaaaaaaaaaaugugaauguauuaaacaauccaaucaaaaggcagagauuuucagacugcauuaaaaaacacgauccgcuguguccuacggagucagaaacaggaaucugaauuucuagagugauuagggaguuacccuugcaaggauggugaagaaaugucagaaauaaagggaaccugaauggaaaaaaaaaaagauccaaccauaggcauacuacaggagacacacuuuacauuaaaagauacaaauagaaugaaaggaaggaaaugguaaaagauuuaucaugcaaacagcaaccacaggaaaggucaaguagcuauauaguaauaguaggcaaaaagacuuuaaaacaacaaucuauuaauucuguauauauggaauuaaaauaucuggcugaaaucuccaguaccaguuaauucaaauggagucagucuaauuauucuguaauaagacaaauuuaauagaaugcgcacauuuggaggucacuaggaaauuaagccuaagcuaaucaagucuccuaauucucccuuucuauuccacacaccauaaaaccaaauccacuuuuccucucuucaacgcgcaauuaauugaggucucauuaauauguuuuaaaauucaacaucuuuuuugccaaguacuuuagugcuaaauucuuaaagauucuauaguguaggccauuuaugagauuauauggugauuuagagauaguaaaacgucuugaaucugauauuauuacuauguugcagaaaaauaaagaaauucuuuucaggauauuaacaagaucucuuaucuucugguuugcacgaagacgaaucaacuucauaggacucacucucucaggucugcucucccggcccggugguuucaaaauaucguccacauucuuugauucaggcuucuucucgacucguggagcuggaggaggcugguggcucagugaaggagcuggcagaggcauucgcuccucaggauaaguccuucguucuccuaggauuccagcaguugaacaaaauuacuauuuguagaguaauuauuuugaaauucaacucuccccacacauccuaagguaauauaauucaaaccaaguccagugauuuuggggccacuuuuaacuuuaauuagagaaaauuuaagguaauguaaaaucuacugaagucaagaaaaugagaagauuuaaguaugauuucaggcaaauagaauguucugcaaaacacugaauucauccuuguuuguauuaaauguaggaaaguuaagcaacaggacauggaagaauaauaaaugcuuugcuggauaguccuaaguucuguaacuucugcuuuaugguuuuaagaguaagaguuauaccaucuuaggagagccuguuccuaaaaauagguaugaguuucuaguuuaaguguaaaucauagcagugaaaaacuaaaagcaaccuaaauaacuaagaauaagggucuuggucuuauauuuuauccacucaauggaaugucacagagccauuaauaaaauagguuuacauaugaaaaauguguauggugcaauaucaaucagaacaaucacgauaaagaaauuguauuauuauacuuugauuacaacuucauaaauaugucuguaaagagcgaaugagaggaaagcuacaaaauuauaauagcuguaguaugguagguagugagacuaucaguaauuuugauucuacuuuguuuuaaaaauaaacaugcuuuauuucauuaauuacacugcuauuuuuuaggacaaugccaccagcucuaagaaaucugugaauacguuuuacucuaaaaguuuaaauucauagcuacaauggaaagcaucucccaugcuuuacauucucaacauccuuguaguuaauaaggcaucacucuaccuccaaacauggaugguccuucauagacuggucggucagacuuccggucauaggauggccuaucaaaacccccucuucuggaugaggaauggucuuuuuugucucgauaugacugagcucuagaagguguaauaggaagcgcuucagcaaauaaaaaauauuugggguucucugcuuuauaacgcaacagcauuaacugcccaauuuucucuauaggaagguacuccacacaguaaauguuuacuuuuuuuuuuugagauuggggucuuacuuugucaaccaggcuggaaugcaguggcgugaucucggcucacugcagccuugaucuccaguguucaagcaauccucccaucucagccuccugaguagcugggacuacaggugcacauaaccacacccagccaacuuuuguuauuuuuuguagagaugggguuucgccauguuggccaggcuggucuugaacuccugagcucaagagauccaccugccuuggccucccaaagugcuaggauuacaggcgugagccacuacgcccggccaauauuuacauuuugacuuugcuuuuucauuuagauuuacuuuauauacauacaucuaagaaguucaugggaaagcugggcaugauggcucacgccuauaaucccagcacuucggaaggccgaggcagguggaucacuugagcucagaaguuugagaucagccugggcaacauggugaaaccacaucgucaucaaaaacaaaaaaaaaauuagccaggcaugguggcacaugccuguggccccagcuacucaggagacugaggugggaggaucacuugagcccaggagguggaggcugcagugagcugagacugcgccacugcauuccagccugggugacagacugagagagaccccgucuccauacaaaauaguaaugaauaaauaaauaaauaguucaugggcuugccccccuuucccuuuuccuuggcuggcugccagaaugcccuuagguauaauaauaauaauaauaauaauaaauaaaaagcucaugaauugcaaaaauaaauugcuugccuacugaguaugacugcaccuuuauugacaauaccauuuccauucccuucuggcuaucuccaucucccauuuaauucucuggaauucaagcuaccaagucaaggaccuacuuuccugaaaacugguccagaauuguucuucccccuccaaauuacauauacacaugcaugagaagaauauguuacuuauuaaauuucucuuaaacuuuuacuguuaaguauacaguaauuuguacaccuagcaaagauuguuuuauagcauaccuaucaucucggggucggcguucucugucaaaucgaucccggucauagucaauaacaccacgaucccggucucgaucucuaugugucucacgaucccuuuuaaaaucucgaugaucugcuaugacauuacuuugacgaucaaaauaaggcucacgaucucuuucucuaucauaacgaucacguuggccugcaugcucuacaaaaacaauuaguacaaaauaacuauaucccuuuuauagaaauaaaagcagaaaacuauaaaucuaacuucagagcugguauaaauuuuugccauaaauucaacuaagaaucuuuuagcuguauuaaauggaggcucagauaaucucaccaaaaggaaaaucaugugauaauuaggcccuaaaauguuuaaaaauacugaccucucugggaauccuaccugucucaaaaguugaucuuucagguaguggaucugggcguagaguuauucuuucuccauaagguaucuguucaacuuuauuaguggauauaucugguaaacaaaaucagagauaaaguacuguaagagugaagcuagagaaagcuaaagcugaagcuaacaauuccuguagaaucccaaauacaagugcacuaucauuacucaccucggccauggccauaaucaacagucuguuguacuggugguggcuuggacauugguggcauacccauaggcacugggccaggagggggaauggaagagugaacaggugggggugguaauacuggagcagauggaauugcugcaguuucugacuuaaauucugaauucaguccuuguucaucauuuguaucccagagcccauagaaagaaucuucaucccaucguuccuguucuacagcugaaguuuguggcuuuaucacuggaggaggaggagguagagguggaggagguggagguggugguauugggacagguggccuggucacaggaacagaugaucuugcugguggagcagagggucuuacaauugaaccuggugguuugcccauaggagggggaggucuauacgacccuggaggcuagagaacagaauaaauagcuuaguggacaaguauaccacuauguuuuuauagaucaguggaaauuaaaaucugguucucaauuuauaagaaaaaaguuaacaccuuggacucauucaaaauuucgugcuucaaaacauaccaucaaaaaaaaugaggacaagccacagaaagggagaaaacauaggcaaaucuuauauuugauaaagaacuugaauucagaauauacaaaacacuuaaacucgguaagacaaaucauaaaaaaaaaaaaacuauggccaaaagaugagaauagauauuucuccaaagaaaauauauaaaugcccaauaagcacaugaaaagaugcucaccaucauuagucauuagggaaacacaaauuaaaaucccaaugagauaccauuuucauaugcacuggaaugguuauaauuaauaagacagacaaaaacaaaugauggcaaggauauaggaaagaaaaacccuuuuagauuguuagugggaauaaauggugccacuauagaaaaugcuuugccaauuucucucaaaaagucaaacacaauuuuuuuuuuuuuuuuuugagacggaguuucacucuuguugcucaggcuggacugcaauggcgcgaucucagcucacugccaccucugccucccagguucaagugauucuccugccucagccuucugaguaacugggauuacaggcacccgccaccacgcccagcugauuuuuuguauuuuuaguagagaugggguuucacuauguuggucaggcuggucucgaacuccugaccucaggcgauccacccaccucagccucccaaaaugcugggauuacaggcaugagccaccgcacccggccaaacauaaauuuaucauauggcucagcaauuucauuucucgguaucuauccaagaaaaauaaaaacauauguccauccaaagacuugcacacaaacauucauagccguacuauucaacaacccuaauguccaacaacuggugaaugguuaaacaaaaugugguauauucauguaacagguuauaaauaaaaagaaauuuaaaaagcaguaaaaagaaaugaaguacugagucaugcuacaacauggguaaacuuugaaaagaagauagacacaaaagacuacauauuauauaauucauuuauacaaaaugcccagaaaggcaaaucuauauagacagaaagugcugggacugggguaggaaugaggauuaacuaacuguaaacuggugcagugaucuuacagggguaaugaaaacguuuuaaaauuuccauacuccaaauuagggugguagccacguaagauucaaaugucccaggccaauaccaaaucuacugaacuucuguagguggggucccaccaguaauucaaaauuuuaaaaaaacccuccaugaauaauucugauuuauaacccucgguuaagaacuaucuuccuaugcucagugugcaggaaggagagaaaugaauaaauaaauaagaacuaucuuccuacucuagagaccuaucuccuccacaaaaacaguaaauuuucagugagagaaauccuagauagccuccacacuucuguuccuuucaguuaucugguugacaauagucaucuguggugaagcugagaccaacagagaacaugaguacuaugaaacaacaaaauaaacuaaaugaacaucuaguaaucuaaggagugccacuguugugugcccuccuuccauuuguuuucccaaagcaucaccaguuaccaucagaaaugucuaugauggagaugguaggacuucuuagcaaauugguccuaucuacucaauauugaaacccaguugccaaauacauuuuauuuuuauucuuucuuugguaaagacggggucuugcuauguugcccaggcuggucuugaacuccaggccucaaguaaucuucucgcuucagccucccaaagugcugggauuacaggugugagccaccaugccuagucucuauuuuaaucuuuguaagugugauucaaacacuuacuucccauuucuuaguucacugugucuggcugguuugguuuuauuuuuuuguuuuuuguuuuguuuugguuuuuuacuucucuguuauucuaggauguuuuuucuuuauugacgcuauuuuagauccuggagagcccacaauauacauuauuuauauauuugcccauauauacacaguacuuuaaaaauaaacuuucugaauaauaaaauggaguugacuaauacagaaggaacauuauuugacuggagguaacuacuggcuacaguuaaagacaaauggcuauuaccuaaagguaaacuuuuaaaguauggcaugguaaacuuugucaagaaaaugccaauauaggaugaagcuauucagucuggguagaucuaucaagacaaguuuuaaauaucuuaagaucucauagauguauacuuauaaauuuuuuaaaaacugcuuucuucauucuauauagugaaaguaaaagauacauuuuuuaaaauuauuguuuauaugagaaaggguuaauaucuauauuauauuaaggauaaugaguuaauuuaaaaaaaaaaaaccugacucaaacagauaaaugggugaaggacacaaacagaauuucuguaagaggaaaguauaauuaacaaauaugggaaaauauucauguucacuaguaaucaaaaaugcuguauuaaaauuauuaaauauaccaaaaauauuaaguagcuaaugcuuacgaggcuauaguauagauguuauacaauuauuuuuuuucauuuauuuauuuauauauuuuuuugagacagagucucacucuuguugcccaggcuggagcgcaguggcgcuaugugcaaccucuaccucucagguucaagcaauucuccugccucagucucccuaguagcugggauuacaggugcgcaccaccuggcgcgugccuggcuaauuuuuguauuuuuaguagaggcgaggguucaccauguuggccaagcuggucuugaacuccugaccucaggugaugcacuugagacagagucuugaucugucacccaggcuggagugcaguggugcaaucuuggcucacugcaaccucugccucccagguucaagcgauucuccugccucagccucaccuguaacuaggauuacaggcacaugccaccaagcccagcugauuuuuauauuuuuaguagagacgggguuucaccauguuggccaggcuggucuggaacuccugaccucuugugauccaccugccuuggccucccaaagugcuggcauugcaggcaugagccaccacacccggccauuauacaacuauuauagagagcuguuuggcuaugugacaggaaucauuuaaaaaguaugcuuauucugggccaggugugguggcucaugccuguaauccuagcacuuugggaggcugaggcagguggaucaccugaggucaggaguucaaaaccagccuggccaacauggugaaacccuaucucuauuaaaaauacaaaaaaaaugagccaggaaugguggcaggcaccuguaaucccagcuacucaggaggaugaggcaggagaaucacuugaacccgggagguggauauuacagugagcugagauugugccacugcacuccagccugggugacagacuacauuccguuucaaaaaaaaaaaaaaaaaguaugcuuauucuuugacugaagugucccacuuugggacguuaaaaucacuguuggcugggugcaggggcucacaccuguaaucccagcacucugggaggacaaggcaugaggaucacuuaagcccaggaguucgagaccagccugggcaacaacgcgagacccugucccuacuaacaauuuuuuuuuuuuauuauuagccaggcguagggugugugccuguagucccaguuacucaggaggcugaggugagagaaucacuugagcccaggaguuugaggcuccagugagcuaugauuguaccacuguauuccagccucccaggcaacagagcaaaaaaaaagagacaaaacaaaaacauaaaacuuacuccuaagaaguuauuggccgggugcggugguucaugccuguaaucccagcacuuucggaggcugaggcagguggaucaccugaggucaggaguucaagaccagccuggccaauugguaaaacccugucucuacuaaaaauacaaaaaauuuagccagguguggugccaggcaccuguaaucccagcuacuugggaggcugaggcaggagaaucgcuuaaacccaagagguggagguuucggugagcugaaaucaugccacugcacuccagccuggacaacagagugagacuccauuucaaaaaaaaaaaaaaggaaaaaagaaaaggaguuaucuaaaauaagaacccaauacaaagacauucauuaggguaauauuaagaauaacagugaaagauuagaaacaaauuccaacagaaauugaauuaauucaauaaauuauuguaaaucaaaaaauaauauagcauauaacaauauggaaagaugauuaugauuuguuaagcaaauaaagcagaaauguggauguacaaucuggcgcuucuauuuacuaagacacacaaagaugaaagauauaguuauuaucuuauggacucaauuuagaaagaaagacaagaaaacagacacucaaaaugcaacauaauaaagaugacaacaaagacuaguacaagauguuacaggguauguacaaggguaauugcccuacauagguggaagagaaaauaguagagcugaguuguaaaagauaaacaaacauuagccaguugcaggaggggaugggaaggcaaagaaaagacucuaggcuuagagaacaacaugcauacgcaaaggaaugaagaaguaaaagaaucuagcacauucacaaaauuguuaaguagcucuauguggagggaaaaugaagcaucagagaguggaguagcaagcaauggucagcagaggucaggccagcucaggaagaacaagaaagucaugcaagagauucuaaauuucauccugaaggcaugggagaacauugaaguuuuaaagccagguagccacauggugagauuuguuuuaaaauguccaucuggccacaaaucacaucgacgcugccugaaguggaguauagggguagucccaaucucaaaagggcaugagagaacuuuuuagggugaugagaauuuuguuuuguuuuguuuugauuuugagauggaguuucgcccguugcccaggcuggagugcaauggcgcgaugucggcucaccgcaaccucuaccucccggguucaagugauucuccugccucggccuccuuaguagcugggauuacaggcaugcgccaccacgcccggcuaauuuuguacuuuuaguagagacgggguuucuccaaguuggucaggcucaucucaaacucccgaccucaagugauccacccgccuuggccucccaaagugcugggauuacaggugugagccaccgcgccuggccgagaauuuuuuuaucuuuugguauacaucugucaaaacucgaacuauaggcuuaaaauggguguaauuauacuugagaauuugauucaaaggagguaaaaucaaucagcagcaggguaggacaaaucagcaagauggagcaagauggaggguugauuuucagguuucaaguuagggugacuaggugauggugaggaaaaaagacaauuuaaugggguaugauaacgagccccauuuugaauaugcugcauuugacaggagucacauccacagacagaaacccugcagacagguagaugcguacaaaggucaggagauccgaucuggggagucaacaacaccaugguggucacugaugucaacaacuaugucuuacuguuaaguauuagaccaggauggaagggaacacugagaaaugaaaaguguuaauuugaugaaaugguucaguagagguucaguagagcuguuuucuucauuaugcugucauaaaacuaccugcaagauaacauuuuaaacauuugaaaagcccauuacuggcuuaaagguaaaauaacaaaaauaaaagaaguccuggcaugcucuugggaaaaaaaggagaacuuaauuacucaagucuuuaacauaaacaccccuuuucauacugccugaacaguucugaaguauguacugggguaugacauuuccccaucugaaggacuaguagccugaagagguaggaagcaucacgaggcccacaucuagcccugccuagauggaaaacaggacuuuuuuuuuuuuuugguagagauaggggucucaccauuuugcgaaggcuggugucaaacuccugggcucaagcaauccucucgccuuagccucccaaagugcuagaauuacaggugugagccacuaugcccagccaacaggacuauuuuaacauaaaaauuauuagaaaaauucuaccauuuugugaacagaagcuauguaguucagguguacuugguguacuuaucaaaaucuggggaaaaggagcaucucuaccacacuuuugaacaugcuuuuaagguguucaaaguucaauuaccauaaacuuuuaaguuuccaaaauuuacauuuuauagaggaaauuuguuauuuauucaacuucuaaaaaaaaucaaacaacauagaaacauacaaaguagaaaccauuucauuuucugagcacacauucucccauaccggauacauuccaggucuugaagauguauucugcaaucuugauuccugaggugguagauggucagccaucuguggcucagacccgaagucuuucaucuuuugaagcuguucuuucuguucccugcaaacaaauaaaauugacauaguacauaaagcaugcuuauuccauuccuaagugacuacaauuaauauuuaauuaaaaaaaggagaccuaaaaaauccuuguccuaaaauucucugcaguggccauacacugagcagcuccaggauuacccucuuuugcuuuuauguagcuaacucaucagucauuuaagacauauaaauaauuauaaauuauugaagauauucaagaauagauucuacaaccugccucaguuguuuucuacuaucucaucuacuuguuauguuuuucuuuaauccaaccaaaagcucucuugcuauuuuuuuuuuuuuuuuuuugagacagagucucacucugucgccugggcuggagugcaauggcgcgaucucagcucacuacaaccucugccucccggguucaagugauucuccugccucagccucccgaguagcugggucuacaggcaugcaccaccgcgcccggcuaauuauuuguauuuuuuuaguagagacgggguuucacuauauuggccaggcuggucucgaacuccugaccucaugauccgccugccucagcuucccaaagugcuaggauuacaggcguaagccaccacgcccggccuauuuuuuucaacucuuuagaccagagguugcaaaaugguggcccaugggccaaauauggccuaaaaagguuuucaaaauguggcuuucacaucaguuuuuaaaauuugaaauuagcugucauauuuacaaagcaaaauauuucauauauaaauucaaaucuuaaagagauaugguaacaccaggccuacauucccacaugccaacaaucagcugagugcaguagaggcugcccauguuagaugaaacaaccugucacaaucuucaccguacucuacagaguuauacuuggcccacuuucacucauuuuuguuaucugauucuuggggacauuuuaauuuauggccccugcuguagauggugagaacaacugucagucuauaccuuuaaaaacaacauuucauauuccugaagauaauuauguaauccuucgguuuuuucuuuaaacugacgaaauuccuuuuacuuuuuuucacaaugccuaccuuaaacauagguaaaauccacuacaauuucuuaagaccuuuuacaauuuucuccuuacauuaaagugacccaaaugaggguccacaaaugagggaccacaaaguaagggucaaguguguaagauuauuuacugcucagguaaaucccaucaucacaucccuuaugauacuccuuacgacuuuacacugacacaacauaaacgacuuguauucggcuaugacauuauccaucacucccuauauauuguuuaauuauguucauguugccuagaaagcuuuaaaaaaggaugaagcagcagcagcaccuuuuauccagcauuaccaugcaaagcaauaacgaauuaaaaagaaauuuaaaaaggaaaaaaaaagaaaccuuggcagcuuaacaacaccaaucagcuugguauucuccauaaauaacacagauuuuagaguuuuagacagauugaguucaaaggccggguuugccacuuacuagccaagggaacuuaaccucuuugaacuuuagugucauuugugaaguggggauaauacuaccuuaucuuugcaggccuuugagauagacagacugacauaauauacacucaauuauuagcaagugcccaguuacacgguagguguuaaaauuaaaggugucuauaacuuaaaagugaauaguguaguagcuaaauauucuauagcaugcuuuccacauuuucuucaugaguaaucuggaaaaaauaaaccucuuagcuauagaccauacaaaccugccguaucuggucuuucaucauuaccuuuucuucaccguauuuuucuuuccuaguucuaaaguuuaaguuauaauuuauuguuaagauccacaaauguaaaccagaauugaaaaauggaagaaauacauuggaauuuaucaaaaccuaaucauuaauugacuuucucaaaaaaauugcuuuaaaaaaguuuucaaucugucacugacuucuaaauuccuaucccaagauacagcugguuuaaggauuaaaugaguuuauuauacacaacacacuuaguacaguuccuggcccggaguaagcaugcaauaaauguuagcuuuuguuauuguuguuaccacaagaaaagaggaaaauuauguagauaccuauacacaguugauuguaagucaagaaauccuauuuuccauuucacaaagaaaacauuugguuauguagaaacaaauaacauccucaaggagaaauaucugcuuuuaguuauaaugaaagauaaaacauccccaaaagaaaguaucaauaguuaagacaaaucugaggaugcuccuaagcaaaccauucuuagcuucaacaaagaaaaauacagcacuuuccaaaguuuuaucaaugauuagugaauauaaagucuaucagaucuaauaccaaagaacaaacugauuacuggaaaaaaugaagguuacacaugaacccugugaaauccagagcacugaaaaguugaaguuugacacuugaaacaugcacaggcauggcaugccagcaacacuucuacaaaggccaagacagcaaucaauuuucacaucuuagggcauaaguuuaucauuaacacaguuccuaaauacccauucuaacccuaaaacagcacugaaugaccagaaauauaaauuaaaaguaugugauaagaacuugaaguaaaaugauuccauucaaauauaucauaucacuuuaaaaagagcagucugaaugugguuuuuauuaaaagaaaggaucugaaggagucaacuuaccgaagcauuuucaguucuugugcagcuuucaaaaugauuucaugcugccucugacugagaaccauuaccccuccaaggccuuggucagagucuaagcuugcaucggaccccaucauuucugaggaaugaugugaggagggcauauguuccgccaugggggaaugucuauccacaucagauggguaccaucugucugacaaccguucucuuucccaguccauucugucaggaacauaaucucgcuuuucccgccauguaucuccucuuucuggauacucucgaauccucaacucaccccuaucacggaaaucucgaucauacccaugcucucgauuucuuucuucucuccaucuaucaucccgauaucuauccaaagguggaagaggugggaggggcgguaaagguggaagagauggaauaucccguucacgaaacugugauucuuguucauccaguggucucccauaaucucugucccacucauuauccaaacuucuaucauacauauccauaggucuugaaauccgauccacaucccuguccaugucccuuuccauuucccuauuguaguccucauccauauccuggucucucucccaaucaucccaccaagggccucgccuaucuccaucaugagaccgagaugguggugcugagaaccuguccucucuguuauagagcucuaguguaucaucuugauagucacguucacauucucuccaguaucucucucuaucccagucaucgagucuuucucguuccauuggagcauuucuaccaucuaauggaaacucuucaugcccucgcucuucuccaugguuccauggagcccuaggaggcucaucccggugauauggauacauuuuuuccccaccaucuccugguucuggucugaauggaccucuaucacgaccaaaaucugaucuucccaguccccuuucucgacugccaggcccucgaggugguccucucucccugcucccagcucuucggggugguauucucucucuacucccagcccuucgaagagguccccucuccugacugccagcccuccgaggugguccccuuucucggcugccagcugcaccccuguccuggcucccuugaagaccaccuggcacuuucucccgacugcuuccaggccucaccaacccucugucccggcuaccuucuccucuguucaucuucucucgacuaucuucucuucuacccaucaucuuaucccgaaagucuucuugcuugaccaauccugggccucgacugauugccuggccgcgaccucuguuuacuagaccuuuaucccgugugucuuccauucugcuuugcccaggaccucuguaagaugagcuguugccucuauugccuucuaaucuauuaucucuauuaucuggccgaggcaggccuuuaucuugguuguuuucugaaugggguagaccaauacccacagguuuaaaaucauuaucugcuguuaaugaugauguugcuacugcuguuccucccuccauccccccuguuuuugaaggaaaaguagauugagcagguacaggcuuauucgcaagggguacaggcugaguaacagcuugggcuuugucgauuugagucuccauacuuugaacauucuggucccaauuagagggcucuacgggcccuuccgagacuucacuuuuagguggcucuuguugagagucgcuuagauucucauuugacugagccgccuugacauccuuuacaucugcagcaauggaaaaugcagcugauugcauuuuaaaauucuucugcugguuacuacuggugucugcuaaugguucuuuguuuccugaaagagguucugcuugugacuuagguugcugcugaugcugcuguccaaaagcugguuuggggccuuuccacugugguccacucugucgaggacuuagggauguacuggggguaauauaaaauugagaugcuggcccccggggaaucauuccccacuugcuuuuagugcccucugcugggugaccuucauaucugggucuuggcccaucggggcgauuuccuucaaaacgaggcccuuugggucucgguccuucacaccuugacccuaaauccucaaaucuucgaggaccaucaaaucuacaaguaaaacaaaagauauuacucaagacaguaaagcagaaaaaaaaaauucuccauguaagaauauuuaaggcacucuugccuuagaauuuguuuacaacaaugacucuuuucagucauuaaauuaauccugagucaccaauaucuuagaaccaguauguuaagguggcagugcucagaaggucuuaggacaggcuuuggaaaucaugucaguauuaucuaacuuacuucaacacaucuccugccgcaagucacugauauacugaacgguuaaaaagcaauuacaggccuggcgcaguggcucacacuuguaaucacagcacuuugggaggcagagaugggcagaucaccugagaucaagaguucaagaccagccuggccaacauggugaaacccuaucucuacuaaaaaaaaaaaaaaaaaaaaaauacaaaaauuuagccaggugugguggcaggugccugcaaaucccagcugcuugggaggcugaggcaggagaaucacuugaaccugggaggcagagguugcagugagcugagaucacgcuauugcacucuagacugggugacaagagugagacuccgucucaaaaaaaaaaaaaaaaaaaagcaauuauaaauacugugccuuaggagacagaaaaggcugcucauuuuaaagagaaaaaaauuaacaaauuccauaacuaacucugagcacuucuggaauuaaauuguaacuaaaaacuaaauaugaaaagacuaacaagaaaauauaggaugauuauaaauauuguuagagcuagcacuaacauuuugauugacaaaaguuaaaaaaaaaaaaaaaagaaacaguagcccuaucuuaagaguagguucugacauuuuaaaaagucugcacaguuauuuuugcuauaaacccacuugcucauccaguaaaaagaaaguacacauccuuuaucugucaggcauuacauuacauccaagagauacaagaauaaaaugucauaugugcccucaaagaguuuacaacaaaauauaaagauaaucuaaguguaaauaaguaccaagagauguaaugucucaagucuauguguacacaauaaggaaaacagaauuggagaggcuuauguugaguuuuaaaagacaacuucucugaaaucaagcugacagaaugaguuggagaugaggaaaguauguggcaagggcaccucaagcuaaggaagcaagaggaaaggcggagaaacguguaucagcagagcauguuuggaagugcaaauaguuuagcauggcuaaugcaaaggggaaacagagucaagagagcugauaaagagggaaauguggaaaagcagcacacuaaaaaauaagguaaagaaguaagcgaggaucacucuccagaagauuguguaugccucauguggcagagacuacugguggucuuccaauacccauuccccacuuaucuacaauaacaggccuccuguagcuagacacaaggccccccagacaagacucucuuucucaauaucucuugcagcuagaacuggcagccaaguucuggccaaggagcugagagugaaaaugauuugcacaucuucuggguuguccccuuaaaggaaagggcacauccuccucuucuccauuuccuuuuucaugcugguucugacaugguggugaaauauccaagaccagguaaaucagaaggaacuggauuccugaaccaucaccuaaguccuaagagagaauaaacuucuaacuuguuaaagccaucugacuuggaucucgauuauaacagauaaauuaauucagcugguuaaggaguuugguguuaccuuauaagcacuuagagccacuaaauauagucugauuuuuaaaagauugcuuuagcagaaaaauaguggacagagacaaaaaguuuaaagaucaucuuuacaauuuggguaagugaaggugaugccuagucuaaggcagugacugauaugagaauguagaggaggggauaaaagugagagauguaaaauaagguagaauugauaggauuuugucaccaguagaaauaaaaugauaguuguaagggaagaauuuaagaugauuccaagguuucuggcuuaggugacugaguaguagacagugaugccuuucaugacuuuuaaugagugcuaggaggcuuuuucuuucauuucuuugggaaaucaaugaagacuaauaaauucaguguuggcaaaauauuuauuuccuaucccugugacuuuaggcuuuguuguucuaaaagucuaguuucaaagagacgaacacauccacuaggggacacaacaaaugauuccacuaaccugaaguugagaccccaacuuuacucugaaguuccaaaucaagaggcaauggagaggguuacuguauucacuggggauaacugacccuaacuuucaagaggaauuugagugacuauugcacaauacaggugaagugaagugugucugaaaugcaagagauccucuaggacaucucuuaguauuucccauguccugagauucaaguccacggaaaauugcaaaggguuuuguagaacugcaaacagcagaaguaauucagaaagaacugcuaauagcccauaucuuucaagaaugaaagccugggucaccccaugaggcaaggaauccgaacuggcugaaguacuuacuuagagcaaagggaauauggaaugaguaguggaagaacauauauaccagcuaugaccacaugaccauugcagaaauauggacuacaauaguuacaaauauuucuuccuuaauuugauauauuuguguuuaaauauguguguguguguguguguguguauuaaccaaauauuuuuugguucauuaguuuucuuccuuauuaucuaacauguguuaauaagaguuaaccuuauauuucaguauuuaaguuacagaacaugaaagagggagugugaaucagguggagaaggaugaacuaauauuaucuuaaagacaaaaaaaaaagacuuugugugcuuuucuggggaaagagaauguuuuugguuguccagcaauaaaugucucauguuaggugugaaaaucucccugugacccaaccuaaucagaaacauaugggaaagacugccaggcacgguggcucacgccuguaaucccagcacuuugggacgcggaggcgaguggaucacuugaggucaggaguuagagaccagccuggccaacauggugaaacccugucucuacuaauagaaaacuuaagcugggcaugguggcgugugccuauaaucccagcuacucggaaggcagagguaggagaaucacuugaacccaagagguggagaaugcagugagccugagguggugccacugcacuccagccugggugacaaagugagacuuugucucaaaaaaaaaagagagagaaagggaauuuugggaaauggaguuuagcucagccaaguugaccuuuuacaaacccauugcaaggaacucaaaaauacacaaacccauaauaaacagagagaggagguaaucagaagaugaaaaucuuguuuguacauucugaaagacaaagaacaaauaugagugguaacuuacagagcaggaagaaaccaguuuagaguacugauggcagaaagggauaaaaucaaaagaaggcuggcuugcccagagaaccucagagaaggucaggauucucagacacuagggggugcuagggaaggaaaggaguaaaacuuggggcuaaaaauacguaaaucuauauucggaaccaucaaccagccuuuccuuaggcugaaugucucuuaaauccuugaauuugagaguccccuagcaguaguaacaguuccuuacccuauucacauaaagcagaaaccugacagguaacaagccccucucauauacacagagcucccaaucaguuugucagugucuuccaugcuuaaacauaaaugcacagccaaggauugcuagauauuugaggaacacguccaaaaugaaagaaaaacuaaagauaaauaaauaggaucugaauuuggagaaaacagaaugcaaaaagcagaaaagaacuuucaacucaaauuguuauccucagagagauucuuaaagagacugcaucuauaaaucaagaacaaugugcuauuuauaaaaaagaucaacgccagaagaaccacagaaaaaaaaauuuccaauucucaaaauaaaagaugcaauaaaggacuagaaguuaaaguaucucaggaaguacaacaaaauguaagauaaaaggcacaaagauaaucaauccaacagauccaaaauccuacuaaugaagaguuccagaaacagaaaacgagagaaaaaaaaugaaugaagaaauagcacaaagaaaugucccaaaguuaagagauuccaaucucuagacagaaaggggccagcauacugacuacucaguacaauuaauaauaaaacuaaauaagcaaacaaaaaacacugaaauuucagaauaccagagauuuuuuaaguuugggagagaggaggucaccaaaacaggaaaagaaucagaacaguauaacaccuacacaaugugauagaacaaaauagaacaaugauccuaaaaccuugaggaauaauuaucuucaacaucauauuuuauauccaaauuagcaaguaagugugagauuagaauaaagacauugucagauacaggacgacucagaaaauuuaccccucacccacacuuccuuagcaaguuacuugagcaugcacuccaggaaauggagguacugaaugguaacaggaagccaugagauucgauaaacagcaaaucacauuccggagggucagcaaggggaaugcuguaguuaacacccauauggcagaguguugaggaagaacgaaaacuuuauuuuucaggacaguuaaauaaauauguaauaucuaaaauguguaaguguuuaaguagugaaaagggcaacauaauuauuuagugcuaugaagauggcgaccaaaagaaacagcuaaauaauugaaagaggaugccauuggcaaaaacauuuggagggcauggagcaguggguggccauuuggcccaauuuuuuuaaaccaugcauaugaaucacuuugauaaaaauguaaacuguaucucuuuaaagggcacagagagaggauuagcucucaucagaagggccgcuucuccugagacuacaagauuaugagcaugcuaaguaaagcuaaggguuagaagugagauguuuuacugggcuugauagguaaacuugauuuccuguaaggcaggaagcuaaauuauaaauauaaugcaaaauaaaaauguuugcuaagauugagaaagcagcacuagaguagauggucuaugcgaaguagugaaggcuuggcagagcuauaaugggcaaaggcgaaagaaggugaccagaaacuugucaaaguauauacaucacaaugcuaaggauggagaguauauauuuacagaaggaaaaaaaaguaugccgcuuuagggcuugugaaggugugguuccuuucucggaauuacacuuauuaauuuaaagugccucaauaauauaucagaucauuaaaguuguauaaaaucauuugcuauguauuaaauguagcaauuauuuguucacauaagugauaaaagaagacuaucuuccacaauguacaagaguccaugagagaccuuauuaacauguuaucuaguauucuaaucaaauucuaaauaugagcaaagucccuuccuaacaaaauugugaaugccuugagaauuuuauccaugacugacauuuuggaagaagcaacuuucacugaacacauacugauugucagguaaugagcuggugcuaaaaagagagucaugccuaaccucaaggaguucacuguccacaggaagagugagacaauuaacucaacaauuagaacagaauuugauaaauauggaacauguuugucuugcuaaccaaaguauucccaaugucugauuucauuaaauaaucccaaucuguaauuacugaagugcugccccagggcaggaaaaauaggaauaaauaaagcaaagaauggcaagaagggaauuccagacaaagaaaagagcauguguaaaagccagaagaaaggacaaaggaaguaggaggcauuaaaaggugugcagauaagaggacauggcagaaggguugaaaggguagggugcuuuguuuucagaccaaauugcugaucaacagccaaggcccaucauuuuauuuucauucugggggccagaaauuguugaaaccauuugaaauacacuuucaacacuacauauaaauggcaaauauuuaucacuauuugauuuuuuuuuguccuuuucugagacagggucucacucugucacccaggcuggaaugaaguggcaugauccuagcucacugcagccuagacuuccuggguuccagugauccucccaccucagucccccgaguagcugggaccacaggugccugccaccaugccuggcuaauuuuuuaugucaccaggcucggauaauuuuuguauuuuugguagagaugcggauucaccaaguugcccaggcuggucucaaauuccugagcucaaguaauccaccugccucagccucccacagcgcuaggauuacaggcaugagccacugcaccugucuauuacuggacuuucaaauuuucaaaguucaaagauguuacaaaaugacagacucaaaaccguuuucauuuauaaaacuagagaccuuuuaaggcuuuguaacaaauauaucaagagauacucauauuaaaaaucuguaugaaaauaagccaccuuuaaauauaaugaaauacuaugacccuuuugacauauaaaaacauguauuuaaaauauaguagaaacauuacauaaauucacuaaauacaaucacauaaaaacgcaugcauuguaccuugguaagauaaaaagaaaaauaagcaaauaucugguuuuaaguauuuagaaaguguuuauuuguauaguuaaguguguuauaaaucucuuaaaaaaccccuaaaacuagguauaaauaccuuagaauuauaaaaauuucaaaauuugauauaaaacuccaaaauguaaaaaccuaagagguaugaugcaguuauacaaauacuuuuaaagaagguauuuuauguauuauacuauuugcagaaacauauuaaaauuaacaaaccaugggaauuacaagauaccaaauuuuggaauuaaauuccuuccuguuuucuuuucacgugaaauagcaccuguuuucuaaauauguauaaccaagguccuaaaauuaaaauucccaaagauaaguuaucacuauaaacaagaacaaccauaacaaauggaaauauaaagaaaaccuauagcacucacagucccuuacuaauccuaguaagauagcuauagaauggaaaaaguccacaauuccaauccuaaagccagucaaaacauaguugugacugaucagaagccuugauauuauaaagauuucaauucuuccuccaaauggucaauggauucuaugcaaugcucaucaaaauucuagcagguuuuugaaaacugacaagcugauucuaauaagaauaaucaagacaaucuagaacaggggucagcaaacuauggccuauguuccaaauacaguuaaaagugaucuuuuuuacauucuugaagguuuaaaaaaaaaaaaaggcugcacaugguggcucaugucuguaauaccaacacuuuggaaggccaaggugggcagauggccugagcccaggaguuugagaccagccuggacaacacaggcagaucccaucucuacaaaaaauaacguagccaagcauggugggacacaucuacaguuccagcuacaugggaggcugaugugggaggacugcuugagcccaggaggucaaaguuguaaugaguugugauccugccacugcauucuagccugggcaacagaguaaagacccugccucaauaaaauuuuuuuuaaaugugaaaaaaaaaaaaaaaagaaaagaaagaaaaauauuuaacagagaccaaaugugacccacaaggccuacaaauauuuaccaccuggcccuuuauaaaaagcuugccaggccagggaugauggcucacaccgguaaucccagcacccagggaggccaaggcagauggaucaccugaggucaggaguucgagaccagccuggccaaaacagugaaaccccaucuguacuaaaaacacaaaaauuagccgggcaugguggugcacaccuauaaucccagcuacuugggaagcugagacaggagaaucgcuugaacccaggaggcagugguugcagugagcgccacugcacuccagccugggugacagacugagacuccgucucaagaaaaaauaaaaaagaaagcuugccaaucccuuaucuagaagcacagaauuggaggaccuacacuaacagauaaauuuauuguaaagcuacaguaauuaaaauaugacacuaaugcaaagacagacaaauagaccacaggaauggagaguccagaaacaaacucauuuaaacauugaauuuaugaugaagucacugcaaaguaguagggaugacuucuucaguaaaugguguuggggugaacuggauaguuauucggaaaaaauaaacauugaccccuaccucacgcuauauaaaaucaguuuuauauggaguauugauuuaaaaauaaaagguuaaagaaauaaaagaagaaaaaguaaauaauaauacuuguagccuuacgguuucuuuucuuucuuuuuuuuugagucaggaucucacuauguugccuacguuggagugcagugcacagcucacugcugccuuggccucccaggcucaagcgauccucccaccucagccucccacauaacugggaccacaggcacaugccaccaagccuggcuaauuuuuuacuuuuuguagagacagggucucacuauguugcccaagcuggucucaaauuccuaaccucaagcaauccuccugccucagccccgcaaagggcuggaauuauaggugugugagccaccaugcccagcugacaauauauuucuaagaacagaaaggaaauguggugugguaauucacuuaguuauuaaacaggaaggaccuuaucuuaucacauauuuuguggcaagaaccuggaccaucucaauuugcuaaaaggauaugugacagaaggccaggcgcgguggcucacgccuguaaucccagcacuuugagaggccgaggcggguggaucacgaggccaggagaucgagaccauccuggcuaacacggugaaaccccgucucuacuaaaaaugcaaaaaauuagccaggcguggcggugggcaccuguaguuccagcuacuugggaggcugaagcaggagaauggcgugaaccugggagguggagcuuguagugagcugagauugcgccacugcacuccagccugggcgacagagcgagacuccaucucaaaaaaaaagaaaaaaaaaaaggguaugugacagaauuauuucaucuuuuaagauguuugugugcccaaauuuaauggaugaaaagaguuugucuuuaacauuuuuuucacuaucccuuuauuuuuauuuuugagacagacucucacuccgucacccaggcuggaguacaguggugcaguucugcaaccucugccacccagcuucaagcaauucucaugccucagccuccugaguagcugagauugcaggugugcacaaccaugcucagcuaauuuuuguauuuuuaguaaagacaggguuuucccauguuggccuggcuggucucaaacuccugaccucaagugauccgcucgccuaggccucccaaaguacugagauuacagaugugagccaccaugcccggccccuuuauucuuaaauucuguaaauuauuuguaaaauuacuuuaaacuuuaaaauacaaaggguccauuggaccuaaaagguaaacgguaaagacuacuuuucuacuauacugagaucaaacugucuuacugcagcguuuaguuucuuuuuuuuuuuugagacggaaucucguucucgcucugucacucugucgcccaggcuggaguguagugacucgaucucggcucacugcauccuccaccucugcauucaagugauucuugugccucggccucccgaguagcuggaauuacaagcgugcaccaccaugccuagcuaauuuuuguauuuuugguagagcuggggcuucaccauguuggccacgcuggucucaaacuccugaccucaagugaucugcccgcgucagccucccaaagugcugggauuacaggcaugagccacuguacccagcaugcagcguuuacauucaagugcucauuaagaaaauaaaaaguccugcagugagaaauuuguaauacauauaauggauaaaaaacugauguguagaauucacaaagaacuccuacaaaaucaguaagacauaaaaccuagucaaaaaaugggaaaaagacuugaaucagcauuucauaaaagaggaaauacaaauuaacaauaaucaaauaaaaaaagugaaaccucauuagucaucagggaaauguaaauuaaauccauuaucaugauaccacuaaacauccacuaggauugcuaaaccuuaaaaguuuaacaauaccaaguguugauaaggaugcaaaaaaacugaaacacugaaacacugcuggugagaauauaaacugaaacaaccacuuuggaaaaauguuuaacaauacccauuaacgcagaacauguauauacucuauaaucaggcaauuccaauccuuaauagauauccaaacaaaauuaaacacacacaaacaaacacauacaucuaaagggacacauacagcaucaaaagacacacagcagcacuuuucauaauaaccaaaaaacuucaaugaccauuaauauuaaaauggauaaacagauuguguuauauucauacaaugaacuauuguacaggaacgggaauaaacuacuacuacacacaacauggaugacucucacaauaauacaaugucaagugaaagaugccagacucaugaguacauacaguauuauuucacucacaugaaguucaaaaauaggcaaaacuaaucuauggcucaguauagcaguuaucuuugggguauuagaaaauaacugagggggaugagggagauuucuugggcaccaguaauuccuauuucuugaucuaguagugauaccaugugugccuuuuuuuuuuuuuuuuuuuuugagacggagucucacucugucacccaggauggaguagaguggcacgaucuuggcucacugcaaccuccgccucccggguucaagcaauucuccugccucagccucccaaguagcugggacuacaggcgcauguuaccaugccagcuaauuuuaguauuuuuuaguagagaugggguuucaccauauugaccaggcuggucucgaacucuuaaccucaugauccgcuccccccucagccucccaaagugcugggauuacaggcaugagcaaccgcaccuggccaaugugugucuuuauuuugugaaaauucacuaagcugaacacuuaaaauugugcacuucucuguuacguuucaauaaguuuuauuauaugugaaaaaaaagguccuggaaaaccaacauccauugauaugacaguuuucuggaccaacgguagucuucuggaagacugagugaauccaaugauauacacagugucaaaacagcuccccuagacucucaacaaugugauauguuauuuacaugucaugcaguuuugucacaugacuuuuuagaaaucucguuuuuauaaagcagcuuaaaucuggauuuugcaaaaacucaaagccauuuacaguacuuuauuuguaacagcauguuaucaguaaauuuguuuaguuguguucuaaacucuuguuuuucuaaucagcuuugauuauuuaaaaaaaguggcuucucauaucaguuauauguuugauagcaaaaucugaauuagaaauacaagaaguucacagguuuccuuaauaguauagauuauucuuaccucagucuuguucacucacuaaccagcuucccacugauuuuuuaccuaguuacacuggagaaaaagaacuaugccuggguaacagucccaaacuauacucuauaagggcugagugagcaaaagcagcagggggugacugaaauggcaaugacauaagcuaguuaggggaaacguuuucaaaacaagguggauaaugugaguaggauccaauucaaggauuaaaaagccauccuuaucaaagcugcagaugaaaaugcugaagagggauaucacauaccuaaaacaauauaaucaucauugaccaagauuucagcagacugaaaugauggugcaaaccuaacuagaaaacaaucuaaagagaaauguaaagucuuagaaaaaggaacaagaaaaacaaaaacaaaaaaccaaccacacaaguucaggauaagagagacuuggcuuaauaaaagcuaaugugaaaaagaccugggaagcuagauugauguuaaguucaacaagagucaacacugugagagugcugaaaaaaacaaacaaaaaagcaauuuguuaagcuauacaauauaagcacauuauuuauaaugaaguugguacuaggcccaugcuccucugcaucugaaguaaguguucauucugaaggagacuaacaaacuaaaggcccuucaaaggacagugagcaguacagcaggaugagguuagaaacaauguuaagaugaaaagaaucugaguugugauuggcagagcaaacugggugagguagggugagggagacaugaggguaauaguuuuuaaauaacuguagugacaugcuguagaagaggcauaggauaauucauucuguguugcuccagaggcaaaucuagaaucaacagauaaaaguuaaagaaucacauuuagguucaauguaaaaaacaaacuuucuagaaucaaugccuuauauggcaguguuccuaaucacaaugccaauguuaagcauacaacugcucaucacagaaaguacaauggacuuaaagugggucagaaguccuuggauucuaaucucaucuugaccauuuacuagcuguguuauaugaggcaagguauuuacaaccucucugaaucucagcuuuucuuauguauuuauuuaccuccugauaucacuaagaggaauaaauaagaugauaugugcaagacucauugugacaaacugaaauggaauacaaacgugcguugccguagacagauauauuagauaauugcuaauauccucccagcacagagauuauuaacuugagaaguuauuuucuucugaagacaaaacuuaaaauagguccuaaauucacacagccaagauuuaguaggcaaagagagaaaauauuaacaugacggaaaucaagggagcaggaaauguauguuucaugagguguuaagaauguacuucucugauagcaaauuaguuaccagaucuaaaaggcaaugcucauuccaggagauuaagaacgaauucaaaucaagaugauacacaugccaaauaagcacugacaguauaggcuugaaucauggcaguaaacagagcuuaaauaguacuuuugcuuuggggacccucuagacucaacuguaccuauucugggguucuacucacucugcuaaauaauccugacugagcaaguuacgcaguccucucagugccauuuuguuaagaguaaauggagaauaaucugccuacuucacagguuguugagaagacuuccaugagauaauaauguguguaaagucucuagcaaggcuucuugguacacagaggaauucauguuaauugcccuuucucuuaacuuugauuguggauggaguuuugugccacacugcuuucagaauuauaagcuuggggaauaaaagauauauuuuguuuucaaauguuaaaaugagguugaaaaaaaugaugauguagauccacugauacugagaugaaaaucuaagcaauacgcagauugguggaaaaauaaguuauaagauaaucuacucaguaugaucccauuucugcaacauauauuuuuaaaaugauucucuccagaugguggaauuaggugacuuucacuuuuuucuacacuuuucuguaauguuugaauuuuguauaaggaguacccauuucuacuacaauucccaacugagaaaaaaacugauuaaaguauuuuucuggcugagcgugguggcucacaccuguaaucccagcacuuugggaggccacggcaggcagggaggccaaggcaggaggaucgcuugagcccaggaguuugagaccagccuggucaacauaggaagauccccaucucuacgaaguauuuuuuaaaaacuggccagauguguuggugcgcaccucuggucccagccaccugggaggcugaggugggaggacugcuugaacccaggaggaagaggcugcacugagccauaauucuaucacugcacacuagccugggugaaaaaccgagacccugucucaaaaaauaauaauaauuuccauagaaaaguuaucauuuaggucaacuuggggagaaaaaucuauuuuuacaaacuuggaaaaaaugaauuuaacaguuuuuagaagguaaagagaaaaaacuuacacaccagcaauuuuuuuucuuucuaaauauguuguucaggauaaacagaaguaucuccuuaacuggggaaaauauaaaggauguaagcuccaugggggcaggaauuuuauguguucugcuauauucacugcucuaaguacaagagcaggaacuuaaauauuugcugaauggauaaaauaaaaguccuacuuaccuuaugcuaaauuucacugccucaagccaguagaauauuggcuuauucaucuuuaucucuaacaacuaacaaauuaucuaacaaauaguaauugccaauucaauuauuugucaaaugaaugaaaaagcaaacaaaagauaaaguuuaauauuauuuuuaaagcuaauaagucaauacaaaaugauuagcauuacucuacaauacuacauucauucuggauuauaaucucuacauauaggacaaaagcagagacaucaaagaaaugggggcauguuaccuuuucuagauuacauacgugaugucuuaacaagcagacaauauaaguacaaagagaguauaaacauuguauaaaugaagcuuuuuauaccaucgagaaccaaauagccuaagucaauaaaauagccaaaccaaaaaaaaagagaaaaaaaagcagaccuaccuugggccucuuggacuuuccaaguaacuacuucuaggaggaucuggaagcaggccaccugaucucacuggcauguccuucacugcagugauuggcugagauggagcagcugaagacuccccaaguccuugaucagaugagaaugaacuguauggcagagcagacuugcucaaaggagcuuuugaauucacuuguucugauggaccagcugauugcaacggaggaugguaaguugucgguggggcagaaccaaaagacacaggaguaggaagcagugcuggucuagguuucucuggaacuugcgagcucugugaacuggaggcugguggaacuggggcugcuguuaacugaggagguaucccuuguggaacuccagggggagguauuccuggaggagguguagcugaagacaauggugggaggggcaugacagguggaggugcuguugaagagagagauggugggggaagaacuggugguggcccugcagaagacagggaagguggggggagaacuggugguggcccugcagaagagagagaaggaggcaucccuggugggggaacagagguugguagagaagguggcauaacaggugggggcaugccaggugguggcacuguagcagggagggcagggggcaucacuggugguggcaaugaaggaggcaacacuggagggggcauuguagguagagguggaggcaucugagaauauggaacaaaaggagguggcauugacauguuccccauauacugguucuucauguucugaaaugaauugacuuucuccuggagauagcucugaguggcuuucauaugucccugccauguuuuccacugcuucucauacuccugaagcugaucuuuaugaggauaggaauggaguuguuccucccauagcugaaacucucgcucccauucuugguaaagauguugaaacuguugcugcugcaucucauaaugccgcagcugcauaucuacagacauggucuacaaauaaagggauaaaaacuauuuaaaaccauucauauaagauaauuaaucauagguuaaaauauuaaugaaucaagggcauuugacgcuuuaggaaauuagaacacuaaagacuuugggaggcuaagaauaaguucguuaaguucuuugagugaugaucauucuucuuccuuccuuuggcuuagacaacuuacuacagaguuggaaaaaccaaccaaacaauaaagcaaauaccuaucuuagcaauaaguauuuuucaaguuuuuaauauggauaauuucaagaacuugaaaaaugaucuguuauuauagauauacagacacaacauuaccccucaaagauacaacacaaacaaguaucuaagucacuuuaucuuuuacgguauauuugcuuagguuuuuugugauggcuguuuuuggccucuuugcuuaucuguuacuguuguaguuuacaggcaaaacacagguuaaccuguagcuauaugguaaaaauccccagcucuuaagacccuuagcaauaguaagcuaacaucuggccuggguugacaugaucaggaaacucuacuauaaccaaccccuccccagucccccagguaauguggcagauaacuacuugggcaccccuugggaaacaacuaauugucaacaguugguaucuuuuguuuuuuacacuuaaaucuuucaagaauaacaaauccuuucaaugucuuggggcaacuuccuauuguggacuauggaagcacuugccuguauauguggugggggcuguauaaucugcugauacuguuguagaaucugcuguaacugagugugcuucugcauuauucccugauacuggaaaccgacucgaugcugcuggugcugcugccagugugcugcugcagccugcaacugcuuuaaccuggcaucuucuucuggguccucagacuaaagauaaaagaggacacaucuuuauguaagucauaaaacagcaagcaaaaauauuuuauaaauguauuauaaaguccagaaucccuacaacucagaaauauccaacugucaaacacaguaucuucaguucuuuuuggauugagaacagcuauucuaucuuuagauaaaacacauagcucuaucuauacuauuauggauacuaauacaaaggaguuuauaaauuccauagucuucacuggaauaauaaucuuauuauuccuaaauaugacaacaauuuucccaguggaaaguggucccaggccgggcaccauggcucacaccuguaaucccagaacuuugggaggccaaggcggguggaucacuugaagucaggaguccaagaccagccuggucaacauggugaaaccccgucucuacuaaaaauacaaaaauuagccaggcaugguggcagguaccuguaaucucaccuacuugggaggcugaggccggagaaucacuugaaccuuggaggcagagguugcagugagccaagaucgcgucacugcacuccagccugggcgacagagcaagacuccaucucaaaaaaaaaaaaaggaggggaggggaggggagggaagagaggucccagcuacuuggaaggcugaggcaaggaggaucacuugagccugggaggcugaggcugcagugaguugagaucacaccacugcacuccagccugggcaacagagugagacccugucuggaaaaaaaaaaaaaaaaagugaaccuuaaguuauagaccuuuucacucuaugaaaaauccguuucuuuuuuugucacuuuucaccaauggacuacaauauaaccaucaugguuugauuaaacccuucauauaaggcucuugggagaacaaugaccuuuggaccaauaugagaaccucccaugugccagucacuaagcugagugacaagaauuaucacauuuaaugcuugaauaccucuauaugauagcuacuauugaauauacccauuuugcagaggaguaaauugaagcacagaaugguuaacaaauuugcccagucacuacuggcaaguggcaguaccuggauuauagccuggguagcuugacucuaaaagcucaagcacucaacuauugcccugugcugucacuaugaacauaugcuggcaucuuccuuuagugcuuagaggcacucaauucagaagaguauccaacucuucacucaaacuaggaaaaauuuccuuuucuaaaccugauacaacaggccaggcaugguggcucaugccuguaauccaagcacuuugggaggccgaagcagguggaucacuugaggucaggaguucgaaaccagccuggccaacauggugaaaccccaucucuacuaaaaaauacaaaaauuagccggucaugguggugcaugccugucaucccagcuacucaggaggcugaggcagaagaauugccugaaccugggaggcagaaguugcaguaagccaagaucgcaccauugcacuccagccugguaaacagagagagacccugucucaaaauaaauaaacaaacaaauaaaccugauacaacagacaucugauuucacaaaugcaacuuuauagguaccuaaaaaaacaaaaauauauauccauuuaugauaaaaguauacuaaaugaaucagaaaaaagcuaaauaauuuaauaaacacaaacaauuaauuauaugguuaccugggguuccucaggugggagaggagguggcacuuccucauuuggagguggcaaugggggcuccucagaagaaggagauucuggaacuugacugguggcagguacuguaacuucuucuuuuaccggcucugguguauccuuugcuaccacaggacccuuuuuguguccuggcaaaugaacuuuuguccucuguugcaaacuaagcaagugcugucgauaccaauacugcugcuguuccuacaacagaaacaauuuuugagaauuuugauugacaaucauguaucucugcaacuugguguugacaaggaccuaucuuuaugucuguguucaugugucuauauguaaaaaaaggcaaagcuagacugaggaagacaaauaaguuaacaagaucuuaaacacaggcuacagaaaaauuucaguuccucccccaaauuuauacauuuaaauuaaaccauacauauuaauucaacaugcuucuguacucuaauaaaacacaugcuuuuggagguaagagccaucuuuuugauaaaugaucaggguaaaucucuucaguauucacaacuacuuauuuuuaaccuggcuucaguuuguuccgauuuauugacaggggucuuguaauuaaugaauauaacugaacaguccuaccucucuucucugccuucucucuuucuccucaagcacuccucccucuuuucuuucuuuuuuuuuugagacugcaucucacucucucacccaggauggaguacaauggccugaacauggcucacugaagccucaaccucccaggcucaagcaauccucccaccucagccuccugagcagcuggguucguaggcaugcaccaucacgcccagcuaauuuuuuuauguuuuauagacacaaggucuuacuguguugcccaggcuggucucaaacuccugggcucaagcaauucucuuaccucagccucccaaagugcugggauuacaggugugaaccacugcacccagccuccucccacuuugaaacaccuguuguagcauuagucuacccauacucagauguacacacauauaagagaauaugcuguacacacauauaagagaauaugcuguguuuuauuuauuuuuuuuuuuuugagauggagucuugcucugucacccaggcuggagugcaguggugugaucucggcucacugcaaccuccaccucccagguucaagugauucuccugccucagcuucccgaguagcugggauuacaggcacccaccaccaagcccagcuaaauuuuuuuauuuuuaguagagaugggguuucaccauguuggccaggcuggucucgaacuccugaccucaggugauccacgagccucggccucccaaagugcugggauuacaggugugagccaccgcaccuggccaauauacuguguuuuaaaaugcuuucuauuuauuuuaaaagccuuagcuuuaucuuccaaauuaugcuguacuuuaauuuucugaaagcuuauuuugugcuuucauuuaaaaauuacaacaauaagcuuaguauggaaauauuagaaaauauagccaauccucauuauucuuggauucuguauuugcaaauuugccuacuugcuaaaauuuuuuuuucuuuuuuugagacagggucaucucccucugucacccaggcuggaguguaguggugcaguuucagcucacugccaccuccgccuccugugcucaaaugauccucccgcuucaaccucccgaguaacugggaccacagguaugugccaccaucuggauaauuuuuguauuuuuuguagagacaaguuucaccauguugcccaggcugguuucaaacuccuggacucaagugauccaccuuggccucccaaagugcugggauuacaggcaugagccaccacacccgaccuaaaauuuauuucuaaacccaaaauccauacucacugagcuuucccagucauucacaaacauguggacagcagugaaaaacaugaguccccugacucaugugugcauucccagccgagaugaagugcaaggugaugcucugccuucuuguuccagcucuauacuauaaauaagugucauuuucagucuauuuagagacacauuugucaaacuuuugugcuuuuuuguugauuucacuauuuaaaauggcccccaggcauagagcugagaugcuguuuagugucccaagagcaagaaagcggucuuaugucucacagagaaaauaucuguguuaggucagcuuuguucggacaagugcuacagugcuguuggccaugaguacaauguuaauaaaucaacaauauguacuaaauaagguucuuuaaacagaaacacacauaaacaaggcuauguguucaucaguugauaaaaaugugacaagagacucacaggaaccuaacccuguauuuccccgaggagcacugguucaguauucacuaauucagugucuguggugaguuuaaaaaucucaaauaaagaaaacugacuacacagguaaguaauaacuaauuaauuaaaaucaauaaaagaaaucucaccacucagaaaaaaacuacaggagugucauuauccuaguauuauauaauuucccaugguuacaagguugcauaaagaaaaccaaaaguuaucauaacacuaaaauauucacugaugaacugcccuguauacuuauaugacuaacaaaagcauaugauucuacuacaauuguauggauguaguauuucaagaaagugauguuggagaacauuggaacuuauuacuggcagcugaggaucugcuagaaguccuaccaguuaacaaccgaacaguacuuuacaguaaaaacuauaaaagagaauggccugaauaccaaagguugaaaaacaguccguauaaaaaucgauaaaucccuaaaauauuuuuucaacaugucaaaaaaugaaauaaaagaugaucuauaauguuguuauauaauuuucccacaaaaauuacagcaaagaaacccaaucuauaguuuauucuuuguucauucuaaaacuuggcuaugauuucauuuauaacaauuccaucaaauauaaaaucugcuuauccuuaucacuuugagcuuuguuuuuccagacugggucccaaucaaauguuuuauguuuuacaauaaacuuuugguuccuguguuaaaugaauucacuuuacuugccuauuuucuaauccaauuaucucuggauaacuaggauuuccuacacuguuaauauuuuauaguauaaccuccccuaauuuuccauaugcaaacagaugcauuaaauauacauaauacauaccuuuuucucaccaaacauacugauuuguuaccuacuuuucacucaaagaauguaauuuuucuuaggggacagcugccuuccccucuuuuuauauccuaucugguagucaagcauagugcuagagcacacaguaggaugucaauaaaugguuauugaucaacugaagcccuucccucucggucacucauuacuauuaccugaaacuuguuccaaucuauugggaagaauaaauuccaucucauaaacuccaucuugacguuuaacccaugacuggauuuuuuguuuuuaacuauuauacauauaaucaucagcucccaggauauaauuacagauggucccugacuuaacaaugguucaacuuaugauuuuucgacuuuaugguggugugaaagugauauguauucacuggaaaccauaccaugaauuuugaucuuuucccaggcucaaaauauucaguaugauacucucuugugaugcuggacagcagcagcgagcccuaggcuccuagucagccacacaucaugagggcaaacaaucaauccucggccaggugcaguggcucacaccuguaaucccagcacuuugggaggccaaggugggcugaucaccuaaggucaggaguucaagaccagccuggccaacauggugaaaccccgucucuacaaaaauacaaaaaaaaaaaggcggagcgcaguggcucacgccuguaaucccagcacucugggaggccgaggcagguagaucaugaggucaggagaucaagaccauccuggcuaacacggugaaaccccaucucuccuaaaaauauaaaaaaauuaaccuggcaugguggcaggcaccuguagucccagcuacuugggaggcugaggcaggagaauggcaugaacccaggaggcggagguugcagugagccgagaucacgccacugcacuccagccugggcgacagagcgagacuccgucucaaaacaaaaaaaauacaaaaaaauuagcugggccauggucgcaggugccuguaaucccagcuacuugggaggcugagacgggagacucgcuugaacccaggagguggagguugcagugagccaagaucgcaccacucacugacuccaucucaaagaaaacaaaacaaaacaagaaaaaaaccaauacucuacuguguacuguguggccagaugacuuugccuaauguaaacuuucugagcacauuuaauagcuaggcuaaacuaugguauucaguaggcuagguguauuaaauguucaacuuacauuauccucaacuuacaauggguuuauugagauguaaccccacuguaagucaaagaguaucuguacuuuuacuauucaacguaagaaaacagcacacuuggccaggcacaguggcucaugccuguaaucccaguacuuugggaggucuaggcgggcaggucaccugaggucaggaguucgagaccagccuggccaacacggugaaaccucgccucuacuaaaaauacaaaaauuaguagggugugguggcacacaccuauaaucucagcuacuccggagggugaggcaggagaauccccugaaccugggaggcggagguugcagugagccgagaucgugccauugcacuccagccugggcaacagagaaagacucugucucaaaaaaaaaaaaaaaaaaaaaaaaaaagaaagaaaacagcacacugaccaugaaagccaaagccaauaauaauaauaauguagcauuaaaacacuuccuuccauuauuuuaauacugaaaacaucaacagacuuauccuucaguuuuaaaaaaauuaguacauucucuuucaaguagaaguuaaaaguuuccuuuuuuaaaguugcuuugaaagcauuauuaaaagauacaaagaugcaaacuaucuuucacaaacuaagccaaugcuacagauaugaagacuguacagaaugaaaacuguacagguccagauucuuuaucagcuucuucaucaccuauucucaugcuuugucuuagauccagaccaggguuaagaacuuguuaagggcugaaguacuuguugauucacugacaguaugccuuguaggucaauuucucuuuuuuuuuucuugagauggagucucgcucugucgcccaggcuggagcgcaguggcgcgaucucggcucacugcaagcuccgccucccgaguucacgccauucuccugccucagccuccugaguaguugggacuacaggcgcccgccaccacgcccggcuaauuuuuuauauuuuuuaguagagacgggguuucaccauguuagccaggauggucucgaucuccugaccuugugauccgcccaccucagccucccaaagugcugggauuacaggcgugagccaccgugcccggccgccuuguaggucaauuucuauuuaauaugaacccuauaaguaguaaccagaucuaauucaauccuaugguaggcuucagcacauuuuugaagcucugcaaauaaauaauaaugauaucacucacaaauguccuuacugacccuaagagaagugugaucaucccuauuuuagaaagaaaaaaaaugccugaacuugcuaaugaugccagcucuucugaaugucccaucauaucagauaacuccauuucauaugggauguuguuuuauagguagagggaaaucauaauauaggucacauuuaaaacgagauugaaugaagggauuucaaacauaaagaauguagaacuauuggcugggugcgguggcucacaucuguaaucccagcacuuugggaggccaaggcgggcggaucacaaggugaggaguucgagaccagccugaccaacauggugaaacccugucucuacuaaaaauacaaaacuuagcugggugugguggcacaugccuguaaucccagcuacucgggaggcugaggcaggagaaucgcuugaaccugggaggcggagguugcagugagcccagauccucgcgccacugcacuucagccugggugagagcgagacuccaucucaaaaaaaaaaaaaaaauuaagaauauagaacuauuugucacaaauacuguuauuaagaaagaugcugccgaggcacgaauaucgcuugagcccaggaauucagaccagccugggcaacauggcaagaucccaucucucugagaaaaaaaaaaaaaaaagaaagauguugauuuuaauuuacucaggaagcacuuacugaccacugcugcuaguaaugaacuagauacuaaaugauuuuccaaguggagaacuauaaaggaggugaguguuuguguguaauguuuuaaagauuaauuuuagaagauuaccuucccuauccagguuaucauaaaugccuauaagacaauguucuaugucuuauauucuaaagcagggggcagggaggacaccugguaaaauaaugaauuggguuuccauuuuagaaauuuauuuaaaauaggcuuaaauauuuuugagauucacauucuacuguaagaaucagggucaccagauaagcuuaguccccaccuauuuuuauuuuaaaugcucauuuacuucaucuauuccuccagcuccuucccucauucucucucuccuucagucaaacuucuugaaagaguugucuguacucaccauccccauuuccucaccuuccaucacuccucaaaucaaugcaauauggcuucagucacuaugaaacugcuccugccaaggucaacaauaaucuacaugucaguaggugcaaaagauaacucgcagucuuuaucuugcuugacgucucagcaguacuucacacagcugacgacucccuccuccuagagucuguuccuugacguucauggcaacgcacuauccacuaucuugauuuuccaccuaucacacuggugccaaaguaacugugguuuugccauuaaaaguaauagcaaaaacugcaauuacuuuugcaccaaccuaauaugaauaccuauuuggccauucuuucauugguucccuuagauacugcuauuuguggagcuaggcuuaauguccuuuaaccucaguucuuacucuacacacauuccuugagaggcuucaucuauuucugugucuucaaauaccauuuuuaugcugaugacuuauaaaucuaugucucccagaucuuacaucuagacuccagagcuauaucuaacuuccaaguggacaucuccauuuggaaucuaugucucaagaaccccaaacucaguaugucugaaaccuaacucaugauuuucuccucacccccagaaauguucuuccuccuccuccuuuagguuuuucuguuuuaguaaauuugaccaccauccacccuacggcccagcccagaaaccuaagaaucauucuugaugccucccucuccauaacuacucaaccucaaagugaauucuagcagcuaaauauuucuccacucuucccacuucucuccaucucaacuaauaccaucaaagucuaaaccacuauuaucucuugccuggauuacuucaauaacuauucucucuaaaucacucuugcuccuuuuaauucugcucuccacacugcaagcagagugagcuuucaaaaaugccaaucugucacauucaccuauguaaaauccuucaauggcuuccaacugcccuuagaaugaaguccuuacaggccuucccugaucuaguucauaccuaccauccucacccugagcuuucagugagccuuauugaacuuaauucuuugaauucuaacuucugguuaauuucuacucuuuuucuuuuuuuuuaacugagauggagucccacucugucgcccaggcuagagagcaguggggcaaucuuggcucacugcaaccucugccuccuggguucaagugauccucccaccucagccucccaaguagcugagauuaaaagcgugcaccaccacacccagcuaauuuuuuguauuuguaguagagacagaauuucaccauguuggccaggcuggucuugaacuccugacuucaagugauccgccugccuuggccucccaaagugcugagauuacaggcaucagccacugcaccuggccuacucauuuuuuuuuuuuuuaggucucacucuguugcccaggcuagagugcaguggcacgagaacuccugggcuuaaacaauccucccaccucagccacccgcaaguagccggcacuacaggcaugcaacaccaugccuggcuagguuuuuuuuuuuuuugagucggagucucacucugucgcccaggcuggagugcaguggcgcgaucucggcucacugcaagcuccgccucccggguucacaccauucuccugccucagcuuccugagaaguugggacuacaggcgcccaccaccacgcccggcuaauuuuuuguauuuuuaguagagaugggguuucaccauguuagccaggauggucuugaucuucugaccucgugaucugcccgccuaggccucccaaagugcugggauuacaggcgugagccacugcgcccggccaccuggcuaguuuuuuaaacuuuuugugggcggggggcgggggggggggugucucacuuuguugcccaggcuggccuugaacucccggccucuaaugagcccaaagaacugggauuacaggugugagcacccaguccuccuacuuauucuuuagaguucauuuaaauaucacuuuacaggcccggcguggcagcuuacgccuguaaucccagcacuuugggaggccguagcagguggaucacgaggucaggaguucaagaccagccuggccaagauggugaaaccucuucuguacuaaaaauacaaaaaaaaauggccgggcacucugacucacaccuguaaccccagcacuuugggaggcugagacaggcagaucaccuggggucaggaguucgagaccagccuagccaacauggugaaaccucgucucuacuaaaaauacaaaaauuagccaagcgugguggcaggcgccuguaaucccagcuacuccugggaguagcugaggcaggcugaggcaggagaauuguuugaacccgggaggcagagguugcagugagccgagaucgugccauugcaccccagccugggcaacaagagugagacuucgucuccaaaaaaaaaaaaaaaaaaaaaaaaaaaaagauaaaaauacaaaaaaauuagccgggcgugguggcaggcaccuguaaucccaguuacuagggaggcugaggcagaaaauugcuuaaacccggaaggcggagguugcagugagccgagaucgcgccacugcacuccagccugggcaacagagcgagacuccaucucaaaaaaauaaaaauaaauaaaauaaaauaaaaacaaauaaaaaauaaaaaauaucacuuuacaaagggaauccucuuuaauuagguuagcgcucccagcuauauucaauuauuuaaaauauauuuguucuccaccuccuaugcgcuagauccuaugcaagguacugugaauacagugguaacuuaaaaaaaaaacaaaaaacaaaaaacuugccuuugccaguuccuuggggaauaaucuagugauauuuuauaaucccauagcacucuguacgucuccucuuaauuacuuacuaaaugucuucucccuucccccacaacugaaacaagaagucaaugagggcaggucccaugucuaucuuguuaaccauuucaucuccaguauuaagcacaguacucauaguaccuggcacauaguugcuaguccguaaguauuuaaacauuaaauaaaugauaccucuaaaaacuaaucaaagccaacagcuuuaacuaaauaaaucaguccuuuaaacacauagaaaaauuaauuauucaaaaagacacauuccgaccgggcgcaguggcucacgucuauaaucccagcacuuugggaggccgaagcagguggaucacuugaggucaggaguucgagaccagccugaccaacauggugaaaccccaucucuauuaaaaauacaaaaacuagccaggcaugguagcaugcaccuguaaucccauauacuugggaggcuagggcagaauuguuugaacccaggaaguggaaguugcagugagccgagauuucaccacugcacuccagccugagcgacagagugagacucucucucagaaacaaacaaacaaaaaaacacauuccauuaaaucaucaacacuuuacccgaaaaacuagaaaacaccuggaaaaauaucaaguauuuaucuuguccuuccuauaccaacuguauuuccaaucaaauaucuguggcaaaaguuuuucuuuacauaacuccauauaguaacuguggaagaaauggcagaaaaaaaaaaucaccagguugcaaccucugucuaaugaaauaauuuacuuaggcaaggucuuucuucaauugaugaaccaguagacugaaacauuagaugcaagauugauagaaagcuuuacaguagagggaccaauggcauuacuaacagugggacaaccaggcaucgggugucccaugaggaaugcaacacuugccaaaagaaagcugaacuuaaaugaagguuccagaguuaacuucuaauucaaaaaaaaaaaaaauguggaagacauaggaacaagucaaaugugacaccaugaaaaagcagacaaugcagaaugucagacauucuacaggaaaacugacaacagauuuuucaucaaguucaaagacaugagguagaaaaagaaaauaggagggacugaccuaggucaaggguucucaacagaggguaauuuugucuccaggggauacuuggcaauguguggaaacauuuuugguugucggacugggggcugccacuggcaucuaauggguagaggucagggacgcuguuaaacauccuacaaugcauaggacaagccccuccacaacaaagaaucauccugcccaaaauguccauagugccgaagcugagaaacccugaucuauacuaagaaucuuuucaguauucuguuuggacucugacuugaacacaccaaaaaaacauuguuugggaacagacugugaggacagaaaacaacaacacuguugagucaauuugggguauuuuaacauggaugguaucaaagaauuauuuuuaguucauuaguaugaugaaacaauaaaggaaaucugaacggaucagguauuagaugauaccaagaaacuguuaacuuuguuagguguuaacaauguguuuaucuaagaaagggucuuggccgggcacgguggcucacgccuguaaucccagcacuuugggaggccaaggcagcuggaucaugaggucaggaguucaagaccagccugaccaacauggugaaaccccgucucuacuaaaaauacaaaaauuagccaggcgugguggcaugcacuuguaaucccagcuacucaggaggcugaggcaggagaaucgcuugaacccgggaggcagagguugcaaugagccaagaucgcgccacugcacuccagccugggcaacagugugagacuccaucucaaaaaaaaaaaaaaaaaagaaaaggucuugguuuuguuuuguuuuguuuuauagagguacuugacuaagaauguagggaugaaaugacauaagaucuaagauuugcuuuaaaauauuucagcagaggccagguguggugguucaugcccauaaucccagcacuuugagaggucaaggcaguguacuguuugagcucaggaguucaagaccagccugggcaacauagcaaaaccccgucucuaccaaaaaaaaaaaaaaaaaaaaauagccaggcaugguggcaugcaccuguagucccagcuacuugggauggcuugagccugggaggcagagguugcagugaacugagacuaugccacuacacuccacccugggugacugacagagcaagacccugucucaauauauauauaugcaacaauaauaaaaaaggccuaggugaaguaaacauggcaaaaucuugauagcuguugaaucucaaugauggguauguauggggaaucauacuuuuuucucuauuuuguguauuuuaaaaauauuucacgauaagaaauuuugaaugacacauuccaaaaacaaaauaugaaucaaagaauaauaaauauguagaaggauugccagagacugguacuggcaugaagaaauauuuaucaucuaauaaaccaacauauccuaagucuagaacaugacaacucucguauuuuauucaacaaaucuguggagagccuacaauuugcaaggcacuguccuaggugcuacgguaauaagaagauaaguaagauaauuccugucugcaagggacuuacaaucugaagaacagaaccaaaccagaugggugagcacaagcagggcuucauggaaaccuugauauuugagauaugccuugaaagcaauacaacucuaaggggaaacagaggguugaggagguuaggaugaauucuaaaaagaagaaagaaagccacaggcuucaaggcucuucuugaucuggucuaugugcaccacaagucucauuuuccaccacucugccucucaccaaagaauugcaggcacugaauauucaagacacugaguucauuacagaaaaggguacaaaggcagaaaaguaaaagcacuguucaugguaacuauacauauuaaggccugaucugacacacacacuccucccaaaaaaagccaaaaauacaauuauuuugucucucuguaaggucagaaaaacagucuaguagagugagaauauaaauguccuauuuuggcucagacuaacugagaauguuugacaacaaaagcacuaaagacuucagaguggggugggaaagaggacagaaagucugucucuauaauagagcaaucuggggaaaauaaacuggugagaugguacaaauuugauguaagccaacagaaucauuauucuacuacuuuauuucagcaucccaaguguuuucuccagaagaugugccaagcaucauuucuuaaaacaacuugcuucuguucuuaauuucuaaugccaaaccaccguaaaauuauaauacugcaucccuaucuuuuggaaaucuuuuauagguaaaucugagcguuuauauuacaagauucucuuuuuuccuuagugaaucuaagguaaauuaguaaucgcugaaaaagugucuacuuuaggaaaucauaacaauugauuuauucugcuuuaguuugaccuucccucucucaagggggaacucguuuauuacuguuacccugucaauuugucuguucugcgggauaagaauggcugacucucucaugaaaagauaucaccaaacuuuuuuuacguuggccaaauugcaaggcuguuucuuuggagugaaugguaaugacaaugaaacgcagaaaauugcucauuaucuuaaaacaaucuuuaaauaauaugagaaaaggaugucugggucaauuccuaaaauggaccaaucgauccccaaaagggucucgggacucaucuauguauuguauauguaccuauaagcauaauuaggaugcuccugguaagacaagauuuccauccuuuuucugaaaccucuuaauucaggaagcugacaacuaucccuggccccuaaguaauauuuuuaaaagaagcuaacuaaucauaaaguuuacaaacauucaagugucagcccuuggcgaggccucuuuuucaugcuuucucucaaauggaaacuuucguuuaaaauacaauuuuaaaacaagacccucugcaacaaaaucuauuugcaacagcaacaaaaucuaagaggauggucaaagaaaccaaggaauguaucugagagguaacuuuugagccaccccaccacuguauguaauccauacacaucuacaaacgcuguuuuuuugguaauucacaucuagcuaauuaaaaagcugagcugucagcccucugacucuuacggaauccuuuggaguguuagcuagucauuguguguuggaauuagacuaaccacugguuaaagcccugaggccugcucauucagggcccucuaggugaaagaugagguucaggcagaugcuuucuuaccuguggagucaucguagagggaucuggcucaggggcggcuugcugcuguucaguacucuuguuuuuggccccacucuccaaaggcucuugcuggacaguugucuuauuuccagggggggcggacgguggugguggagcuaguaguugggauuuagaauggcccugggaggggcgggaaggagaugccugagaagagggcaaguaggacugggaauggcucaaauaggauugcgaggaagaggaggaggaugaguaagaaggggugggcgccagguaggauugggaagguggggacugcgaaggggacggcugagcaggaggcagguagggcugagaugaggucgggggguaguaagaggguggcggcugaggugggggcauguaagacugagaugggggcauauaggacccaggcggcacagggggagauucagggggggauuccagcuccauuggaaccaaaccaggaggcccgucucguuggugguggagcaucugguguuuguacugcugcugcuucugauagcugagggccggcccggguggcgggggcaucgguggcgguggcggcugccagucuccguagccgccccccggcaucacuggcgggggcggcagagggggcggaggaaggugguggggcugaagcacgcacugcauuugcuucuggugcaucugcugcagcugcuggagcugcgccaagugcuguucgcggaagcucaugaagcccgaggaggagggggccgcgggagucgucgagcucgaguacccgggccccggcgaggccucaggaagcgccacuggcggcggcggugggaccgguggcggcggauaguggcugcucccgccauaccggccccaauucggguacauaucgaaaaagaaggcgcagggcucguccuggcgccguuacucgucgcaaccgaccuccaggagccgcggcggcgacggcgacagccggaacucgcggcgccuacaggccccggagcguguaaacggagcgcgccagugcgccggcgcucccgagcugggcccgcgaccg

SEQ ID NO: 17105 - RNA, 84818 nt, Homo sapiens
cacuuccgguuguuguccggcccuauauccgguguccgcccgcccucggcuccuccgccgugaugcugucccgaucccgcugugugucucgggcguucagccgcucgcucuccgccuuccagaagguacggucuggccgagccggggccccgacgggugaggagucuguuggcgggcagagaggcggccuggaaggcaggggcgcggcgcgccggccgggccgggcaccaagggcacugggacgcggaggccgcgcgggcugggcggcccggggccgugguugcccucgggaccguuuugcggagcccagcggcccccugccuucuccaggcagccugcggggaacguuuccugcuguaccccacccuccgcgcgggagcuggggagccgcgcccguccagauacuugacucagaguuagggaggaggcgcggcggaguccuccggcgggauucggcgcccgucucgucuugcucuguuaaaaucaguggguauuaaugagucccguugggaaguugagauaguuuggcaggcccagcguguugauugggucugccagcacgguguguugcauuuaccuucggaguuacgagauucaccugucaccaccacugggacagcuuugagcguguacuuaaaagaaaaagcuggguuuuuuuuucaucuugggugacgucgauaaugucuucuuucucaacaggggaacugcccucuagggagacguucccugccugguaaguucugcccuuaccgucaccuaaaaugcucuccuccugggcagagcaguaugugaggaacucgggggugccuguguuucucauaauauuuaaagacaguuugguucagagaguagugagacgcaaugcuacauaaucacgagcuaucgcuuauucauuuagcucguaguugaguuucuacuguguuaggcacugugcuagacgcuagggauacaggaguggauacagaaguguacaguucuugcccucguggagcuccuaggcuaguuggauagugucaguugcuaaacaagccaacaaaggcaaauuuuuguaacugcugagaaggaaacgaggguggacagaagagcccuuuuugaggaggugacuuaaaaguuauggccauggccgggcgcgguggcugacgccuguaaucccagcacucugggaggcugaggcgggcggaucacgaggucaggagaucgagaccauccugguuaacacggugaaaccccaucucuacuaaaaaauacaaaaaauuagccgggcgugguggcaggcgccuguagucccagcuccucgggaggcugaggcacgagaauggcgugaagccgggaggcggagcuugcagugagccgaguucgcgccacugcacuccagccugggcgacagagcgagacuccaucucaaaaaaaaaaaaaaaaaaaaguuauggcuagcagaaugugacggagcuaacccagugaagcccaggagaaagagaauggcauucacaaagacccugaggaagaaaagagguuggcagaacuuaagagcuggaaaaaaggugauuuggccggaguauuuugguuaagggagagaguggcaagagauagaagaugguauagagacugaaggaguuuagauuuuauccuagcaguuaaaaagaaaaaagugucauccauagcuuuuuuucuguuauaugccuagccuaaguauuuguugaaugaguugaccuuguugugggcuuucuuugugccaagcauuuauaugagugcuuucugugaauuuuuuaguuaaucaucucaaaacaguaaaaaguauuuucucuauuuuacaaaugcauaacccaagacaagagagcuuaaaagccuuggccauggucacccacccagcuguugauaagccaggucuaccugacccauccugaacucuuaacccaccauguucucauuuacucauggacucaacagaucauuuauugagugcuuacuauaugccagccacuguucuagguaacagggguauagauagacucuagccucgagauuuuaugggcuagcuggagagagagagcaaauauacauuuaugcuccgacaagggcauaaauuuugguuacuacgagagaggaauuaaagggugugaugagagggugggaugauguagaccagcuugggaagguugggaaugucaguaaaggcuucccugaagaagugacauuuaacugagaccugaauauaaaagagccaagaaaauguauuccaggcaaagggaauugcuugugcaaagguuuucagacaggaaaggacuugaccagugauagacaugggaagaagccugucuggcaggaaagauagagugggcuggacgguacaggaucgcguaaaguguggacuuuauccugagaguuaugagaacauaaagccccuagcacaaugucggcuuguaguggacucucaauaacaaacauguuuuucaagugggaacccugaacaaugucaguaaacauuuucuccacuucauaggugggcaggacaauggaaagagccuugcacuuggggauuugcauuugggcucagggauucaccuugggcuagucgcuuaaccuccaaaaguccuacuuauaugaaaugggaauaauggcagauggucguuccacuucagagaguugugagacuguaaaaucaaaaugaggucauuaugggaaagcuuuuuauaaacccuaaagcacuguacaaaugaaauuugcuguaggaugaacucugaauuggacuccagguucccaaaaucagugugagccgccaucuauucuaguucaaaaacauacuaugcuuagaauuugcacugcauagucauuggcugcuggacauaaaggugacuggcuuaccuaucuugggaugcuugugaggaggugggcauaagagagggcuagcucucauuugguguguccugagcccaugguucagaaagaguuguuaaucugaaagaaaaaagacauaagaaagaauucagaagaggcagcuguaguuacuagucaucaguuggggaaaugcaguuaacuaugauaaggacagcuggugggcagaaagggucucucaccuuguugagagugaccaggguggaagacuucagaaaggcaugggaagucaauaaacugaaagauggggacaugauuuucucagcucuaggacaaacuggagaccccgagccuaaaguagccaagucuuugcuacuaggauucaggugauaagauuuccaacccaaucuuuucaaacccagaccaaacauccuccuugcuucucaaauuggguuauguauagucacaggauaagccaucccaugucuuucucaagcuucaguuguauuugaagacuuggcgaguagagacauuuuauuaugaaaacauacaggaauaaugaaaaguucuggcuuuuuaagguagaugagauuauauaaucacuuugggcugugccaucaaauuuuuucucuuuccuccccagccaaacacauacccacucgaucucacauacccauuugcucucugccacuaaggcuacuuuggaaaaguuugagaagcaggacucuaugauaaagauuauauccguugccguugauccugcucugucucaggguugggggugagcagaccuuuuccauucccagcauguauccuuugugagauaagaguuguugguuaagaguuauuuuguuucuugcaggggucuccuuaugccagggaccagguuacccuaacagcaggaagguuguguaaguaucacuggggaguacagauauguggccacggguuauuuauuuaaagacauaaaguucuaaauuugaccaucugauuucuucacuggccuccagaccuagaaauugaggugauuauguugagucccuagacuaaccucaauguucacuuuucccaugugauguuccuugagcaucagcuccgugucagguuuuggacugggagugugcccacucuccacagguguuuggauuauaaugaaaguuaaguuggaauccucuuuuuaugggauauagaagggugcuccuagauauucuguuuggauguaagugcagcugaaaggcucgagguuacauuuauuguggagauugagagcauccucucaguagcauaguuacucauuuuuaaaaacaguaaaagcauaaaacugguugaguccugggacugacugacuaguuuggagggaaugcuguuauugcauaaugcagaguuuggagaaaggcuacccauguguguuucagauuaacuucugcguaugaauguugcuuaaaugcugcuuugcauuccaaguguuuuugugguggugcuaagagaaugcucucuaguaaccuguucagcagcugucaggcugcuuacucuacagggagaauccucaaagugaagaggucagcggaugagcuucuuacuuacucuacaucacaaugaggguuuuuguuguuguuguuuugagacaggaucuugcucugccacuuuggcuggagugcgguagccugaucuuggcucacugcauccucagccuccugggcucaagagauccuuucaccucagccuccugaguagcugagacuacaggcacaugccaccaugcccgguuguuuuuuguauuuuuuguagagaugggguuguuuugccaugauaccugggcuggugucaaacuccugggcucaagcaauccauccacuugccuuagccucccaaaguggaggauacaggcgugagcuauggugccuggcugauuuuuuaaaauuugaguaaauguugcacucaguacuagaaauaugaaucccgguguuauuuuggagggcaguuugauagucauaagucuuugaaguguguguaccuuuucuuuuuuucuuuuuuucaagauggagucuugcucugucacccaggcuggagugcaguggcgcgaucucggcucacugcagccucugccucucggguuccagcaauucuccugccucagccuccuggguagcugggauuacaggcgcacgcuaccacaccuggcugauuuuuguauuaguagagacgggguuucaucuuguuggccaggcuggucucugaaacuccugacaucaggugauccgcccgacucagccucccaaagugcugggauuacaagcaugagccacugcccggccuguguguuccuuuucaucuagcaauuccaucucuaggaaucuauacugaagaacuccugguauauuuaucucagauuuaauaucugauaauauaaauauuaucagauuuaucuuaaaauggcaaagagcaagggauuggcuaaacuauagcauguucacauguucacacuaugaaaagugggaaaaagcagguuacaaaauaauuucauuuucuacugugugguaugaucccauuguaaguauucuuuuugcuauuucuaauauucuguagugaacaucuaguuauuuagagauucaaaauguauuacucaucugcaaucaaaugaaaauuggggcaaucaugacucucuacaauaaauacacuaaauauuugaaaguaaauaaugaagaaaaaguaaacuuugugugggaucaccccaaucaugucacccuaauccaguaucuuuguguguguugugccuuuuuugugaauaagguacccacuuuauuuaauaaaucuuuuauuguaaaacaauuuuugguuuuauguuuuuacuaauaguauuauauuuacaugauuaaaaauucaaaaaguaaaaaggguguccaugagaagacuuuuuuauccuuguccucuagccccccgaaugccucuuggguagugguggccaccacuccggguuccuggaugacuugcagagcagccucugcacuugcauguuaccuguuaguucuugccuauaggcauguacuuuacaagguuacaaacuauauguagaacaauuuguauucuuguaguuuuuaaauaucuucauuuuuucuugguuauacauagaccuuauaguuauuuugacauuauaaaaguaaaaauaccuaaagacaacuuaaaucucuuuuacuuuucuauuauaaaaaugcuuguuguggaauauucagacaauccugaaguguaaaaagugaaaguccccauccaaaucauucucccaaauuguguaagugugcaacacauaaccagagauaccauauaugucuacaucucucaccccucagagguaaccacuguuaauggcuuugugcauacagggugagcugauucuccaguuuauauuauuuacuguaaaggccauaucaguaaacgccuuggucuuugagguucguuuugaaugaauccagaauguguugaugugcuguuuucuagcaagagaaccgaguaggagauaccauaugggguuugugugugguuuuuuuguuuuuggguuuuuuuuuuuuuuuuuuggcauaacaccuuguuuuacuuccgaguuaaccuuguuaaucuugcugccuuaucugaucuaaaucuguuaucuugagggcagaaauuccauuauaccuugcacaauggcuuguacccugggcaggccguaaaucuaucucggauuuaguuaaggaagagaccuggcuggacauggugacucacuccuguaaucccagcacuuuggguaggaucuuugagacccgucugggcaaugaaauccauagucuacaaaaaguaauuuaaaaaaauuaucuggguggcaugugccuguagucccagcuacccgggaggcagaggugggaggaucccuuaaauccaggaguuugagguuacagugaacuauuaucaugcuacugcacucuagccugggugacagagcaagacucuuaucucuuaaaaaacaaaaaaccaaaucaagaagcuaagucauuucggucugcaaaggaccaaggugcuuauuuuuuuauugaaagagccaaauguaagucuguuuugugagaguuggcauugcauugcagcacaggggccugagcauacuuggggagcucaccauuuaagguaccugggucguuaggcucuacuccagaccugcugagucagaaucccugggggagaggccuagacaagugaacuuugaaaaaguuccuccccaagugacacugauggacaccccuggucaagagucacuguuuaaggggaaggugacccauggggccuuaacuagacuaaaaugugagugguucgccuguuaaaaggaguuaacguguguuucuuuuguagcauuaacaacagugucuucaguguucgcuuuuucagaacuacagcuguaugcaguaaguaccugcuuucuugggaauggaauuuuaugggaagagcaacaauugauugaguuuaauuaaagaaaaauauuaaaaaggaaaaaugaacuacuuaugauuuucuuuuuugcauuuuuccuagaggaugacuugguuacagucaaaaccccagcguuugcagaaucugucacagagggagaugucaggugggagaaagguaagauuuaguuuccuauuuuuuuuuuuuuuuuuuuugagacagagucuugcucuguucccagccuggagugcagugguaugaucucggcucacugcagccucugccucccagguucaagugauucuccugccucagccucccgaauagcugggauuacaggugcccaccaccaugccuggcuaaguuuuuuguauuuuuaguagagacaggguuucaccauguuggucaggcuggucucaaacuccugaccucaggugaucugcccaccucagccugccacaaaguguugggauuacaggccugagccacugcgugagccacugcgccuggcuccucucacuucuuaaguuuaagugcuaucuaaaauucuccccuccccucaggauaguuguagaauuuauagcucugccguuuucuuuacauauguacuuucugcuggcccuguaggaaaggguucuuauaacauaccugccaaaauggguuuuguggcuacuggaggcuccccgcuaacagguagccuuguagccuuugauugucuuuucagcuguuggagacacaguugcagaagaugaagugguuugugagauugaaacugacaagguaggcuuaucuuauauucguaccagcuuuucaugggcuucccuuaguuaaccuaaugaaagaaacagggacuuaaccauuguuuagagauaauuuuuaacuagcucuaacuucaguuguaaaauuauuggauuuguucaauuuaaaaaaaaaacaacuuuuuacauuuaacuuuuuuuuuuuuuuuuuuuuuuugagacagacuugcucuguugcccaggcuggagugcaauggccugaucucagcucacugcaaccuccaccuccuggguucaagcgauucuccugccucagccucccuaguaucugggcuuacaggcgcaugccacaacgccgggcuaauuuuuguauuuuuuguagagacagguguugccaggcuggucucaaacucuugaccucaggugaucugcccgccuuggccucccaaaguguugggauuagaggcaugagccaccgcaccugaccugcauuuaacuuuaaauuguuugcuguguguguacuauguacuucauuuaguagcuuuagucuuguaguguguggugaggggguggggaggguaaauaagcuguuuccacuuuuuccuguaucacuuggaaacauauuaacugaauauugccugaauguuucugagaaaggacagaaagugaaucuucacaguagcgaugacuuguuaucacccuugcucugaaauuauggccuuagauguuugugugcaaggccuuauauauuguguugcaacucuuguuacucacuggagauacgcuguuguuguuguuguuuugagacguuucgcucuaucacccaggcuggagugcaguggcacgauaucggcuccaccugccagguucaagcgauucucgugccucagccucccaaguagcugggauuacauuuuuguaguuuuuaguagagaugggguuucaccauguuggccaggcuggucuugaacuccugaccucaagugauccgccugccuuggcaucccaauaugcugggacuacaggcaugagccacugugccuggcuucauuggagauucuauacagcuaauuuucuaaugcuggauaaacauuuggacuuccuccaucugucuuccucuuccagacaucugugcagguuccaucaccagcaaauggcgugauugaagcucuuuugguaccugaugggggaaaagucgaaggaggcacuccacuuuucacacucaggaaaacuggugguaaagaaguucuccugguggucaaggucuccaguguucccucuugggauugggacugagcauaaugugcuaauuccccgauaugucaaagacucuugucauuccagcugcccuuaguugagggaauaagggguaaauuuauauauagugugaacuucaaaugucaaauucuaaaagaaaaguguauuuuuuaaaaaauaaaccuuauacucuguucuuuccauggguguuucuuagcaggagcugagaaacuggaccuuuucuuauagauauacagauugagcauaccuaaucugaaaauucaaaaucugaaaugcuccaaaacugaaaauccaaaaucugaaaugcuucaaaacuuuuugagcacugacagaaugcucaaaggaaaugcucauugucuuuuauggggaauucaguguuguuucuuuucacaucuguucucucauaucucuaggaaggguugguauuucuuuugggaagaaaugagaaacgaauuuguacuggaccugauaggauuagagauuaauaacuuuaucugacucuuaguuaaauuuuauaaccacuaaaaagucuauuucuuuuuccuaagcgagaaucguacccguagaccaacgagucacagaagucuauuucuuuuucacuguuacacuaauaaggcagauagaccgcaugauugagguuagucaggcaagaccagaagcucagaguagaaaacauguaugguagaaggcugggaaauaagguaguccuccuguugcagaaguuugucuuagcacuaacccuggauauaauguccagaugggugaaaaacagaaacaaacauuucauuuaaaguugugagauuauuacuuggccacuucagugauuuaugagucauccuggaugaagugcuuucuuaagccuaagucaacccucgaugacuauuuuauuuuuugagauggaguuucacucugucgccaggcuggagugcaguggccugaucuugauucacuacaaccuccgccuccggaguucaagugauucuccugccucagccugccgaguagcugggacuaugggcacaugccaccacgcccagcuaauuuuuguauuuuugguagggacgggcuuucaccauguuggccaggaugguuuugaucuguugaccuugugauccgccugccuuggccucccaaggggaguaaucccuuggccuguaauccugggauuacaggcgugagcaacugcacccagccuauuuuuuaauaguauucuugcauauauaauguuaaaauagaggaugaagaguaucaguaauuagaaauauguuuauguaugcauuucaauauuuuaaauugccuagguguuuuuuuuuuuccuuggaaguuuacauuuucuugggcuugauaggugcuuugaaaguacuugcugaauuuauucaguggaaaccugugaaauugggaagggagcuaaguugagccaguuaucugauggacauuuagggacccugaggacuagagaauagugccuuaugucauugugugugugucucauagugcuuugcauauugcugauacccaguagacauucguuacuugauuggagcuagaguuuuugccacuaaauuuugcuugguugcuucucauuucagacagugccaguggcauauacuuuucuuguuuuucagcugcuccugcuaaggccaagccggcugaagcuccugcugcugcagccccaaaagcagaaccuacagcagcggcaguuccucccccugcagcacccauacccacucagaugccaccggugcccucgcccucacagccuccuucuggcaaaccugguaggcuuccaacucccacaugucaugugggagaacaucucgucuaauauguuccuucaaaggguaaacucuagacugaugaugguucugaacaggccagguuggcugcuuuguagaaagaauucuagacuuuguauccaaaggccugcuuugcaucucagcuuucuguuacuagcugugugucuuuaggcuagucacuuaauuuaucugaacagauuguucaucugugaaguuggagugauacuaauauaccucagaauaucuugaagauuaaguaacaguacauaugaaagcacuggcacaaacucagcagauguuucuuuccuugucugaugcagcuuuauccucuuuucauuuucagugucugcaguaaaacccacuguugccccaccacuagcugagccaggagcuggcaaaggucugcguucagaacaucggguaagccucugaggaccacuuucaggaaagaggcagggggcaguguugagauuaguggaguauggguguggugaugccuaccuuugaaugccuggcagcucauucccucaaccuugauaaagggaguuuaggauauaacuucuucauagucacauaaccaucaaaugauaggacuagaaccugaggucuucugaacacuuguucagugguuuuccuacuauauuaugcuaccagugaaagccuuggguaaguuaaauauuuguaggggugguagcuuaguaacucacccccguccucccacgaugucacacgcuucagagaggugguuuagugagcucuauuccuauacuucugggauacuuagcuguagcuaagggauaauacucaguagcaauagcugucaggugcagacauaaagccucaaggaaguauggucaggauugugguuccucugccugagaauacuuccuaaaaauaugauagccucgaaaguuuguugcucaugagguucuguuccacaaauagcuauucuuaugcaaaucuuuaucaacagaaagugcccuuuuucuuaugauucuuauguuggcuagacuacacuacacuacauucuuuuauaaauggguuuugguuuuuaaaucacuguuucugagccuucauucuuggucaagcuuuaggcacaucugagugaguaguuuuggccuguguuugcauguuuuugcuuggaggagaaagggccaccacaggaaagggaagccuggagcucguguacuuagauacuguaguccuuggccaucuacucguggcaagccguguucuuucugacuacacggggaaugcuugacccagagagaucagauugucaaugcuuguuccacucuuacuuucaggagaaaaugaacaggaugcggcagcgcauugcucagcgucugaaggaggcccagaauacaugugcaaugcugacaacuuuuaaugagauugacaugagguagugucucuagucccucuuauccccuaggccccuuuuucuuagagaacacgaacuugccccacuccuuaucuagugcugauucuaaaacuaacuugucagggaagagguauuuguuuauuguuuuuuguuuguuuguuuuuguuuuuguuuuuugagauggagucucgcugucucccaggcuggagugcaguggcaugaucucggcucacugcaagcuccgccucccggguucacgccauucuccugccucagccuccagaguagcugggaauacaggcgccccccaccacgccuggcuaauuuuuuguauuuuuuuaguggagacgggguuucaccguguuagccaggauggucucgaucuccugaccucgugaucugcccuucucggccucccaaagugcugggauuacaggcgugagccaccgcgccuggccuguuuauuguuaacuuucacagagugagccgcuggcuucuucucuaauuggcuuuccuaauacuaugccugccuccuccaugaccuuaaccuuagccuuggcuagguguaguggcucacaccuguaauccuggcacuuugggaggccgaggcaggcggauugcuugaguccaggaguucaagaccagcuggguaacaaggcgaaaccccaccucuacaaaaaauacaaaaauuagccaggugugguggugcacaucuguagccccagcuacuuggggggcugagaugggaggauuguuugaccccgucacuuacauauuuuccuaagugauucagaaucgaguggaugaaaaggcaaagauaggcugggcuugucuuucauuuuacccagcucugacagugaaauggaaaacaaguuguguuuuuaaauaaccuuagaauguuaaccaaagguacuaauucacuagguaugcccauuucuguagugagcuaauuguugacuuaccuguuuucuucaagauuucaauguguucaaguaucagcacugucaggaagagaaauuugacaaacguguuuugagugcguacuguauacagaguacuguacuguggaauucaguggggauagacgcugggcaccauggcucgugccuauaaucccagagcuuugggagggugaggaaggaggaucgcuugagcuuaggaguuggaaaccagccugggcaacauagcaagacugucucuacauaaaauuuaaaaauuagccaagugagggcugggugcgguggcuugcgcuuguaaucgcaacacuuugggaggcugagguggguggaucacaugaggccaggaguucgagaccagccuggccaacguggugaaacucugccucuacuaaaaauacaaaaauuacccaggcaugguggcguaugccuguaaucccagcuacucggaaggcugaggcacaagaauugcuugaacccaggaggagguugcaguggcugauaucgcgccacugcacuccagccugggcaacagagcgagauugugucucaaaaaaaaaauuauguaugguggcauggaccuauagucucagcuacuugggaggcucaagugaucuuccugccucagccucccaaauggcugggaccacuacaggcaugugccaccaggcuuggccaauuuuuuuaguuuuuguagagacaaggucucgcuguguugccuaggcuggucuccugaacgucuagggucaagccauccuccugcuuuggucucccacugggauuacaggcaugagccaccauuccuggccaaaaaagaauuuuuaaacaggucuucaagagugacuagcauuuugucagccuuguggagaaaggucauuccagaugauguuaacaguguagaccaugagaugggaaaguagaagacacauuugagaaauugucaaaaaucauuucuguugugaggauuuuguauagcaaagaaugguaaagaagguuggauccuuauuucagaauguuuugaaugccaggguaggaguuuauauuuaauucaggaagcaagucaagucucaggucaucucuuucuuucuuuuuguccugaggguuuagucugcgaaucuacuuuucauuagagaaauuugcuuuucuuuggaaaggguuugaaaaauagggagaagggaguguuuucuugauagugcgcuguggcauuguucagaguagggcucugugaccuguuuuacuagaugucauccauucuguugggaaacuuuccgaagagacuggaugacauucaagccaaagauuucucucuuguucauaggauguaggggaaggaccuugacuaaugaaucacaaaggcugcagcuuauguuucagugcauuagggccaaauuguacacaaauugaauuggacuuugaaauucuacccaguuucuuaagacaaaacauguaaauauuuguggcccugaaagaugcaguuggcccaacagcuuugauuggaaaggaagcguaauagcuggaucuccuuucagcagcuaaucaaggugucacuuaacaauggccugcggucuugcugcagccuaauuugguuuagaucgagugcccuuugggucuugugcugaucagcuaacccauaagggaccuuucugagaccuucucccuuccucuauugucccagccuuugccuccaagggcagagcucugaaauagaagcuacuuaaugaccagacaauaacauuugggcagguuugagagcagagauguuuaucacaucucuuucccucuucugcagcucuugugucuugggaaccaguaaugucuuuagggugguaauccuagcacuaaauaagguuagaaucaggaaaacaagcauuuuaaacccaaucagucccccuuggaaaaacuuccuuuuucaaaaacaaaagaucugaagggggcuguuaaaauuguaccacaucuuaccuuucaugcuaaugucgaauuaggccauuagagggagaaagggagaacugagcauuuggcccugagauaaaguuaaauucaauuuucaucguagaacugcauuacugcauuccgauaaauacugagguuuaugcagcaaagugaugggaaagccauuucucacuaacucugcaaugugucauugaaaaaaaaccagucccaaaagaauaaaggcugcucauguuguaaaggcuuuucagaaggcuugcugcuuaaucugaagggaaccagccuaaaccacaaguggccacuuuucuaaauaccaaggaaaucacagccauuaaacuaaucuuagggcaagaacuaugucuuaauuagcuuuguaucuugguaccuggcccugacccucacauguaguaagguguuaguaccuguuuggaagaauaaguggauggaacugccaacccuggaaagaugaagaacggauaugacuuuccgugggccugaaagaacacuggguuauacccuucccugcagagucaugacugcuuuuucccgcauggagccucauguacccaugagcuguuuauuuuagucuccacuaaucaagagauaggaggaauaucacacgggaguuauacucagauuuggugggguuuuuuuuuuuuuuuuguauucuaacaagaaauaaaaagaauauugcuuauuuuguagauuuuguuuauacuuuaaaaaauuuuuuuucaggauggauagcucaguuauucagggcaaggauguuggugugcugugugaucucuuguucauaugaugugucacugaaaucugugacuucuagaccaugaaggagcccuguaaagagaucaacccaccuuaaagacagauugggccugauuccuguagauuucuuuguaaaagaacagaguuacuguguuaaccucagguagacuauuucaaaacuugaacuaagguaaugguccagagugagggaaaagcucucaccuaauuguguauauggauugagaaaccugugugaaagucaaaaugcaggcuuuguggucaguuuguuuuguaauauuuucacaguaacauccaggagaugagggcucggcacaaagaggcuuuuuugaagaaacauaaccucaaacuaggcuucaugucggcauuugugaaggccucagccuuugccuugcaggaacagccuguuguaaaugcaggugaguugcuuguggcuggaauuggagagguccugggagguagguguaugagcacagaccugcucccacaugcagaggaucaacagaccaaggcuuuuuauuugcuaccuauagaaauaucaguaucuuccccagggauuucuugguucaccuuccugaagcagcaucaugauuacuuucuacccgccagcugggcagaacaguuucucuucccaguguacagcucggcagcugcucaggcagcaggcaguucugggauagcccagcucuccaggcugucuccugucaagguggaagcacguguucuggcuuccuccccucccccagcuccacaggcccuguuaccuuggggccugacuuccacaguugguguaggcuccuggcugaccuuugaucuuaggucgaugggccucacugggagcuucggcuuggccucucauggaccuggugcuuauuuucuuuccuuuuuacuuaccuacgucauuguaguguugaccuaacaagcacuuuguuuuccuguugacacacuucucuguuccuugggagauuggagaggggucagugcuacuuuugccauccucagcagugucaggggcccuaaaggucuagaaguagaagcccuagucccuccuguugaguggugcucuagggagguagaaggccaucuuuguuuugcccaaauguauaccucuucuuuuucccauucuucucaugccucccugacuggcucucaucuuuuucaguggcccccuucugcuugcccacacauguaggcggcucucaaaaguucucguggccucuuuuucacauuacaugcuuccucuggaugucuuaucuaacaauacaacauggacuuucugcggaaaugauucccaagccuuuauuuucccauuaguugcuagguguacauuuucagaugcugguuugccaucucuugagguagcauauuucaaagccagaucaccccgcuuacucuuggaucuccccucuuccucuuguugagaguuggaagcagagaauggguaguaucucuauaucccuuuuccuuugcuaauuugcccuuuuuuggaacauuuguuaacccuagucauucucugcuaaaggagggcuugacuagagcuacuuaacgagaguuuagugcauaccuauccuauggaagccaguguguugagcccuucuuagggcugccaaagaaauggaugcuccuaugcccaggcucagucagggacuugggagauacuauacuugggaugggaguaaguggaaugccagcugccaugcauaaugcagugguguucauggugguuggucagcccacacuguaucaagcucugcagauuuuuacucuguuaaugcacauauuaccucauuagucuuggccuuccuggggaguuguauguaacauguauuuucucucucauagugauugacgacacaaccaaagaggugguguauagggauuauauugacaucaguguugcaguggccaccccacggguauguuggggcaggagguggggaauguuggucuuagacccucaccuuaucugugugaaggagaucacacaagagaaaucauuucuuuaauucuguauuuuuagaagggaguuaguaaaaguaaccuuuuuuuucuuuuaaaccaugccgcauucuuuuaacacuuucuguuaaucacacugaguaaugaagguauucuagggagggcauaccauggguugaaucaagggaguuguuaacuauaaaagguacuauuaauuugcaacugaaaacagcuuuucacccccuucagggucuggugguuccagucaucaggaauguggaagcuaugaauuuugcagauauugaacggaccaucacugaacugggagagaagguaaaguagaaagauguauacaagcugcuaagcaggcgagggaagagagccuucagaaggcugggcucacuagcaagcagugcucauggaaagucaagugcauagccccugagaaaagcaguugcccaugagagcuaaguauuuuauauaucugguggaguuuaccaugcucugguaacugaaaucucaucagaugagaccugcuagaaaagaucaucuuugaagucuucaacuguaugaaauugugccuuuucucugguggagcacuggucauagacaccuuagccgaacaacugucacacggaagcuagcgcuugugccaucgaucucgauacaagcuuucuggacuuccuuugcuuuuuuguuuuuagaggcagggucucgcuguguugcccaggcuggaguagagugguagagucauagcuuacugcagccuugcacuccugggcucaagcgauucuccugccucagccucccaaguagcugggacuacaggugugcaccaccaugccuggcuaauucuuaaguuuuuuauacagaugggggucucacuauguugcccagguuggccuugaacuccuggccucaagcaguccuccugccucggccucccaaagcgcugggauuauggacugacuuuaggugaaggaaacuggguuggcuugauauuucaauuaugaaaucuguuuuuaggcccgaaagaaugaacuugccauugaagauauggauggcgguaccuucaccauuagcaauggaggcguuuuuggcucgcucuuuggaacacccauuaucaaccccccucagucugccauccuggggaugcauggcaucuuugacaggccaguggcuauaggaggcaagguaggaaccgucacuucuaagguccuaguggcuaggucucgaugaaagggaaauccaacuaaaugcuaauuguaaaacauuaacuauaauuucaggccuaaguuccauuucuuaguuucuaauagcuaaggcacugauuaucaaauuguggucuggaucagcaucaucugggaccuuauuagaaaugcauauucuuagaccccaucccagacuuaaagaagaagugcagaugauccugaugcauauucaaguuugagaaccacugagcugaggaggcuuguuugcuucuauggagugggggauauaguuggaaacguggucccuugccccugggaaacagaugacaauuaugcaugucagucugugagcugccaaguuguaugauaaagcuuguaaauuucccgggaguucagagaauuaaguauuaaaaggggcuugagcuggcccuuagaagauacguugguaucaaaaaagcuuucugggaacuccuguguuuagaauccuuuuggguuacugacuccugugugaaaccacagucuguagaucuuccuggaaaaugcccauacacccagcuacacauacaauuccagaauuuguagacccuggcuuaauuuuuuuuuuuuuuuuuaaauucuaaccccagagagaagcaaguacaggcagccagaacugaagggaaaacuuuccuuguaggcagcagaugcguuagagggcagaguauguuuuuaaaaaauaaaaggcaguugugagaagacaguuuucuuggcaaacuuuguuucugaguggggaagcuuugcacugaggguaaguccuggucuuugaaauacuguaaauaugcagaggcaacaucaauaggaaaggcucuggaauuaggaacuuucuuaugggcugugcuaaaucuccuucagcgaggcuggcuguggcuugcuggagacaaaccuauuuaccuuuccucucuguagguagaggugcggcccaugauguacguggcacugaccuaugaucaccggcugauugauggcagagaggcugugacuuuccuccgcaaaaucaaggcagcgguagaggaucccagaguccuccuccuggaucuuuaggaggaacccacacacccuacaaguugaucaugcaggaacugaaaaccagucuucucccuguccccucaugggucccggguuagccuggugacaggcagacacaugcuguuggccucaagcaaggaagcagagcacuguguaaccagcagucacaggucuuuucuuggcguuccugccaggcucucccucucugcaccugucucauagccucgaauaucuuaauuccuuaggcuuaagagagagagccuuaauggaugcucauucauauuccugccuuucuuccaucagcucucugcaaagaugauuuugcuuuucccuagugcugguauacuauagagaaaccccuggggaccaugugauuaaguuccuaucuuuugaaaguuuguucugcagagacuucuaggaggaugcugugccucccaagcucagagcagccucuguccuggcugugcacauucucccuugauuccacuuguguggagggauugaacacaggcaaagaggugcugcuuugcuucuucaauggcaccuucauucuccguugucauugacuucaagaugccucuucuaccucuuccaggaagcacaggccaggggaucugggugugugagugggaggagagggcagagguccccugaggucaugcauuguaaucaucauagaaggagagcccaggccugcccucacgcucuccaucauaggcugacaccaagaagacucgucuuggcacaaucucacacagcuggggcuguagcaacccuuuccaaccccuuugcugguugcugggccucauucuagcaccuuguucuuagagcagauucuagcacaucauggcagugggaccaagcguggucccgaggaagggccagagccugguagagacuagggaagggaggucuccucuagacugacucacauugccuugagcuuuucaguuaaguugcuguaagcaccugggcugaggaggcaguuuuuguuccuuccugcguuauagcggggccuugucucuuccucugcaggacacagaucuggaggacguggacugggguaggaaaccacccugaggguguuaguaccuaguggugaaacggaugaggucauuucuaagguguguugcccguggaucugggcacaaucauuggaauuccuuggagccacugggauucauggcuuuguauccaacugcauccaggccugaggcugcugacguuugacaccagggccaguagagagugcccuuuuguaucuuaagccaagaagugaggccugggggugggggaggggggaaggggugggagccaauacugagugccugcagcaucuacuacucugucuucacuauucagaacuuguaacuaaaguauuuaaagaaacugauuuuaaaugcaaauuaaagggcagauauucucaaacaggguuccuguaucuguuccuuuuggcuacugaggugguacaaguccccagcacuguugcacugaaauuauugaaagccacucaagguccuguugcuuauuuugugaaaucagaaaucccuuauguggaacuuaacacucauaauuugacagaagguagaacccugacugccagccgggaaaguguugccaaaaagagucaaccucuguaaaaauauuugaagagauuuauucugagccaagugugagugacugauggccugugauacaacucuuaggagauccugagaacauguguccagggucgucuggcuacaacuuaguuuuauacauuuaauacauuuuagggagacauaagauaccagucaguacauguaagauguacagugguuuggucuggagaggcaggacagcucaagaccuggggauguugucauaggcagaaucaaagauuuucugauuggcaauugguugaaagaguuauuaucuaaagaccuggaaucaauagaaaggaaugucuggguuacaguaagggguuguggagaccaagguuuuaugcagaugaagccuccagccagcaggcuucagagaaaauagauuguaaaugcuucucaucagacuuaaggagccuguuuuaacaguaauuccaaaagggaggggaguauaaugaggaauggcuggcucccucuucccaccauggcccgaacuagcguuucagguuaacuuuggaauacccuugacugagacgagggguccauacagaugguuggggggcuuaggauguuuuuuguuuuguuuccauaaagcaucauagucucuuagugccccaccuuccuugagccugucaagccauacucuagaauagagaauuuggggucaccaucuuugugaagcccuuucaaaacaccaguagacuugcauuuuuugugugggcuuacauuauuucagugauggauuugggaggagugggggcaucucauuucauuuggauuugauagccuuguggaccaagaugcucaaggucaauacacaugaacaggugaggguugaugaccuaggagcaguggucagugagcgugaguguacaggguggguagcuaaccuagacugcagguggcaggugugauggaguccaggcuuaaacacagccuugucuuuuccagagucccugucugcugagcucuugcagugaggccaucccucugugaaggucugucacaggagggaagugggucccagagaguagaacuagagcucuaguagauagaaaaacaaauuagguugaaugaaaggaagaacaggauuugguguuagaagcuuuaauuuaucuaucugguaaaccugcaaaauaggcauuauuuaccccauuuuaucgaaaggaggucgacuguaagagcugggacccacaguauucuaaacucagggcccaacaaagugucagauguguagcuuuggguggaugaagcacagaaguuccagaagggacuugugcuucaugaagcggugguuggaagugguccagccugacuuagggagaguagcagaaggaacacuaacuugcaacucuggcuagguuguguccuuaaccuuuuugagcuucaguuuucucaggagcuaccgucuguugcaaggggucacugugaggaugaaacugguauucccccaggcaccaugagccucuuccaaggcuucuucauccucuuccccacagaaccugguccuccccgaccccaccccuuccccugaggcccacauggcaugcugcucaccaccagcccugcguccuacuuccuggcagccccaagcucgcucuugacuucacucuggagcuucuacaggggagccuuccaaccugccccaaugagccguggucauugcauggaagaagcgagaacaccguaggccagagcaggcuuuauuggggccguguaaaccccagggagaggcaggacguggaccacagagagucauguacaggcugcgcuuucacuugucuucucugucucagucuccugaagagcccgaggaagucaagucuccccaccaugagugaggggucuggucugacaguugggccuucagagccaggcacguggaccgugucagaagcgccaccugguggugacugggaugcuggcagggaggagcugagggcaaaacucuaguggaaauuucccaggucggucccacgccccggugacagggugaacccugagaggagcccccaaacuggaggcaauugucuuugagguaaccacucaccccagcuuuucagagaccagaggcaagacauuucuggcuaagagccauggauaguuguuccaugcguuuugugguuucuuaucccaaaagggcaugaagucacaguaggcagugacaugguaaacagccagggccugagagggaguccugaugggcacaccuugucuaaacugcuuuggccuggaagcugaauugcuguccucuugcaccccuggggcaggcugccccucuucccccacacaggcccacuggggaggaggacucuugauucugguuucagacuugcucuaaggggcagacccaugcauuccuuccuccccccauuacucuuauuuucuuccccucccuuuugcucucccaagucugaaaucacaagauagggggcauggucaggaaucgggggugggggggugggggugggggucauccuguccccuaccucaucccucccugcacaacagauggcaucccugcuucugggccuccccagcugcacgaacagcuucugguggaagaggccuacucgcugugugacuaagaggacuagccaggacagucugguuuggguccacugagccaguggaucaguguccugagaugagucuccagagauguccugaguggggcacaacauggcagugagugagucacagaaccucacaguagggugcagcagguggucaacagcucagcgccagugccacagaaggcaaccuuuaacauggugaguccacaugcucaacgggucuguugacugauggguagaugguucaagcugcuuagcagggcaagccuugacugcccccaccuccagcuuuuccaggagcuggcccuuccugggugguggccauaauucugaggccccagugggagcccagcaggacagacagugcccuccauuccucgcccaaagcccgcugauagagggccagcccuggguugggugucaggcaaggaggagaggcgauccagaccaggccagcugcuuccgucacccgcucugcccucuuaccccaccagcuugcuccauuggaugguacugaaaaagggaugggacuugaguuugcugacaccaccuucucccaugcccaggcgccggguaggcucgaacugcagcagcugcagagagaggcccagucagcugggccacuccagcuguggaggcauggggugaccuccagggacuccaaccacuauggccucuagggggccugcucccuggcagccuggcccacagaacccccauuuuacccugggaacauugguggugguuggccaccaacauauagaaauguguugccccuacugcccucugcacccacaucagacacugagcacgaagcacacgugguucagacacaguucugugccccucccagcaccuuccucaggcuaggcagcugcuuccucuggccgggcuacaccucaccucagucagcagagaggccgcugggcgacugagccacucgggcagcuggagcugggugugggccuggauuccugaaggguggcucugggacagugccugggaggacacagggaagggccucugaggaggcaaccccaggaccgucuacacuccaguggcagccaggauuuuuuuuccccaugucacagcccaugaggaggaugacaauaaugauaguugcuacagccagacacagugccugauggcuaagcagugccuuuauguuauccacgaaaggcaagaaacaggcccagagagguaaagggacuugugcugaguucaggguuugaaccuaggucucuuggcuccaagcuugcuagaagcaacuaucuuggguugcaaucagggcaggcacucuugggaauagugauggaacuugucuccuuauuuuaaaaauccacacgggcuguucauuuggcagcaggccauggcaugcuaccaucggggccaaggcagcggcguggcaauaaaagaaaauaggaccucuccacaccccagaaaggcacagcuuugaggagcagagggucugucuggagggaaguaugagcuuccaggaacccccaggaggaaggccaagagcucugggcuggagaggugggaggagacaggaaaagagagagccacucugggggaaauugcagccaggacuuucgggaccccgugccaugggacgaaagcaggagggagccuggauggacuggucagcucuggacuucaguucacgcugcauccauuucggcuauuuccugcucaaaugcaauuuggccucccccuugcugccuacauaacuggccucaguugcaguguucagcucaugaggggaggacagaaggcagagccaucaacuguucccaagagugccugcucugauugcaaccugcaaacacagguucccggaguguuugcagggggaucuuuugagcucuuggcugacccaggcuggacagggcagcugcuugccugggugaaagagccccucucucccauccuccagcuaaggucugggggugacagccaacgaggucaugggugggaggagugaacagcgggcucaggaugauugaacagccuuccagggaagaagggcugugucacauuccgcgcuuccuccaaaucugacaccaccugggcccaggcucucuggcagaaaccuucccugaccaucccacucuacucguauucauagaaguugacagucuccuuagcuauagccaacuaauguguugggagugcuaagugugucccuggcuucgggggcaguugugcugguaggacagccaggcagucucugcccagacuggcuggauggacuaagccuggcccaucccacacucaguggcacccaccagggcacuacacccagcccagccacucaccauucccgucagcaguucauacaguagagacccaaagcuccaccagucacaggcuuccgucagcucggaaaucccacccaccucugugggaacaagaacacaggugucccagccucaccuaagagggccucuuccauucuccucagccuacccagacaccacccacccgcucugucauucucagacucugggcacaacccacacaaaggcacccaggugcuaaggcccacccuggccuccccccuucuugccuggggcgcuguagagauuguccacggccuccccgcagcacuggggcuccaccucugaccacuggccaaaauaugugagccggaugugaccuccagugugugggaggaaaaaggaggggacagauugaggacagcugauacaggggaggggguugcagggcuucccccaacagucaugcgguaggagccaauggccuugcugggcagaaacucggcaggggcacagcacccuccacagaggcacagcacucugaggcccacagagcccacaggguacucccaggagccucggccaacagacuccagccuaggcccccugaaaggcuggcuggggccagggaggagcagacaaccuuggagguccccucgacuuuggggaucucucguccucugccuggacgcuuugggggccaccccacugaggggugaggagggcaccuaccugccugguccaggagcagguucccgggguggaggucccggcacagcacccccugcucgugcagcgccuccagcgcuaccagcaucucugccgcccacugcuucaccugcuccucucucacacuccagguggcccugccacagccccggccggccccaucugcugacaggcagcucugauccaugccucggccacagcccccuagcaccgggccggcccccucaggaacccaagugagcccccgagggggcccagcgucugaguucuggccagcccuccuagcuugaaggugcagguggccaccuggggccuuuggaagguccgaggagccagaggugcugguccuggcuguggguucaccuucagccucccucuggggucugguggauggggccuccccagcuaggagaagguucggagaaguccuaggaggcuccagggcgauucuguccuggccaggggcauggccugagggaagccucgcuggggucaggagguugagguggggguugagcugagccuucauccucuccuggguagagccagagcugagcccagaaugucgggagugcgccugggagagcaggugggaccagagagugccuccugggccaugcagagggagcggugagcguggggacagggagaaaaagaguauggaugccagggccggcucccacuccugccucccuucugucuugggcgcagacuuuccgccucuggguguccuggccuaguucagccccucaccucugcucccucccaccccucagcuuagaaugcccucugcccuccucuugacccaacuaaagugggcccagccuuacaaacuggcacaccaccgagagauguccagcacuaucagugucugugguuugggugguggguucacuagugugaacacuguuuuuagggagaccgauauaaagaaauuuaaagaaaagucaggcacacacuuaugaugacuauaugucaugaccccagaugugcaccucacuuuaaaaagucaucaauacaaccaucaguaucugcuacauggcccaguuccuguccucauaacuucagucaccaccacccugucuggccacucccaagggaucggcacaacccggaaaaaugaaaagagccaacgcuggaggaaacagcgacagaggagacagcugugauucucacgcccacccacgauguggacauccaccccaggauguccccugcccccuugguaccacacaggggcccacaacagccugacuggccuccagaaaggccggguccccuggucugugcuguacaucuggugcaagcuccgccccuccccagggcucagcuuuuuuuuuuuuuuuuuuugaggcggagucuugcucugcugcccaggcuagagugcaguggcgugaucuuggcucacugcaaccuccaccucccggguucaagccauucuccugccuccaccucccaaguagcugggauuacaggcacgugcaagcacaccuggcuaguuuuuguauuuuuaguagagacaggguuucacuauguuggccaggcuggucuugaacuccugaccucaguugauccgccugccucggccucccaaagugcugggauuacaggcgugagccaccacgcccugccagggcuccgcauuuuaaggguugacgacauaccccaaaggccuggggagcugacagggggccccaggccugcucaccuugcacaugcuccaggugcaggaagauggaguccucgcucacaaaguaccugagcagcuucgucauguaggggacuccgugugggaugauggucagccgcucccugcucaccauguggcaccuggguaggcucugggagcagcagggcaggcagaucagccggggacaggccagagacugcugcuguuaggggaccuccuagcccuggcuucaggggcacccgaaugaggguggagcaacugccucccucaguuccugaccuguccuuacccccacugccccuguagaaucuggguccuccacccucuagccaaagagggggcagugugugugcauguguguuuguguguauguguauguguauguguaugugugugugugcaugcauguguguccaucuggaaaguggggcauguucaggcagaacaaccagcuuuugugggagggagugcaggcuucaaaugcagguucuggguaggaguuuccaagagcccugagaaagauccaaggggaaugcagaguggcaggggcaggguggcaccugccuucaccacaaaggucccuccgguugccggguccuggaccagcugcaccugccaaaguccaagaggcacugguuaaggcagguacuagcuccuggggcuccgugaccccagccugacccccucccagguuccuccacugaggcugacucacuccaguggcagggcagggagggcgggcuuugguggcacuccugaagcagacaucgauccuauccugcucacccaccccugcuagaccuguggucucagaugcugccuccuccaggaagccuucccaagauuacaggggcuggggucccuaaucugccuccaaugcucucuuaguucacccuuaggagagccucuucacacugucuaaucugucucccacuggacugugagcucaguauucccggagcccugcacagugcagggauguaguaggugcuagacacaugcacugugagcagcccgggccuuggcucacugugugcguggugggcaugcgagcagaaugcccugcccucucccugcccacgcugggccaggccucaugccaccugacgggagggcugagaagcccuguuccaccuggaccccagagaucagcugagaagcccuguuccaccuggaccccagagaucaacugagaagcccuguuccaacuggaccuccagagaucaaccccucacccaaggccuuagcuagagccccaacauccugcagggucugaggugucauggcuggaagggaccucagagccagucacuuccucugaucucuuguuuuacaacugaggaagccgcagcucugaggugacuccaggucuccccagcgcagccauguugugugggcuuggcacgcugcguucaggccuuuuucccacuccacuccacccccuucauuuacacacacccccaugacacaaguuuaucuaugugaaaaaccugcacauguacuccugacugcaaauaaaaauuuaaaauaaauaaguaaaguccgcuugagaggccgucuuuggagagcagccucuccuucuuguguugguuuccauuagaggcagacgcugucaaucgcaaggucagggccauguuuggaguugggcccuugacucaucugcauggugggcaggggcgggccccagcauaggagcgggcacauggguacgucgagggcgggaaggcagaggauucagcccaggugagggcauguggaggcaaggccagcacccugggguugugacuccuuggcuguuggccugcccugcggacauuccccagggaggcuguggccagccauggucggggugggaacugggcccugaggccaggcugcugggcagugaggaaggccacagcuugggaucaggguaggggaaggggcacugggcuucgauccugggcaaauugaauugauuuucucaucuaccaaccaggaauuccaaaugccuaccuucccuacaucucuggauuguugaagccauucugaaagcccuuggugagggccaggugugguggcuuaugccuguaaucccuguaauuugggaggccaaggcggguggaucaccugaggucaggaguucaagaccagccuggccaacauggugaaaccucgucucuacuaaaaauacaaaaauuagcugggcauaguggugcccgccuguaaucccagcuaccugggaagcugaaguaggauaaucacuugaacucaggaggcagaguugcagugagccuagaucaagccacugcacucuagucugggcaacagagacagacuccaucucaaaaacaaaacaaaacaacaaaaaacaaaaaaccaagaaagcccuuggugaguggaaaggcugugagaaugucagugaucacaucugccaagucacauggccucucugaaccuugcucuuuuuaaguacaaaacggggucauagcagcacuuccuucaggggguccugaagaggauucuguuaaagcaggcaauucaggcagagcagcagccugcaccugccgcagaacacacccuugauaaccugucgugauuauuaccagugucauccgaggggaagcccacccuggcuguaaagugguuacucugugcuaagcacuuuacauagguuguuuaauuuuauccccacaauccugccaaaauucaggccugagccucagagagguuauguugccuacugucccacugcuaaaaaguggucaagucaggaccugaacccagacaggcugaucccggagcccugcagacuuuacuggaacugggggcacaaccaggugacccuggcaauggccuucccuccugagccuguuucuccaucaucagugaaaggaaggcaguggacuagaugagagcgcccaggacccuuuucucagcaggagcgagguguccucuccaaccaccagaggucucuccuccaacagccagagaccgaguccagccugggcuuggcucccugaccaaacuugugcaauguuagaaaaagcaaggaagaaaacucuggagucauuuaggagaacagaguuucccacaaauccugacaccccagauaauuccccacugucccuugccaagugggauuccccaccaccugguccugggcaagggccuguaacugacagaguccaaaaaaacuagcgaaggagggaaggcugaggaggccagaaauaaaccuugauccauacacugaaagauuucuguuaaaaacauauuaaaaccaaccucaguauucagaaauaauuagacuaaaacauuaacagugauuaucuuggaguucggcaggauucaggggauuuucuuuuucuucuccuuuuucuuucauuauauuucaaaagggcagcaaagcagcaggcauuuucccauucauccaaccaaacaagaaacuccuuuuacucagugguuuggaggauggaggacugucuagugccuugacuucuuuguuuauuauuuauuuuuuugagacggaguuucacuguuguugcccaggcuggagugcaauggugugaucucagcucacugcaaucucugccucccaaguucaagcgauucuccugccucagccucccaaguaguugggauuccaggcaugugccaccacacccagcuaauuuuguauuuucaguagagacgggguuucaccauguuggucaggcuggucuugaacuccugaccucaggugauccacccaccuuggcuccccaaaguguugggauuaugggugugagccgcugcgcccagccccgcugacuucuuugaaccucaguuuaauucucuguaggacaaguauuaaaaugcagcacuguccaauugaacuucuuaucaugauggcaggauuauaugucugcacuguccaauauggaagccaguagccacauggggccauugagcacuugaaaugugacuggugcaacugagacacagaugacuucauuuuaaugaauaugaaugcacagaggcuuaugugccuagugacuacuguguugaacagcacccuauaaggcuucguucccccauggugacugugaggauuuaaugccacagcucuguaaaugagaagguuccauacaacugucgggugagccuuccauuugggaagauggaaggcaguucugagugcuuucucucaccuuuuaaaaaagagcaauuguuuuaaauaaagagacccacugaauucuugggacagagggacaauuaaagcuuuggugaaacacgguaaaccuuuucuuuaaagaugcacaaaguaucaaaaucccaggaggacucucccauggaacaaacaagccuaaagguuucaaacaaguucuuaaacucaaagguccacaggggccaggcaugugagcaaauaggcaggguggaggcgcagaaaggagggcuggugccccgucuaaggcaggcaucuccuccuccacucccugcugccacaggggaaugggaggccagcguuuccagaucugauuuuuucaagagaagcaggaaaucuggacuuuuauaagaaucugcacauuuucaaauguugguaacaacuaaaaaaacccaaaaaacaaacaacaaaaaaaacaccccuguguuuaagccaaauaaaagaagaagugacuuggaugaccuucuuuuucuuccuccacccugucucagagccuggcuccugcacgaggcucagcaaauacccggugaugucucccuggcccccaggcucugaggccaggcccucggguauucuggcugcuugccaagucccgacccacccaccucacugcucccugccaccaucucuucagcccuuaguuauccuaacagccggacacguuaggggucacucaagcaucaucccgagcaagcccuuugcuuccucccugggccugaggguugcugcuggcuggcacugcccacuugcccagaucugucugggcacagcuguggaauggaacaagggugacaguauauccaagucuggcugcagggacccaggcccaggggcaguaacaccuuuccuaauuugaggaaagugaugcuccuggcuugggcaugacacagggaaaggaaguaggaucucaggagggaggugaaguccuuaaguugaguacccaagacaggauaaaaaagaaaaaaaagaaggguaguccugaaauagaaugcggcgggccacuggcucacgccuguaaucccaagugcuuugggaggccuaaacggagguggaggaucaccugaggcaaggaguucgagaccagccugggcaacacagcgagaucucucuacaaaaaauagaagacaauagcagggcuugagacuguggucccagcuacucaggaggcugaggugcgaggauugcuugagccugguaggucgaggcugcagugagccgagaucacgccacugcacuccagccugagcuacagagcgagacccugugucaagaaaaaaaaaaaaugguugggcuuggcuuuaauuugugcuuuccaucugcaggggccucgaaacacuggauuccuaaaccacuuuccugaggcuaaacaaguuuggggaauucugugucacaguguacaucugcaccuaaacacucuaagaacuccgaucauuaagaaacaaagccauauaacuucaacucgcuguuuuccuaucauacucagcucagaaccccucucaccacaacaccuaugguucagcgggaucguaccgggaggcacggugucagucaccucccggccagucccugggaacggcugugcucagccaagguugggucguggccacugacacucaagcaguggggaggggaccguggcagauggaagcuggcagggccugcgcugacagucugggaccugccccagggacccaggagaagcagcuggaguaaggcccgggagcagaagccugcgugccucccagcucacuccugucacuuguauuuagagccaucaagcacguacucagugucacagcaugugccaggucuuuccccaaaauuguuuuguuuuaccucccagaucaccccauugggggagaauucucaucucacuuuccagaggaagaaaccacagcucagagagcagggggcuugcccguggccacccgggguggugcccagcgcggggccuucccucaggcagcaugucauccucuugccugugggaaguacaggacugucuccuuuucucugugggcccccagaucuaccaaaaucacccagugaguauguuaaauaacagauucuugggcaucuguauuuuuaggaagcucuccauuuagccagcuugguaaagaacuucuugggugacuauuccaggguucaggggaagaggggaaccucauacuggcuggacucugauuugaccucauugucuguccuucuaaucagaagcacucuaacaaugagugccccgaguaaggguugggacgucgccuccuaucuucuugucugcccugaauaaggcaaagcaugcgagauagcauugggacaggguaaaguuacaguuaggucaggagaggaaaaaaagggcagacuugccaaggcccugggcaaggacgggccagaacgggcccucucuggacagguuucuggaguugagcacgucccagccgcaggaaguccccagcugugcucgguagagcgucuuggcugcagcccugggguucagggugaguguggugggggugcugugggaagcgggaagugggagugagcagggccucgaggacuggcagggugcccugggcauagcuccucgcuccuccugcaguuucugucccaacucucccaaggagcagguuuucuggaucugagcugcagggcuguggaaagggccugucugccucuucuuuuuauauuuuauuuuauuuuauuuuauauuuuauuuuauuugagauggggucuugcuauguugcccugguuggccucuaacuccugggcucaagcaguccucuugccuuggccuggugcuuggcccaaagugcugggauuccaggugugagccacuguggcuggccaaucagccucuucccguucccugcauuuuccuccccaggacccaggaccaaagucaugcguguuagggaugggggagaggugggaacugcuggaaacaacugcacucgcacuccccacugaccccugcccaccuccucuggaggagugggggccacugcuacagaccugcuuucagcauaucaugucucucuccccaccgccaccccaaauugcauacacugucucccuccugcaaggcgaguguccacucacucaccuucucgaugaccccgaccacccugcagccccucagcugcuccacggcagagcucagcgugcgaaugggccggagccucaggcugcugaaacccugcagaggagggagacaggccacacacagccucagggccgagcccuccuuggccauggccuucucaccaggcaucaggcaggggcuucuggaugcaaggagaacagcugggagggcagggguauaggcaggccccaccccacaguggcaggcuggguggaaaagcuggccuuuaccgauaggcacccauacugguccaggguggucaggccgaccucucugcugagcccguccaaggcccaugaaguucucugggcuucagaagcccccucucaaaagccccaucuaggccaggcgcaguggcucacgccuguaaucccaacacuuugggaggccgaggcgggcagaucacuugaggucaggaguuugagaucagccuggccaacauggugaaacccuaucucuacuaaaauacaaaaauuagccgagcaugguggcgccugccuguaacuccagcuacuugggaggcugaggcaggagaaucgcuugaaccugggaggcggagguugcagugagccaagaucacgccacugcacuccagccugggugacaaagcgagacuccaucucaaaagaugcagaugcucccaagguggggauagggaaguaaccugggaacgugugagucucagggaacgugccuugaagaccaagcaccuacuuuggggaaaggcagccguacaggaugcagugagccaaggagggcugcgugaguacgcgcaaccgugggguaagaagcgugcgugcauuuuccacccucacugaacacuuacugguuuagagaaagccauguggggacugugugugugcacauacaugcacacagauaugugugugugcacacaagggugucggggucugcuccaaauugcaugccgguucacaagagacagaaucaggaggcucugaguguggacacacauaagcguguaaauugaacggugugcaaggcuggcagaugucuaugugcacacauggcaagugcucugugagggaggcagacgacuggagaugacucagugaguuguuugaaaaugaaugaaccaugaggcgugggagagagaggaagccaggaggaaaagaagaugggccgcccuggcacacuccagcccaaauaaugacuuccacugccggccucugcccugcagcccagggcgggccugugggugucggggccuccgcagucuccccucagagcccuccucccgcucaggccuuuggguggggggggucuccucaccgcgcuggggcuggcuccacugcucagcggccgcugcagguggcaguugaagaucuccucugcccgccgcagguauuugguaauuuucagcuucacagccucacgucgcuccuuguuggggucaacugugggagacaagagucaccaggguccccagccauggccucggagggcuggaguuccagcucccauugccugcccucuacccucccaaggagugagcuccuguuucuaaggcugguucggcagauucugcccccagauugcuucaugagccccuccucugggguggggggccagccaggaaggaggaggaagggagcuggcaggaggagguuaggaaccagggucacuccucagcagacagcacuucaccauuagcacccaccgccuugcuggcggcugucacacccugggaagggacaggguggggauuuccccauccauuuuuucagaggaggggauagaagauuccagagagcauugcuucuuccaucucugaugcccaguguaaagaaggcuaggguggggaccaggaucgggggauaaaggaauuugcuggacagacuggaagcccaggcuugaagggucucuucagccagagggcaggaagggcccagugcccaccucaaggccuggccaccagggcccacaggcgucucaaaauggccucagcaccagccucuccccugacauggaaguuccucaugcugcccuggagggaccuccccucucgccucuaggccuugaauguucuuucuggaacucuagccaguucuucagcuggauaacgcaccuaccauucuccagugcucagauuagagaucuaacaucuagaaaaugcucuaggccggcccagucugaccucaguuucccucuuuccucucuucacuuccccacuaauccucuuccuaccugagacuauaaugguccaaaucaacucaucagucuccccccacuagaaugcaaacucccagagggcaggagcccagcccagcuccaggaacagucagguguagugggccaaguacacagccugugaagugaaaccccaauugugccauuugauagcuguggagccuugagcaagcuacugaacugccccaugccucagcuuccucaucuggaacaugagaauguaaaaaaugguuccugugugcuuggaacaacauacaacaacauauauaguaauuucuauuacugugacacucaaaugaaugaaucuacaugaagcccuuagaauaguaccuggcauguagaaacugcuuaauaagugccagcuaucauugucuuuuauggaggcccugcaggccagcauagugccgugcucacucaguacaaauggacaggggacaagacagaugggugacaggaagagcccugcacuggcccuuccccacccaccccagcccugcccagccccgguccucaccguguaugccacggagcagcacguccacgccauucugauagugguugaaggccgccucauaguccucacuaacaucgcgcuccagggccagccggaucugcguggccgcauccaccagauagucacguuuugucaugucaggcacucccagagccacccuguugcgaaucugcuccagguacacgugagcuugggaccgugcucgugagcaaggcucaggcuccaggccggggcugggcaggcacucacaggccaccaggcucauggcugcccugcagcugggaccuggaaugggcaaaugcauuagggaggaccuagcugguagcaacaccccuauccgcaccccaguuuccuccacugaaugucagggagacucauauucaccuccaaagacugaaggggucagagcuaaaguggguaaggucuuuucauggauccagguccuuccuaaguggugguaaugauagaaucauaaccagcucaggauucuguuuucuuuucuuuuuuuuuuuuuuuuuugagucagagucucgcuaugucacccaggcuggauugcaguggugcgaucucggcucacugcaaccuccacuucccagguucaagcaauucuccugccucagcaucccaaguagcugggauuacaggcacuugccuaccacaccuggcuauguuuuguauuuguaguagagacgggguuuuaccauguuggccaggcuggucuugaacuccugaccucaagugauccgucugccucggccucccacagugcugggauuauagacgugagccaccgcgcaggccuggggcucuguuuuccuuuccagucaaauucaguucagcaaacauuucuggagcaucugguacuguguugagcucuggagagagcugaggauaucugugauccacagccaccuucacagggccuccguagagcaagcuugguauccaguacgcauucagcacauggaggccacacacgcugggcucaaaugcuguuccucaugcuguucccuccacccugccuguugucuccucccugcuccuccugugggaaucucauuuacccuuugggguuuagcacuucuccguggaccggauggauugccccugcuguguuuuguucccuugguccugaggucaguguggucagcgagugaggaccccuccuggagccagcagagagcagagcacagagcugggcuguaagaacuguuggcagacggaaugacugaguggcagacucggugccacguuggaugggggguagaagagggcagggugacccagccccagggagggucgcucuguccuccuggcuuuacuuuugagaaggucauguggccuccaaggaccugacagcagcuucuuccugagcaaugugugacccaggcggccaaagggaugacagccguggcugcgggaagggaaggggcucagagagaggcccacaaagcuaccccgccuuugcucucccaggucccacugggaaugggcaggacccggaacuuccaaccccaggucauuuggagagaaagaggagagagcaggaugggcgguggggcggggagggagacccacagccucagccggcggggagcugaaucccggccaggaugcggccaggaggcagagggaggccgcaccaucccugcucggccaagcccaggggaacuugaggcucugaggccuugcucuggggggugcccggguaggacuggcuucaggguccaccccgccgggcaggguccugccgggcagagccgccggccccgccuggacacagaaagcggcgcgugcaacccacggggccccagccgcaaggugcacggucccaggguggagggacggccgagggggccccucgccugggaggguggagaagggaccggacaaaacaccguaccugcccgagcugggagccggguccgcgggccaggccucccccucacguaccggcccuucacgccagagcgcgccgcgggccgcugcuuuccggcauccagcgugcggggccagccggugcagcgcggccauuggcugcggaugagcucauacuugagccuuagaauaaaccaccaaucaccgcccggcucggcuccugccggccuuaaagccgcaaggucugcacggcugggcugugaggggcggggggcgguuuagagaggggagggugggaugggaugugggguggguggggagagcaggucuagaaucauccagggaugcggaaggggcugcuucagaaaucuagacgugccacuucuaggacuuuucucauucauugcuucauucauuuauucaacgauucaaugcuauguauugagagucucccaugcaugaggagcuggauguugagauacagccgugaacuagacagcgcuguuuacauccgcauggggcuuacagucuagugagggcuaccgagaguaaagaacccagcaauagaaggcuuuugauaucagaaccgagcuuaaaauucaagacauaggccgggugcgguggcucaugccuguaaucucugcauuauggaaggcugaggcgggaggaucauuugaaccuaggaguucaagaccagccugggcaacauagguagacccaaucucuauaaaaauuacaaaauuuagcugggcaugguggcgugugccuguggucccaguuacucaggaggcugaggugggaggauggagugagcucgggagguugaggcugcagcgagccgagaucgugucacugcacuccagccugggugauggggcaacagaucacaggcaacccugugacacagaucucaccugcagguucagugcugacuggcuucacacugucccccggcugcacuugcucuaccuuagacacccuuucauacuuucucccucugacucccacccgucccccuauccucacucucagccagcacuguugcuucauccuucccuugacagcaguggcgcacagacucccacaggcuugcucuuggcccgcgggcggggcugugcccacacucugcuuccaaccuuuuuccacaggugacugucugugccccaucgaaggccacccuuccaggugggcaucagucccgugccaucaccuacucagcgacaccacuccagcgauucucccgucucucccacuagauaauucccaccugauacaaacauaaugcuuguuucuccccucuuaaaagcaaaacaagaaaacaaaccaaaauacacucuaggccucacuucuuuaccuaccacccuagguuugcaguacggcuaauuuccuuuuuuuuuuuuuuuuuuuuuuuuuuuuuaguagagaugggguuucaccauauugcccaggcuggucucaaacucuggagcucaggugauccacccaccuuagccucccaaaguguugagauuacaaacgugagccaugacaucuggcccaaaaguaaacuuuuaaaacacauccuauagaaugggagaaaauacuuggaaaucauauaucugauaagggucuaguaucuagaauauauaaaggacucuuaaauucaacaauaaaaagacaucccauuuaaaaaugggcaaguaauuugaauagacauuucuccaaagaagauaugcaaaugcaugccauaaguacaugagaagaugcucuacaucauuagucauuagagaaauacaaauuaaaaucacaaggagacaccacuucucacccacugggaugaccacaacgaaaaagacaauaauaaguguugacaaggaucuggagaaauuugcauauugcugaugagaauguaaaaggaacagcugcuuuggaaaacaauuugccaguuccucaaaaaguuaaaauagauuuaccauauaacgcagcaaucuacuucuagguguauacuuaagaguauugaacacauauguucacauaaaaacuugcacaugaauguugauagcagcauuauucauaauagccaaaaaguggcaacacccaagguccaucaccugaugcaugcauaaaaugugauguauccguauaauggaauauuauucagccauaaaaaagaguggagugcugauacaugcuacaacauagaugaaccuugaaaacaguauacuaagugaaagaagccagucacaaaaggacacauauuguauacuuccauuuauaggaaguuuccagagacagaaaguucaugucagggaggggacaguguguaugggguuucuuuuuggggucaucaaauguucuagaauuagacagugguaagaguuguacaaccuagugaauaauacuaaggaccacuaaauuauauauuuuaaaaagguaaauuuuggccgggcacgguggcucacgccuguaaucccagcacuuugggagguugacacggguggaucaccugaaaucuugggagcuggagaccagccugaccaacauggagaaaucccaucucuaccaaaaauacaaaaaaauuagcuggguaugguggugcaugccuauaaucccagcuacucaggaggcugaggcaggauaauugcuugaacucagaaggcggaggcugcagugagccaagaucgugccauugcacuccagccugggcaacaagagcgaaacuccgucucaaacacaaacaaacaaacaaaaaaauaaaauaaaaucguaaauuuuaugguaugugaauuauaucucaauaaaaaauuauuacaauaaaaaagaaagaaaaaacaaugccugaacucuugauccugcccugaaaccuuuuccaccugaagccuuucccauccccauccugaugauccgcccauccuguuguugcucaggccaaacauuuuggaaccauccugauuucucuuauuuuuucgcacagccccuugccccucuccauuauuuuucaccaaccucacucacuccacugcaacuccugggacacaccaggcagcucucaccccaggggcuuugcccagcagcugccuucuggcugaaauugucugccaccacguauuugucugguuuucccugccccuggcuuuuuuuguuuuguucuuuuuuugagaccgagucucgcucuuucccccagacuggagugcaauggugcaauaucggcucacugcaaccuucaccuccuggguucaagcgauucuucugccucagcaucccaaguagcugggauuacaggugcacaccaucacuccuggcuaagucuuguauuuuuaguagagaugggguuucaccauguuggccaggcuggucucgaacuccugaccucaagugauccacccgccuaggcaucccaaagugcuggaauuacaggcaugagccaccacgcccagccccugccccuguucugaggcguugcccugaugugacuuucuugugagaccuacucugaccauaccucacccacaacaucuucauucccccucauucccucugcucugcuucuuuuccauuguacuuaacacuguuagcuacauaacuuacuauugaugcuauacaacuuauuuguuuuuucuuugacauggugucucauucuuuuacccagcuggaguacaguggugcaaucacagcucacugcagucucaauauccugggcucaagcaacuccuuccaucuuagccuccugaguagcugagaguaugggcacaugccaucaugucagcuaauuuuuuuuuuuuuuuuuuagagacgggggucucacuauguugcccaggcuggucuugaacuccugggcucaagcaauccuccugcuuuggccucccauagcgcuaggauuacaggaacgauccaccaugccuggccuguuuuuauguuuauuucauuuccuacccccaguguaagauccacaugggcaaggguuuuuuugucugcuuuauucaucacuguaucccaagugccuagggcagcaucuggcauauaguauuauucaauaaauauuugcugaaugaaugagugaacacuaaaggaugagaaggaauuaaccaggaaaagugguuagagagggcaguggaaggaaauguucggggaggagaaacaauauguauaaaugccuuaacaaacuaagggagaaaaaacagcauuugcucaucaaacagauggcauaaagucauuugauaaaagucaacaugcauucacgauaaagacaaccucuuaacuugcuuaacaaacugaacaaacucaugaacguacuucuuaacuugauaagguguuaucuaccagaaacuuagagcaaacaccauuuguaauggugcagcauuggaaacauugccacgguccgacuguuuuucugguaucuggaaggguccuacuccucuaccgcuuuagaaguuaggcuuggccauggcacuugcuuugaaaugcuagugaacagaauacauguugcuuuaggguggaagcucccaaagcuuguuccuccugccuuagugauccuggaaguagcugaccauggaggugcagagccucaauuagccuggaucccugagaaacaauaaauggaugccuccucagcccuaagacuuguguuggacaugaaaugugagugagaaauaaauuucuauuguguuaagccacuagauuuugggaucguuuguuacuguaauauaccuugaccuauccugaauguuacauccaaugcagucagaaaugaaucaaugcuucuacucuucuacaauguacuggaaguuacaacuaaugcaauaaaaauuuaaagacaagcaagagguuuaaggauuggaaaggaagaggccaaauugccauaguuucuggugaugcgaucauccaccuggaaaacucaacagcaacaauuggugagcccagcgauccucuugccuuggccucccaaagugcugggauuacaggugguccuugaguguuuugacugcuauccaucacaugagguuaaguguggaauuuuucacugguggugucaugucugugcucaaaauauuucagauuuuugagcauuuuggguuuuggauuuucagauuagggaugcucaaccugcacacauaaucuaucaauucuacuucuagauauuuaaucuaggaaaaugcuugcccagauacauaagaauauauauggauauuuauggcaacauugcuugcaauauuaagaaauggaauaaauuccaaacauaauaucauaaguaauaucaauaugaaguuaauaacaugugggauauucauauauuaaauuauuauuuucagcauuuuaaaacaaugaaacugaaccaaaucuaugugcaugaacauguacagaucucaaaagcauauuccugaguaaaaaaagucagcuccuaagugccaccuacaauaugaugccauuuauauuuauaucuauauuuuaaaaacuuuuauucuuuuauuaauauuuaggccuauguaaacaucguacuauuauuauuauuauuauuuugagacagaguuuugcucuugucgcccaggcuagagugcaauggcgugauuuuggcucacugcaaccucugccuccgggguucaagagauucuccugccucagccucccaaguagcuggaauuacaggcucccgccaccacgcccagcuaauauuuguauuauuuuuaguagaaacaggguuucaccauauuggccaggcuggucucgaacuccugaccucaggugauccaucugccucggccucccaaagugcugggauuacagacuuaagccaccucacccggccuguauuauuuuauauauaugaaauauuucauagcaaaacaaacuaaaaaggagaauaaauguaaauaaaaaauauccacacccucuaaagggugugcagggaagucuguauccuauucugugccuccaggacccacuaccaggugcaguuaucaauuuacuggggcucagucaaucaauucuucccauuuuuccugggcauauuauacacuguauugaaccuugauuuuuuucauuaaacaauauaucuacccaaaggaaaccuguaugcucaauggcaacaaauccaaacugugucagugaaacauacgauguguguugaaaacccaggaaacagaacacagagaugacaggaaauaaagcugcaucucaugccccagcacaacugcagggcauggaagcagcaggaagagcaagugccccaugucugugggugcaggaagcgaaucuguagguccagaaaugcaggauuuguggguuuuuguuuuguuuuguugagacaaguucuugcuuugucguccaggcuggagugcagugucgcaaucucaguucauugcagccucgaccuccugggcucaagccauccucccaccucagccuccacaguagcugggacuaugcucagcuacuuuuuaaacuucuuuguagagacgggggucuugugauuuacccaagcuggucucauacuccugggcucaagugauccuccccacucagccuccuaaaguggcgagaugacaggcgugagccacuguaccuggccgccauucacauuuucauguuucugaucugcugguuguacuggcuaucaggacagugcagcacuaaucuucaugcagcugcauugcugcuguauuugcauccuacuagaacagcugcaauaauuucaccaucucuauuuucuuuacaaaguacuugccugacaccagaauuuuaaacagacuuucugacuaaguggucuuaaacauuccauggccaccuuucuuaguguccagguaauucagaauagguaauaggggaauugucaaaaucaaaugaaguuuaaagugcuucaugguuuuuagaaaauacuucacgaaaggaaggcagaauguuuacaaaucuaauaauuaaauuugaaggacaaucuaaaaagaucuacaaauucauagcuuaacuggccuaagaccgagugagccaucacacacugugggcaccacagcacgaccucaagaacucaggaggaauuuccuuccccaugucacagagagcuuugugacagggacuggcaggaaaccauggucccaccuaguaagauucugagauguuuuccacuccuuuuuuuuuuuuuuugagauggagucuugcucuguugcccaggcuggagugcaguggugcgaucuuggcucacugcaaccucugccuccuggguucaagcaauucuccugcuucagccuccugagcagcugggauuacaggugugcaccaccacacccugcuaauuuuuguauuuuuaguacagacggguuucaccauguuggucaggcuggucucgaacuccugacccugugauccuccugccucagccucccaaagugcuggcauuacaggugugagccaccgcacccagccguuuuucacucuuaagggauauucauuucaguagcuaaaguaacugaaauaauuucuggguugcuucuugguaaacaacauagacuugaaagaagcaguucucuaacuuuuuggucucaucaacacagagccuuuguuuaucugcguuauuucuauugauauuuaguguauuauaaaagacauuuaaggauauuucauuauuuaaaaauaacaagaaauccaacauaugguaacaugaauguuuuaugaaaauauuuuaaaaguauuuggugacaggaguagaauuauuuuccuuuuugaaaaccucuuuaaugcugaccuuagggauagaagaccgcugugcugucauaucugcuucuguguucagucugcugugaugaguuguucugguugaaguaggugaagaaaauccggccucacacagagauguagcuggaaaagggaggaguaauuuaacagccacuucagacauucuggguguguguuuucuuuuguuuuguuugagacagucucacucuguugcccagguuggagagcagugacaugaucucggcucacuguaaccuccgccucccagguuuaagcgauucuccugccucagccuccugaguagcugggauuacaggcaugugccaccacgccuggcuaauuuuuguuauuuuuaguagagacgggguuuugccauguugcccaggcuggucuugagcuccuggccucaagcaauccgcccgccucagccuccuaaagugcugggauuacagacuugagccacugugccuggcuuuacugaaauccuaaaaccacacuauuagcuauuauuauuaaucuuuacagaugauaaaacugagacucugggagguuaaguaacuugauuaagcucacacagcuaggaacugggagugcuaggaauccaacccuagcaguuuggcuccagaacccaaguuuggaccacuauacugauuacauuaagccccuaacagaggaguucuccagggagugggggaagggaccucuuggggaauagagugggcagcggucaguuagagcuuuguaacaccuguaguuguucuaugcuuuuaaacaguaaaguauauuggcauauaauuucuaauguuaaaauuacuuuuaaaaaauuauauauggaauagcuaggugugguggcucaaaccuguagucccagcuacuugagaggcugaggcaagaggcugaggugagaggcugaggcgagaggcugaagcgggaggcugaggugagaggcugaggugggaggcugaggcaagaggcugaagugggaugcugaggcgagaggcuaaggcaggaggcugaggcaagaggcugaagcgggaggcugaggcgagaggcugaggugggaggaucucugaaguuugcauucagcuugggcaaugucgcaagcccuuguuuucuuguuuucuuuuuuuuuuuuuuuuuuugagauagaaucucgcucugucacccagacuggagugcaguggugcaaucucggcucacuggaaccucugcuuccuggguucaagugauucuccugccucagccuccccaguagcugggauuacaggugcgcaacaccaugccuggcuaauuuuuguauuuuuaguagagacaggauuucgccauguuggccaggcuggucuugaacuccugaccucaagugauccacccgccucagccucccaaaguacuggguuuacaggcaugagccacagcgcccagccuguaaaaccuuguuuucuuuaaaaaaaaaauuauugaauauaguuuugggauuauguacuuauuuuucauaauauagugaggagagcuguaagggaguagacggaguucccuaagucucuagugguggaccagacccaacgugaugcagaggaguguuugggaggcuuuccugaggaagcaccuuuuagcugaguuacagaugaugugugucuguuagucaacagaguugagggauugggugugggagggggaagggauuuccgggcagaggaaacagugugagcaaagguccugaggggcacuacagauuccagaaacugagaaaaagacaaguguguuggcccuuagagaaagaggcggcauggcaagagacagggcugcaaaggaggacagggaucagacuucaugggaucuuccaggcugaggaaaggacugggagcauauucuaagagccacacgugcugcugaguaagaugaaaauggaaaaugcugaucggcaccagggaggucccuagagucacuuuagcaggggcugcguuacaguagugaguggaacugccaagaaagagacugaaaguguacacaucucuuucaaaacauguugcucuaaagcacaagaccgggauagaaaggcaccuggaggaagaauggguuugauuuuuuuugcugccauuccuauuucugugaugggaaaaaccucuucacacagagucauauccacaaggauguuuaucacaguauuauuuauuaaaacaacaccaaaaaaagaggaccuacauauccaacaauagacccuuuaaucaaauuaugggauauccaaaugaugcaauacaacucaagacuuaaaaaucauauuguagcagaagggaaauacaacuccguauguaugagacagaguuuugcucuucuuguccaggcuggagugcaguggugugaugucagcucacugcaaccuccgccucccagguucaagcaauucuccugccucagccuccugaguagcugggauuacaggcacccgccaccaugcccggcuaauuuuucuuucuuucuuuucuuuuuuuuuuuuuaguagagauggggucucaccauguuggccaggcuggucuugaacuccugaccucaggugauccacccaccucggccucucaaagugcugggauuacaggcaugagccaccacaccuggccaguguaucauauguuaaguuuaggaagcaaguuauaaaauaacaaauguauuacgaucccauuuugguauggggaguugaguauaugugacagggugucuccuucaucuguuccuuucuucccugucuucauccuugguggugauggugguaguggggucuuuggauauaaugcaccauaauaaaaauuaugccaagagaugugauccacuuuaucaaaaaggaaauguauuuguuuuguaggugcuccacguggggacacacgaggguccaccacaaucucccaggagggagcuggguccugggaggagggcagagggaucagagagagggagaccagggggaggaguuucuggccccaauuuuguaccaaagcuggaaaaaacaaaguguugcucauucuuuggauuuuggaaaauuugugauagauuauaagacagauuuuuuggggggguauugaagaaagguguaaccacucauuaucugaaaccacaggcugaauuuacugcaugcuuaagcaagggacagcuguacuugcaaggcacagcguaucucugagcaaagcagagaauuaaucccauacagguuuugggaagugugugguuuaaggaugggucaacgugugcugguugaucuuuggcacagucauuggcaugcagcuguugccgacugguuauuuucagaagcguggggcuaguccugauugagugcauaguuucagcagcacaguuacugaaacacauggccauauaaaccagguuuauaauugguucuaagagucacuugauaucauagccacauaccaauuagucuuuuccuaagagggugggcauguuuuauucuagggggaagaaggggaagggcagauagcucuauauacacacaaagaggaaggucucaguagagcagccugugugucuucuccgcugcuggagcucaucuugacuggccagggcugguuccuaagaaggaucccaggcacccagagccuccuggguuuggaugugagaggaaaguccugugaccuccuuugccucucccaugucuggagagaagcuguauuuccggcuaauccaggagcgacagcuccagggugcaccccagguucugacauggggacuugcagcacccccccagguuggacccugacgugccuggcaccccuugugaacccaagaccucaacuucagcuucuccgcacagcagccauggccagcugucagccgccaccuccuccgagaggcuggaauuccucgggcagauuucucacccucgcaggacuucuuuccagcgugucuggcaagugagagggcuucgcaggccccaggagaggcuuguggcagagagggcuuugaaagggagaggaggagggaggguacugcuguuacagcccaagccuuaggcccccgcugaggacgucagguggcccaugucuggaaacacccagcgcuguggcccacguggugacucuuggguggcccaggcugggugugugggggcagggccucagagaagagagaaggagaaggggaagaccgagggcuggggguggcgguggagaggccacugaggacagggaguggaacaaccuugcagagaguggugcagggagaaguuacuagaauggcagcacccucucccgccacccaggcgacaccucucggggaacccaccucugcgagggagcccucaacuuccucccggccugaccugccugcucgaggguuuccacggucacaaaguuaccucagggacuagaaaagaaccaucuuuuuggccuggagccucugagguggggccuccucggccucagucacagccaaggucagggggaaggagagcgccccaggcuucccucaggaaaaggaaggguccggcuucuuuagggaaacagcugcugggaucuggugcugacagacggccaucuuuccacaccaaggcucuggccugucaccacccugucuggggccucgaguucccaccagaguuuucauaggggccucuucugcugacccacccaauccacccgcagauggucuggcccgccucucagacugggagcggacccagcucacuucccuaccgccccacugcccuucucucucuccauccucaagaggaggugagguggugaggggcagugagcacaggcuucggauucaauuccacgucagucacuuaugguacaguuuuaaauucugacucgcuuaacuuacauggcuuuggaccagccugggccucagcuccuucauuuguaagaugaggagguggaaauggauuauuuguaaacuuucuuucagcccuaaauuccaugaucauaucauauuauuguuuaauuucuaauuuuuuuuuuuuagagacagggucucacucuguugcccaggcuggagugcagugacaucauagcuuucugcagccucaaacuccugggaucaagcaauccuccugccucagucucccaaguagcugggacuacaggugugcaccaccauaccuggcuaauuuuuuuuuuuaauuuuaauuuaagauggcaucucacccugucacccaagccggaguguaguggcgcgaucucagcucagugcaaccugcaccucccaggcucaagagauucuccagccucagccuccugaguagcuggggcuuguagccccaugcccagcaaauuuuuguauuucuuguagagaugggauuucaccauguugcccaggccagucucaaacaccugggcucaagugauucaccugccucggccucccaaaguggugggauuacggcgugagccaccaugcucggccauaauuuaaaauuuuuuuguaaagaccucaauucauugccaaagcaauccucucgcuuuggccucccaaaguguugagauuacaggcgugagccacugugcccggccacguuauuguuuaaaaaacaugccucuugcagccuagcacagcccuaacuccccagcauggcacccggggcccagcccgccuaccagccuuagccaucacccucugauucaccugccuuaagcaucagccaaacugaaccgcuggagagucccuguacagguagggguuuugccagcucuggggucuuuguuaauggguugccuccaccuagaauggcuuccccagucaucuccccagacccaaaucuugccuacucuucaagucacagcucaaaugccaccagcuuugcaaagccaguucugauguuccccagcugcaggucaucucagguggcuuuagcagcucuucagcugcauucuuuuagcuacauggccugcuuuccuucuauucuaaucaccuguguauaucugauuccgcugacgaacuuuuuaaggucagcgacaaugucuuauuucucucugcguaacccuagcuaaucgaggugcuccccuggguucagucucugccuagugucucacugagugggcgucucucaaagaacauucgggccugcaauguuagggagcaugacagugcuuccucaaagcccuucucaaacugucuuauaucaauagagacuccacagcaaaaccccaaacuccuucucuagucccagccccgaggccuuuuauuucccucugccuaccugcuugcuuucucuuuccuagcuguuagguagaccagcuuagcccuccagcugugaucucucuccuuauuccccuuauuuauugcagaauagaauuuucuuuaguagguagggaagacuuuugcuugcuaauauacuuugcccugucauacauguaucuacuacaaaauaccuaggccuuguagacucaaaaaaugcucaugagugaauaaaugaucaggguuaccagcccacgugcaugauuaagaccaaacaaucuacuucucucuauccuuguuacuucucccuagaccaaaccaccauaauugguugccuggcuucuccacagccuuugaagugguauuuguacucuaaguuuuacacuccuagagaccauuuuccacauaguggguggagugauuguucaaaaauguaccuaauggcugggugugguggcucacgccuguaauccuaacacuuugggaggcugagguggguggaucacuugaggucaggaguuugagaccagccuggccaacauggcaaaacccugucucuaauaaaaacacaaaaauuagccaggugugguggugugcaccuguaguccuagcuacucaggaggcugaggcaugagaaucgcuugaacccggcagguggaggcugcagugagcggagauugugccacugcacucuagcaugggugacagagugaaacccugucucaaaaagaaaaaaauguaucuaaugucauuucauuccccuguuugaaacucugcagugguuuaucucacauuauaacaaaauuugaacuccuuacccugacuugcaaagcccuuuauggucuggccccuggcuacuuccaacaucacaucccauauccccccucccugcccaucaugcuccagccacacugggguuccuuccagcacuuuccaccagcugugcccucuggagugcucuuaucccugaucuuuacaugaccaacuccuucuuguccuucaaacuuuaccaucaaugucaucuccacagagaugccauccauaaccuccugaccuagaguaccuuccccccaacgcuaucucuucaccuuuccuuauuuucuguucugguuucuuauugcugcauaacaaacuaccucaaaacaauuuguuauuauaguauuuuauguuucugugcaucaaggaaaucaaacggcacaguggauacagcuugucuuugcucuguaagaucuggggcaucugcuaagauaacuguaauggcugcggguuggaauagcuugggguuggcugagucucucucucucucucuuuuuccacaucucuauacggccagcuugagcuuccuuccaacauggugaccucaggguaguuggacaucuuacaugauagcauaggguuccaacagaccaaggcagaagcugccaguccucuugaaagcuagacuugaaacaaguauagggucucuucugcuauagucuacugaucaacgcagacccaggccaauucagauucaaacagagggaagacacuucaccucuuaagaggaggaauguaaaauaauucaagagcaucucuaauaugagagaacgcauuuuggcagcaagacauuuucuuauuaauguauuuguuuauauggguaacuugcuuauugagcaaguuuuuuucccccuuccaucauugcuucuagaugaacuauguugguucuccuuuuucugucccguaacaguaucuugggcagaucuucuaguauuccuguugcuuuagcuuauuaaaggcccagccccaucuaggcugguccaucuaaccaagacuaaccauuucccuuccccaggcagggucuggauuuggcccaggggaguggggagggguguaguuugccccuguacccccacuccucucucucucuccuccuccuuuucucuccccuuuucucuucuuucacacagauggggagggagagcuuucaggaaagucccugucagcuguggccauuucuucucuggcuaugaauguucccggcaugauggcguucagaugcuaacucucuuguggguucaccacagggccaccucgcaccacuguucccugaugugagaggucccuucagcucuauaucucucaccccaccacucagccacugccccaaccuccacccaacagccuaccgacugugggucugcacagcugcaggccucccucuugggaggacauggacaagacagcucaaggacaugcaccuuccgccauguccaccugacccaugggcaacgacugcugggugccccaaggagucccugcccugucugucucugccucuucaauccugcccucccccaaccucccuguccagauggcgcgugggcugaucucaacagcaaauccagauccagggagaggaggggagggagucagcaccccaggacuccagugacccaucucccucucucuuccuuccccuguccuggucuucugcuuauggagacugaggaagggggugcugggagauuugggggcauagcagaauugcuuuaaccaucucuuaauaaauccuguaggcaaaugggccuagucucaaaugguuccuuuguuuuagaauaugggguacucaaggcccuuuuuccuuagcucugaguccggccacccauucgagcagcagaaaaggcccacccaguacccucuggcacuagagcaugggcugucucuccccucgcaugugugguccacgagagcaggguccugugugucuguccccacuggauccuggaugccuagucagugucuaggacacagagggugcuccacaaauagaugacaagcaaaucccucuaggaccuaaauggcuggaacggcugccaauauagucaaguaggccagcuggcuccuuccuacccauuccugcugcgaggcuccugcccacggauguggaguuuugcuucuggcuuccaggagcuuuucugguuucugucuugcucucuacaggggucacuggccugggucgggaggcugcccgccaugugggugaccuuauggagccaaaagccuugaagaugcuaccgggccuggguugggguccucagggcugagcuagaggccuggccagugggaggggaugggugcucuucccaguucacagugggucaaaggcaacagcucagaacagcugcagcuaaagagaggagaggcaggagaggaagugcauuucuuuggcaaaguaugucuccuggggcugacucacacccgucuaugaccacagccagaagcacauucugaccagcguguccugcagaguccccaggccucggugaacagggcaccaaggacagcugccucagcagggccaccccacuccgcuggacauccccagcuccccucaaagccccaggcaggccccugugccccugggucccuguggguuucuccucagcagccucaaaugaggaagugaggcugaggagagaaugggggaacuucucuucccccaauacauauagcagcauauaacaucaaagacacagacacacagacacacacacacacacacacacacacacacacacacacacacaccccuugcaggucagaagcagaguggaguuugauaguaagugguuuggauuaaaaaaaaaauaggccuggcaugguggcucaugccugucaucccagcacuuugggaggcugaggcggguggaucacuugaggucaggaguucaagaccagcuuggucaacauggugaaacccugucucuacuaaaaauacaaaaauuagccgggcaugguggcgcacgccuguaaucccagcuacucagaaggcugaggcaggagaaucgcuugaaccugggagguggagguugcagugagccgagauuguggcacugcacuccagccugggcgacagaaggagacuccgucucaaaaaaaaaaccauuaaaaaauaauaagaagauuuauuuuuuuccugccaaagcacugaggaggaagacggaaggaacugggggguaaaaggcagagaaauccgggcagcaucugcugguccuugcgucuguucagcagcccgagcaggcuauacgugcugccguucagcgcccugagacccagcccaggaugucuaucaggagggccggaggaguucgggaguccuugcggcacugggcuggggcagcccuaagcccugggagaggaggagauugugcucuugaugcuguuaaaaaguggcugggaccagccucuccucaacuuuggaaacaaaacuacaucuugggagcuccucguuagggaaggggcgaccccagggugcuguagaagcagguugggcgaccuccggggcagccuugaaguggccuccacaggaacagucuccagugaccacccagggccaccgagacuugagccugggccccaguagaaaugugucaaagccagaagagccaucuagccaggccccucaggucagagaugaaacgugaaggcagagggaagcccagugccacucggugaguuauagacaaagccaggccucugacccccgcuucagugcucuuaacucuccaucagccauuucaccuucuugggccuaaguguccucagcugucaaaaggaggaaggaaggagcaagcuaacauguugucgugagcugugacaugcccucucgucgacugagcgaggcuuuugagauaaggaaacugaggcucggagaaggugcugugcucuuccuguuacaccccgaucccugggucugucuggcuuccguucccggcugacgcucacugccccggaagacacacccacuagaucagcguuuccacacuagaauacuuuauucaagagaaucuggcuuggcagucagauggcccugcagggacagcuugugggggugccagggcccuuggggaaccugcuccccugccacugccuucagcugggacgcacaggcuccuccccuggugaccucauccccacuggcugagcuguuucucauccaggcagcucuuucuccagcccggggcccacucuguaugugucucuuagggggggcagggugguggcaccuuggccggaaagaacaaugucccaguacaagcaaauggcaaagugugaggggagaucacgggggacaaggaguggcaaaagcccccaggcaaccacuguucuccagagcugaauguucugaucuucagaagaagagggggaaguggcuggauccccuccgcccgcugccggccuucccaccagccaggccguggcggccccagcaggauccgcaucccuacuuuggacaggagcuccgaaagcaagggcugcuugucugugcagagccugaggcccaagaacagguagcagggcccccuucuuuccuucugcaggccccuggagaccuccagggccucuggggccuagcuugccccucacgaggccacgugucuugcuucuuucaaagcggaagcucccaggggucuguggcuggcuucucucuuucucucacguuguugaaggcacugaauuccugaggguccuguccuucccugccccucgucuugaagggagcgaggcauucagcagggaaacaguuggcuaauaaauagagggcagguaccagcaggagucacugaagagugugacgguaauaaauacacgagccgggugcggggucucucuccuccaagggguggguuaccuccggggaacagcaucgccgcaccugccagagaccaagcacagacggggcggguaucagcacacuguggagggugcggucuccuccuauggaggagggggcaggcccagaggaggagcuugggcagggagcauggggagggcgcagugcuccugggucccugcuugcuucaagcugaggagaagcugggagcuacccuucaccaaacacuuacccaugugcccagcccugugccaagcacugucuucuuaacccucaacaaccuuccaugaggaaggcacccugauuauucuugugaagauuaggaaacugaggcccagagaggugaagaagcuugccuguggucacacggccagucggugacagagccacauuugaaccuaaucacacuccaugcaaucaugccucugauuacccuaagacagcagucuccaaacaggggaguaccgcuagacgcacgugaggccugaguacugacgguuuuaaagaaauccauuuucagccuccaggucuacauugccuuaaaauuauuuuugugaggcaguggcugagaucugcuucucuggccacaacacaucuugcucauucuaaauccucauaaagugcuuugcugccagguaaaaguauucugaggacaugaaaaaaagaacaauuugagauauugauguaggucuugagaaagaaaauauggcuaaugacuggguaaccaaggcuuucaacaaaacugaagaacagcuuaaccaaauugucagccaggauaucaugagaaguaauuuguucuuagcagagcaccuugagauuucuggcaaauaacuuggaaggaaggaguucaaguaauugagugacaucuagucucauuuacuuauuuaugugaacaugguuucucaaccuucucaucaauaaaaaaaugauaaacaggaauuaaauuaaugcagaauccugucucagucuggcaggaaguaacauucauuaauggauucauucacuaauugaaacgagguagccacauccaucucauugagaugcauucccaaucaaauugauuguauuuuuauguugaacaucuauuaaaauaggaaguauuugugcuguuuugaccaaauggugcuacuaagaauuauuuugauaauuuauuccaggagaaaauuuaauuuagguuuaugcucacaggaaauuuaaaauaauucaaacucauauaucauuuuuuuguggcagauaaauaugacaagguaaucaauaaaagacuucugaaaauuaaaaguacuguuacacuaggcugaaauucuuggggguggggagugaaauggaaauacaaguuccaggaaaaaagaaacaauguaaauauauaauuaugaaaggaaguguuccuguauuuuuuuuuuuuuugcuuguuaauuuucuuuuuuuuuuuuugagacggagucuugcucugucccaggcuggagugcaguggcgugaucucggcucacugcaaguuccgccucccggguucaugccauucuccugccucagccucccgaguagcugggacuauaggcacccaccaccacacccggcuaauuuuuuguauuuuuaguacagaugggguuucaccauguuagccaggauggucucgaucuccuaaccuugcgauccgcccgccuuggccuccaaaagugcugggauuacaggugugagccaccgcgccuggccugcuuguucauuuucuuaaaaguggaugauggugaguauaacauuaaaauggcguauuuaauaggauacaccuggagaguguucuacaauagcuuuguauuaaaauauuaauaauaugccagaaauuauauccuuuguaaugacuuauacuuuuuuuuuuuugagacagguucuuacucugucacccaggcugaggugcaguggaucuaucucggcucacugcagccuugaccucccaggcucaggugaucauuccaccucagccuccugaguaguugggacuauaggcacauggcaccacguccagcuaguuuuuguauuuuuuuuguagagacgagguuucaccauguugccccggcuaggcuugaacuccuggccucaagcgauccacucgccucggccucccaaagugcuagaauuacaggcaugagguacugagccuggcuugacuuauaauucugaugaaaauguucaaugucaacuuaagaaugggcaagggagcacaugggcuuuuggaauucuuuuuuuuuuuuuuuuugagacggagucuugcucugucacccaggcuggagugcaguggcgugaucucggcucacugcaaccuccgccucccggguucaagcgauucuccugccucagccucccaaguagcugagauuacaggcaugcaccaacacgcccagcuaauuuuguauuuuuaguagagaugugguuucaccguguuggucaggcuggccucgaacuucugaccucaagugaucuacccacuucggccucccaaagugcugggauuacagguguuagccacugcgcccggccacuuuugaaauucuuucaggagauucccgagugaaaugucugaagacugcugccuugggaacaggagccacgggacacuuucugccuccggcugccggcggguaacucgggccuggauggacuucccugccagcuuguuucccaaauugccgcgcgggcccagaaaagagaugagagcauaaaccccuagggggcgcaguccccaggaucccugucuucauggaguggggcucauggggucagggcuugggucaacuccacuccauagcacgaaaugacuuccuggagucacgugcgugggggaggcuuagccccugaaggagagccaccucucuucagugacugauugacugugcacgugaaauauuuuauuuuuucuauuuacucucacagauuuggguuuucccuccucucauccuucucucccagccacacucaggccuggggcuccauucugcugcccacaagguacgaaguggguuagaagcagcaaggggacccacaggcaaaaauacuccugggagacaguggcgaggggcacauguuccccggggcuacuaggaaguggccccagauaacgucucagcugaugacagacuuuuaaucacuaaaagguaaacacuaaugugcaggaauccuguuuguuugcucacagauguaccugacacacaguaagugcucaguaaauguuuguagagugacugaauguuugcuggaccuccugccccucauucuacacagagaaaagcuaggcugacaaaggugaaaugauuuguugaaggucaauggaaaccuagggcuaagccgggacaaaaaccaagguccacugaugcuuccugggcccuagagucuugaggaggugcagcucccuguucugcccccaagacuggccucaguccugccucucccccuccccaaccuaacccuggcggcaaggcggggcuccccucgggcccagccuccucgccaucccugggaccccgcacacucacagguggcagucugugggucucugcuucucucuccuccucuucccccugcccuugggucuccuccugcaauaagccaagcgucaggacaagguggcuggggaaccccaugcuaggacagaggcuggcaggcccgagaauagccccgagccccagccaaaccacuuaccuuuccggcuucaucuucucccgcagaggccuagggaaacagacagagagaggggcagaggaacguuaggaaagcaauaaguggggcucccugccgcccggacagguccccuccgacauccccaguccugguccugcagcugacacugaggccacuaggggguagcauggaguuggcaagggagagguggccagagccucaaggcuucacucccacuccaggcucuggugaccccaccacgagagggacaaaucaaccuccuggggaccccugccacccgcuucugcacuucucagccucuuggcaucaaauuugguuguuucugucuguucucuguugcuuuuucuuucucacuuucuuugcugcuuuuuuccguuccuuccagggugcauucugggaauuuccucagggacaggagaugauggccagacagcggacuggcugccugucagggcacagccccacuccauccggaacaacauggggagugagcgacggggugggaggaaggagggagcaucagcccugaagucaccaggcaugucugggcucugccucccagggcuguggcuguuggcccagaagcaagaagaaaggugucccuguugccuggccccuggcaggggauagggccucagucuucacugggaacaguggguagagacaugggacagcaugguagcagucagcuuuggggccaggacaugcuacccucagcugguuccucccuugggagccagggcaagguaccagggccucuugggacugucugguuguaccucuccauauugggcaagugacagacacucuuggaaccucagucucuucaucugccugccccaaaagaguggcugucagggcaaaggggauggagaaggugacucugggucaccacccagcauugcacccaggaggguucauuaccgagcucuuguuauauggcuaagcucuggcuuggagggauggguggaaacaaguugaggcagggucuccaacacuccaacaaaaggggcagccauagcccugcccaggaggcaaggcuaagccugggggcuauuagaaaaguggucauggccaugaaagguagccugaaaaacgaaggcuuacgaguuaggucagggcccagaaucccuccucccacacucacuagcugugauaaaucaugaaacuguauugagccuugauuuucucaucuguaaaauggggaugacaauagggccuaccucccaggguuguuaugagagcaggaaccuugcucaccacugcaucccaucaggacaaugccuggcaugugguaggugcucaauaaauguaugugacuaaaugagaaacauucaagugccuccugcggggcuaggcacagaauagguacacaauaagugguagucuucccuccugccgccccuggcuagggcucuggacuucuagucuggugccuucauccauggcccaguaguaccaggagcagcagcucagcccauuucucucuucccugaaccuagcuggcagugccaggccuguugcuccugcuaaccaauguuccaagugcccccagcacaggcagcaagacuggugcuggucagaggcucuguggauugggaggggccguagaggggugcugcaacaucaaggaagccacagugucacucuucuucugccccuuuucuccuacccgagcuuguccuucuugcugcuucucagccccguuugcccgcuccugugggcacacagcuugccccagaacgaaguucagacuugcaaugucuuugccuccaggcaccucuuucagaggcccguggcagcugccucccaucccagagaaggggaacgacacgcaccgaaccccugcgaggcugggagggacccacccucucucuucccuugcaguaucucaacagcuguaccccagcugcugggaccagcucccuuggcaaaacuggcugguggggggacaaaaugaaugguagccaccccugguccugcccucuuggucucccucagucuggaaaaaaguucagcccgcagcggggaugggcagccuuugccucugcccugggacccaucuuugcugaggcugccaagaggacgggggccuuuccuugcuacccacccgaccccggagaccuaccggcauucgcagcgaacgugcugagagaacgucagcuccacguaggagggccgguccccagaacggaucuuuaggagcugaaggaagaaagaguugaugccuggauuggggaguggcccacgaguuuccggcacucuucucucucuccuuguaaggagaacccgacucuguuuccugcuagccuguggacuacaggcccucacuccacucugaacguggggcaaacagcucucucagcugcauggggaucugagggaggccccugucccucccugcccgggagcacuagcacagcaauagcacaggaagggggcucauguucuggagucagagagacccguguucagaucuugacucuuuuaccugcugaacaagugaaauaacaucucugaaccuugaguuccccauccgugaaaugggaaugacaccagccuugaaggauugaaugacacaccacuuguggcacgccuaggacagugcuuggcauuacucaguaagugcucaguaaaccacugcgugugugacauguaagcugcacuugcuugaaaagggaccaaaugcuccuggugucaacagggacuuuauacaagcagauuucuuuccagcuuuaacuagacacccugagucuugggauaggacucagcgugaggcugagaaugcugguggggguggagaugagugggcucagagccaucggagggcuuaggaagaagaggcccugggcuggggugguaggagcacuggccugggagucaggcuccagcccugggaccugggccuaucuucuucccucuccagguaccuucuagugggcagauucgguggcccccugggcaggguauggaccuaccugcauggugacauuggccgucuccaccggcacacagugcagauucucaucgccgcagcagccggugcagcgcagcagggagacacaggaugggcugaacaugugcuccaccucgcugggguacucggacacgacguccaccagccucuccagcgcccggcaguagcugcggccccacacuuccuggaaggguaccacugcgaggaagcaagggggcugggucaggccagcagagaccugccccuugaagcccuaaaccuggcucccaaggcccugcuggccuuccagguucagcccccagccccauccgagcucccucaacucugaacuccuaaugugaucccuccgaaaugccugcgggccccuuagcucaucugcuggauggaaauccccauggaacagaaucucucagggucccaagcuuugcucuguccucaacucaggcacccacgucugccuuggcucccuggagcuuugaggauuguagccccggcagcuacccaggcccucuggaucuuucucaagccugacccggugcuuccuccaacuuggagaacuugcagaaaacagucauuccuggagucaugcagggaggguuggccuucccuuauuccucugcucaaacaccuuccacggcucccucauuuccugccccacucugugccagcuccucugccuggcaaccaagaccacauccagcaauguggcccgacccuccucuccacugaguccaaccagcgcucacacugagccacggcagcaccacauucacucccagcucuggcuugugcacucugcagcccguacagcugcucuucuucccccuccucucauuucuauccaaauaaaguccacccgccauuuuccacgaccugccuccccaccuccucuuugaagacuuccccagcaauuccagugcacacagaugagccucccuugagcacugcuuggccucuggccucaagggguugccuuaucuccggcacugcuugcucuuaucuccuuuacaaccaacucgaggcuccaugagggcagagauggacguacccguaaacacaggcuaagucacuccugguugauuagaugacauuucacugaggaucauccgggucaucccugaccucacgauguccuggcgaucgugaaugggaucuuuugggggcugaucuggaaucccucaaaagaugcugcucuuucgggggaaggccuaggaccaggccccaaauagaggcucacagggagaguggccagagucagacaccuggcuuccaguccuggcccuacacuggcuaugugaccuuggggagaucacuuaaccuuucuggauagaucaguuuccucaggugggaaaaaagaagguugggaauaaaugguugcuaaggucuuucccucucugaccaaccgccugugaaucagugccugcaacccagcccagcccagagaccauggacagagaaacacccccaggccugggucauccugcucugcaucugauggucauccucagcuaguggggaagaauggggagcuggggguccugcagccucugccauggaacaauggccucucccagcaaccccucauuucuuccaugccucugccuaggaggcagaaggggccaaaguccauuccacugagccuaugaggacaugagccuccugguaaucucggaagaaaaauaaacuucaguccuagcagaggcccucgggaaaggcugcaaacugguggaaaauacccagaggcgguguguccauguggagcuggcuaggcagucauagaggcaauaaacaguguuaucugcuuguuugcugcuccauucugcuccauucugccgugcucugcuuagagggcacuagggccuaggggcuggugguggggggaauccauaggccuccucugacucuaccacuccgcgccacuggauacugccccggaacccagugggaaacaaggccucucuccccaaaggcgcccaaagugcagggaagccugccuuugcaauccugggucagagagcaccucccuaucaccagcuccuugagcuguguguuuaguuuaaaaucuucaugagcacuacgugacucugaacguuuaaucuccaccuuggaaaacauaaauaacagcagaggaauaaugagcugccaaagcaccacagaagacucagguuccugcccugggaccagccgucagcgaggggacagcagcagagaaggggcaccccagcccccuccauccugcaaacagacacccacccagcugggcugcggggccauggccaccuuuggcagaacuggcugggccucggcagcagaagaagggauuuccuuuccucaccccacaucccaccaugcagguuccgggucccugaaacccuggaaucugccacuuucccagcccuguggccgaacuguguugggggagggcugagaaggaggugggcuggagccugguuuaccuggcagccaccaggaaagggcaauucaucccugaaggccccgcuaugggugugugggagaaacaaaaggggcugggugaggggccgggcugagggaguacagugaccgcucccagaugugggcugugucccucaggaaagagcucugcucagcuguccccgagagcacuuccgcuggccccagaccugcuccgggaggggguggaggugagagcaacgggaagcuguggcccccucagggcccccucaggcacugccagggcugggugguccccagggcugcuccugaggcugcaagugugcccucagcucucucgccagcccugugagugagccucccaccugccuaccuaccaccugggaugggggagaccccaggagagaaaugcuuaauccugagagcaaguuucuguggagggcacuggagacgggccacagggcugggcagagccacuggccaccagcccaagcccacaaguguccucuccauggucacuggcagggcacacagacagccugccacaagggacacccugcucaugcccgcucagccacggagcuauugggagcacuugguucugccagauccaugaggagugucugaggcuuggggcgacccccagggccucucugagccucagggccugccugcaucuguaaaaauggaguacaaccccuuccuacuucacagccuguggucaaaacagaaugacagaaaaugccuaacauuguuaccgugaauaguaauaguaaaaaucaaugcccauggcuggccaugcugucucuggcugugguguuaacagguggggaugccauuuucagauuuugagagcuggggugcaaagcucguuguacuucucccggucagauugcagacucccugauugauaagugugacaggagagcugaccuaaugaaucuacacuuccaggccuccccaccucaaauccugggugauauguacacccauuucuccucccuggagucagaggacaagucccuuuuucaaucucggaaaaagaagaaaccauagacaucauguagccaaggcucccauuuuacagaugagaaaacugaggcuaaggcaucuuugguagcuguggccugaccuacacuaaaagcaccaaaaagggcauaguguggagguaggggauggguccuuccccaaaucccaaggagcauaauguugugcugguuccagaggcacagcaagggaggcauccaugaggucaagggcagcuaccuccucuaccugcucaggggucuaggggccuaagccuuaggugucagaguauggccaggcccgggagaggcgggcugccaggcaggcagcccagcagaggguguucccagcacgcagauggcuaucacgcgugugcgugugcaugucccuacaugcccacucucccauggcgcaggggaaaccucagcggugguguguggccacuuugcacgucuuggagaggcagggagggaggagcgagguagggggccuggcaugggccuccugccuucuguacauaugucucuuuggcaaacgucucguugcccuuugaagacucccucuugaugcaaccagggcggggaguggaggggccagggagggcgcgacuauguucugucuguuuauaaucaauggaaacgcauggucagaucccggcaguuccaccagggcugggcugcuggggagggccccucacccauuccugauccucuugacugcccacugcauucagcucccagacccccauucuggccccuggcacucacuccccacccuguccuccaagaccccauccauacccuuaaaucaugcuggggaagggcucugagccagcuggaugaacccuggcuauacuggccccagccccacucuccgugugcuggugacuccagcccacaccucucuagucucugggucaccaugaggggaucucuuaggcccugccaaagucaucacccagcaugucuagcuuguaggcucuccccagcuuuuaucaaccugcacccacgcuucaugccacaccugggcuugggagaaaggaagagaggggcuuggggagcaugcguacccccagccuggccagcuuaccuuccaccucugacgagccguucccagcagacaaggcccacugcuauggacagaaaagugcagaggugagcuggggguaccuuggagcucugcacucuugggccaagugugauggcaagaagguaggggccccucuggguuccuucccacuugcugcacaugcucugcccugucucagagcagccugaguaccacuaaaaacucacuggacccuggguagguuaggucccaccccucucuggccucaguuuuccucauuuggaaaaggaugggaggcuagaagcuuuuggagacccuuggccugcugcaucccaaagaucuuccaauccugcgggucugccuucuacccagcccccaggccaacccugcugggcccugcacagcccgccuuggcugggugccagagcccagggggaggugaucagcuggugggagcugaggggcuggagcggguggcgccaugagcuggugcagccgguaacguuacaccucuggccagcccugcagcaggcaggcggguggcugggcugcucggacuccucagggacugcccagcccacuccuacucuugggcuggggcuggggacucccagggcagugggacaacgcagugggaaggcaguucauuggcuuugucaggauuucacugcccaagcuggcucccagccagacucacccggcuccugggaaaagggcccugcucacuuccccaggcccugcacucaggaccuccggccacccacccaggagaaaaggcacagcgagaccccuugucucguccccagcccacccaggagcccacggcucaguccugagcccuggugggggcagggccagccuccccaccaacagcuucuucagcuggcuccuccgccacccccaccaggccaggucagagguccuggggacgccugguuggccauggggccucgacccugaccacaaggccagggacccgccugggauuaguggacagaugcuuuuagcaaagccaccagggcuccaggggccagacaggaaaccucccucccucccucccucccuguggcuucccugcccccaccaagacagcccccaggaccugggggacagccagccugaggucucuucccaaacgaaagaaguccagccuggccuuuaggaaguguguggacauccuuggaguugcugcucccuggagugggucugugauuucagagucccaugcuuccagugcugggauggggaggucuggggagccaggcuagguggggguagcucuuaccugggggggcacagcaggcagcgccagcccggccaggagcugcaggaagcaagggaacagccucaugaccggcaucuucucagacgucccgagccagggggcuccgagggaaaaccaccaugcucaucccccggggagccccuggcacaggaggagaagagcugaguggggggcuggacgccucccucacugcugccccgaggccccggccggugguucgagcaucuucuggaagccuugcggagucaggagcccguagguaaggcuguggcuggggaacccgacggggagcggcccggcggggcggggcgccgaggggcaggcgggucccggggaugguccgucgggcgcccagugccacuccagguccucccguagcugggcggccguccgucgaugcaguuuccuccgcagacagcagcucccuucugagacugcagccgguccgcgccuggguuucagggacugagccggggcggggcuccgggccggccccgcccaccgcagacgagguucccgagccgaguucccggagcgcccggucagcccgcagcgcccggccagcccgcagcgccggagcccgcagugcgugcgaggggcucucggcagguccagacgccucgccgagcccagcccgcagcuccccgggccgcgccgcgcccgcccacagggcccacagcccugcuucggcucucagggcggucaccugggaugggggcauccaggaguccagcgucagccgucaaggcucaugaucuaaccgccucugcaggaagggccguccgggaugccugggaaggcagccaugcccacaccccuagggggccaagggauuccuagccagguuauauagaugaagaaaccgaggcuccgagagcaccccugccugcauaugucgaauggacauaggcauucuuggaaaguguguguguguugugugugugcgcgcaucuguguguccgaggaacuggcagagacaaaacccaagccuacgugacuccagaacucuaacccgaccuaccacccuccuagccaggcacggacacagugggccucccacaggaaaccucucagggcaccuggcuggaggaucaggccuguugccuccuugggaagcagucuucccaggcccucccugcggggcagcccccugugguagagaguggucucacucaggcaucuccuccuggucccuggccgaggaggaacuguacgcugcgcgggggucugugugcaucugcgcgugugcaugggcauuugcgggucugugaauauccaugagcggugcaucugagccucuguguggucugaguacgugugacuacuguaccuccaaauacgccucugugugggggucaggucucucuguaucucuguaugcuugugugaucuguucguguccgcuguguaucuggguguguuuggaagugucugaauguguaucuuucggugggacugugagucugcacgccugccugucucugcgugugugugucugucucugugggugaagacugugccucucucucugcguuugugugugcccucccuugguucuggaucuuucuuuaccaccacuccucucacugccuucuguguccagcucccaggcugcaggaaccuggcaggacugggagucacgaguuggcugggccuggggcugguggguggcugugggggaggagcgaggccugggaaguggccccuacagcucacauuccagccaagagcagggaggccagggcagccccagcucucaccccagugaccucugcguccacugccugccugccugcccacccacgaggggcugccagagaugcagccugccugccuggccggcccuaagccuggagguucaggaggcgggggccagucaccagcuggcuaagcggggucugcaaggaacauccugacgagcuucaaacaagcugggguucgugggguagacaaacugcuuccugggcccagaaucauuguggagggucacugugcaugugugugagggugaguagguguguguuugugcauauauguauuguauauguugcccauaacaucuuuguauacauacacguguuugugugugucuuuaguuuggguauggauuuguguaugugggcacagguguguauugugcacaagugugugcgcgugugcuuaaguaucuucauuguauaugcuugucuauaacugaguguuucuagcacuuaugcaugggaugugucuauuguguaugaguuuguauuuuuuuuuuuuuuuucugagacagagucuugcucugucgccuaggcugguagacaguggcgcaaucucggcucacugcaacaucugccucauggguucaagcgauucuugugccucagccucccaaguagcugggauugcagguguacaccaccaugccuggcuaauuuuuguauuuuuaguagagacagguuuuugucauguuggccagacuggucgagaacuccuggucucaagugauccacccaccucagucucccaaagugcugggauuacaggugugagccaccgcgcccagccuguauucauuaauuuguuuuuucauuuggcauguauugccugagcccugcuaugcuccaggaacugcucuaggugcuagggauaugauauggagggucucucugaguuuacauucauggaguagggggauaccgauggcuggggaugccgaaguucucuuuccugagugaacucaacaccuugggcgaagucugugguucccacaagugcaccucaguccuucaucacuaaauuggggaccauacccuucuaaacccagcuuccugggcugugagaugaauuagccuaggguaggcucagcggcagagaccaaggagacucuaacauuuccauggauugaaucaaaguuuguucuugcucacauccaguccagagcagcugugcuaguaauucugcucccuuguuuuuuuuuuaaauuuuuguaauuuuaauuuuaauuuuuagaaacgaggucuugcucucucucccaggcuacagugcacugguguagcacuggcuauagcucacugcagccuccaauuccugggcucaagggauccucccgccucagccuccagaauaacugggucuacaggugugugcuaccaugcccaguuaauuuaaaaacuuuuuuuuuuuggggguaaagacagggucuugccaucuugcccaggcugugcuccuuuguacacuggccccacuauugaccagccacaucgccucaagcagcuuccuuugcuuucagagccccagcuuccuccaucuguaggagugggaaugauaacaguacuuaccucauaggguugugcgaggacugagaaagcaccuuuggugcaaagaaugguagcaauugaucacgauuucuaauuuaauuuuugacuuguauuagagaaauaaaaauacuacaguuagaccaggugcaguggcucacgccuguaaucccaacacuuugggaggccaagaaggacagaucaccugagauuaggaguucgagacccgccuggcaaacaugguaaaaccccgucucuacuuaaaauacaaaaauuaacugggcguggugggaggcaccuguaauccuagcuacucgggaggcugaggcaggagaaucacuugaacucaggaggcagagguuucagugagccgagaucgugccacugcacuccagucuggacgacagaguagaacuccaucucaaaaaaacaaaccaaaacaaacaaacaaaaaacaaacuacaguuacagagcagaguccuguagcauggacaugagauagaaaauaaagaaucuuaugcuucugccuguggcaguggagaaagaaaauggagcgauuugcauaggugcacacaaacacuaauucucaccaucacagugcaggcucucaauccucaacugucacugaggcccuugaaguagacccaggugcuuaggggguggcagucagugcccacaacucaacacuuaacuguuuaucaccacaaucucuugcuguuguuucagggagagaaguaauauuuauugaacaucuauuauaugccaaacagugugcuuggugcucuaaccaccuugacucauugaauucugaucacauuguagugguagguuuuaauuauuuccauuuugaagauggaaagauggaggcccagggaguuuauguaauuuuccaauagucguuuagcuacuuaaaaaggaacagugauggggaucaagccgagaucuuucuccaaaggucuuuccagugaaccuaagcgcuagcucccaaccuuacugcaaggacguugaaggugagggcugaugucuugagccguuucugggucuuccccaugcuggagcagaauggaugcuugacagacuugggaugguugauguguggaaggaaggagcccugauuucaggagcugacucuuaugcggggagucgggcagauacagauaaacaugagggguuggguguggaaacacugggccaugacaaugcaguggacccugagcagucauggcuuccagucugcaggccagccccuggcccccaaggcauccugcaaacacaguuucccauauuauuagucaucguguuagccugaaacaccugccccaacccaucccagcuuguaggcuuucagcuuccugacucacuuccccauuuucuagccauuuucccauuuucuagccucuuuguugucuuggcccuaugaacuuuuccccagugaugacuuguccucucuuaacgacaauucagcaccugccucuggagaggugucucaagugguccuggguaaacacccucugcuucugaccuuguuccugagucccggacuuggguggcugagaaguguagcauccaaggauuaucuuccccuucaugacugguagaaagggaaacagugggcagcucugggccaagggccuuuucacuuuauagacugaaccugcauuauagccagcagcuacucaaagcugcuagcaagcagaugcuugguuggccucugccuucuugcccugccuccugggcugcgauuuccuguggacccaccccagccuccauccugagcucuucuucucuuuaugcacuuguucuaggcaggauuccauggcuucccuggcaaccagcacuggguaagacaucccugguacagguucccacaguaccuugaauuccccuccaucauggcaccuggccuucaguaucacaauugcccaguugcuuaucugucuugccuaaaagaugguaagaucuaagagggcagguacugugucucuuguuuacccuuguagccuccacaccuugcucagugucugggacauaguaggccuuaauugauauguuuugaguuggaucaauccucagagacuagaccuuccgcauggggaaaaugucccaagucuggcccucccuuacucacgugcccuucagcuguucagaggugcccccuccuagaccccauacucaagaacuuucaacuugggugggccccucugauggugagggacggagagugugggggaaccaucucuuguuacuguguaaucaugugcuggguuggucaccacagccccaccagccaccaggggacaaggcuuaugucucaggccagagaccagaacccagugggaggccugggguggggcccuguuggaagggggccaggagaagagcccauggguguccaaguguuuccaggagugggaaagaagauggcaucugccacaagagcugggaacgagggaagccaggcaaggugcccacggccuugucccaggcuucuggggcaaugugucaucaccaaaggaauggaaaccuguacuuugggaacuuggcagccagggcuggguuuuucguguuuucuguaauuauuucccuuucguucucccuuaguauuuaguaaagcccuuugugaaaaugccagcuggucucagcugugcuaagaguggugacaaagggggacucugugcgugcuuggcccuaagcuuuaauggagggaccuggcuuaaugguggcagcaaagucaaggaccaucaaggacauagggaggcucugggagccacagcccacaccucauguccagacagccucccgaacacugagucuccucccaggcucuuccaggacccagcuucaauaaccugggcuuuauugaaaccuggggggaauuugagaccagucuggacaacauagugagaccccaucuguaugaaaaaaaaauagccaggcauggugguguguucuuguggucccagcuacucaagagacugaggcaggaggauugccugagcucaggagguugaggcugcagugagcugugauaacacaacaacacugcucuccagccugggcgacagagugagauccugucuccggaaaacaaaacaacaaaaaggaagaagaaagaaaagaagaaaacuggaggacuggagugccagccauggcugauuugagagaggguguuuauaucccagugguguagaaagcucuucugaaauccagaggccgggcaccugcucuguuccagguaccccagagggugacaaucccuccccagcuggggauggcuuggugagcugcuguucaggagcgaguccucugagcuaucuucauuuucugcucuuacaacacagggcccuuucuaagccuuggaccccuaccugucuguugcccaccagggauggacaaucagccagucccuucccagcuggggauggcuuggugagcugcuguucaggagcgaggccucugagcuaucuucauuuucugcucuuacaacacagggcccuuucuaagccuuggaccccuaccugucuguugcccaccagggguggacacucagccagucccuucccaccugccugggacccaccacauccuuaguucccgggacugugccccucuucuccuaagccccuuucccauccccauugcagcucucagcugcucuggcgagaggggcccagggagaccuucuuccucaggaacaaucaccccuuucuguuguguaagugauacacgaggagaggaagcuauuuguaacuaauuggcugugaugaggaacggaggcuuuggagaaauggagagccugcgaucgcucggggcggucccgccucggguugacagcugggugguucuccucagagggggcaguaggucaccacuuccucugcccccacuccacuggggaggccugggggaugcuggcaggugguggcuccugccauuugcaccuacucugugcaggcucccugcuuaacacgcucaauacuuggaaauuucugaaccaccuucaagggaaguauuauugugcccacauuucagcugagaaaauggaggucaagagaggugaagucacucaugcgagguccugggucccgcagcccgcaaguaacagaagcaagagaaauggacaaggaucagcugaggcugaccuaggagacagugucggggagggauuaagauccugcuucuuacuggccgugugaccuugggcaagucuuugcagcuuccuaacccaucucaggggcgggcuguguggcuuaaaugaggaagaggaagccaaucaugcagcacaguacguuguaaaugcuuaacaacuucagugaucuugauuguuucggggagaaaauacauuuccuccaagcuccuagcagaccacccuggucaccugucagggaagccaucccagaacaggagagucucuggguuauuucucagcccuccaaggggaggagccaaccuccaagacccccuucuccauagagaaggaucuggggauaagaugagagagaagagggugcccauguccauggggccuguucugugugccaggcacauaaggagacagaggugaucccaguuccuagacaaccacagauaauuaugaaucagccucugaugaacacagccaagguacaaaaugcuaagggagcauaaacgguggggaagaugaugcuaggcugcgugugugcguguguauauaaagguggggaaucaaaauacauauuggaucucccuggccugggaauccugaccaucccuucccuuagggaaggcauccgagcccugcuagaagauucugugaaaagggagaggagaugggccccgggaccagggccugaggcuucuuggagaaggaggucuuaaugccccagcgugucuucaagguggcagugugacuaaagucuucuucaggggacuuccccaccccaaauggggaaaaaaaaaaaagcaaugccugcuuucugggugguaacugaaggacuucccugagcgacugugggaggggcuuggggucccccaugucucagagacagaggaagcggccccucacccucugcacacuguguccaaaggcugcagagucgggaggcagccagucuggccccgaaggcugucacucggcaucccggagcuggcacuggggugaaggucuggagucuccgcuuggcaggagauccagugcucauccugauccggggagccugggggauggcaaggggcuaaugugcuuguugggagugacgcugucucugcuagggagcaggaggucaguggggacaguacggacuaaacucauaauuggagcagcauggaucugggugaggacacugggagagcuggaucuguuccauuuuacugucaucccuuggaguguuacagcuuggucaguuguccucugugcuucagagagagcgaggccagggugggugauuccacaggaccagagcaccuguguggcaggcucagauuucaucccugacaaagagcagaggcuccuggcagggguggccugagcuaaggaggaaggagacaagaaacugaguguucuaugaguucuuccugcauucaacccuguacggugccagcucuggcucagugcuggggacaccaagacggugauggcucucgagcagcuuccaguccaggaagaacagcuuaacauuggcuuaauaccaagucugugcaaaaaagagcuuccaggggcucugacgcagacuugugguugcaggcagcugagcaggucugcacguuccagguggccuguccucuccagcacauucaggcguguggaagacagaguguucgggagacuucugaggaggcccacagagggagcaggaaaggggucaagaaagaugugaccuggagaaaguaaugcuuguguagcaucuuacaggacggauugaagcuuaugaggaauagaagggcagaaagggcauuauagucaaggagugaagcuggacacaguauggguuauuugaggaacaucuaggaaucugauggggcuagacugugugcaggggaggggaagggcuaugccuggaggugaggcuggcuggggucagguugugaagagauuugaagaccagacugagaguucacaguuuauuccaagggcucuagggagccaucgccgguucuugagcaggggagugauauagccagauguguguuuuggagaaacaacugaggacaggugaaggguuugucccagaggcaggaaaacaagaucugugguuacugcagagcugaguggccugaaucaagacagugaccgugggaggagagggaugggacccagugucauccugauaaaauaauuuguuucucagccuuuuuuggagcuggcuguggccuuggaacuacguuuuggccaaucccugaccccuuagaauuucuuagggucuggguguaagugaaaauguugggcuugaccuuugggaaguaucuuuaaaggaaggagcauguuucacugcuucccuaucugccagacauugccuggaauucaaaccugaugguaggagcucuugcagucauccugggccaugagaauuauuugcaaggaaauugguacccugaaaacuguguggaacugccauaccggcccugaccugcuuacauccagaauuauuauuauguguuggagaaauaagcuucuaucuuguuuaaaccacuauuauuuuggaguuuucuauuaaaaugugcuguuucccauuuuugccuucuaaaggugagaaaauuagucccaugguucuauaugagugucauagagaaaagauugcauucuuccauggcuccuccugggaagugagucacaucaguuuccugggaagaacugggcucuuccauucccucccaguuugaagcaggaacgaggaggccacagcuaaggauacagauguugugguccagcugagcuagaccagccuccccagaugcaucccucccuuucagcucucaucucccauggagcacaggaaggaaacuguguugggggcaaggggugcagaggggagccggauuaauuccacuuaugguuggaucuccagggguggaggagacagaaagucuagcagagcuuucagcagacagacaguggaccuccagcuggccccucgggccuuggacucuucuaugagucaaagaacacuuggcugcuucuccaaagauccuccucugccuccagcuuccuucaucugaaagagcaaggucucgagucuauagcccaagagauccuaagggacaggauuggccccuacuuuggguguaaugaggugggggugggagggcguggggugagaauggagguggaguuggaaacugacaucugugauuuuacucucuuacuuuccagcucuagcuucaggucaggaaagcucuggggaguccaguucucccagaugaugaauucaaugcuccagaugacaucaugcaccugaaucauuuccguaucuuucuuccaggagccugcagaauucccuggaacccauauucaccaagcacuuacuacaugucagggcucauguauacaugugugaucuuauucauuucucacaacgggcuugagagguuggcauuggucccacuuuagugaugagaaucaugagcacagagagguuggguaacuuaccucaggucacccagccaguagguggcugagcuggaacuugaacacuaguuauaugaugccagaccaugcuuuuugcauuagacauugccggggucccgugcuggggaaggccuaugcugaggucacagggggcaguauauuaguccauuuucacacugcuaugaagaaauaucugagacuggguaauuuauaaagaaaaagagguuuaauggacucaagaguuccacaugacuggggaggccucacaaucauggcagaaggggaaggaggagcaaagucacgucuugcguggcagcagacaagagagcgugugcaggggaacugcccuuuauaaaaccaucagauaucgugagacuuacucacuaucacgagaacagcaugggaaaaacccacccccaugauucauuuaccucucacugggucccucccacaacacguggggcuuaugggggcuacaauucaagaugagauuuggguggggauacagccaaaccauaucaggcaguuugcaggugaucccacacccggaucagauuguaaaggaggggcccaauucccccuuuccaggccuccugccucucauucccucguagcaccucccuuuuuuccucauuuuuacuuc

SEQ ID NO: 17106 - RNA, 7152 nt, Homo sapiens
agccgaccucgcccgccccggaagugcaaacuguguggucuggcagguguggauuccgccggugaaggcugaaggcagcuaccuuaaagaugccgggauccgcagcgaagggcucggaguugucagagaggaucgagagcuucguggagacccugaagcgggguggugggccgcgcagcuccgaggaaauggcucgggagacccuaggguugcugcgccagaucaucacggaccaccgcuggagcaacgcgggugaggccggccugccuccgccggcgaaccuggccccugucuguucccgaucccagggcugaaaauuucccaggccucacuucgcguuggcuccucuuauccucucucuuuuggacuguaggggagcugauggagcugauccgcagagagggcaggaggaugacggccgcucagcccuccgagaccaccgugggcaacauggugcggagagugcucaagauuauccgggaggaguauggcaggucaggcucacguccugggcuccugguuggauccagugacacuuuuugcacgggccccucuaccugcucggagacuuuauuggagcugaacagcccuuguuaccugccugaccacuccuccccaccucucucuuugggucuuguugccucuauagacuccauggacgcagcgacgagagugaucagcaggagucccugcacaaacuguugacauccggaggccuaaacgaggauuucagcuuccauuaugcccaacuccaguccaacaucauugaggcgauuaaugagcugcuaguggagcuggguaagaggccugaucgcugggaaaaugggacuggucacaggcacauaagggaacagaagccucugaagguuguucauuagcagagaugggagauuagcugucuucugguucucagagguuuguccuccuuccugauuaggaaauguugcaacaggugacaggaccaaaguaauccucucuacuuuuccuuacagaccaacccuugauagacuacagaucuguggaguggaacagacucuauuaggacagaguuuuauuuucauuguaaagaaacaaaaugaacucccuagagagccaaggucgauagaccuccuucacuaucugaauuuuuauacacacguacacguauaccauuucuaucccccuugucauugcgguccaagugacuugcagauauucauuguaaucagaggaugaagaagcugcuuccaaauugcucccccauuuuuucuucucuggccagucucucucauguagaaguguuguggccaccuuuuggaggaagacuucuuuuaggccgaagcucucuuuacccuauucucagcacuuuaggauuucccagauugccauuccuuggcugaaucuacugucuucaaaaucaguuguaaggagcucuguagugacagaggugguucauagguagggguacuucuggaagagggcaggcagaaaaucccagaggaguggggcuuuuaagaaauugugacauagcugggcaugguggcucacaccuguaaucccacaacuuugggaggccaaggugaguggauugcuugagaccaggaguucaaaaccagccugggcaacauagugggacccugucucuauuaaaaaaaaagaaauugugacauuucacuuuaagcacauuaacccugugguaccagggucugcuaggugggcagugcaugugaagggcagacaucuuuuuccguauacgcguaauguguguuugugauauagcaauuucauauauauauauauauauauauauuuuuuuuuuuuuuuuuuuuuuuuuuuuugcaaaaccguucuuacagaagggacaauggagaacauugcagcccaggcucuggagcacauucacuccaaugaggugaucaugaccauuggcuucucccgaacaguagaggccuuccucaaagaggcugcccgaaagaggaaauuccaugucauuguagcagagugugcuccuuucugccagguaaggagacugcuggaguugcuacuaagaaaaaugaaaaaugaagaagaaauaaacgagagauggguagggccauuccaaccuugaauugauaagcaagacuuugagacacugagaagaucaaguaaaacauuaagugaauuuucaagguguucguccugugaacauucauaaauagugguuuaagaaaguuggggccgggagcgauggcucaugccuguaaucccagcacuuugggaggcugggcggguggauuaccugaggucaggaguucgagagcagccuggccaacaugacaaaaccccgucuccacuaaaaauacaaaaauuagcugggcgugguggcacaugccuguaaucccagcuacucuggagggugaggcaggagaauugcuugaaccuggaaggcagagguugcaaugagccaagauagcgccacugcacuccagccuggacgacagagcaagacucugucucaaaaaaaaaaaaaaagauggcgagcugcuggguucaaggaaagauaacuugauucuuuuaggaaucaaagcaggguaaauuaccuuggggaugacuaaugcuuggucugaccucacuugauccuaaguaaauaauaggucucaaaaaggaaauauguaaggaugcagguuguuuuaaaauaaugagccaggagcuaucuugucagcaaucgugauuauauuauacaugcauguuguauuuccaguuuuauggcugcucuggugcugcuguggagcauuagacauuuauuagcuuccccugggcuucccuacagcuuaccagagcuaugagagucugaaaaaucaguuguccgaaaaaugaguuaucuauuggaaauuaugugcuggauaugcccauaucacacaauuccccagauccaguuacauuugagagcacuuuucacuauuucucacucuuucucuuagaaucagccuuucccucccauugcagggucaugaaauggcugugaauuuguccaaagcagguauugagacaacugucaugacugaugcugccauuuuugccguuaugucaagagucaacaagguggguauaucuggaguuauguugaauucaugaagauuauguuucuaaaauauugauuuuuaucuccuccuguaauauccacggugagagaauaaaguuucuagcaccuuucaaaguacauacuuaggccuuuuuaaucuguuaacugaauuucuuuucccuuuuuucugcaucauuguuccucucuuggaguagccucuaaauuugguugaagcauugaaaagaaugaaguauuaaauagaacuaaggcaagagugucaguuucuagggauuggcuacagggcuccugccuuaugcucaaagagcuuggcaguuguggauagugaaugaaaaagauuccuggcuucucagaagguauggcaucucaauuuccagaaaauaugggacugagagcaguagguuuugcaguuucuugucccauuuuacauucauucuuuccuuggaaaccuacuuuuaagcuagaacuuguauugagccagggaucccuucaccucuaccagucugugaccccucacgauaccaauucugaggucuaagcauuuagcuuuuuguggccaguggcccuuuuagggcuccacccccaggauggcucacauuuuuugucuugucccaaaggugaucauuggcacgaagaccauccuggccaauggggcccugagagcugugacaggaacucacacucuggcacuggcagcaaaacaccauuccaccccacucaucgucugugcaccuauguucaaacuuucuccacagguaagugugucugucucuagcuagaagccagcagaaaagaaggaagccaaaggguaggcuugaacucugggacuucaaccaccucacuccagggccuccauuuaucugcauuuacucaauggauuacacccaguggaggcuggaaagaaccacagaagucuugauucaguaaaacaguugagaguucucagcugucaacuuuaggaagucaagauuguaaggacaauauguaguugggaaagguccuuugcuuacgauugccaccacucccugucgccugaccauuucugaaaaugccaagcagguugaaaguaggaucauagaaucaguuuuguuauuguugcagggccuguccuuuguaaccugaauacaagcaaggacuaagugaagagccauuucaucagugauagaagcuauuugcuuugaaaacaucaaccuauuuauaggucucuauuuuuuaaauugaggugaaauucacauaacauacaauuaaccauuuuaaaguauacaauuuagugauaucuaguacauucacagcauuguacaaccaccacucucuaguuucaaaacuuuuucuccacuguagaaaaacacccuguacccauuaaguaaucucucccuauuuguccuucuccccaucuccuccaaucugcuccugucucuauggauuugcccauuuuguauaaaaggaaucauauaauaugugacauguugugccugacuuuuuucacuuagcaugauguuuucaaaguucauccauguuguaaugucagaauuuccuuucgaggcugaauaauauuccauuauaugaacauaccacaauuuauuaauccauucaucuguuuaugggcauuuggguugguuccagcuuuuggcuuuugugaauaaugcugcuauaagcaucuguguauaaguuuucuguguggacauauguuuucaucucuaggguacauaccuaggaguggaauugcugggucucuaguuuuuauaaauuuuuuccuuuuuaguuccccaaugaagaagacucauuucauaaguuuguggcuccugaagaaguccugccauucacagaagguacagaagcugugugugcaugcgugcauguguuguguguauucgggguuugugugugcauguguuuuggucuuuuuguuguuuuguuggucaguagaacugaaugcugucaaguuguguuuuuuaucauacuucuuguggggacuguuuucuuuagaagcucaaagugcuugaggaccugaccaaguccauguuaauuuguucugagacaaauauauuuuagauuuguuggggcuauuguggguuggaucauuuagcauugucuggguuuggcuuugcaugcuguuugagauauagacaacaaccaguugggaaaauguaccuguuuuccugcuauaaggagucauuuuggugaauugacucccaaaggaagcagguugugaaauguuccuccuuagaaaacucaccuguagccuggauagucucaugucuugggguucuuuucucuggcuucuucugaaggcagcagcucagcucauuacgcgugcagccucaucagcaaggguggccuuacacaccaucugagagcaacgcauaguaguugguugggguccuaguuccucuuggaaguugauugacuucaucccuuuauuuaaauaaacauucaaucuucaagaaauaguuauugagcaccuacaauguauccagcacucuucuaggcacugaagauaaaacaaugaaugaaaaagauaaggcccuguucccacacauucuauuguggaagacagaugagaaaguaucaggucaugggaugccugaggacaagcaaggcugaugugguagaaaguggcuaggggccugagauugaggaagggucuuaaugagaugacauuucagcugaguccugaaugaacagaguccaccauaugaagaucauaguuuucuaugagcuggugcaggggcuuagccaguuagaaaaggauggccauacauggcuagacaguaaugagcaagggggagagugguccaaauuguaauucauguggugugucagggagggcccagaucuuaaacuucaauccugaguuugaauuuuauucugagggcugugcagaggcaugggagaguuguaagcagggauugucaugaucugaagucaucucuucugguuugcauuuuuccauagcuucccguccuuggggagcuaauaugccugcauucucgagccuggaaucuauaugcuacuuaauuaugagagagggagccucaguuuuaccuuuagcaugugugcuugccuuucaggggacauucuggagaaggucagcgugcauugcccuguguuugacuacguucccccagagcucauuacccucuuuaucuccaacauuggugggaaugcaccuuccuacaucuaccgccugaugagugaacucuaccauccugaugaucauguuuuaugaccgaccacacguguccuaagcagauugcuuaggcagauacagaaugaagaggagacuugaguguugcugcugaagcacauccuugcaaugugggagugcacaggaguccaccuaaaaaaaaaauccuugauacuguugccugccuuuuuagucaccccguaacaagggcacacauccaggacugugucuugccuuucagaucuuaacagagcagcagggcuuaacuuguugauuuuggagccucuuagugaccugguugcgucugugucaggaacuuaaacuuucugguucaguaguguguuaaacauaacacugaauaccuuacugggauacagauuuuugcucagaaauggcuaugacacuuuuucuaggcucuaccaauaaaagccacuugaagguuccauaguugguuuauuuauuguccuacucugacagaacugcuugaaacagcagcagcagagccuuuuuuguguuugcauagagggcuguaguuagcgggaaaaguguacaacaugguaguacuggccagaugcaguggcucccacuuguaauccuggacuuugggaggcugaggugggaggcuuguuugaggcuuguuugaggccuggaguuugagauuagccuggcaacauagcaagauccugucucuacaaaaaaauauuuuaaaaaauuagccagacaugguggcacaugccuguggccucgcuaugcuggaggcugaggugggaggaucacuugagcccaugaguucaaggcuucagugagcuaucauuguaccacugcacuccugccuggaugauagagcaagacucugucucuaaaaaaauaacaaguacaaaugaaaguauaguuuccuuuacaauuc

SEQ ID NO: 17107 - RNA, 2005 nt, Homo sapiens
guaaugauucccaacaugggcuauugugucuuccacguuuauuuucuacacuugauguuagccaaaaggccaaggagcaauuccauuuucuuucuuuccuucuuucuuuucugagacaagucucacuccgucgcccaggcuggagugcaguggcgccaucucagcucacugcaaccuccaucucccggguucaagcaauucucugccucagccuccugaguggcugggauuacaggcgcccgccaccaagcccagcuaauuuuuuuguauuuuuaguagagacgggguuucaccaucuuggccaggcuggucuugaacuccugaccucgugauccacccgccucagccucccaaagugcugggauuacaggugugagccaccgcgccuggccguuuauuuuaauauauucuucagcucugaauauuugcuaguaucccaguaauaguuuguuaaaucaauaaacguguugacauacaugcauagcauaaugucuggcacacaguagguacuccauugaaugaaugcaugaauuauuaccgugucaauuugcuugucuauuugcaaauguuaauaguuaauuugaucccuaaaguguuugugaacuuaaaacacacacauacgcacuuucccugacaacgcuuaucugcuaaccccuuaauuauguucaucugagacuggaccaaaacauguuguuuuauucaauuuaaauaccaaauucaaauuuauuuugaauauagcuuagaacacauucaauguuugcuaaaauaauaauaauaauaauaauaauaauaauaauaauaauaccauguacauucaguuagccagacaauuacuccagcccaaauacccugcuaugggacaugaaccggaugucugcccggcacacauucaucaggugaccccuaaaacuucuucucuaagguccacacugucuaauagccaaguugaaaucuuuccucgaaauuuuccucucuagugucucagugccccaggugucaucaaggugucaaaggcgcuugggagugccugcaaaccgccccauccccggagacacagccucauuccccgcccucgcgccuaggcggccggugggcgggcccagcgaagggccuuguggcuguuuccuauuggggcuugguugcuauggugucacucgccuuuaaacucguggguacaucuuucggaaauuaaaggagaauuacuuccagggcugcccauacuugccauggccgacucaguagucacuaacuucaacaaaaauaaaacuguugcaauaguauucuauuaaagcuucuuuaacugcuuaaacuugcgguuuugacaugguaccuauccuuucuucccuuuucaaaagauucgcuauagagucuuucucuacaugccagucuccaaaauggcgcggacggcaucagaaggucagaggugagucacguggguccccccgguuccggcgcgguugaggccuucgguggugaacgagucuccagcaccaugucugguuugucuggcccaccagcccggcgcggcccuuuuccguuagcguugcugcuuuuguuccugcucggccccagauugguccuugccaucuccuuccaucugcccauuaacucucgcaagugccuccgugaggagauucacaaggaccugcuagugacuggcgcguacgagaucuccgaccagucugggggcgcuggcggccugcgcagccaccucaaggugcggcauugggcgacguggggccgggagggaagacggcaggcuuaggcgaggggaggcucggguucgggggagucgggccggcggaggccugggaguuguucuggccucccgggagcgcaaaggacgugcgguggagcccgcccccucaccccgcugguugccugucgcggggcggggcgggucaccaacgccugggaaccccaagaagggcugcgaggcuuuggcggauguggugacaccugagcuggggcgguugucaacguccuauaccaguuuuggucucag

SEQ ID NO: 17108 - RNA, 11303 nt, Homo sapiens
uaaaugaugauaugagaucuucuguaauuucucccucaucaugucccguaaagccaaaugugcuacugauuuugaaauauuguacauguugagcacagaauauauuguuuuaacuuguucucaucccuggaaggcauuccaauucauuauuaguuucuuggcaguuaaagcacaugccuuucugguaauacugccuaauacacauaaucccuuuaauacccacccacugaguauagcgagugcucccuccuccgugucauuggcugcagaaucuucucucccuuuccccuaaguggcccagcgucaucgcauucagggggagcuacuguaaccacugcagcuguucuaaaauugcaagugugccaacagccaucuuccuuuccucucuagucccgcaggcuccuguucacacaggcuuucuccaucucccucucugucacagcgggcuaucugucaggauucaugagccuaagaaggcacugucuaaaauucugaaagcuggccaggcacaguggcucacgccuguaaucccagcacuuugggaugccaaggcgggcggaucauuucaggccaggaguucgagaccagccuggccaacauggugaaaccccgucucuacuaaaaauacaaaaguuagccaagcgugguggcaggcgccuguagucccagcuacucgagaggcugaggcaggagaaucgcuugaagccgggaggcagagguugcagugugccaagaucgcaccacugcacuccagccugggcgauagagcgagacucaaaaaaaauaaaauaaauaaaauaaaauucugaaaguuucccaaaaaaaugcccguuauguacccaccuuucccacugcaaguuuguuuauugauugauugagauagagucuugcucugccacccagguuggagugcaguggcucaaucucagcucacugcaaccucugccucccagguucaagcaauucccaugccucagccucuuaaggauuacaagcaugcaccacaaugccuggcuaauuuuuguuuuuguaccauuaguagagacaggguuucaccauguuugccaggcuggucuggaacucccagccucaagugugauccacccacuucggccucccaaagugcugggauuacagguaugagccaccacucggagcccccacauugcaaguuuauucuggaauaacaucauuauuauucuguuaucauggggcagacucugagaagaggagacaaaggacuuaggacaacaguccauguacacacacacacacacacacacacacacagaucugucuuuggaagauaaguaggcaguuuuugacacaguauuaaaugaaaauauuuugggcagugaugccuucagaguauagaaaagcuagguccgacgacgcgcggugguucacgccuguaaucccagcacuuugggaggccaaggcagguggaucacgaggccaggagauugagaccauccuggcuaacacagugaaaccccgucucuacuaaaaauacaaaaaaauuagcugggugugguggcaggcgccuguaguuccagcuacucgggaggcugagguaggagaauggcgugaaccugggaggcggagcuugcagugagccgauggugccacugaacuccagccugggcgacagagcgagacuccgucucaaaaaaaaaggaaagcuagguccuacuuuaauaaagccuaauaaaugaagauguaaauauuaaaacagaugaauuaaguggugauuaacugucuuguaaaaaauugcuuuguguauauaggcaguaucagggauuuaauuagucucucuccaugcauuugaaccugauuuauagcaugaggucucuuuuaauccuaucuccacuuccucaaagauacugaugucagcuaccaccagaauugcugagcugaauucccugacccaagguggcucgguuuaauucagucaaguauuaggcauucagccuguugaauccucuccugugcccagaucccuaaggccagccucacccaggguguggccugggcagagagggcaacccgcccgugggauggagcugcaagguucugauggucuucguagaaucacagcuggcuuggcaguuucuuggcaguuucuugaccaagcgggagacauagauggaggcauguugucuuccaggaaggacacggagguccauauaaaaauucucuacucuuaucccacagaugcgugguggcaugggagugcggaaaaggcaggccccgccauagauggugggaaaaccgcuggaaagaugcugauccaugguggcugaucaccauggugagauggguaccauacuaaugguuccauccucaacagugcuaccugcaugauacaacugugggcaggacaggccaggucuauucucugcccuucuguuugaggcuuuggagacagacaacugcaggcccacugguuuuacucauggucagacuucccaggaccuggccuuuccucuucaaugucacugucauuucccacaaacccuaucccucacaacauuugagaaagcuuuaguucaaaaauguggcuucuuccccuauucauucauucggcaaaaacuuauugggcaggcugagcaguaggcccaguaaggaaaugcagucuuggcugggcggguggcucaugccuguaaucccagcacuuugggaggcugaggcaagggaucacuugaggucaggaguuugagaccagccuggccaacaugacaaaaccccaucucuacuaaaaauacaaaaaaaaaaaaugaaaugcagucuugucuuguagaaccccaggaaagauugcagagcauucaagcacugcagcaagggugagcaaagauggaguagaaagggaccugauccagguguggaggaguuaacacauccugcuugaguugaggccugaaagaagcuuuggaauuuuucaggggaaaaaaagugacaggaagggcauucuaggcagauggaauggugcaugcuaacacacagaggaugggagaguucagcacauuuagcuuuaaggugccaaggacaggauaccguagcucaugcccauaaucccagcaauuugggagggugagacgcauggaucacuugagcccaggaguuaaagaccugccugggcaauauggcaaaaccccaucucuacaaaaaaaaaaaaguggaaaaauuagccaggcgugguggcacaugccuguggucccagcuacuggggaagcuaaagugggaggaugggaggaucccuugaaccccggaagucgaggcuacagugagucgagaucacgcacugcaucccagccugggugacagagugagacauuguauccaaaaaaaaaaaaaaaugugccaaggaguggaaggaggagagggcuggugugaaggguugagaggauugcaguuugagcugagccagagaaauaagcaggucccagguugcagagggccuugucuaccugguaaaacauuuagguuuucuccagagagagaaaugaagggccauggaacaggcuuacccagugggaucacaggauuuguguuuuagaaaggacacagacagcaugauggaguggcauuggaaggcaacaagcagaccacuaaagagccagaauggugagcuccugcccccagccaugguggggggaggacaugaguagcaagauucugccuaaauuaauuauuaauaagcgacgcagugauucaucuauaccuuccccauuccuagcuucauuuccccauccagccccuaggagcccugacuuugauucuaguccguuucuguuuccuucuucccuuagcugcccucuucacuggaauucucuaaggugccuguucagcccuauggaaacggcugccagauucuucuguuuucuucauggaaagcucccaaguuuuucucuccaaaaucccuuagaagugcuuuggccaguggaagagaggggucuucaacgucuuucaaagaacagcuaagaaauaguggcucagugaaguugcuaguuaugggaacgccaccugcugugggagcugccagugacgggaagcccaaaucagcaagaugagccccagccgcaggccucacauucuggcagucuccacgagccaagagguguccaugccaaguccucauucccauggugaugccuuaugggcuccaucauguuagccagaauauacccugggagauuauaccugggagacacguagcucaacaaguacggaacaugucuucccugcugguauuggggggacaggaugaauaucugucugauaagcucacugagauauguuaggcuuguucccugugaauaauuuauauuuugagaaaccuaguacuuucaaauucauacaauaaugagcuguguuauauuaggauucuguuguauguucaccuaucaaaauuuauaccuuaaauacucacacucaauauggggagauacaaagauaauuuagauaucauauaugauuaacuauagaaaacacauaucuuuuuuuuuuuaagagacaggggucucacuauguugcccaggcuggugucaaacuccugggcucaugcaauucuccuaccucagguucccaacaugcugggauuacagguguggguaaccaugccuggucagaaaacacauaucuuaacacaauacacgauaaucacaauagcaggaaacaaguuuuguuuuguuuuguuuuuuuaaucagaaaggcaacauuuccaggugaaaauuuuccucagugauguaggaaaugccaucuucugucaucagcccaucucuaaauucucacucucacauuuguucauguagcugcuacuccuaauuccagaugaaaaauuccugucguucaaaggcagagccguuuguaauuuaugcaaccccuggguuccaucaaaugaaaagaguuacugaaauagaaguuauucuuauugccaugccaacagcagacccacaaccucagcuuacaaacacauucugugcuaaagcccaaagcacauacccucacgugccuccaucagaaagaucuuuccauuuccuucaagaacagaccuccuucacguacaauaucccucccaguagcauacguaggccucauuccucagggagcuggcaggaacacacacacacacacacacacacacacacacacacacacacacuccuccagcacacaccuccuuucucauuuuccagagacccgggggugugugugugugaaugucugaacugaugacauauugugacagaggacgcaagacagugaggcacagccucaaagcaaugcaggucacagcaauaggcuuuauauaacccagagccauggagagacccaaaauagcagccucccugcugcucaguuagucuccuccaucaaccagggauaaaauuagagcaggcgcugacgugcaccugcgucugcacagggacuccagggagacagugagaacaggcucgacacucugccaucggccacgcagacugccagauuuuucagacccaaucuguuaccagacagaacucugugugugugugugugugugugugugugugugugguacacacacgcacggguguacaugugagccauguggagcccugcucugagaacauuucaagggaauggcugggaaguuuggcggcauggggcuuugagaagaauguuccagguuuuugggggaggaagucaguccccacaccaguccccauuuuacuucauaguuccuucucgccgcccucccuaccgcuucucucuggccuguguggggucaaguuuggcugggaaguccuuccucuaagaccucguucugcaaaacaaacaacaaacuaaaacaaaauccugcuguguuuauuucaauucaaccaaacacacacagucuggagaguaaaagcuugugccaagagguccagaggagagacaggcuggugaauguggccgacuguucugcaggccccgggcccccacuuugucuggaagccaugaacgcugcuuacaggugggauuggcagaaauccuguccugccgaggcagcaggugauuuguucuuuuucugcuugagggaaaacagggcagaaugauuuuuucccccaaaagaugcacaguuaaagguuagucauuuuguaccagauaugauacaaauuucaagggaggaagcauggcugaccccaggaaccagagaccagauaaauagguacaaacuagauggaaugagacaagauuguguuuuguuuuguuuuuaggaaagagccgucaucccacacuaugaccucugaaauucuacuauuauacauuaauuuugggaaguuuauguucuuggacuucccuuuuaaguaaauacuuuagaagcuggccaugguggcgcgugcauauaguccuagcuauuugggagacugaggugggaggauugcuugagcccaagaguucaagguuacagugagcuacaaucauacuacugcaccccagcccacugggugacagagcgagacggccucucuaaaaaaguuuuggccaggcgcaguuacuggccagcuacucgggaggcugaggcgggagggucgcuugagcccaggagguugaggcugcagugagcagugacugugccacugcacuccuggcuaggugacacagugagaccuugucucaaaaaaaaaaaaaaaaauguggggggcugggcgcaguggcucacgccaguaauuccagcacuuugggaggcugaggcagguggaucacgaggucaggagaucgagaucagccuggccaacaugaugaaacccuaucucuacuaaagauacaaaaauuagccaggcaugguggcacacgccuguaaucucagcuacuccagaggcugaggcaggaaaaucacuugauccagagagucagagguugcagugagccgagaucgcgccacugcacugcagccuggugacagugcaagccuccaucucaaaaaaaauaaauaaaaaauaaaaaaauuuaagaagaaaaaaaacaccuuagugagugguaauauauucaacuauuucacauggagguauccauaauuuauccuuuuccuuuuaagguaacccaaauaaauccuggauucccauauagcccaggaucugugcaguaucauuuucacaaaacaaaacaauauacacacgcaugcgagagcacacacacacacacacaauaaucuaauuuuuaauggccgggugugguagcucacacuuguaaucccagcauuuugggaguucaagauggguggauuacccuaaggucaggaguuucagaccauccuggccaacauggcgaaaccccgucuccacuaaaaauacaaaaaauuaccugggcgugguaacacaugccuguaaugccagcuccucggggggcugaggaaggagaaucacuugaacccaggaggcagagguugcagcgagccaaaaucgagccacugcacucaauccugggcaacaagagcgaaacuccgucucaaaauaaaauaaaauaaaauaauuuuuaaaauaauucccauuuuuauuuaaauauugagaaaagcaacaaaaaggaucugacagcaagcaaagccacacucugaacuuccccuuucccuccuccaagucuuuuuuuuuuuuuuuugagacggaaucuugcucugucacccaggcuggagugcaguggugugaucucagcccacugcaaccuccacuucccagguucaagcaauucuccugccucagccucccaaguagcucggacuacaggugcgugccaccacacccagcuaauuuuuguauuuuuauuuuauuuuauuuuauuauuuuuuuuuuuuugagacagagucuugcucugucgccaggcuggagugcaguggugcggucuuggcucacugcaaccucugccucccggguucaagcgauucuccugccucagccuccugaguagcugggauuacaggcacacaaccacacccggcuaaauuuuguauuuuuaguagagacgggguugcaccauguuggucaggcugcucucaaacuccugaccucgugauuugcccaccuuggccucccaaagugcucggauaacaggcgugagccaccacgcccggcccccuccuccucugagcccuuuaaaaauuccagacacccauagauauugcucucccucucucaaccucucccuuagcucuuuauuuuugugucaauugaccagcaucucuggcuucuuuuaguccucuccaaucugcucacucuuuggcuucuucaagcacaaaaaggaagcagccgaggcugacucaguaagcaagaaucuguucccccuucaaaguccaggcguaaggguucagagacagugcggcuacucacccugcuagaccgacagggcuguggggcuguggcggguggggugggggagaucucugaggaaaggacuuugcuaaaggagauaggaaggaaggggguggagaaauggaguggagggaacuucaaagugaaauuucugucguuggacaguuuuugucuuuggccuaccuuguacagucaccaagaguugagaccaagagcuuauugaaaguacacgguacuuugucuuaguauucuguccaccuuuucuguacucucuaccggcuuucaaccucuggucucacuauccccacugaacauuggccccacugaacagccccgcugcuacugaacagguuucuucaugcccuuuguucaugaagaaacuuuguucuugacuuucucuuucuuucuuuuuuuuuuuucuguuuuuuugagauggaaucucucccugucacccaggcugaagugcaguggcacaaucucugcucacugcaaccuccgcuucccggguucaagcaguucuccugccucagccucccuaguagcugggauuacaggugcacaccaccaugcccagcuaauuuuuguauuuuuaguagagacaggguuucaccauguuggccaucagggucucaaaccccugaccucagaugauccgcccaccucagccucccaaaagugcugggauuacaggcaugagccaccgcacccggccccaucucucuuuccauaauguucuuuccucucugcccuuucuccuacccacuugucucccuucuuggcagccuagagaacuuaaauucauucuucaguacucagcucaaagguuacccacccuggcacuuuccccuucccuucccucuccccgucucgcacaugguaugcagaauucuaagauggccuccaagauuucugucuccugguauacacaucuuacauaauccccucuccuugaguguuggcagcauuugugaauaugaugggaugucacucucuugauuaugguaaaaaggauuuugcagauguaauuaaggucccuaaucagcugauuuuggguuaaucaaaagggaguuuagucuggcuaggucuguccuaauuaggggagaccuucaaaaagggacuaggggccaggcaugauggcuuaugccuauaacccagcacuuugggaggcaagaggaccucuugagcccagggguuguagaacagcugaggcagcauaggaagacccccaucucuacaaagaaaaaauuguuuuaauuagccaggcaugguggcauaugccuguagucccagcuacuugggaggcugagcgggaggauggccuaagcccaggaguucgaggcugcagugagcugugaucgcaucacugcacuccagucugggugacagagugaaacccugucucaaaaauaaauaaauagccaggcacgcuggcucaugccuguaaucccagcacuuugggaggccgaggcagguggaucaccucaggucaggaguuugagaccagccuggccaacaugguaaaaccccaucucuacuaaaaauacaaaauuagcugggcauggugguacaugccuguaaucucagcuacucaggagacugacaugggagaaucacuugaacccaggagguagagauuggagcaagccaagaucauaccauugcacuccagccugggcaacaagagcaaaacucuaucucaaaauaaauaaauaauaaaacccugaaaacaaaaagggacuaggauccucccugaagucaaagagaauuuccugcuagucuugaagaagaaagcugccaccuuaugagaggaugugugaagugggccaugugacaaagacuugagggaagccucuaguugauaagaguggccccuggugacagcugccaagacaacaaaggccucaaucauacagaugcaagaaacuaaauucugccaacaaucacgugagccuggaagaggaccucaaccuccagaaagaaaugcaacccggcagacaccuugauugucagcuugugagacccugagcagaggacuugguucagccauaccuguaccccugacacauggaaacugugagauaauacauuguuguugcuuuaagcugcuaaauuguaguaauuuauuacauaguaguaggaaacuaauaccaccaccccucccaagaauucuucaucuucuggauucuguagcacauugcacucaucaguauuauaacccucccuacaccauaucauacuuaucccccacacaucugccacccuacugucacugcaaucccaggcccagucuucuuugggcgugguaccaaguaucugggagcuaauagguaggaaguaauacaugcuuguugaauuaaugucaugcaaacccaaaauuggcugcuaucucuacugccugaguauuuuuaacagagguaaucuuuucuuuuucuuuuucuuucuuuucuuuucuuuuuuuuuagaccaagucucacucuguugcccaggcuggugugcaguggugugaucucagcucacugcaaccucugccuccuggguucaagcgauucuagugccucagccucccgaguagcugggacuacaggcgggagucaccacgcccagcuaauuuuuguauuuuuaguagagacaggguuuuaccauguuuaccaggcuggucucgaacuccugaccucagauguuccacccagcuuggccucccaaagugcugggauuacaggugugagccaccgugcccggccagagguaaucuuucugacaucuuguguguguguagggcuggcucaguuguccauaacauuuuguauguacauacauagauuuaauuauuaauuuaaugaauucuauaguagccccuaaaagaagauaugguuucagauuuccccucugguuuuaggcuauaacauuucucuugaauguucugagaauaucagauccuccaugacaaugucuuuaaaauugugucgaguaacacuaacc

SEQ ID NO: 17109 - RNA, 3408 nt, Homo sapiens
ccaaccgcaucugcagcgagcaucugagaagccaagacugagccggcggccgcggcgcagcgaacgagcagugaccgugcuccuacccagcucugcuccacagcgcccaccugucuccgccccucggccccucgcccggcuuugccuaaccgccacgaugauguucucgggcuucaacgcagacuacgaggcgucauccucccgcugcagcagcgcguccccggccggggauagccucucuuacuaccacucacccgcagacuccuucuccagcaugggcucgccugucaacgcgcagguaaggcuggcuucccgucgccgcggggccgggggcuuggggucgcggaggaggagacaccgggcgggacgcuccaguagaugaguagggggcucccuugugccuggagggaggcugccguggccggagcggugccggcucgggggcucgggacuugcucugagcgcacgcacgcuugccauaguaagaauugguucccccuucgggaggcagguucguucugagcaaccucuggucugcacuccaggacggaucucugacauuagcuggagcagacgugucccaagcacaaacucgcuaacuagagccuggcuucuccggggagguggcagaaagcggcaauccccccucccccggcagccuggagcacggaggagggaugagggaggagggugcagcgggcggguguguaaggcaguuucauugauaaaaagcgaguucauucuggagacuccggagcggcgccugcgucagcgcagacgucagggauauuuauaacaaacccccuuucaagcaagugaugcugaagggauaacgggaacgcagcggcaggauggaagagacaggcacugcgcugcggaaugccugggaggaaaagggggagaccuuucauccaggaugagggacauuuaagaugaaauguccguggcaggaucguuucucuucacugcugcaugcggcacugggaacucgccccaccuguguccggaaccugcucgcucacgucggcuuuccccuucuguuuuguucuaggacuucugcacggaccuggccgucuccagugccaacuucauucccacggucacugccaucucgaccaguccggaccugcaguggcuggugcagcccgcccucgucuccuccguggccccaucgcagaccagagccccucacccuuucggaguccccgcccccuccgcuggggcuuacuccagggcuggcguugugaagaccaugacaggaggccgagcgcagagcauuggcaggaggggcaagguggaacaggugaggaacucuagcguacucuuccugggaaugugggggcugggugggaagcagccccggagaugcaggagcccaguacagaggaugaagccacugauggggcuggcugcacauccguaacugggagcccuggcuccaagcccauuccaucccaacucagacucugagucucacccuaagaaguacucucauaguuucuucccuaaguuucuuaccgcaugcuuucagacugggcucuucuuuguucucuugcugaggaucuuauuuuaaaugcaagucacaccuagucugcaacugcaggucagaaaugguuucacaguggggugccaggaagcagggaagcugcaggagccaguucuacuggggugggugaauggaggugauggcagacacuuuuacugaaugucggucuuuuuuugugauuauucuaguuaucuccagaagaagaagagaaaaggagaauccgaagggaaaggaauaagauggcugcagccaaaugccgcaaccggaggagggagcugacugauacacuccaagcgguagguacucuguggguugcuccuuuuuaaaacuuaaggggaaaguuggagauugagcauaagggcccuugaguaagacugugucuuaugcuuuccuuuaucccucuguauacaggagacagaccaacuagaagaugagaagucugcuuugcagaccgagauugccaaccugcugaaggagaaggaaaaacuagaguucauccuggcagcucaccgaccugccugcaagaucccugaugaccugggcuucccagaagagaugucuguggcuucccuugaucugacugggggccugccagagguugccaccccggagucugaggaggccuucacccugccucuccucaaugacccugagcccaagcccucaguggaaccugucaagagcaucagcagcauggagcugaagaccgagcccuuugaugacuuccuguucccagcaucauccaggcccaguggcucugagacagcccgcuccgugccagacauggaccuaucuggguccuucuaugcagcagacugggagccucugcacaguggcucccuggggauggggcccauggccacagagcuggagccccugugcacuccgguggucaccuguacucccagcugcacugcuuacacgucuuccuucgucuucaccuaccccgaggcugacuccuuccccagcugugcagcugcccaccgcaagggcagcagcagcaaugagccuuccucugacucgcucagcucacccacgcugcuggcccugugagggggcagggaaggggaggcagccggcacccacaagugccacugcccgagcuggugcauuacagagaggagaaacacaucuucccuagaggguuccuguagaccuagggaggaccuuaucugugcgugaaacacaccaggcugugggccucaaggacuugaaagcauccauguguggacucaaguccuuaccucuuccggagauguagcaaaacgcauggaguguguauuguucccagugacacuucagagagcugguaguuaguagcauguugagccaggccugggucugugucucuuuucucuuucuccuuagucuucucauagcauuaacuaaucuauuggguucauuauuggaauuaaccuggugcuggauauuuucaaauuguaucuagugcagcugauuuuaacaauaacuacuguguuccuggcaauaguguguucugauuagaaaugaccaauauuauacuaagaaaagauacgacuuuauuuucugguagauagaaauaaauagcuauauccauguacuguaguuuuucuucaacaucaauguucauuguaauguuacugaucaugcauuguugagguggucugaauguucugacauuaacaguuuuccaugaaaacguuuuauuguguuuuuaauuuauuuauuaagauggauucucagauauuuauauuuuuauuuuauuuuuuucuaccuugaggucuuuugacauguggaaagugaauuugaaugaaaaauuuaagcauuguuugcuuauuguuccaagacauugucaauaaaagcauuuaaguugaaugcgacca

SEQ ID NO: 17110 - RNA, 2248 nt, Homo sapiens
cggagaggaagggaaggaggggaccggggaggaggggguguggagccggcgcuucacacccacugaccuuaaccucccccgccgccuugggcgcccuccucccgcggccgcucgcgcuccucuccccgcgggggcgucccggguuccaugcagucccccggcuccgccaccccacggugcaggagcgcucgagaaagcaggacgcggcgagcgguuauguaagcgcaccccccgcgcaccgccgcccggcuugugcccgccaggcagcagcagccgcagcccuaggagagagacgcgagaggccggagccgggggaaaagucaaaagccccuucacgcacagccuguguuaaccauguaccucagucccggcgcuucccccacaaacugagagcgacagggagaauuuccgcacaguuucauccuuggacacuucaggacugagcgggugaggaggcgaucucgccagccugcuuuauuuuucgguggagaaggaugggcugagaugaaggcauuuggggacuccuaccccuacccaccggcccccgccagcgcccuuaggccccgagacggcuggcugcaccagccugaccucugcuagggcugcagccugagaccgcggcuugcucuacugcuggcgcaguuugacccuugggcuuguacccugcuccagcgggcuucuccuuuccacuccggacacagcagugagcagacccagcccucagcagaccccaaguggccuucuuccccguuccagcuucaauagccaaccccacucccaccuuccauccuucuagagaggaaauggugaaggggacuccagagggaaggcgacauccauggugcccuccaguauacaaaggcagagacacagagcccucagguagaacgggguucccuagauggcaucuccuaccuccagagcuccuggguacccaucgagcccccuaccuucugccuaagccagauaggagugacgauuuuuauacucagcgacuuucggccuccuucugagagugaugucaggucaucacccauagaagaaaggaagugaaagaaaaaguucaugccuucuuggagugcagaugcucagagugaaagaaacaacaagacuugagacagaugggugccauugagcaaacccgaacaugcaugucucucucaugugagugagugcaugagacuuuauucuccuuauuuccccagugcagugaaaucuuucuggauaaaagaagugggcuaauggaaggagagacagaccaagucccaaugacauugccugaccauuuucaccuucgccaucagcagucucccucacagcauuggugugggcagguaagaagaaagcaaggcccugaaagaauauacauuggaaaaugagcaguaauuugauacucuuguggaagagcaugacucuucgccccagaaaggccaaugacaccuuuacuacagcguaaagaucaaagccagggacugugaaacugccucaugauguuucucccaugagaccugugucuggauguuuauauggaacaaaacauggaacagaggcaauaguacuugaugugucuucagcuggggcuuuggauaaacuaaacugaucuauauucagggacuaauaauuagggugugugguuagagcgcguccucucuagggccuguuuuggacuguggcugggccaccagcaguccuacugggccuuugcuucccccacaaauuaaauauguuacagggguggcaccaaggggugacuugggaggccuuuaguccccucuaccucucuauaaucuccauuagaucuucucuguuauuugcuauugaugcuuuucaguuucauauaggacgcuauaagaacacagcuucaaggccucccuuccgccacauacucccuacuaggccccucuacguagucacugccucugggaguggcuagagggagaagccauaaacuggguccuuuaugcagacauuggaugcuggauggagcugauuuaccacuggcucuuagggacagacaagugacucagccuaaggcaguuugaauuuaaguuuccuaucacaacuagaaaaguccugauuaacacgcccagcccuagucaaugggcugauugagagaucgucacauaucccaagaaaaucucacaagacugggaauuuuguggaucugcuggaaagagaagcugccagaagccccacgugaaagggaacuacugagagugaagcuaaugggaggaaaaguagagccaag

SEQ ID NO: 17111 - RNA, 10475 nt, Homo sapiens
aucagagcagaggguuuuucuauuuauuacaaaaguuguuacacaaauacagcugaccagaaggucuaaaaacagcccagacucuuccaacccucaugcaucuguagauagaaggagagcuguggucuugcucacacacaggggagcccuucuuagaagaacugccugucccuuggaagguucagagucuuggguccagcagcagagaggagcccaaccugcguggacaaccccuugaggcagcccuuggucacagcugcucugggugggcagcagguuuaaguuucauaguucacauguucccaccacacaagucaaaucaaggcaugaaaauaaaagggaaaaaggggaaggcuggaaaagggagccuggaagagguugcagguaggggaaggagacacagugggcuuccgagaagcuggcaauuucuugacuuggauggaguuacguaguauucacuuuaaaauuauucuuuaaauuguacguacauguuauauacuuuucaguaugcauaucuuuaaauuuuaaaaauuaaaaaaagaggcuaaaagugaauaaaagggcagaugauggaauagaaaagaaauuaaagaggagagacgacgaaggaagaagauggccaagguggaaaacgagaaaguccuggaggugauaaugcuggccucaguuucucuucuucugucuggauacugguucuacuucuagauaccggagcccgaccagcauacccaggauggagaaaccuuaaauacagaggaaagacuagugacuaacauacauacgguaccuuucuucucucucucuccuguguccacccucuguacuagcucuagagcuggcacagcuccuguaggaggucuagggugguuggaugcuuacuugccaccaucaggggugccaggacgccaaucgugggagcugcaguuccauagacaaacaacucagagaggaaaugccccagggcaaggaggaagguccagagugugaugugauagagccuauaaggaagcagacagaaaugggaaccaaaguuacuguuuguucagaacagaggaaaaguaucagacuucauacagacaaauaagaacccaggaugucauuaagacuuaaaagaaaggacacuuguuccugaggaagagcugguuauuugaucacaacgauauucucaucuagggcaaaacugaagguuucaacugcuaaacugagaggagaaugguucaggcauccagaaugaacguccaggucucagcaaaguggugaacucagcuauagcaaagcagagccugaaugaugacaaucgcaggcaguguagacaacuuuggauccagcacgcuuacauauucuauuuauccaaauugguugacucugcagucuaaucccaccuggcaggcaucuggccaugcacuugucgguguuuauaagauggaugccacagaacgaacggccucauggggaguaaggagcaaggacaccucuggggcuuuuagaugcucuugcaauauacguugguuacuuugugccuuagccuagaaaaguagucacauugaggacauggugacaaccucaugggaaaagaacuuaucuuucagcuuugacuauaagguagagaagagacaggcuacuaggugacugaccacuuuguuugcugauaucuuuuuaguauaaaauuuuuuaaaauuaugaaauacuucaaacauacaaaaaaauuacugaacacuauaaugaacaccaaugcaaccaacacccagcucccucagaucuuaacaucuugacauuuuguuucagacucuucuaauaaaaacuuacagagaagaguuaaaucauccuguguauacuuauccugcucuaagucuguucucccucauccccacaaguaacugguaucuuacauuugauuuguaucucuccugugcauauuuuuacaccuuuuuuuuuuuuuuuuuuuuuuuugagacagacucuugcucugucucucaggcuggagugcaguggcacaaucuuggcucacugcaaccuccgccucuugggucaagugauucuccugccucagccuccuggaguagcugggacuacaggugcacaccaccacgcccagcuaauuuuuguauuuuuaguagagaugggguuucgccauguuggccaagcuggucucaaacuccugaucucaagugaucugcccaccuuggccucccaaagugcugggauuacaggcagaagccacccgcgccuggcccauuguggaaacaauauguauguguguugacuuucagucucuaguuagggagggaauaggaucagaaugcacaucagaagugcaucgaucaaaguccuaggcuagaaaggucuagaaacaggagucagcguuugcagcuguccuguguggggagaggugaaaguaaaugguaacugagguaaagauaagucugggucaggccgggcacaguggcugaagccuguaaucccagcaccuuggaggccaagguggguggaucacgaggucaggaguucgagaccagccuggccaacauggugagaaccugucucuacuaaaaauacaaaaauuagaggggcaugguggugcgcgccuguaaucccagcuacuggggaggcugaggcaggagaauggcuuaaacccaggaggcggagguggagguugcagggagcugagauugugccacuguacuccagcuugggugacagagcaagacugucucagaaaaaaaaaaaaaaagagauaagucuggguugucuucgcucacuucaaaagcacaacaaucaaaagauauaucccucauacucaucagcaauucuucauugugguacaggucuuuaaaaugauuguucaauccucccuuccucuuagucacccugagagguagaacagauaucuauucucauuuuauggaugaagaggccaaggugcaaggaaggugaauaauggacuugcuacugcaaagcuaguuaccaacagaacugggcccagaacuaaacacacugcuuccaaaaguaugugucauucuaggacaaguaaacugcagguucaaguuugaaaaaaaauuaaaaaaaaaaauaagguugaagagaucaaacggcuaauagcccugcuucaaaucucacuugagucagucuuucuuuaaacuaacuguaucucuaauauuuagaugugcaaaaucaggaaugaaaaucaugaccuccagggcugcuaagaaaagacuuaaucaagaucacguagauaaaagcucagcauaauaagaggggcucaauaaauauuaucgccuccuguuuuccccagaugccaagagccuggauaagacagaaaaacauuuuaaugugaaguuggcauucagauagccucccucggugaccugaacaaacuguuuccaccuagagugugaugaugacucccgcugggaagaaagcucgagcccccucuaguggccagcacugguuauggcuucugauugccugcaauuguuccacccuggucuguuugaguacccaagacagguagauucaggagcccuagcuucucuuucacccucaccugcugaugcugcauacacauacaacaguuuacuuguggguuccucuuuuuucauggauugugauuucuguucauuccugcuucuuaaggaggaaugugagaaagguauguguggguggcuacucuaaaaagagcauaccacucuacuucuuuaguagaagaagggcugauucuuucauaaagaaguggaggggcaugaugcaggccacuggauaauggccugccaguuugcuaugucaguuccaaagaauuuucagacuuuaaugaagaccuguuaggucuacuauguuuucuaggcuuggagggaauguaaccugugaguuuuuuauuauucacauucuaagcuaaugcauuaaaaugauuaacaguucccauuacucaagguaacagguaugccucgcaucugauuuccaacaaaaggaugcuaaagcucuuccuucccuuacauacgucuuguugugaaugucaauggcacagaggcagcgaaucacugaugagagcagcguccagaucccaaagguccgagcuuggaggccauucacuguguagcagaaaaaagcaagaguguucagaaggggagacuugagguuccuuccaaacuccuccuauuucacuggugguucaugggagauagggagcuggaccugaccucucuguggcugggcaggauggagguccuaguggcaacaugggaacuagaaggaauagaaggaauuccagaaugagaacuucucagauucucuucaaaugucuacaguuggaagggaaguuccaagaguggaaacccacaaagagcccaguuaggcaaauaacuccuagauauaguaauuuaccccuuuuguccuggaagccuagagggucuggaucaggacagguuuuggggaacguuguagagacugaucuggaaaugcaagaugcccaggaggccagcagacuuucaaggcugauccaggagagaacucagagauacuggggaccaauuuagaugcccauauauggucuuuaagauaugugagugccugggucucuuccugcauccagaucuaugcuguuggaugaaccaauaccagguugguuuccugugugcauggcagugggacaaagcacuguuucuuugguguuugcugggggcauccugcuguugguagcuuuguucugacauugcuguauuaaauaucuuguccugaaaguauaggucauauuccaccauaacagugguucuugacuuugggcauuuauuacaaucaacugagguaguuuuauaaaauuacaaggccuggguaccagaccaacuauaucguauucucuggaggagggccccaggcauaaguauuuucuagaaacucccuguuuggguaauuuaaaugcaaaaccauugagcuaaggcauccaguggcucggggaugccaaaacagugaaagcaaagauacuuccuuugcuggucuacuaccugcugaguaagauaaauuuuaagggacaaaauugacaacugaaaagucuacuaauguuuacuugggcuuuaaggauuuuuccagccuuuggaaaaucagacagcucucccaaauucacaauacugaagaccauuagaugguagugagaaaaaauuccauaugccaaccaaauaucuagcauuagcccuggauagcuauauucuuuauaaaccaauuugauaaugagaagacuaaggacguuucucuaguuaagaguacucaaccagcccuaaccagauuagguaugaggugaaauucugugggacacuuuagagcacugcuacuuucagaagaguaccaugaaggccccuagaucacaagggagauggcagccucagcuuccgugcuggcugaacacacacacacacacacacacacacacacacacacacacacacauaaaguucugcucagcuauaugccuuuaagucacaugaccucuggaccucuuugccucaacuuuaaacucaaagggcuagaccagaugaccucuaaaaaugugugaaucuauauaggguuccaugaccaccugagggcagcauuugaaggugaaaagauggaauuauucugcucacuuucccagguucuuuacucuuauuauauuugagcuuucuuaaaaugagccuuagccuacuuaauuucauuuuauacucagacacugcagaaaaacgagcuaggucagagccugaaucuggguuagcuauaaaugugacacagaauugucaucugcugugaaacagugcugcagcuuaaacuaccccacacaucagcgugaugaaguggaagcugaaauggacacucucaguagagaggcucaggaagccaggaaaggcugccaugggccuucuuaaguuucauuuugggagaccaacuugaagggauuuuaaauaccuucucagggacuaugucacggaagaccuugaauuaauaacucuccaucuguaacauggaauaugagucauguaagccccagaaucauguaaaccugauucugaagagggcuuugagauauauguaaagcuucuuuauggcuuucuugucaggcaucacagagucaccaaguaagucuauuuccucacuugcccuuauaaugcuuuuuuuuuuuuuuuuuuaaauacaugaauugcccagggcaguguaaaaucaaugaaaaguauucagagaagcuugggggaaaaagggucaagugcucaccacaaagucuauuacuccaguagcugccaaaggcuagcuaaggcagcaucagaaucaucugggaaguguuuuagcaacuggauuccugagcuccacccagguucaauaaauagguuuggugagggaaauggguaccuguguuuguugacguuuccuagguuacucugauguacagccugguuugggaaccacagcauagggccaguccuauaaguccuauaaaggaugcagaaauucuuugauuucuuaccaagguuuggcuugccaguguagagcuuuucauagagaaaaguguggucucggaagcucugcagcguguuccccauggcuaugauggacaccauaaccagccaacuucuuaacacauucaggaaacggcucaugacuccccucaaacgugggagggcuuuuugccuuggaaacaaaggcagaggacaugagacaaugagggccagucuauguuaaccauaagcaggaagggaggaagaaugaagcaggccaaaaaaagaaauucagucacacuaauaguggugaaugaacaguauacuuugcaauaaguggcacaguacuuauccuugucuaagcaauuucuccaaaauauuacccuaaaucagaacuccuuuuucuggguuggaaucaguccucuaucuuuacuucuauaccuucauguuuucaugccauuccuucguaaugcaaauagcucaaaggcgauuauaacuauacucacagacaccugccuggcuauugaugacggauucuuccaaguguauggaacuuuauaaauuugaguaggacuuauggugugaggucacuauuuacaucccuagguuuucuggacucugguucucagguauaccaugcuccauaaacuagaagaacaaucuaaaaguuaaaaauaaacugcugugugucaacuccaaauaaaauccuaagcccaucacggacugaacagagccccucuuggccuaggggaccccagaaaaauccuaaaacugagcuccuggccaugacaagaugggaggucugacaugcccuguuauauucguuguguuuucagguuuagagacagcaacuuaccagcauuaaaguuaaaauagagaucauaagaaugacacaacagauucuuugugcaauaagauaccaaauuauaaacaagaccuaaggccaugccaggcaaggguuaaguuacacacuccuacauuuaaagaauaaaaguuauauucugccacaagguuuuuuuuuucuccagcagcuagaugaacacuggccuugagauaagcaauauuaaaacaauugcagcucauccagcucacagaggcugacuaccugaccccuguuccaccaguuguaacuacagcuuugauuggacaagagacugauuucaguaauuuucuccagauaagaccaccaaccguggacugcuccuggccaguuuagcaggaucacacacuugagugucuugguguccugaaaagacuuuuugacguauagagccuaggugugauagacuuaaauguuaggucuccacuccaaagugaacaggguucauaugugguuacauauguuuguucaauaugcaugugucaggacaaccuucaggaauauucacagcuccuccuguaaccugucgaauguguauguuuagcaaaccuguucagcaugaagcucuaccccaaacccuucuccuucaaaguaacugucucuggucuuggugggaggcacucuucccuguuggguggcuguaacccuuugcaagagauaaagccucuuuuccuuuuuuccaaauuuauaaauuguguguguuuaaguuaacgugugaguuuaggacuaguaagaaaauuauauagcgaaggaaacagcaaucuugguguuggguugcaagaaaauaauagguuucagucauugagcacuuacaccgugaacugugccaagcaccuaacauauauuaccauuuaaucuuuacaaugagguaagcaggcacuauuaauauuuccaucuuacagaugaggguuggaacagagagguuaaacaaguuucuuaaggucacacagcaaaguuggcagagcugagauaagaaucauggucugcuggacugcugcagugcuaccucauuguuugagacuauuuuaaugaaguucccauuuuuugagaaagaaaagcauaccauauccacuuuugucuucaaguuguauggaaaauacaauuagauuacauacuuuuuguuuuuuaauuuauuauuuauuuauuuauuuuuuugagacagggucuugcucugucacacaggcuggaaugcaguggcauagucauggcucauugcagccuugaaaucaaaggcuuaagugauccuccuaccucaaccucuccacuugggcucaacugauccacucaccuuggccucgccucccaaaugcugggauuacaggugugagcuacagcacccagccuuuuuuuuuuuuuuuuuaaggcuuaguucaacucuuguugaguaguaauuucaguuagucugauuuaaauaaaaccaaaauagauaaauaaucuaauaauggaaugacuuuuucccauccucauuauuauuuucuugguccacgguuuaucuguugucagguuaaccucuugggccugaagugguaauaaacuaacaggcuuucuuugucacuuuggcaauacaaguuucgguauuguucucugcuacccagugggacagauauuaaagucagcaauggcccaagacagugugaaacaccgccgcccccccccgccaacuccccgccccaaacaagcaauaaagagaucuagagaaggaagggugaauugaugagcccuucagggagagcuggaucacaaagguggucucugucgaagaucagagagacugagggucuacuggacaucacaggccauuaucauuugggccaagauccacccauccucuuuauuuucucacucucucucaagaggagacuccuccgggguuuagaaaagcugcauggaugcaccucuccacuuuucugcacaaguaugccuuccauuucacagaaguguuaucuguuagaaaucccaacagauagcugaugaggacagagccugagcacuucugaauugcucugccaauuucucaaccuaauuucccuaaagcuuaagggccucuuagaguguauacaacaucuauuuccaaauuuuguccuggcccuggcccagcccagccaagcccagcccagcauaggugugcuguuaaaacuuaaucaggagaaagggauucuuauccuggcccuaccacuuaguagcugugugacccuggguaagucauuuacacuuuucagucucgguuuccucaucugcaaaauggagauagaaauaucaacccgaagggcuauuguaagaauuauaugacaaaaagugaaggcucuuuguacagugcuaggcucauaguggcugcucauucgcucauccauuccuucguuccuugaauucaccaagccuucuccaucuuccuagcucccccuugucaucgccucucgaaaccuuuuccccccaaaagguugccuuccaguuaucuuccuuccaucccaccuccauuuuuccagacucuccggauccucucaaucagaagcaacacagacaccuacaucccucuucucccccauauucuccuuaccuggcgaccgggcccccagcacagcaguggcagcagcagccgcugccgcaaacaagcucccccaggacagcuccagcccggaguccaccugagccauuuguccccgcccccucccucagcccugcuccaggauugggccguuuccgucaguacucucucugauuggcugucccgguuucgcccgagcaggagauggggagugaaccccuuuacugccaaucagcgguugccgcugccuaagccucuccccagguacgccgcucacgccguaagcccuccuguuggaccuagcggaacuccggguuuggagucaaccucuuaggggcggagaaaaaaacagcggaaaaaaaaaaaaaaaagaagacucccuucagcugagggcagggcucugcgcccgcgcugcgcggcggugacgacauucgcccgcguccgcagcugagcguuaugagcgccugcgcaguggcuccgagcgggcgguugcuuguugguuguuguaguaaccggggaagcagccgucggcggcugcccugagccuuccuggggaaggaggagggagguaggcgcagagcgcgguccacgccugcucgccccg

SEQ ID NO: 17112 - RNA, 21558 nt, Homo sapiens
cgcgggccguagucgagccuggugggcggcuggcuggcaggggacguggucggcggcagcggggcccaggggcggcggggcugcagcagcggcggccccagcuucgccgagcagcgaucggcuggugggcuucucguuggcgggcuccgcguuggcgggcugcuccccaggcaccagcgcagcgcgcgcucgcccggcuucgucacucgccuccagcuacauccgccggccgaggcugcgcgagccuccgggcuugcgguccccgccccgcgguccuuccuccacccucagccagggcagcugcagcccgagcgaacagccacggagcauccuccgcccgcccgggccgcgccaccgcccaugcugcagccagucccaggcagcgaccccgcggccgcagcccgccgcucagugaccucagccuggccccugcgcgccgcccgagccggucccgcugagccgcgggccccgugcccugcgauggcucggcuggugcagcgcggcgccaggugccagccguccucccgcugagacgcgcccgaguggggacccgcugggccucggggcucgcagccuucgccuccccgccgcgcccgcucccuuucuggggacuccgccgcuguuucuggggacgaggggacaggggacccagacaaagcccacuuugugcagggaguuggccgcaggcggggaaugugcgcgucggcgcgcgcccccuccccgcucccggccagcugcgagucuuggcucccggacuugucucgucgcgucggagaaaucgccccccagcgccgcucucccgcccgggggucuugguuccgagcucgcgcggccgggagucgccucggucuuccuuggggcgcgcgcagaugugagcgugcgagaguuguguaggggauuuuguucccuccgaaacugagacccagggcgcccagugggcacccgugccuugacucuguccuuucugcagccgcugguccgagcugucuggccucaguuucccuccgacuuuucuccgcucugccagcccucacugcugcccgucauuguucucgcaguuagaugggggugcuuugugacggcugccaaguugggguguguucucuuuauuccguuuuucaaacagaacaaggccuccaaggcugaccccagacaacccacccccucggacccuaauucaccuuauugcacugauuuuuuuuaucaagucguauuuuauuguacaggagccacgcccugauuucuuaaaggcgccuugcacucuggccauguguuaucucugcagccggugugugggaggccucuugugagccaguuguuuucccgccuccaccaccccccucgaagauuuagggaugccaggggggaagaagguggcuggggguggcagcagcggugccacuccaacguccgcugcggccaccgcccccucuggggucaggcguuuggagaccagcgaaggaaccucagcccagagagaugaggagccagaagaggaaggggaagaggaccugcgagacggaggcguccccuucuuugucaaccggggugggcuaccuguggaugaggccaccugggaaaggauguggaaacacguggccaagauccaccccgauggagagaagguggcgcaacggauccguggggccacagaccugcccaaggugagacacacgggucaggggggugauagcacagucuagguuuuagugaccuuggggccaagagugaagccacacucuccucccacggggcaggggaccacuggcucgguaagaucuuuaaaaugcagugauaucauaccugucuaggagaacuuucucucacugccauucuaggagggaggcucacauacauugucuccaggaggcccuccccgcugucuuuuaaaauguccacguuuuacaggaggggacagcagcagauggaacuaacaaacacaguaggauggcuugacgucucauuugcuugaugacacuugccaagccagagaacugugagcagacaaauguaaugaaugacuaaggagaugcagggcuucauauguugagaaaauauuuucgugcauuaugucauugaauucucccaacagccuugugacguaaguacaguuuggauucccauuuuacagaugagaaagcugaaaacucaaguaggaacucaagaucccacagccaguaaguggcagaacugagauucaauuucaggucuucaggagaagggcgggggguggugguggagggaaguguccagguccucuucucuguuggacaguagauucaagcacauuagaagaggucuuauggagaagcauaaaaugaaauaauuuuucuguguuggcuguaacuccuccuccaugacagcuauacuucaguugugucaccaacgaaaacagaggcuguaucucauucaucuuugucuucccaaggccuccugugugccuggcacagaacaggcacuaguguguguguuugcugaaugaaaggguauuugagaguuucugugcuguacgcugcuauauggaaauacaugccagauauuaaaaaaaaaaaaaacaugaucaagacuaggaggcacuuugccaaaugcagaggccugaaaucuccaaaaaagagcccuuuggacugaguucagagcccagugcuuagcccugccugcccagguuggaaggaagggggcuaggaagaauggaaguuagugugaauuagacaugaggacaaguggcccguuuuguuuuuaccaaguuauugguacagccaucagaaagugucuucugggaaaaagagaaucaaagguugaagguuuaaauacugccuaauguuuccaggggaaacaaaauguagauugauuuggaauggccgcauaaaugugcucugcacugacuuaauauuuauuuagcuaauccccuagaguuggauguuguuuccaguuuuauuccuaaaaugaauacuauggugaacauucuaaaauauaaauuuugggguucaucucugauuauuuccuugggaaaaauucugaaagcgaaaguauugcgucaaaggauauugacauugguaggggucaccugcuuaucuauauggccucuuccaccuauuugagaugcaguuuucuuaucaauaagaugagguugauuguggggaagaaaugagagacuguguguuaaaguauuuaacaaacuguaaagccccaaaccaguaccugguuauuggauaucaguuaccuuuuuuuuuuuuuuuugagauggagucucacucuuuccaccaggcuggagugcaguggcaugaucuuggcucacugcagccuccaccucccugguucaagugauucuccugccucagccuccugaguaucugggauuguaggcaccuaccaccacaccuggcuaauuuuuguauuuuugguagagaugggguuucauuuucaacauuuuggccaggcuggucucaaacuccagaccucagguaauccacccaccucagccucccaaagugcugggauuacaggcgugaaccaccacgcccggccagacauccaucaccuuuacuuaugugcuuuaucaagcggcaagacuggguuuugcucagaucauuugucccgaugaggccagagucacacccugcucccacgugaacaagucgggcagcucuccagccaucuugcuuaugucuaaaucaggccauaaaagagugugaaugguucccugcagaacugccaccacuccugggaacuaaaaaagaaauagugagcucacuaguaacuggucuguaaugucauucugucaucuucaguccucauguacaggaaagacacggaugaaggaagucuaggggugggggcuguguugugacagaccccuagacuuccaucgcuaggguagaaggaauuuugugagagguuuggaaaaauuugaaccucccccucuucaaaccacagaucucagauaaaucgcaugagucugcaugaggucccuccucuaccugggcucugaguagaaagguacccuuagagucugggagugcaguggaguccaggaggccuuggagagaagcagcguggguugggugccugggugccagggugccaguggcagggugggcugaccccgcccuuaccaucccuaggggccaugccacuggagcuggcacagggucauucccuacagcggccacacaguguggggcucaagaaguguuuuguugggaaaauugggagauuucucacauaaagauccagaguuuuggcaucuuuucagaaaauaagaagacuugggaacacaugggaaucugcagucccacguggcagcugucagcuggggcuggggagugaguccuacucccccaucuugccacugucuccaccacucaccuaccaggccugccugccccguguauguuacuugcccggccccugcaugugguugagucugggaccccugcaggcuggugucauaaaaggagagcacucuggagucaaagcuaccauguucaaauccuugaucucccauaacuacuuauaugaggaagacaggcaacuuucuugugccucaguuuuccgcagcugugaaauggagcuaauagcaaugcccaucaagaggauguuagaggaauuaaugaugcaaagcaugugaugcuucauuaagugccucuaauagauacccaguaauggagcagggagugaguguucaucgacaccccacuagcgcuuuggagaagcagccuuuacagggaugaugccaguauguuauagggcaacaauuucuagaaagaucccaaauccagcaacagcuuaggcuccuugauaagagucuguccuugauguuucaggcuuccacccccuuuaaaagcuuaguggccacugaccccagacccagcugcugaaggucuuuuauggucucuuauggcucaggccacagagcuccugcagaaugggaauuuggacaucuccucuagcuacuuauuaugacuccagagugcuuuccuuugauuuauuuaugagacagcgucucgcuuggucaccuaagauggaaugcaguggcacagucauggcucacagcagccucuaccuucugggcucaagugauccucccaccucagccuccagaguagcuggggcuaccggugugcccuaccaugccuggcuaauuuuuuuauuuuuugguugagauggggucucucuauauugcccaggcuggucucaaacuccugggcucaagccauccucccgccucagccucccaaagugcugggauuacaggcaggagcuacuacacccagccuggacaucuccucuaaaaggguaacguugcugggauuagcaugugcgaggcacacugauaaugaugacagugaacacaaauuaagucugugcugugugccugacccugcucuaaggccucgaccugcagcaucucauucgcacuauaaggcugauuuuguguuggugcccacuuuauaaaugaagugucugaggcacaggggaggucaggagcuucacuaaagucacgacuaggccgggugcgguguaaucccagcacuuugggaggucgaagcagguggaucacuugaggucaggaguucgagaccagucuggccaauguggugaaaccccaucucuacuaaaaauacaaaaauuagcuggaugugguggugcaugccugugauccuagcuacucuggaggcugaggcaggagaaucacuugaacccaggagaugagguuuucagugagccgaaguugagccacugcacuccagccugggcgacagggugaaacucugucucaauaaauaaauaaauaaauaaauaaauaaauaaauaaauaaaaagucacgacuguaaauggcagagcugaauauccauagugaugaucuaguuggagacucagcccuauugcccucuaggccacacuuuuugggcgcacacauccagcugcaagcucuccccaccucccccaggccucauuguguucgauugaaauagaccccuccagugagaaugucucuguagaacucaggacuagggguuccuggagccgggggaauccuuggccuuggcuguggaggaggagugcucccuggggagaucugguggcuauaccacucccccuuaccgugccccacuuaaacccaccacucaacagugaggaaauauuucccgacuccuguuucggaggugggggugaggggcaagaccuaaaaugggccuggucauuugcauauauagaaucuuucuuauuuguguuugagugaacgagucuauguagguaaugaacauucagacaaaaaggugcaggugcugucugcaguggggugacaugagucaaggagcuagccucggugaugguggccuuaaggucuugccucugaauccccagguauuuucuugaccuuccuucucccagagcagccagcuccuagguccuuugucugcacagcaggugcuagugcuuucguggguacugccuggucccggcccaggccuggcucugggugaaugauccaguccugggacugcagcucccuuuuugcagcuucuugugggaggguguacuacaaucuuuaucccaagcuccucaaggucacuggauccccacuugugcauggggauaaucugcaugcuucccugccuggcaggggcugccaccugcagagaucaggugacuggguggaugugccaugcuauuuaaauugcuaaguaauuccucuaauuccccuuccaccuccccaccccuguauccuugacauggggaggccaggccaggcccuggggcccauuugguacagaguggccagacaggaagaggggggagccccccaccccggguuuuaucuugcuggugacuguaagugguggugccaguuuggggagggggagcaaugugaaagggaaauggcucccuccagacagagacgucagcggcucaggagccagggcagccagugcgguugcuagggacuccccagacaggaaggagaagaccgacgggagggagggugaggaagugcaggcgacgcuguggcccuggaccagggccccuucccuccugcgucuccaccccuuagaggaggugucugucagacacugucccgugugccugugccaucagcaacaccccagacaugagugugcagugauaacuggagugucacuucccuccuugucagagccccagccacugcggucacauuauuuaaaaagcugggcuggcaucuccaccacucgagagccuccccaggaaaggaggaaaagagcuucauccuucccuccuuacccagcccuacccccuucccuucacacgugccccugagcacagacugugacucucagcagucccaucgggugggugggcucaguguggccuuggagggccggguggaggcuugggggcagggggugggaccucucuauguggggagccuuacagcuacugugcugguggacaagggggagcccugaggggugggccuuuucccuggaagucugguucuucuacccaaggaagucuguucugaaaccucggaggacccuagcugauguaucucuuggccuccuuggccucacugacuuguuggcagccaaacugccagauccgggcuccccuggcuggagagggucccauacuggcauaauggucucuuuucuggagacuggaggcugagggaagccugggggucagcuguucuugaccuuacccccagcagccuccaggcucccaggcaucgggaaacacugccuguucucuccucugccauuucugggcugggugcuggaaagugcguucuggggaggaagacugucuggguaccuggaaaccuguacugacuagguguggagcuggcaggaaagagaagacuuggaggaggacccggccccucugugcaugccccagccacagagcuacagcaagaccuguuccaaaauauguccuucuggccugcuaccgcugacugacuccuugacaguucaaguuggugcucuggaaggcauggcgaauaugcccaugauacuggguggguccccuaccaaggaugcucaccccccucaggaccacucccaaagccuagggcaccaccugagaagaugggaccccggauauaccagcuuugauccggcgcuugaaccagagcaaacuucaaaccuaaaauaaccccaauauuauauucuuaagucuugaaacuaaugaauauuuaaaauuuaaaauagucagugaauuaaccuauguuuuucugaaguuauuaaagaagcauaaaauuggaacaucagcauacacucugaaugaggaaugcuguuaagucccaggagggaaggaauggcugggcuggggcccuggcaagagucuucgaaugaguggggugccaagaaaggaagcucaagugggagggaggggaggcugugccuccccaggguggggcgccucuggggccaguccuagguguuugguggacuggaagcuccaaggugagccucuucuugugaccggagcucuuucucuguccccagauccccauaccgagugugccuacguuccagccgucuacaccugucccugagcgccuggaagcugugcagcgcuacaucagagagcugcaguauccucucuggucaagggucauggccaccuucuggccgguguggugggccuuguuuccaggcagagcuggagagguaucagcagagccgccucauuccacaacgccagggccaccauucacgugacaucucugugcucccuggugcugugggacgcggcgcgugugccuccugggugucggaggaauuuugucugaugagugcagggcccacucugcacucucugccacccccuucccgcuccugccgugugaugggguaaagagaggaaaauggguccugagugacuugcuggugggguggccaagucuagauagaucugcucuguuguccacccagcccuagcagagggggagagagggagcugccuuggggcuuuuaaaagucugauuuugaauaaagggaaaaauggcagagaaaaaggauuuucugcuccaggagguaacuucaggauccuagaauuuucuccaguucuucuccuuuuuuucccuggcaguaggaugguuggccagcaggggaagagcugggcuccccugggcccagauuccucugugucccugcucuagccccugcacccugccccugcacccugccccagagcuguguguccuggguccucucucccaggcuucuggcugcagaggucagagaugggagagcuaggcauggguccugggucgggagaagccaggcugaugacugcauaucggguccagcuccuccuucugccaguggggaaacugguccagugaggcagguggcuggcucaggagcaauuaaaggcugaguuggacccccuacccuagccuccucucaguuccuguggcuucucagcugguuggaagaugaagugcuguagggcgcuguucccagccacagccucuuucuggcccucgccgaacuggucgccugcuccaugucucuuguccuaagaagagaagccaggggagaacaagggagaaagccaaggagggugagggagagggaaagagaaggaggcgugaggcggggagaagaauucaugcugugcccccaucuccccuccaggagacuuggcucuugagcuucaggauaggcaggaagagagggucaaccuccuucaggccaagcuaggaagcccuuaacccgugcccacagguacaaucacacagggacacaguucuuugaaauuaagaagagcagaccucugacaggguaaguauggggaggccaguccucugccccagggcuggcuuggagcuucuugaaagcccuauagugcaccuuggagaggaaguuuauggggcagucagggacucuucugaaggaagccagccuuugggggcaggugccacccuggggccuuauggaugucauaaagagaaaaauccggcugagaugaacagccagggcugccuugaugaaaaggaaaucccggguccaugcugagcuagagggugggagagccgcccccagcucuugccuuggccaggagagagggugguccuagguggauuguaggugagccucagaucuuuuguuuuuuagugagagguggaccuugcaggagagagcccucccuucucuguucugcggcugccgcacuccccauugcugauucccauugcaggguacuugcauggucaccccauuugccuuacuccguggacucuuuucugggcauugaguagcaggcucagggucugagcacagggagcucccuggagagaauguugcaucucucacuucccaucccgccaccccguguguagcccccugccuggauucacuuccccuggaaaguuucugcccaugaagccccgagggcagaggagagugaagagugaaugccacagcugggucuaggggcucugcccaaagaugcccacagacuuaagaccccugggcuuuaaaaauucaugugaauuggccaggcacgguggcucacaccuguaaucccagcacuuugggaggccgaggugggcggaucaugaggucaggaguuugagaccagccuggccaacauggugaaaccccaucucuacuaaaaauacaaaaauuagcugggcgugguggugggugccuguaaucccagcuacuugggaggcugaggcaggagaaucguuugaaccugagaggcggugguuacagugagccgagaucacgccaccgcacuccagccugggugacagggcgagacucugucucaaaagaaaagaaaaagaaaaagaaaaaaaauuucauaugaaguuuacaucuugccccacacauaaucuauguuugcuucuuugugaaaaugcauuuaaauggcuuauuagcaaaauuacuuaauuacacccucuccgaggcccuggauggaguccacccucccuauccccaaagcuuugcuuuuguuggccuguggcugcugugugcuggggaaccacuccagccuuacuuggcauggaggagucugggugcccuccugggcaaagccagugaccaggcugaauucccaggcuggggacagagggaggaaccacgccucagggaaaggcugucuuaaaauggccugaauuccaaguucaggagcagaucuguagucagcagguaacuaucugccuaagaucccacauccaggcucaggcagcugcggggaggcaguugcagucaauuaacaagcuccugggagaagccaugguugggucaguggugucuacugugcuucagaagggaagagaucgaugcugacgucccuccucccccgacugccucgcagaaggccccagccugguggcuggagagaaguugcccccagcuucugcugcccucccccagagcucuuuggagcaagagccaggcgugggagguggaagugaaagaagggaagagcagggagagugggccuccuuccuaucagcaguggccgccucuuucccacccccucaggcuccagacuuccguccgucgggaguguggagggaggugcugggccugagcugagagcagcuuagggggcagccucuguccuucuagcauuucuaguccacccugcccccuccuucucacauuccccuggaggggcuggaggcgcuguccuuacugaccugccucccuuucccacaggcugauggaccuggccaaggaaaugaccaaagaggcccugccaaucaaaugccuggaagccgugauccugggaauguauccuuccucaccugaaggggagggguccgggcuucucugggccucagcuuccugcucugaaagugagggugggguagguugaaugggcuccagggcucucccauaugcagucaucugcuuggccccaagauggagaagcaccccacuaaaguggaagaaccccccaaaauggaggagccccgaggucccaguaccccacaucucaguugcuaccuucccaggcuuacugggcagcucuuuuuugagucacguggauacagggaccguuuucugaaccccaaaucagggcacagugucucacaaagacaguuguaccauuuccaagaacuagacagucugggaggcacaguuggaaugcccagauguuggcauuuccagaacauguugauuucuggacgagauauuaaagcaaaacugccuuaaaaaaaaaaaaaaccacaaacaagguuuuccagucacacccccgccuccaacccaaagggcagaaguggggccuguagcugagucaccaggguagccuuggagacagaccagccaccaggagaggcuguccuccccagccccacagucaacagcgggagaggaggaaguguuuauggcugguucuccauccuaacuggucaaugccugagcccuaccuuuucuucucagucauuuuauuauuaaaaaugucauaaauacacgugaaaccuagaacaacaucaugaacuccugugcacccguuacucagcuucaccaacucaaagccaauucuguuucaucucuuccacccugcccguauucuuuaccagcuuuuaaacauuuugccugcgccccugggguaggcagcccacugggcucagugcugcagaggagcacagauuaggugggagccaagagggugacggggagggggucugauggaacaggagucccaucugagggcagguccugggaggacugugauccagggguccauccccaccccccacacagacaugccugccugaaguucacacaaagaggcugcgggugcccuucucuucccgcagaggucucggagggaacgccacuauggcaggcauuugcuaacagggcaggcccauuucuggagcccgacaucccugcccuguuuaugggguucuuugcugggauaagccugaggccacccgagaaauucaggcugcaggcagugccuccuucaugucuucacguucacuucucccucaggggucacacaccaaaguggaggcucccacccucauaggagagagacugguccuuuuccccaggaggacacacagaagucacuccaggcaggguccuauggucucaaagcuuuucaggggucaccugguggcuugugggcaggaauaaaauaggaacagcccccaucugggugaggggcuccuucucaguguccccacagcucccucaggcacagcacacgccgugguucucacgucuuguccucgccgcacucugagccucugcagggccgggcugugcauuucucaucgcuguauccuuggucacuuacaaggagucaggcucaguaagcauugguggaaugagaguagugcuggagggaccguggcauaaugucucaacacagacuuuggggucagguugaccuggacuugaaucguggcugggcugcugacucacugugugacccccaaggaaguuccuuaacaucucugagccugggaguccuccucugcaaagggggauaguggcaguguguagaguuguuaggacaaugggccgagccggugccgugagacgcagcacagugcuggacauggugucugcuacacgcuucuauccauucauguccuucuacccauuuguucgagaacuuucacugaguaacuguugugugcccggcuugaugcugggcccugaagaacaugacagacaagggcccugugcuugggagguuugcauucuaguggaggagacaaaauaagcaaguaaggaaaaagaagcaguaaacacuggucauggugagagugccguggaggagguggacgguggcgcaggcucagcuucaguccugagcagcagccaacuuuggcaggcaggggaaaaggccggugugagaaacucaggugggaggccccgggggcuggagaggugagcagguggggcagagguguaggaagugggagugggccuggggcuggcugggggcaccucccaggccucaguaguacacgugauuguauuugaagggccacaggcaggguugcauguggauauggggagaggacagggugaggguaagagaagagugaagccgcgucuguggccugugugugugccaaggugcgggauggagggcgagggagugaggcaggggagggaaggcuucucuuccguccuugggccacugggcucuggaaagcccugcaguguggcaccagcccugcuggacuucagagcgguggccacaaaucccuggaagccccgugccuauucgagguucccuuuauugagcuccagcuggauaccaggcucaaugcuagauggcaggaauaccaggaggagacgccaggcguauggagaugagcaggacuggugucugcaccccaaggcuggcggugcguggaccccguggcucccggucccagucccucccggugugcuggccccgugcuucuccuggcucuuuccuuagcggggcacuggccaguuaccucaccaacagcaugcccacccuggagcgcuuccccaucagcuucaagaccuacuucucagggaacuacuuccgccacaucgugcugggggugaacuucgcgggccgcuacggugcgcugggcaugagucggcgcgaggaccugauguacaagccgcccgccuuccgcacgcucagcgagcucgugcuggacuucgaggccgccuacggccgcugcuggcacgugcucaagaaggugaagcugggccagagcgugucacacgacccgcacagcguggagcagaucgaguggaagcacucggugcuggacguggagcgccugggccgcgaugacuuccgcaaggagcuggagcgccacgcccgcgacaugcggcucaaggucugcccgccuuccacgcccucgcccccucccucgcccccucccccgccccagcagaggcgaugugaggauugagaggacuggggagcuucucaggggacuggggugcugggaccuugcuuaguggucgauauuguucaggugguccccuggggugggcagaccaggacggcugcggagggaggaggugggugggcuggguuuggauggugguagguguugggcacauggcaaggucacugguggagaaucacggccugucuggagggugugaucgggugcugugaugggcagccuccccacuccuccuguaacauauccugacucugccccccaacccuagcaaccauuaaaggacuaggagguggucagaagaaagggaagucagaccauguggaagacaaugagggcaguguuccuucuuccucuucccacccacacuugagcaggaggugauagggaguugggcugggggcuguuguaccaaaaacagcugggcugagcuguugagcccuagagccuuucagcaggcagaauucugacaucugccuggguucuccuggggcugccagggcccccugcuggguaucuccauagcucagucacugcugcacugugacugccccuccaggcagccuggagccuccgccucaaccaccgaccucugcacucccaagugcacugcuucucuugacagcccugggaggccagcgggcgguaggugguagcuccauuuucaggguuggaagcccagagucuugcucacuggcagugagaggcagaucagacuggagcucagccuccugauggggugauggggaacccagguguguugcaggugccugcagguguccuggcagggguuuguaagagcuacggcugcccuagccauugccagcccuaggccaagaucuccuggggugacagugccuuccccuagggcagaggcaggcugcagccaacccugcguuagagaggggcugcucucuucugccccugagcugccgcuccccaccuagcucugggucccccagcacccuggcucuugcuccucaguuugcuauugugucuuuaaggcaucagauuggaucuagggugagagccaacaguucccuaguguuuagagcugugauggauucccagccuauucagugcuaaacacucaccuguguuacuugccccucuccagcacuccugcguuuugaaaacucaagucaagcugacggugccauauaaaggaugacucuuuuguuuuucucauuuuuuucuuaagcagagcuaaagcuaccagucugacuucucaauggcuggagauacccagcaucacccuuggggugagugggaucucagccccaaguucagugugggcugcucccacaacuggcacguuuaccuggccuuuguuggggacuuuuugcaauauuaugguaucucagugacuucccccacuuccacucugccuucaggagcccacagggauuggacagccccauggaggaacuccugcucuggcagcuuuagugccugggaaauagguugggaaagauccagacagggaagagccaugcuugagguuccccgggccuuccccagggcagccuccagggaccuguggcuccuggaaggagagguugggcuccagggcaguccuggagugaugcuguugcuuccuccucugcaccuagauuggcaaagggacgggcccucccucucccaccaaggaccggaagaaggauguuucuuccccgcagcgggcccaguccagcccccaccgcaggaacagccgcagugaaagacggugagagagggaccacgccuggguggguccaaagaggguuuuuuuccuuuccucucaucgugugggucccuuuuuuuuuuuaucucucucccacccuucucucuuuuucgcucccacccaagggaggugacuugggaugguggguuuagagguuuguguauugacauuucccacagcaaggcaguucuacuuccccagagaaaccaaacucugcuagcccacuagucugagcauggguuaugugagagaaaagguagaaaggauggggccccugcaaggcagugagccacccaggaaugucaugggggagggcgugaauauuagauggcuuugaacauaacuuugccccccacccaagagucugguuuuugucuguauccagguagcaagaacaagccauugaaauaccagcucuccuccucugauuucagcuccuacacaucacucugacucuugcuuuaaauauaauugucauucaggagccaccucucugguaugaauucaggggugggguacuaagcaggccucuggcaccaaaauauccaucaucugugacuuuuaucuaagaggcuuuuguagaugacagauuccccucagacagauuuauacuuuaagcuguuaccuaccaacugcagccagauuagccagccuccagcagcgagaaagccugugagagcgagccggggccacauucagacagcacaggcgggccaggguguccaaaaacacacuuccauacgcacugugcugugcguuggagggccacuuggagaauguggcggggaagccaccaggcagccgcugcuggcuccccaacuccaucucccuaacagaccacucacucuccucccgcucugcucucuuccucccacaggcccucgggugacaagaagacuuccgagcccaaagccaugccagaccuuaacggguaccagauccgggucugaggcggaugccagcaccccaggccccacccacucuugggggccaggauccaccugcuggaaccagccuuaugcauggggaaggcggggcuggugacaaggcagggcaagaggcugcaggaagaguguguuccagcucagccccccaagcugcucucgcucccacugagccaagcccccuaacuuugggccuagaggccguuaguauuuuauuuggaguuuuuaacucuacaacugaaguuuaagguauuuggggaaaacuuaguccaaauggaucugcugauggugggaaggccagugcuuaacaaauccaugugucauggggccaggugagggaaacugcugguucugcuggugccucugccccuggcuucucucugggaguugggugcaucuuaucagugggaaaucucccagccuuaccaggccugugauggggggugggggugggguggagauguuucuccaguucugccugcccuggcagaaucuugacccagggaaagggaagcaggguaggaguccuucugagaaaggucuguguagcccauuaaccaggagcuuggcacaggccacaucugccccaagagcaugagcucguggcucaggagagccuucaggcccuugaggcccccaugggcagugcugugugggcagaggaggggugauaugagagcgagcccagggaaggaccucugggcaaaaaguucccaggcccuaacugcgucuacuugcucagucccagcucugccuguugcucuagcccacaggcucccugcggagggucugggcuuggcggaggacccagaauggcacugaggccagcauggcugugggaguugagcaaacccugggugccaguccaggagcuguggcuggacauggggugauggggcgggaugcuugggccugggucucuccgccagcagugccaggagcccuugcuggggaaaucaagaccagacuaggaugcuucugccccaggccugccuuccauucuuuaacagcccaucuuggcuugggguugcaaugauggcugggccagucacuuguggcagggcaucagggcccuggcagggaagaaccuaggcaccugggguuguccccagccugcccgucagcaugagauacccagugggaaagugagaggaugcggagagguuggcagagccagggguagguucuggaggcucaagcaacaaggaggugcagguaaagggugcagugcagccacugagggacagcugggaacugggggaugcaagugagaaagggaugugggggagaguucaggaucaggcugcuugaggaguaauggguuaccuacagcagagacgagauggcuguuugucaggaggcgguagaaagguagaaaggauucagauuguggaaggguaaacggaugagaugaccauuaagguuuuguuuuacugagaggcuguaagucugccagggacagcugucaguaaggcugcagaagggcuggggggcuacacaaggaagagcagaacuaggguuguaagcucaaaugacgagcaaacggugagaaggaggccugaagggcuguguggggacuauggcuaccugaagagggcacacccuguuaaaggggccacagcugcucagcuguucuuacagugccggcccuguguugccagauugucugcuuugucagaggccagaauucugacuuuuuaugugaaauaggauuuuuaaaugcuggugaucacuuaaaaaaaacuuaaaaacccaauacuggcaaaagaggaugccaguuugcaaucccugaaguagagagagcucgugcuggggagaaguccaccaagaugcuuugaggcgggcuguagcaaaguccuguuucucagagcugggcugggcugggguaggauccuugcagcugaggaggaggaaaagccacugagucuccucccagagcgggacaaaccagaggcccuuugcaguugcugggucaccagcggggguggcgcauggaguacagacaguguagcucuuggccugccagggagacggauggugccuuugaagcaaagaggaagggaaggcagaaccagggaugccuuugcugaugagagugccugucagggaaggcgccacaggcuggcagcucuucaaaccagcagcgcuugacccagagccagauccagcauggccuggccagaggcacccugggaggccagcuggucagucccuugccuccccaaguucccccuggggucaaugagcccugggaggaugccuaaccuaacuccagccagacuaauaggggcauggugacccuugacucaccaucccaucccagcuuucagggaguggggguaguguggucuccauguuccuacuaugccuaagaagagauggcucaccuugggaggugccaggcugaaacuagguccuuuccgggucuggaugcugccgcucaggagcaggggcguggccucagcugccucugggagcuucccgggaaugacaggguuugaggggaguagauaugagagggagccgcuccugguucuggagucuuaggagguuccaacuugcaggauccuuucccagagcccuccauggagaaaacagcaaaaugaagcccuuaccugcuugcugucugcaagggagggagccgagccccagcugauaaucccccagcacucacccuuccugagcugagacuucggggcuguggagaccagcacaggacauaguggugcuuuuuaaauuuauuuuuaacuguuucucauauguagcaaccccuccuccccuccugggcauguuuacacaggcucugcucugggggcuggccuggcugugagguuucuggggaggcagagaggcagggacuuuggggccuuagucaccauccaugguaucaccucaucucacuuccugugagggacagggccuggcugaugugaucccagcuccccccaguucaggacugucuuucagcuccuuugccccuggaggugggggcugcuggcugaggaggggucaaggugaguucaagaaagcuaccuguggaaaauggaccagguugggggggugauugcaaagucuccccaaagccuggcuccucaugcucagugccaggggcagaacacuggggagccagguauagagagccuuccugucauaacugccaguccucuuccuccaaggccucugcauauucucauguuccccucacccaucaugccagccaccccuaucccucuucuagcagggccaagauggggacagcagcagcccucuggccuugggaugugaugauaaagcaagccuagggccaggguuuggggagcagagagagccaagaaguugaccacgugugauuuccagcccuucccacugggacuugacuucccaggucaaggaguccgucucauucuggcuggucgagugaccagaggccugugugaaugugugcaccugcuuuuccugccuggaauguuuucuggcucagcugcagcaacaucugugagcccagugucugcccugugucccugggcucgcuccaagugcaggaacauacaugcagggcccaacaugaugauggugugaagggcaggaaacaguccucugaaggaguggggaggugggcagucugcccccgccagguaccaucgccuccugccagcuuccuuagaccaggcagggcugccauggugcuagcugcaaguccaucaguauugaccgucucgcuccaucuugguccuccggagucccaaguuuccuuuucaucaaaucugacaagagagaagaaacaugggugugcuuggcccacagggccugguggugauggaccuccccgcucccucaagcucuggauggcugcaguguuguacuagacuuuguucaggcuguucucaucucaguauugccccuuccuuucacuuucacacuucaucucauuccuguugucacuuuccccgaaacgaauaaagucuccccagcuccugcuguguaggcugggcagaaaccacaacacguaagc

SEQ ID NO: 17113 - RNA, 4506 nt, Homo sapiens
gcagcugggcccgcauccgggggaaaauagagaugcugaagaguaaaccgaaaucgcuuagucagcaacugucgccuccccaagaggugaauuuaaauagccugguaccgagggggaggggcagcaaggcagcacagggccuuucccacaggccagcucccagggcuuucaaaagcacuaggauuuucguucuauacuggagguagggagggugucgccuacgucggaguugcauggccuuagcccuagaaagacaaaauugcugacucagcgcaguuaauaucaauugaauuuauuacaaguuacuaagcuccaaggcacauuacaguguucuguuaacuacagaaauguauaaaggacaaacagagcagauucuccaugucuagcauuucgcucuacuguucaaaagcauccgugcaucaauaaagcaaaaacaaaacaacacguguagauccaacacauucaggucaguagaaacaaaccaaaacauuuuccccucacaaacuugcaacaaaauacaccccaucccccccgacacccccuuaccauuuugcaaacaaaacagaaaaacaaaacaaaacaacaaaauaaagugaagacuucaacacuuggggcaguuuagaaggaagcuuucaccauuuuauagcauuuuuuuuuuuuuuuuuuuuuuuuuuuuuuuuuuuuaggcagcaacacuggccuuggcaaaaaaaaaaaaaaaaaaaaaaaagucuuuuucuuuuguguguguuuuuccuuucagagagugcauaacauuuacaaaaauacacaccagcagcagucguugcuaagggcuauuaauucuguaccuaggcaaacauucugccaccaaauaaaugcuaacgauaugaugcaaaugacccaaccaauacuauacugcuuaacacaaaccagcuuauccuucaaaugaagaaguuacauaccuuuguuucaaaauauagaaacauacgacgaaaauaaugucuauacauaagacuaacuuuuugcaguuucguuauauucacaauucuacaccuugggggugaggggagggagggucgaguuggguugggggaggggcccucaggauuggagaggagcuggucuagggcaaaggagguggcugcccagugguucaagggucucucuccuuuuucacuuuaacauccccagcuaagauagucgcgauuucgcccugcaugaaggcccaagguacauucgacccgacuagggggcauuucucuccgcuggggcaauacaccucgccgguggcccccugggccuugauacucucucuagagcaagggaagcaaaauuuguggcuggggacggaagggcacugaacgaaaugcguauccuccaaacguucguggcaaauggugcagcagagggguccgcuguuggccaugggggaauccggaauguuuugggggugcacuugguccaugcccgggugggcgcuaggcggcgggggcgccaccuguaaauucagguccccguuacgugaugccaagcggcgcugccccggcacggaggccggcgagacugggcugcugcuguuucgccgcgccgacgcagugguagagugcacggaacugccauccuugggcgagugcgcugugcccagaguaucugccaccgacaugagagcggccauaggggacggaccguucuggggggcugacucagguggggugguccgguuggaauggggucccagaggugggggcggcggaggcggaccccccgccgcgugccccggcgccgcgaagcccccggcggacauggugagcuucagcgccucgcucugguucgccauccacugcugccucugcuguuccucgcccagcuucagcgcgcccucggcugaguccgggggcuccggagaggccuuucucuugcgcaggcuggcggcugcgccccggcccgacggcgcggcgggcggcaaggccccgguccccgggggugcgcugggggcgcggcucagacucaccagagcagugggcagcaugggacagcuggcguccagguagggcuggggcagcaugucggcgccgggcacgcccuccuugaagaagcgcacggcuucggggagcaggucuccaagcaggcgccaguccccggagccgugcuucuuuucguacuccagguacuugaaacccgaggauaggccccggccgaaguccuucaugcaguccugauacaucugcuuggccacaccagaugcacuggaguacacguugcccgagcccgugggguacucaaugaacagcuucaauucguaguccaugccgggcuuggagacggcgucgaaggcgaaaacgcggcccagcagcgagugguccuucuugaagcgaaccucguagggcgugcagccugccagcgugagcagcgugucgcggaccaucuugggcuugcuggcccacuccucggcgcgguugcgcaggcucucgcucagcucggccagggccucggcguugcgcugcuucuccuucaacucgcgcuccuggucugugcucgacaccgagccgggccucuuaccaccagcacccacgcccaccucugccaccgacgaagaggucgaagacgacgcggaggacgacguggccgauacacccgggguacccccgagacaagcggggcccccaggagccccugggggagcaggcgucgggggcccacggcugcccagggcguggggaggggguggggggaguaccgcagcgcuggccgggccguuaagcagcgucugcgguagcagguuggggggcacggugagcugggggccuccgccaccccccggguugggcagccccguaaccagcccaccgugcguuccacgccgagacgccaccgacgccgccgcugaagaagaauuggggcucugacgguucagcucugggggucccuccucugguguugguuuggggaagccguuugggccccccaggccguugggcagucgcgcgguguggcugcugcuucccaggcucaccggcgguggcggguacucgaagcggcugcgcuguuccaccgcagcggcggcggcggcggcggcggcggcggcagcgcuuaggccguagcgcuccaggccagacggggccgccagcaccgcaggcuugcuggaaccaucaacgugguugagcuguuguugcugcugcugcugcugcugcugcugcugcuguugcugcugcugcugcugcuguugcuguugcuguugcgcggcggcggcggcggccgccgcugcugccgccgccgccgccgcuuccuuagccgacagggccacugucuugaccccgacgggcggcggcggcccgggggagcggccguccuggaagcagccgugcgcccgcuucagcuggcgcgcugucucgaucacgaauucgaugcgaucagcgcccucguaguugacgcaaccgcggcauacggguuccgagaagucccagaucauggcccagggcaugcggggcaggucgcacagguagcaagauugucuccgggacgaggacaccugcgccgccgacaugaugccugcccuggggaagguaggcccccgcccgggcugucuccgcggcgccuucuccuccgggaggacuggccggcuggggagggaguccgacugcgggggagggaggagggggggcgagaaaguucugccccaggggcuggagggaacgcgagucuccaccgccggcgcagcgccucgccgugggggcuccaccgcccgggcagcggacggguucagcccucucuucgcccccaccuccuacugcgguugacucgucgcgaggggagcucaggcgccuucuuccuggugcugcagacuugggcuggaagcucccggcccgaggggagggggcgagggugcccggugguggccgccguugccucuuggcccccuccccggaguggcuggugcguggaagcucgaaaggggcugucucuuccucuccccggggaccccccuacgagcugcguccucuccccgacgggcccccuggggcgagggccagaggguucagugccacccggugcccggguccaaucuugcugaagccgcugcuuccccggaggaccgggggaggggguggcagccgagaaaggaccuucuccccuccgcagcgucggccguucugcuggcggcgacuggguuugcaccccggagggagccgccgcggccacugcuuccaggacgcacgagagcagaggagaggagugcacgcacgcaggcucccgccgcccccaggccuggccggcgcccgggccgccgcggcuggcggcgcucacguuggcugcagggcgcucgcgcggcgccucggcccgggucgcaucccuucccgcucgugcucacgcucgcccggaaugugggguugugauuguuacucuacguuccggaggcgcgucucggcgcuccugcuccggcugcggcucgcgcuguccccggcuuggccgcgcgggaugccgcccgggcggagcgcugacgucaccgccaugcucugcaccagu

SEQ ID NO: 17114 - RNA, 4506 nt, Homo sapiens
acuggugcagagcauggcggugacgucagcgcuccgcccgggcggcaucccgcgcggccaagccggggacagcgcgagccgcagccggagcaggagcgccgagacgcgccuccggaacguagaguaacaaucacaaccccacauuccgggcgagcgugagcacgagcgggaagggaugcgacccgggccgaggcgccgcgcgagcgcccugcagccaacgugagcgccgccagccgcggcggcccgggcgccggccaggccugggggcggcgggagccugcgugcgugcacuccucuccucugcucucgugcguccuggaagcaguggccgcggcggcucccuccggggugcaaacccagucgccgccagcagaacggccgacgcugcggaggggagaagguccuuucucggcugccacccccucccccgguccuccggggaagcagcggcuucagcaagauuggacccgggcaccggguggcacugaacccucuggcccucgccccagggggcccgucggggagaggacgcagcucguagggggguccccggggagaggaagagacagccccuuucgagcuuccacgcaccagccacuccggggagggggccaagaggcaacggcggccaccaccgggcacccucgcccccuccccucgggccgggagcuuccagcccaagucugcagcaccaggaagaaggcgccugagcuccccucgcgacgagucaaccgcaguaggaggugggggcgaagagagggcugaacccguccgcugcccgggcgguggagcccccacggcgaggcgcugcgccggcgguggagacucgcguucccuccagccccuggggcagaacuuucucgcccccccuccucccucccccgcagucggacucccuccccagccggccaguccucccggaggagaaggcgccgcggagacagcccgggcgggggccuaccuuccccagggcaggcaucaugucggcggcgcagguguccucgucccggagacaaucuugcuaccugugcgaccugccccgcaugcccugggccaugaucugggacuucucggaacccguaugccgcgguugcgucaacuacgagggcgcugaucgcaucgaauucgugaucgagacagcgcgccagcugaagcgggcgcacggcugcuuccaggacggccgcucccccgggccgccgccgcccgucggggucaagacaguggcccugucggcuaaggaagcggcggcggcggcggcagcagcggcggccgccgccgccgccgcgcaacagcaacagcaacagcagcagcagcagcagcaacagcagcagcagcagcagcagcagcagcagcaacaacagcucaaccacguugaugguuccagcaagccugcggugcuggcggccccgucuggccuggagcgcuacggccuaagcgcugccgccgccgccgccgccgccgccgccgcugcgguggaacagcgcagccgcuucgaguacccgccaccgccggugagccugggaagcagcagccacaccgcgcgacugcccaacggccuggggggcccaaacggcuuccccaaaccaacaccagaggagggacccccagagcugaaccgucagagccccaauucuucuucagcggcggcgucgguggcgucucggcguggaacgcacggugggcugguuacggggcugcccaacccgggggguggcggaggcccccagcucaccgugccccccaaccugcuaccgcagacgcugcuuaacggcccggccagcgcugcgguacuccccccacccccuccccacgcccugggcagccgugggcccccgacgccugcucccccaggggcuccugggggccccgcuugucucggggguaccccggguguaucggccacgucguccuccgcgucgucuucgaccucuucgucgguggcagaggugggcgugggugcuggugguaagaggcccggcucggugucgagcacagaccaggagcgcgaguugaaggagaagcagcgcaacgccgaggcccuggccgagcugagcgagagccugcgcaaccgcgccgaggagugggccagcaagcccaagaugguccgcgacacgcugcucacgcuggcaggcugcacgcccuacgagguucgcuucaagaaggaccacucgcugcugggccgcguuuucgccuucgacgccgucuccaagcccggcauggacuacgaauugaagcuguucauugaguaccccacgggcucgggcaacguguacuccagugcaucugguguggccaagcagauguaucaggacugcaugaaggacuucggccggggccuauccucggguuucaaguaccuggaguacgaaaagaagcacggcuccggggacuggcgccugcuuggagaccugcuccccgaagccgugcgcuucuucaaggagggcgugcccggcgccgacaugcugccccagcccuaccuggacgccagcugucccaugcugcccacugcucuggugagucugagccgcgcccccagcgcacccccggggaccggggccuugccgcccgccgcgccgucgggccggggcgcagccgccagccugcgcaagagaaaggccucuccggagcccccggacucagccgagggcgcgcugaagcugggcgaggaacagcagaggcagcaguggauggcgaaccagagcgaggcgcugaagcucaccauguccgccgggggcuucgcggcgccggggcacgcggcgggggguccgccuccgccgcccccaccucugggaccccauuccaaccggaccaccccaccugagucagccccccagaacgguccguccccuauggccgcucucaugucgguggcagauacucugggcacagcgcacucgcccaaggauggcaguuccgugcacucuaccacugcgucggcgcggcgaaacagcagcagcccagucucgccggccuccgugccggggcagcgccgcuuggcaucacguaacggggaccugaauuuacagguggcgcccccgccgccuagcgcccacccgggcauggaccaagugcacccccaaaacauuccggauucccccauggccaacagcggaccccucugcugcaccauuugccacgaacguuuggaggauacgcauuucguucagugcccuuccguccccagccacaaauuuugcuucccuugcucuagagagaguaucaaggcccagggggccaccggcgagguguauugccccagcggagagaaaugcccccuagucgggucgaauguaccuugggccuucaugcagggcgaaaucgcgacuaucuuagcuggggauguuaaagugaaaaaggagagagacccuugaaccacugggcagccaccuccuuugcccuagaccagcuccucuccaauccugagggccccucccccaacccaacucgacccucccuccccucacccccaagguguagaauugugaauauaacgaaacugcaaaaaguuagucuuauguauagacauuauuuucgucguauguuucuauauuuugaaacaaagguauguaacuucuucauuugaaggauaagcugguuuguguuaagcaguauaguauugguugggucauuugcaucauaucguuagcauuuauuugguggcagaauguuugccuagguacagaauuaauagcccuuagcaacgacugcugcugguguguauuuuuguaaauguuaugcacucucugaaaggaaaaacacacacaaaagaaaaagacuuuuuuuuuuuuuuuuuuuuuuuugccaaggccaguguugcugccuaaaaaaaaaaaaaaaaaaaaaaaaaaaaaaaaaaaaugcuauaaaauggugaaagcuuccuucuaaacugccccaaguguugaagucuucacuuuauuuuguuguuuuguuuuguuuuucuguuuuguuugcaaaaugguaagggggugucgggggggaugggguguauuuuguugcaaguuugugaggggaaaauguuuugguuuguuucuacugaccugaauguguuggaucuacacguguuguuuuguuuuugcuuuauugaugcacggaugcuuuugaacaguagagcgaaaugcuagacauggagaaucugcucuguuuguccuuuauacauuucuguaguuaacagaacacuguaaugugccuuggagcuuaguaacuuguaauaaauucaauugauauuaacugcgcugagucagcaauuuugucuuucuagggcuaaggccaugcaacuccgacguaggcgacacccucccuaccuccaguauagaacgaaaauccuagugcuuuugaaagcccugggagcuggccugugggaaaggcccugugcugccuugcugccccucccccucgguaccaggcuauuuaaauucaccucuuggggaggcgacaguugcugacuaagcgauuucgguuuacucuucagcaucucuauuuucccccggaugcgggcccagcugc

SEQ ID NO: 17115 - RNA, 1187 nt, Homo sapiens
uaaucucuggcagaggccagaaacaggaguagguuucuuggcugcccguucugauaaacaaucuguucuuggggagaguaggugaaggggacuggcgggggaagugggggcgguaaucugcgggcaugaugugggguggggguaggagaaggaggaagaggagggggcagccuccaggccggccccagcuaacccuaguagaggccgcccccccacccgccggaaaaugcaagugccccuccuuggggcgcguggucugggggugagucagguuuccugcccuuaaaaaugugagcagacaguauaugcuuucuugcuugucacuucacaacguccagggaacgucggagggacaucaagggcccagggagagggaaggaagaggaggggaggagagaggagcccgcgcaucccuaggcuuugaacccauuucaaacgcucugggcguugcaaaccaggugcgcuugugcacagacugcuugucccaaaaggaaaccgaggcaaccacgggggaggcuggguagggaugguggugguaagaaguauuuuaaagcggaacaaggaaagccagaagauguuuaaaacaaaaggagagacuauuguucagcgucggaggucgcugggauggaagcuguaggcaagaaagcuggcugcggauuuugcaguggguuuauugugugggcaaccaggcagaaagcgggaauaugaaaaaguggggagggggagaguuggcgugaaggaaaaucagugccuagaaagcugugcacgcugaaaaugucaccaaggagagggcaguggcaccgaauaaaagaugaauaaucggcuaccuuuuggaaaaagcaauguaaaaauauuaauaaaggcgagaagcccgcuucuucucagccugaaaagcaaauccauuucucaccuccugccucuccuccccaucccaacacacacaaaacacacacauacacacagcucuucucugcccugcauccaagaagccucggcuaggcucgcuuuccuuuggauuuaauuacucgaaaaugcugaacaaaaaccuguaauuacacccuuagucccugccacucaggcccaguacacuuccugccuaguuuuguuuuuuaaagaagaggucauugccucuuuucuuuccaaauuggccaaaacaaaaaaaaaaaguaaaagcccuaaauaaaucc

SEQ ID NO: 17116 - RNA, 27684 nt, Homo sapiens
cccaucacucaccagaugugcggcggcucguccaagcgguggaagcggguggcgaaggacagcagcgucaccaaggccagcagggcccaccagccgaccgccucgaagcgccgugagccccaagcaggccguuuggggcuucgcgccacagccucagcggccacgucccggccugcggcccuagcagccugggggccacagcggccccuccggggacgcagcucggacucugccaggccuccgcccguggccggcggcaucuucccccuccucugggucgcccuccggcccggaggcacacuuugucugaccagccgccccgccaaggagucacaagagggcagcucgggguaccccgggaaaugcaacgcccuucacugcagcggagcgcggggccccgggcucggggcggggcgggcagcguggucgcggcccgggccgcuaggaggcggcaggaggcgcagagcaugucgggaccgggagggccggccggcccggggcgggggggacugggcaggaggggucgggcucagggaacugcaacucccagcagcccccagguacggggcguggcgggagagcugggcgagccagaggcgaccggaaggaucuuucuaguccagccccucgcuuuacccggacgaaagacacgggccugauucgucgagucucacugagccuuagucgucggcaggucccaggcgcgaaguuucucggccuggaggagggggucgcgcgaagugccagaugcaggcggggaaggucugugacgcgcacccggguggagggaagcugguuagacaccuggagacccuggggggcggggucagaagugagcugcaccgcccgcccaggccgacaacgacucccggcaugcagugcuuugcgccgggcacgcucugcgccugcgugcugcgcgcugcccgcuggggcucgaaguuccgggaggguugggccagaggaggcgguccugguagggagugcguagcaggguggagucgcuguccggucgcgcuucacuucugcuccgcccucccugcuccccauaacagaccccucccuccacuaaggcuuccaaacgucgccccaagccucccaauuucucgcagcccuucaugcucuucucuuggcccuagcaggaggugaccuuccaguaauguuuguauuuuaagaguccccgggccgggcgcgguggcucacgccuguaaucccagcacuuugggaggccgaggcgggcggaucacaaggucaggagauagagaccauccuggcuaacacgaugaaacccugucucuauuaaaauacaaaaaaauuagccaggcgugguagcgggcgccuguagucccagcuacucgggaggcugaggcaggagaauagcgugaacccaggaggcggagcuugcagugagccgagaucgcgccacugcacuccagccugggcgaaagagcgggacuccggcucaaaaaaaaaaaaaaaaggccccgagcgaggagaggcagucaugacaaucaccuggggagcuucacggcuuucacauguucuucccggggccugcuccagagccacucuguucaucucugguggaacgggcucgagaaucugcauguuuuuauaagcggucuagaugguucuuaacgugccaugaaguuugagaaccacuuuuguggcacuaaggaagguggcacguuagaugggacuuugcgucacguuaauaauguauaguccucccucuuccaaaugggauuuuaggagucuuuuucucaaaucauguguaagacaugguuuaaaaauaaaaucugcuaaaguaaucagaaugcauauuugaauuggaaacacaggucuucuaggagugcugaugagauggauacuugggcuuaaaguuuaguucuacaagugcagaaaggaacggggcaugguuuacauaguuaucacugguaagagaaggcagaaauugccuaagagauuucagguuuccugcuugugggucgugacggagggcagcagcauuuaccaugcuucuggucacucguaguacagauccaaagguguaauccaaaggcauuuagccauuagguaaggcauuucuucagggauucuaagcuaauuaaugucugccacacucuaguggucaccagcagucccugucccuuggcaccaggagucccuguagccuggcuagguaaggaaagggaguugcaucuccaaauaaggaagauccaguuguggccacccaauuccuccucuucgaaagacacuuucugcccaucaccugcuuucugugccaggaccaucuuuacuuucuccacaaaagguaccuucaggacaggcugggacugcugggcuugggaaccaucuuggaagggccuagguucccacuuacacccuugccaucuagcagacugaguugguaguacagggauggcaauagcaaguucagagagcagcuuaauaugcuagggguggcagaggggagagggagcuuuggugaaaugucuauagucagagggguaguaaacagggcaucugagaaguucuuucaaguucuccccuauccauagggauacacauguuuuggugggaagauucaugagugcuaaucacuggcgagucuuuccuggguuccacuuugaaaugcuggcucccgaagaaguaccagagaaauuaacuuugagccccuuaaaccuuggaguagagaucgcacacccagcugcccccaagggcccaaagguaacaaaaaugagaaaagugggccagauaugggccauggcagaccugagagcgcauacgcugguugaugggggccauuagucuguucccaucaauugcugcuauuuaggaacccaaaucugucuccagauuuuuuuaaagaaaaaaaacaaacagguguuguauauaaaauaucaugauuuuuauuuuuauuuuauuuuauuauuuauuuauuuugagauggagucuugcucugucccccaggcuggagggcagugacacgaucuuggcucacuguauccuccgccuccuggguucaagcaauucucauaccucagccucccaaguaggugugauuacagaugcacaccaccacaccuggcuaauuuuuguuuagccauguuguuucgccauguuggccaggcuggucucgaacuccugaccucaggugaucugcuggccucagccucccaaagugcugggauuacaggcaugacccaccauacuagaaugaaauguccugauuuuuaaacauuggcaacuacuugaaacauuuuaaacuacuguguugagcaaacagaaauucugagggccagauagggccccagugagcugccagcuuuugaccucaccuuuggggugagugagcauaucugccagcuguuuuuauggggacagccgagagcccggaggacugcugggaggugggguugaaggagauauguaccaaagcgucaaaaaauuagaauuccuugucuugcugcauugcuagaggaugcccugccaucauuuuagggcaaccuuuguuuuacaaaugagggagccgaagauuuaaaaaggcagagguuuguccaaggucaugcagagcugguuccugcaccagguccagacuccagaugccagcucccagcccgcuccaccacucaaaauacugcaucaaaaccaggccacgcucuguuggggggacaccaaaccuggccccagcaggagcguaagaaacuuccugcgaguuggaaaaaaaugccuuuuuuuuuuuuuuuuuuuugagacgcagucucgcucuggagugcaguggugcgaucucggcccacugugaccuccaccucucagguucaagcuauucucuuaccucaaccuccugaguagcugagauuacaggcacccacuaccacaccuggcugauuuuuuuuuguauuuucaguagagacaggguuucaccauguuggccaggcuggucucaaacuccucaccucaaaugauccacccaccuuggcucccgaagugcugggauuacaggcgugagccacugugccuggccagaaaugcccuuucugaccagagucaaaguucccccaaugccuggguagcccagcuuccccauuggcuccugaaauccaccccuuuagguuuccuuucccugcucagaagcugugccagaggggacauuuccugggaggcugagggucaccacgauaccaugacagagucuggcaagguauggaaggcacucucaggcuagcugccccuuugggggccucuuggaccucaggagcucaaaccagcauaauuuuggagccaagggaccucaugagccucucagagagcuuggagucugcccugauuugcacagaugcaggccugagagaggaggccuggcaggacaggaagaaaugguugacuccucccaagcuggagcccacccagcauggguuaacacgcgccuucauccucucucuccucagcccauccucuauuccuauuuccgaagcuccugcucauggagaguucgaauugguaagagaugugccuccuccaggaugagugcuggagugggguggacuggggcggauaagcccgggugcaaagcuggccugggauggaaggguugcucugucagagaggaccucacccccagcaaccagcaucccccggcuccuagaacccccaucccugcauggcaucuccaccccggaaacacagggugagggugggaggaaggggguuguuuuuucccuugggacugacacuucucccaacacugcucuccaaagccccuuggcaaccauguuuaaagcagggucacaaaauccacaugccccugguaacuggcaggggaacagcuggcccuucucaguucuuauuuuauuugaacuggcaaagcaaacagaacgggccagcaucagccucggaggcuucagaaaagcagaaacaagggcccuguggcuaguccuuguuugacccuucccucccuuggcuuaacacagccuuuggcaaaggucauaaccaaagcagccuguacugaggaaaagcucugugcugagugcuuuugugugccugauuccauuuaaaccucagcaacccuaggagggagguacuauuauuacuguccccauuguauagaggaggaagcugaggcacaaaaaacaggcaacauucaguaacuugcccaagaucuuucaguuacuaagaggcagaacuggaauuugaaccagguagucuggcuccagaggcccauuaaguuacuugcccagggccacacaguuagcaaaugacugugaugaaauuugaacccaagaagcuugccuccagaguguggaggcaaagccauccuccgugaccccuccuccaucccauagucacuugguauuugcugggaucaguaagcaagagcacugggugccaggagaaacuuuccuccaagaagaugaacccaucccugggcgccaguaccucugcccuggcugagccagaagccggagcaauauaggugcugucuguacggccugugugcuuuggccuucccuccuccaggugucuccuccagccccaaacacugucacuccccagacuggagcugaccaacacuaggaggagccugguauugcccaggcucuccacaccaugacaugucugguccuccuccccucauuccuuugcccuucccugagauuggccaucaccauacuugaaugcccaaguguguguaauacacacaugcaugcacacgcacgcagucuucuccacuaguguugacccacccaaguuuuuuuuacccucagcuugccaggggaaauuaucaaaagggauggagaggaaaucuggugacuggagucacggcaaaugcucugaggccaccaaagagccugaugccugucuagaaucucuaguaaacagcccugagaacagagagaauagauuggaagagauucuucuccaacagaacaagagugccaucugucugugugugcuguguguggccaccugagcuccuucccuuggcccuuaguugccuucuugagggaguaauugcaugucuucaaccaagacacuggucaccacuguuuaaggcccugggggggcagaguuaaacacaacacagccuugcugaacuccaggagcccacagagugccagggcauacaccuuuaucaccauccagggggcaugagggccccauuggggggguccagaucuugaggucucuaagaguucaggggugagugaggcagagcaucgugcaucugggguagggagcacguggugacaaggaaagcugagagaaggggauagugccacggugagccuugaccacccagaaguguuagagaagccucccccucuuuggccuuaaugucaccuuagaagggcucuuuccuuuaagaguacggcgagaggcuguucuuugacuccgcuaugugcggucucuccuagcucuggccuugaaaggcaucgacuacgagacggugcccaucaaucucauaaaggaugggggccaacagguaagaaggcugugcccagaccacaaugugggaauuggaggccuugaacaggcaccaggcaggggaaaaaggggaggcucugccccagagaagugaaccugugucuuguggacuaucacugcaggaggcugcuggcucucccuugugggacaagguggcaaggugugcaguagcaggaggccugggaagggcccagguccagacuguguacccuagccugggcucuccagugccugacccugggaggguggguggcuaguggguccccaccccauacugggcccucuggauggcugacuaggguaggagcugccuugguggccacggugugagaugcagggaaagcccauagccaggcuguuaggaugaagccuauggcucagcagcagcugggcuuugggagacugcauggaucccccagggauuacccugggccuaggauuuagggccuucccagggaagggagauggggguggguggcaggccugggguucuccugcuugcuuggcuuuccucuggccaacucaggccaggccacccagcccaccagggccuugucuccacaguuuucuaaggacuuccaggcacugaauccuaugaagcaggugccaacccugaagauugauggaaucaccauucaccagucagugagugcagggccugggggagggcccucaugagagcagugcccugaaugagagcgccugacaucucuuccucgccuguguacagucaaggugccuagcacauaggagaggcucaauacaagacucguggggagggugcgagguuauuuaggaaaauaagggaagauucaagcacauggagaaccaaguucugcaugauaagguccaaaaaggcuuauagggcuugagcugagcagaagcaggggggaagagguguagugauggugcuggaagaggagaaggaggaguuugcuggcccuguccccucugguccagggguccugggcccucucccugccucacugcuccccucuggacagcuggccaucauugaguaucuagaggagaugcgucccacuccgcgacuucugccucaggacccaaagaagagggccagcgugcguaugauuucugaccucaucgcugguggcauccagccccugcagguguggcacuuguacacuugcacccuugcacaccugacacacucuuacacucacacauuggcugugagcugcccagugugggggcgggggugucaagggagggagggggauucucagggccucugaccuggaccaugugaaagaagggggugaagaucgcaaucucagaauucagccccccagcgggucccccgcugcguuccgagaagcucuaguuuccaaggacgcauguacaggugcuugggguggggaaagggccagaauggcaggggagagacugagcaggccccaguccaggccuccugccuuuaaccagagcagcuuccguuucaucugugcuaucucagucauauacugggauacuuguaggauuuuauuuuuuaagugucacuguuaaaacagacaacuaaguauuaaaaacaguucaucugugccagcuucuacucugaaugaggaaauagccccagaaagguggagugacuuaggagucccacagguaggucauaacaaaguggggacuaagucagaaucccugcaugccuaugcccucuacccgcaugucgcuuuaacaaaggauguuggagcagacagacaucuccauuuuauaaugaggaaacagagggaaaauggcuccaggggugccaagauggagccaggcuggaaaucucuggaagccggucuuguggaccucccucaucccagccccacccucuuucacacucccucuccucacaagggaccaugcaagggagaagugagggagacaggccucgaguugugggcacaccugccacagccauggccgcguccugugucacaugaauagggauucuugcacaucucugacagaaucacguggcuuuuugaggccacuggggcagccugcaaagguggcugcugggauggcuaccucccuccaaccucagggcccuugguugaaggaaggggcucauggagccugggggagaagggauagacauccagccaggggcagaugggaagugaacuucccugaggggguuuggcgaagggguagcccccacccagcugucagcgcaaucacagauuuucuuugggcugcacagaaccugucuguccugaagcaagugggagaggagaugcagcugaccugggcccagaacgccaucacuuguggcuuuaacggugaguccucaccucugugagcugccccacaguggccucuuagagguauggcccucgcacacaggggccuggguaucugaaccagccucccaggcugcuuugggccugacaguugcauggaugagggcaggacuggggaggcaaugggcugggugggcauccagaccuuagcuccagcacuucugggaaccucggucccugagcccacagcccuucauagcuggauggcccaacuucagcuucacugccuacuccagcugggaaaccaaggccagcacagcgccagccaucagagugagagcugucaccguggccaguggcagggcuuguccacucgaguggggaaauggugauugucugugcggagccucaggaaacagcagcucaucccuaacagcucucucgagaccuggcugccacauucucaccagcagccaugcccagucugucacucaguugggcgcccauuucauaacuauggaggccaaggcccagaaagcuuuguguccccucccugcgcccagaauaagauguuuauguggccuccccacagcccuggagcagauccuacagagcacagcgggcauauacuguguaggagacgagguaagcuguccccagaccuccccaggcccagccacaguggcugccucccucaugcugaccucccucaagcucagagcuuccugagaaggcgucugcagggggaucucugugccauggggcacuccucagcucacucccacuaaaccgucuuaagagggaguuacucaagguagaagacuggcugugagaggaugaggcgggccagcaucaguugagggauugugcuagaugaugucugcgcagucaaggcaauccaucuucucuggcccucucaacccacagaguugguugucagggcaacuggagcauggccugggagggcacuucagcuccgggggacagacucaugcaggccuagggcagacaagaauuggaggugggaugggugaaagagccgaagcagauuguugguacccccaguagagucgcaguggacacacccaguccagccacugacucugggguaugcacccugaugggaacccaccgggaccucuuucaggugaccauggcugaucugugcuuggugccucagguggcaaaugcugaaagguaagagagagccccgccacccucccuucucguggcucugcccacagucaggccccacucagcuggcgagauagcaucucaugcagacgcuucgccaaccagccaaggagcccaccaugccaggccacauagccacuucugccuggaagagggcagaagaaauuggggcagugcuccuacuacgcccaccacagcccagaugaaccuguauagauagccccagcuccuaagaggagguggcucaccugguggacccccaagagcaccugccugauguccucaaauguggugugucugugagcaguagugagcucuaccucugcauccuuccgugaacccuuugguagggcacaaaugagcaccucucuggaaggcaucaugcuaggcguuagggauauggaaacguauggcacauucccugcccccaagaagcuuacaacaugggggaagagagucuguauauauaaaugccuagcacugggccuuacacauagcagguucacaaagaaauaggaacaguagguaacagaugccaaaugauacugcacaagaccuacccauccccugugaauaagggcugccccaucguccuucccuggacagcucccucgaccucauccagcccugccucucugcucccccugcugcaucagggcagucucccugugucccugaaaaccuuagcuuagcagguguuucucuacuacagauucaagguggaucucacccccuacccuaccaucagcuccaucaacaagaggcugcuggucuuggaggccuuccaggugucucaccccugccggcagccagauacacccacugagcugagggccuagcucccaaauccugccccguuggcacagggccacaggagcagaagcugggugggcugaagaggccuggaaacgagagucuuaauugaggagaugggagacucgaacucuagcccuggaucugccuuccugcugaaacuuguuccaccucaguccccucaucugucacacgcaugugggguggaguagggagaugcggggagcagggugggcaggaauacuguuaucuaugugacggggcagucgugaggcugagaugagaaugcggauuaaaaugccuggcgugcucaccguaacaccacggggaaggcugugugccuuuucucauccgcuuuuguugugugugacuccaaagaaugcccgcgcugaaauuuggcgugaauuaaacugaagcccaggccucuaccuuguuugucuaagacugagcuagguuccagaagaugaacacugucccuagcuggaauccccugugccuggaccaguagaggaagucagucagccacuugccuacccuguggcaggccuggcccaugggaccuaagggcaaugaugagaaauauacccaaaagccugccugaaagaaucagacaagauccagggagauaacagauagaagcaggaaagcaucuagugacuggcugaguucucagggcuaggaaugguaccguuguuaaauguuccacuccaggcugggcgcaguggcucaugccuauaaucccugcacuuugggaggccgaggcagguggaucacuugaggucaggaguucaagaccagccuggccaacauggugaaaccccgacucuacuaaaaauacaaaaauuagccggguguaguggcaggugccuguagucccagcugaggugggagaauggcuugaaccugggagguggagguugcagugagccgagauugcaccagugcacuccagcuugggagauagagugagacuccaucuaaaaaaaaaaaacauauuccacuccagcacugagaggccauuuggcccucucaaccagucccucgucuucagggccagcauucuccagaccagucccaggauuaggcacucgggguaaauccagucacagauggugcugggaaugggaggcaggcucccccgugggcagugugagcagcuacugaccaggccagcuuaggagaccaagcagguagcaguguaccacaggcugcccuggagggagcaaguucccaugcuuggcaguguucaggcagaaccaggaccaccucugggcagagaugccguacagagauugggguagcuucuggggaugaaaugagaugacuuuuuaggagcuuuaccucuugaaggccccaccucugaauacuguuguauuggagauuaaguuucaacaugaauuuuagaggggacauaaacauuuaaaucguagcaaagaccaucaccuuuuuacaggacauuuuccaguaggggcuucucucaaacggaugagugguaagucaaguccuuccuuuccauaucacacucagcagacaccugauccugauaugcuagaggcacagggagacuagauauguacguggucuucccagagugggaguggccacagugaaggaagaacaaugauggaggggccugauacugguaauuccaacucuauggaaguaacaaguccccagaaauacuucaggaggaggaaagcaguagggaggugcuaucaggaaauaccugagaacaaagcaaaaauuauaggcuguguuccucagaaauuuuacauauccauuaaggaaaguggcaaacuuacuggauaaacaggugauacacauacucauacuauuuuuuuuuauuuuuauuuauuuauuuuuuuuuugugauggagucuugcucugucaugcccaggcuggagugcagugguaagagcucagguucauugcaacuuuccaccuccuggguucaagugauucuccugccucagccucccgaguacugggauuacaggcgcguugguuaagcuggucucgaacuccugaccucaggugaucugcccacuucggccucccaaagugcugggauuacaggcgugagccaccacgccuggccaagauacggcuccuccuaacuuuuaguguuuuguuuuuguuuuuuuuuuuuuuuuuggagacagagucucacucucucgccaggcuggagugcaguggagcgaucucgguucacugcaaccuccgccucccagguucaagggauucuccugccucagccucccaaguagcugggacugcaggcccacgccaccacacccagcuaauuuuuguauuuuuaguagagacaggguuucaccauguuggccagaauggucuugaucucuugaccuugugauccaccugccucggucucccaaagugcugggauuacaggugugagccaccacgcccggccuagauauuuuauuuaaaaaaaauuuuuuuagagauggagucucacuguguugcccaggcugaucuugauccucccgccucagccucccaaguagcugggccagcucuuacuucuaaacauaacuuauuuagcucuugcuuccaaggucacagcaauucuacuuucagagaauacuuugaacuaaggauagcugcugaguuuaagccagaagugcacagguuaaagaacaucaaggcugaaugucaagagcuguaaugugugagcugccuuuuguaauccugagcuaugucaaggucaaugauaugacacauaugaaugcuuuuaaaaguuaaaaaauaaucuuaaggccaggugcgguggcucacaccuguaauccuagcacuuugggaggcugaggcggguggauugccugagcucaggaguucaagaccagccuggguaacauggugaaacccugucucuacuaaaauacaaaaaauuagcugggcgugguggcaugugccuguaauuccagcuacucaggaggcugagacaggagaauugcuugaaccagggaggcggagguugcaguaagccgagaucaugccacugcacuccagccuggcgacaaagugagacuccaucucaaaaaauaauaauaaucuuaaauauauuauguguucacagugacauauuacauccagcauacccaaacaugaaucauuaaugaucuccagcuacauggaaucugccugggcuuuuuguuacuuguaggguaguuuggugauuacauucaacugaauuguuucagaucccuucucuuucaugcuucaaccucuaaaauauguugcaacagaaagcagagaaugaucuaacagguucauuuuagcaucacagauaucacugaaggaaauauuuaaaugccacccuucccugcucagaugugaguccuuauucugcaacagacacuagggauguggagaggcaguguuuuaaaagacagcaaagauauauuauggugucacuuuuuguaaaugaaaauaggcugaauucauaucacccagauuacguuaaugauuggccugguauccgaagucgagguuccaaauuugaacagaauaucuucauggggaaacaggccucacugggaccaaaugcugacauaaaacucagaacuuauuaaucaucacuauaaacccaguuuuuccauucccaguucccaggucaugauacucugccaugaauuuaaaugcagaugaaagaucuauuauuaaucuuauucucaauuuuuuuucuuuuuaguucuucuuaacuuucacaaucuuaauagauuaugaaauaauucauaugggcuuauagaauaccuuucuuaaggaagauacaugaaagacaaagaauuuaaaauguaaaucagguucauuaaaauauaacucagauguuaccaggugcauagugaaaaaguuuauuuaugacagauucgaaaacucagaagagaugacaaagaaugcacaaaagcaucacaaaacuguuaccuaauauaaaacgcaagaacugagcuacuugaagaagcacagcucagaaucaucaguguaaucgcaguaacacacccagugccacagggugauaaaaaugguauuuuaaaagaaaaaccacucagcaggacacaagaauuaaaguaacaauuugguaagacucuuagaaaucacagauguugauagcauuucucaugauaggggacauguaaaacaagcugaccauaauaaaugauuaguugggauacuuuuguauuuuaaagaaaaaagauaaaacagugacacgguuucccuuccagacccuuuuuguaaugucagcaacaguacaugauauagaacaguaagaaaauaaugucuuuguaguugccaauugcuuaaaucuuuacgaagaaaacaugaucaucuuucagucaacugacugaucugaguacauggcaccaaagaaagcccuucagaaaauagaagcuaaaugacauaaaguaguuuggaaaaucuucaagcaccucccuuuauuccaauuauccuuuuccaaagucuggcuuucuuauaauccaucacuuugauuacaaaacagcucucuucugggaauuucaaaacacuucccguuacguuaagggaaaauggguacaccagauucauggguuacaggauugcuuucucuagacuuggcuucucuuuaacauggcuaaauggaaauaauuuagcuugguuaaaugaaagcuacuucacuuacaggauaaucucaggagacaugaguggaguuuuucauauggaauuucuuaguaaaauguacuguuuaggauaugagagacggaauuaagauaauguuuuccagaugauucuuggccugauccuaagaaucaacaauaacaaucaauagcaaggaacauuacacauucaacccugagugaugaagagaguucaggaagagagccccuuaaacucugaauuaagggcucuuugguaauaucauauacuauaauauuucaaaccaaaacuucagaaggguucaugauccuauuucaggacuuuagaaaauauacuuuguccucuggaagcaauuucacauauauuauuuugcccccagauaagccacaacuaccugcuuaaauuuuuuuuuaaacuauggaauuaaauaaacaugcaucucuagauuucuagggcaacuuuucaucauaucuuugaagagucaugacauuaacucugguccacauaccuggggccuaaaaaaaucagguacauauaauaggaaucacaucaugagccuaauuucaaagccagugucuugccuuuggacugugugugugaggcaugccuauuuguaaaugagcuccacuaucauugguuuuaggcaauaguguuuucuuagcuuagaaauuucuuaccuuaagaauucaaacaggaggggcuuuguuuagccuucuugguuuaggcagggacaaugcaacacuugagaggcagcagugauuucugagcaaaauucuaagauauauucgauagguuugcucuccccuccccccauacuccuacccuuugcccccuaauuuuauuuuguuuucccucguugugaucaauuuuaaaagacaguucucaagcagcacaaaacgguguaacuuaugccccucccuuaugcuccacuaaaacaagucucuuauguaaauauuagggucacucaauuccacaccuuagaaccacugggguuaaaaggcaaccuucugcagauaaguggucuuaacaaacaaauauaaaagcagacuuuagagucuggguuucaacuaauucucucaaagagggacugagcaggacucauaaacauaaacucauauucccuacagauuaagacuuuuuaugauaauaccuaauucuacugcuuaauauaagacagcguucagauuucacucuuccauauacauauuauaaugggacaauauacacuuuuuuaaaagucugaguuuuucuucccaaaauaacaaaaauauuuuuuaaagugcauguaucaauucauuaagaaaaaaauaacuaagaauggucuaauuccaaauugcuaccuacuuccaugauaaagcuaccuguuaucuaaggauugaguuuuaauaucagaguccugaggacaugucaucaagcaacagagguuagcauaaagcccuuccggagcagcuucacaaucacucuuguacugacaugccaguuaguaaggaaaacagcagagaucauggccugagggaaggggaaaauacagcacagauguauuuucuugaaagauggagaccaagaaacaauuuuuuuuuuuuugagacggaaucuugcucuguugcccagucuggagugcaguggcaugaucucggcucgcugcaaccucugccuccugggcucaagaaauucucccugcuucugccuccagaguagcugggauuacagaugcccgccaccacgcccagcuaauuuuuuguauuuuuaguagcgacggaguuucacuauguuggccaggcuggucucgaacuccuggccuaagguggucugcccaccuuggccucccaaagugcugggauuacaggcgugggccacggcgccuggccuccaagaaacauuuuuaugaagaccaccuccuggguaacccauguugaaugaaacaggucugcuaaaaaucaggggcucuccaacagagccgauaugcaggggacauucucagcauucucuaauuggacacuugucaaaaggaacagaauguuagaaucaucuuugccuaggaauugguaguuuaaaauuuuuacauuuaugcggggaguguguguauacauauauauacagcaaaccaaaaauaaauucuaaaucccccaaccggcugaauggaccccugucuuggcccaggggaucucaaaggaaccugaaaaacuaguccaugaugggaagacagggugccucauauuauggucagauuacagggugccucauauuacccucuucccuuuggaauuuaaauacaacugaccagcauuaacauuaaaacagagaucuuaagacuaaccaaacagacccuuuguggcaauaaaauaccaaaucccaaccugacucugguauagcaucacaugacagcaggccccaaaggaaauuuaccccccaauauauuuauuugacguauuuugaaauggcccuacaaagcugucucuugugggggaaacugcauucuguagagaaucuccuucucuuauuaggucuuuucuggagagucugacaccuuuuaaggccuaaaaagaaaaauucaucaucuguucucucugaagccugcuaccuggaggcuucaucuacaugacuuaagccaagccucccuuacuuuaacuuaagcugacuucaucuuuucagguaaaguuuaacucucucaaccaacugccagucaggaacucuuugaucuaccucugaccuggaaacccccaucuucaagauguccugccuuuccaggccaaaccaguguauaccuuacauguauugauuuauggcuuugccuggaccuucugucucccucaaauguauaaaacuguaacccgacuaccucgggcacauguucuaagaaccuccugaggccccaucaugggcucugaaccuuggcaaaauaaaccucuaaauguauugagaccugucucagauacuuuuugguuuacaauauauuuauauuucuuuuaagcuguuugcugaaauuuuuucacaauaaaacacugggggaaaagaaaucaauacuuuaaauaugucuuccuuucuaaaaggcccaucucucaacaaaguggcaaaacuaaaacuaaagaaauuuaagaacucagucacuauagagaauuccaaucucucuccuacuaugaagcacuuucuuucaauuguuuguuacuauuuguuugugcucuagagaacagggugaggaucaaagcaaacgguuuucauuucauuguuugggucuauaaauuuggacugggaggggcugaggaaaugacugucucuuagaauuugcugggcuguggguucucaguaauuaccugugcuucaguaaguaguaucuugccccuaaaguucaauuauuucagaaauguaacaugaaaauagugaauuagacagugaaaauaucuucuuuuagcuauuuugugcuaauggaacacagaaacccugacaguuggugaaaaaccaguaugaaugaaauguaaccaugcccaggacuucaaaagugaccagacccuaagaggcacacagaggugaggggaacaagucccuuaggcuucccugaugcaacagaacuaggauuccaaagaaaauaagcagagaaucucauggugaaaauaaauaauaacaaguguuauccuugggagcuugcuguguauggccugacuguuucaauuugagagaaaggcagaaguuaauaauaaacaggaaaaauaagcaaggcuuuagcugacuagaaaacagcucaguagaaaauuauuuuacaaagauuauauucaguuagcuaaggcaugauucaacuucaaugaugcaagagcggucacucagcuauccaaugggaugacacacagcaaaucagcucuucacugccucaacagacagucacuaaaauaauuucuuuaaagguauauaaauguuggccaguguaauccucuacaaaacacauuugcaaauauaaaauaauggagguaugaugcugcucagagaaugggaaugcucuggcaguccccaacauccuaucccacuuggggcuuugcuccgaggggaagagcaggugcaggauauauugcccuuugaugugauguagaugcuacuagggacccacugggaagagucccguuccuugaguuaugcuacuguagggauagacccuuggugugaggaaucuaacaaugagucaaaggaaacaucacaaagaaggugacaccucagaggagacaaaggacucugaaauccuggaaucacgggauaucucugauugguuagggaauuccucugcacucaaucuccagcaaaugggcagauucccucacaacuuagaauuuuucauggggagugcuggacuguaccccaaacauggaguaagguggcaucauccaucucugaagggccauacuccucgcaaagccgucacaggacugaccuacagaaauaaaacaucaucgcuucccaaauucuccuaaaaauaucaucuuuaacuccauaaaagagggggcuucaguggcucagaacagaugggaagccuucugagaaacagauggaaacuguuucaaaggcaaaaugaaaugugcuaaaaaaauaaauacaguaauaaauaaaucuaauuauucuucagaauucguaggcaguaacagacauaacacgaggaguaagagacagggagguacaaacacagagacugcugaggucccaucucaccuccgucuccuccuccgccugggggcccagcagcuggugcucuggugaccacuggcugcagcacuaccugcacucuguggcacuccugagccucaggggugacacaguaggaaaugcugucaccagggaaaugcaagcuuuggucagguaaagaacaaauacaaucagcagcaauagugaagcuucauuaucaccuaaacuaagggacuuugaacaccaaaagcuuuaagcccucaaugcaagaaagcuaaaugcagaaacuuuggaaaccugauuggguuucacugcauuugauuccaaagcaacauuucuaaacagcacuccuacucuaaagacaaaaaaaagcgguggggacucuggaguguuuuuuguuuuucaucuucucugucagaugauaccauuccuucuuugauuauaccaaaaaaaaaaaaaaaaguaacacgacuuucaaauauguggguucugacaucaauucaguaccuaauuuccacucucuccacuuugacugccagugcccauaguaagggaaaccagcucuuggaauaggaaauaaugggggcaguuuuucuucccacaagaucuuagguuacauugaucaucacuugagauugcaugaauguucuugcuguaauggcaaaaacauagacuuaggaaagagaaaggagggggugucuaccaucaggaauaguaauagcccuccaaaggcaguguggucucccagcuaugcagagaccaagaauaaccagcaggcaggaauauggcaguggugacaggcuggauagagcuuucuccaaccaaaagauggggcuccuucaugggcaaugugcuuuucccucuucuggcaccucaacaacugaagagagugggugccacuaaaugcacuggcaauaagggcugugggagaggagagggcagcaaucugaaugauaaaccugugccaagaugaaucuauuuuuaaaaaacaucgcccugcuuccuuuuaggcuugugccccauaggugccuucaagagggaauuugcuggagucugaagcaagaaggguaugagucagggacuacagaacaggggcacuacaccaccaccugcagaagccaagaaggggaaaaagcuacgugggccaacagucaggcaugccagacagggugugaggcucagcagccccccaugaaccuuuggcucuugccuaucccaaacaagaggcaccagcuggcagccugcuucagccagcaaauacagccugccccugucccagcaguccuucagcugguguaguagauguggaaguagagagucuuguugcgcagcagggaguaggaguugucgaacuugagcagguagaugcccucaccaggguagucauggcugccagccugcacgucucgguggcugucccgccgguacacaggcaugaccuccccauagcgaccccgcaaggagcuccuggagccucucuccacaucuccagcuggaacggguucugcgugagcaaaauggcaaaguguucagagacugcguaaguccugccugaaggugagcggaaggaccaggugacccaguggcuuucacagagcggggagauuauugcccuccuacagacauuuggaaaugucuggugaucuuuuggucaucacagugacuauuaggugauaucugcauuuaguacccaaggguccaggagugcuaaaaucaggauaguaccuacacaacaaacaaugucccaucccaaaugccaauaaugucuccacugagaaaaugauuuagccugagaggagccuuccuagcuucagaagugucuggacauuucugagagggagaaagagauauuuagaagaaaagaucccgauauucuaucauuuaguaggugaaaggacuagcuaacgaagauaggaauugcagauaaacgugcuauaaagugacccuaggauuccugaaaagcagcaaauaagauacaagguucuccgcuuucccagauaccuguagguuucccugcccgcuugcuguucuaugaagaagcacguuaaaggacugacuuuaagauuauauaagaaaaucaaggaauaagaggaauaagacuaaugcuuaggaccuacucuuacguuaucugaaaaaugccucugggccauccuuuguguaguguguagacacuacaaauaacagccggaauggagcccggagacccuuuuaaaacuugucugggcaugaaguaaagaaguaaccaauagccagcuaugagaguuugggauaaggagagaauggauaccuuuagcaaacuguaaucacucacuuugguuccaggccaagaauaaauaucuacaaacuaagagagagauguaaaauaaucucuggcuuacaugcgaccugaaugaccaucccucuaaacugccgcaugacucacccucucucugcuccugccccaucccugcccccaggaagguguugggaaaacaaugagguaccgauaaggaaaaagaggcuuucuuucaauuaaggcagcaguaucaaccccaccagaauguucucuuuggccuguaccacucagcuuagcuuguaaugcugaguuucucaacugcauucaaaggaagaggaggacugguacaacccacaaaauggucaccagaaaucagauuaagccagaaaacugcaaauuagguuaaaauuaaauuuaccuucaaucucuuccuccucuuccucuucuucauccucaucgucacuggaaucacugaccugcacaguuaugucagugcuaguuacagggguccagucaaaauaaacuccaaagccaaugucauagucaucggucgcaaacucccagcagacacgcuuccccucuggaugaguagguacccggauggucaccaccucaccacgcuucaccaccagacggcuguucuucucuuugcccagcuugcuuuugaauuccuucaccuuggcaaagguccagaugcauggaggagccaucagagguggggagacugaaaggacaagcagcuuagcacugagaaaccaugaggaaacaugaguaccccgggcauuuugcuaagagaggcuggcacagucagacauucuuucuacuggcuugacuuccuuucacaagucauuuucuuuccuuccauuugucugucugccugccuuucuuugaguaucuacuggaaacaaaccaccuccuuuacucccaaaggucucaccuuuccuguggucccccagaagaucugcagauuccaaaucagcugaaagaacaucuauagcuccuguauguucagacuggaucauaacgauguccccagaccucuguggaacuugauacuuagccaucugcacaacagaacucugguuaaaggaguauucgaguggcagauucuaauuaaucucuuuuugcaugaaggcugccccaccccugcucuauuaucuccacuauccccacucaaagcuuaauguacuagucaauguuccuucucuuucuuccaaauagaaguugcuaauaaauucuacuaauuuuuuaaagccaucaaaauauuccauuguuuaaagacuguuuccuaccuuuugcaacuuuccugcuccaaacccuuuauaagguccuuguccgccaacacccucgcagguuguuaacaguauuugcauugacugugauucugggccaugccuuggucuuaccucaccugcacaguaccucccuguggcuccucucauuaauagcucuugcuccuaggguuuaguuugacucccacucugccacacauccuccugcuacaauucccacucaaggguuacuucuacauuacugucaaucagcucuccaaagcacugcagagacagaaucugguuuauagucuuucucucucauccacagcccaccucgggcuacagauugucucagucuugaagucacuaacaguguucuaucaauaguuacaauuucaccuuagaccagccccaggacuugcauuuaaacaguacauuugcugccagacgucugacuuacauggaagaaugcaaauggcauuugauacucaaagcccucacuaacccaugcgggagcuuacaaugucucccuggugaguuucccuucaaaucacucagauuaguguuccugguuucaugcuauuauaccuuaauuucugccccuucuccaaacaguuggcaggcaacucaacaagaaaacuauaccuauugcccacaggggagagcacaucagugagucagcaauccaguuaagaggcuggaauuguauuugugagaaauaaauaaaucaaguuuguaauccucccaggcuguauucucauaauaucuguuucuggagaauaagcccuccaguucucaucuccuuugcuaacugaaaugaaucagacuuuggcuagcgugcuuaaauaaauccuuccuuuucuaaaaugcuaaauaaaggauuagguugcaacauauuagcuacauagccuuaguaaagucucuaacagcccucagccucaguuuccucauuucuuucuuucauuccuuuugagacagaguuuugcucuuguugcccaggcuggagugcaauggcacgaucucagcucacugcaaccuccaccucccagguucaagcaauucuccugccucagccucccgaguagcugggauuacagacaccugccaacacgcccagcuaauuuuguauuuuuaguagagaugggguuuuuccauguuggucaggcuggucucgaaccccugaccucaagugaucugccugccucggccucccaaagugcugggauuacaggcaugagccaccgggcccagccaguuuccucauuucuuaaauggagacacaauggcaccuaucugacaagguuguucucaggaguaaaugaaguguuacagauacaaaugcuuguaaacuguaaaguauuauacaaaucuaauuauaacgccugguggugucuucauugacacuaauaccaaccauuauucuaacacauaugcuaauaaaugauagaaacaaccccaucccgcccccaucccuccauggcaggggcaccacuacaccaucacuuccauacagcuacuuggaaggcugaggcaggaggaucacucgagcccaggauuuugaggcugcagugagccaugacugcaccaucgcacugaagccgggugacagagugagaccuuugucucaaaaaaaaaaaaaaaaaaaaaaaaucaaggccaggcacaguggcucacaucuguaaucauagcacuuugggaggucaaggcggguggaucaccugaggucaggaguucgagauuagccugaccaauauggugaagcccugccucuacuaaaaauacaaaaauuagccgggugugguggcaugugccuguaaucccagcuacucgggaggcgaggugggacaaucacuugaacccaggagguggagguugcagugagccaagaucgugccacugcacuccagccugggcgacagagggagacccugucucaaaaaaaaaaaaaaaaaaaagcuucuguggaaucuuuaucauaaauacuaaauagaucuaccacaagaaaaguaagagcaaaauaguccaaugacuucaggcuccucaaugaagaggauuuuagagaacacaugaacauucacucuaacacuucguuuucugaaucggugccuacugggugccaguacaaugaugggcccuguggaagauacaaauaaucauucuccaaaaaauaaugaagaccaagaugcccuaaauuagagggcaaagagagaauuccgggagccacccucgcagugcuuucuaauuccaacccaaccacuauguguccacauucuggugccuccuuucauaagaaagagccagaaucugcccccuaccucauugaggaccugggccuggucugcaggcagcaaauccuguuucaccaaggccugagccuccaaaggaccaguugcuuuccgcagaucuuccguggcauccuuacucacuggagauaccaucuguggccucucagaggaagagagcauguuaauucaaggacucuuugaaaagacucaaucauccuggagaaacuuugaaauaaaacaacauucgagauacccccugccccaccugccccuggcauuuauuuagcucuacugucaccuuagccgaccacugcccagggcugaauugguccacaguaaaguguugacagugugaaaacaaagacuaacaaggccaggucaaaggcuaggagaaccauggaaaacacacagcuccaucaucugagauggacugcuggucugguuuuuuuuuuuuuuuuuuuuuuuugucauuguuguuucuuuuauuuauuuauuuuaguugacaaaguguauauauuuaugguguacaaugugcuguuuugauauauguacacauuguaaaaugauuaaauugagcuaauuaacauauccauccccucacauacuccuuuuuguggugagaacauuuaaaaucuacugucuuagcaauuuucaaguauacauuguuauuaacuauugucaccauguuguacaaagaucuccagaacuuguuccuccuucuaacaccuuauaccacuugaccaacaucuccccaucccacccccuggccccaacaccuauuaaccaccauccugcccucggcuucugugaguuccaauguuauuccucacucugcggcccacagggcccacagaauuuuaaccgaggaauugguagaaucucaguucaguucuacacacaaagccacuggcuagaagcaaaaggaggaggucugccuaagggagacugggcaccaaaacaaaguacaaaaugaugaucaaggcaacccucucugcaguuaucccugaggcagucuuucagcagauccguuucauacccuguccccguucagugcuaggggucaucacuuucucuccuuuuuaaagcacauuaaucaacaaucccaauggcuucaaacacagcuaugugaauaguuguuuguuuuuuggcagagugcaccagugaugcaucucaccacaaccucaagcaauucuccugccucagccucccgaguagcugggaucacaggcaugugccacgacacccggcuaauuuuguauuuuuaguagagacaguguuucuccauguuguuggucaggcuggucuugaacucccgaccucaggugaucugccugccucggccucccaaaguacuaggauuacaggcgugagccaccgugcucagccaugaauaguugauuauaaagaugcaagggaaugauuuaugcucucuuccauuuccccuggccucacaaaaacuagaaaauuagugccacgguuguagcaaaauaacccaggccuuuugggaaucuguugcugauaaaaggugacauggauuuuuuugaauggcaguuauccaaguauggucuaggggcccuucgggggagucuaugaaguucaaacuguuucauaauaacacuaaaauguuauuucccuuuuuucauucucauuuucucaagagugugcaguggaauuuuccagagacuauaugacaugugauaccgcaauagaaugaacucagaagcagagcugagaauccaacugccuuuuauuaagccaaacauuaaagagauuuaugucucucuuug

SEQ ID NO: 17117 - RNA, 27684 nt, Homo sapiens
caaagagagacauaaaucucuuuaauguuuggcuuaauaaaaggcaguuggauucucagcucugcuucugaguucauucuauugcgguaucacaugucauauagucucuggaaaauuccacugcacacucuugagaaaaugagaaugaaaaaagggaaauaacauuuuaguguuauuaugaaacaguuugaacuucauagacucccccgaagggccccuagaccauacuuggauaacugccauucaaaaaaauccaugucaccuuuuaucagcaacagauucccaaaaggccuggguuauuuugcuacaaccguggcacuaauuuucuaguuuuugugaggccaggggaaauggaagagagcauaaaucauucccuugcaucuuuauaaucaacuauucauggcugagcacgguggcucacgccuguaauccuaguacuuugggaggccgaggcaggcagaucaccugaggucgggaguucaagaccagccugaccaacaacauggagaaacacugucucuacuaaaaauacaaaauuagccgggugucguggcacaugccugugaucccagcuacucgggaggcugaggcaggagaauugcuugagguuguggugagaugcaucacuggugcacucugccaaaaaacaaacaacuauucacauagcuguguuugaagccauugggauuguugauuaaugugcuuuaaaaaggagagaaagugaugaccccuagcacugaacggggacaggguaugaaacggaucugcugaaagacugccucagggauaacugcagagaggguugccuugaucaucauuuuguacuuuguuuuggugcccagucucccuuaggcagaccuccuccuuuugcuucuagccaguggcuuuguguguagaacugaacugagauucuaccaauuccucgguuaaaauucugugggcccugugggccgcagagugaggaauaacauuggaacucacagaagccgagggcaggauggugguuaauagguguuggggccagggggugggauggggagauguuggucaagugguauaagguguuagaaggaggaacaaguucuggagaucuuuguacaacauggugacaauaguuaauaacaauguauacuugaaaauugcuaagacaguagauuuuaaauguucucaccacaaaaaggaguaugugaggggauggauauguuaauuagcucaauuuaaucauuuuacaauguguacauauaucaaaacagcacauuguacaccauaaauauauacacuuugucaacuaaaauaaauaaauaaaagaaacaacaaugacaaaaaaaaaaaaaaaaaaaaaaaaccagaccagcaguccaucucagaugauggagcuguguguuuuccaugguucuccuagccuuugaccuggccuuguuagucuuuguuuucacacugucaacacuuuacuguggaccaauucagcccugggcaguggucggcuaaggugacaguagagcuaaauaaaugccaggggcagguggggcaggggguaucucgaauguuguuuuauuucaaaguuucuccaggaugauugagucuuuucaaagaguccuugaauuaacaugcucucuuccucugagaggccacagaugguaucuccagugaguaaggaugccacggaagaucugcggaaagcaacugguccuuuggaggcucaggccuuggugaaacaggauuugcugccugcagaccaggcccagguccucaaugagguagggggcagauucuggcucuuucuuaugaaaggaggcaccagaauguggacacauagugguuggguuggaauuagaaagcacugcgaggguggcucccggaauucucucuuugcccucuaauuuagggcaucuuggucuucauuauuuuuuggagaaugauuauuuguaucuuccacagggcccaucauuguacuggcacccaguaggcaccgauucagaaaacgaaguguuagagugaauguucauguguucucuaaaauccucuucauugaggagccugaagucauuggacuauuuugcucuuacuuuucuugugguagaucuauuuaguauuuaugauaaagauuccacagaagcuuuuuuuuuuuuuuuuuuuugagacagggucucccucugucgcccaggcuggagugcaguggcacgaucuuggcucacugcaaccuccaccuccuggguucaagugauugucccaccucgccucccgaguagcugggauuacaggcacaugccaccacacccggcuaauuuuuguauuuuuaguagaggcagggcuucaccauauuggucaggcuaaucucgaacuccugaccucaggugauccacccgccuugaccucccaaagugcuaugauuacagaugugagccacugugccuggccuugauuuuuuuuuuuuuuuuuuuuuuuugagacaaaggucucacucugucacccggcuucagugcgauggugcagucauggcucacugcagccucaaaauccugggcucgagugauccuccugccucagccuuccaaguagcuguauggaagugaugguguaguggugccccugccauggagggaugggggcgggaugggguuguuucuaucauuuauuagcauauguguuagaauaaugguugguauuagugucaaugaagacaccaccaggcguuauaauuagauuuguauaauacuuuacaguuuacaagcauuuguaucuguaacacuucauuuacuccugagaacaaccuugucagauaggugccauugugucuccauuuaagaaaugaggaaacuggcugggcccgguggcucaugccuguaaucccagcacuuugggaggccgaggcaggcagaucacuugaggucagggguucgagaccagccugaccaacauggaaaaaccccaucucuacuaaaaauacaaaauuagcugggcguguuggcaggugucuguaaucccagcuacucgggaggcugaggcaggagaauugcuugaaccugggagguggagguugcagugagcugagaucgugccauugcacuccagccugggcaacaagagcaaaacucugucucaaaaggaaugaaagaaagaaaugaggaaacugaggcugagggcuguuagagacuuuacuaaggcuauguagcuaauauguugcaaccuaauccuuuauuuagcauuuuagaaaaggaaggauuuauuuaagcacgcuagccaaagucugauucauuucaguuagcaaaggagaugagaacuggagggcuuauucuccagaaacagauauuaugagaauacagccugggaggauuacaaacuugauuuauuuauuucucacaaauacaauuccagccucuuaacuggauugcugacucacugaugugcucuccccugugggcaauagguauaguuuucuuguugaguugccugccaacuguuuggagaaggggcagaaauuaagguauaauagcaugaaaccaggaacacuaaucugagugauuugaagggaaacucaccagggagacauuguaagcucccgcauggguuagugagggcuuugaguaucaaaugccauuugcauucuuccauguaagucagacgucuggcagcaaauguacuguuuaaaugcaaguccuggggcuggucuaaggugaaauuguaacuauugauagaacacuguuagugacuucaagacugagacaaucuguagcccgaggugggcuguggaugagagagaaagacuauaaaccagauucugucucugcagugcuuuggagagcugauugacaguaauguagaaguaacccuugagugggaauuguagcaggaggauguguggcagagugggagucaaacuaaacccuaggagcaagagcuauuaaugagaggagccacagggagguacugugcaggugagguaagaccaaggcauggcccagaaucacagucaaugcaaauacuguuaacaaccugcgaggguguuggcggacaaggaccuuauaaaggguuuggagcaggaaaguugcaaaagguaggaaacagucuuuaaacaauggaauauuuugauggcuuuaaaaaauuaguagaauuuauuagcaacuucuauuuggaagaaagagaaggaacauugacuaguacauuaagcuuugaguggggauaguggagauaauagagcagggguggggcagccuucaugcaaaaagagauuaauuagaaucugccacucgaauacuccuuuaaccagaguucuguugugcagauggcuaaguaucaaguuccacagaggucuggggacaucguuaugauccagucugaacauacaggagcuauagauguucuuucagcugauuuggaaucugcagaucuucugggggaccacaggaaaggugagaccuuugggaguaaaggaggugguuuguuuccaguagauacucaaagaaaggcaggcagacagacaaauggaaggaaagaaaaugacuugugaaaggaagucaagccaguagaaagaaugucugacugugccagccucucuuagcaaaaugcccgggguacucauguuuccucaugguuucucagugcuaagcugcuuguccuuucagucuccccaccucugauggcuccuccaugcaucuggaccuuugccaaggugaaggaauucaaaagcaagcugggcaaagagaagaacagccgucugguggugaagcguggugagguggugaccauccggguaccuacucauccagaggggaagcgugucugcugggaguuugcgaccgaugacuaugacauuggcuuuggaguuuauuuugacuggaccccuguaacuagcacugacauaacugugcaggucagugauuccagugacgaugaggaugaagaagaggaagaggaggaagagauugaagguaaauuuaauuuuaaccuaauuugcaguuuucuggcuuaaucugauuucuggugaccauuuuguggguuguaccaguccuccucuuccuuugaaugcaguugagaaacucagcauuacaagcuaagcugagugguacaggccaaagagaacauucuggugggguugauacugcugccuuaauugaaagaaagccucuuuuuccuuaucgguaccucauuguuuucccaacaccuuccugggggcagggauggggcaggagcagagagagggugagucaugcggcaguuuagagggauggucauucaggucgcauguaagccagagauuauuuuacaucucucucuuaguuuguagauauuuauucuuggccuggaaccaaagugagugauuacaguuugcuaaagguauccauucucuccuuaucccaaacucucauagcuggcuauugguuacuucuuuacuucaugcccagacaaguuuuaaaagggucuccgggcuccauuccggcuguuauuuguagugucuacacacuacacaaaggauggcccagaggcauuuuucagauaacguaagaguagguccuaagcauuagucuuauuccucuuauuccuugauuuucuuauauaaucuuaaagucaguccuuuaacgugcuucuucauagaacagcaagcgggcagggaaaccuacagguaucugggaaagcggagaaccuuguaucuuauuugcugcuuuucaggaauccuagggucacuuuauagcacguuuaucugcaauuccuaucuucguuagcuaguccuuucaccuacuaaaugauagaauaucgggaucuuuucuucuaaauaucucuuucucccucucagaaauguccagacacuucugaagcuaggaaggcuccucucaggcuaaaucauuuucucaguggagacauuauuggcauuugggaugggacauuguuuguuguguagguacuauccugauuuuagcacuccuggacccuuggguacuaaaugcagauaucaccuaauagucacugugaugaccaaaagaucaccagacauuuccaaaugucuguaggagggcaauaaucuccccgcucugugaaagccacugggucaccugguccuuccgcucaccuucaggcaggacuuacgcagucucugaacacuuugccauuuugcucacgcagaacccguuccagcuggagauguggagagaggcuccaggagcuccuugcggggucgcuauggggaggucaugccuguguaccggcgggacagccaccgagacgugcaggcuggcagccaugacuacccuggugagggcaucuaccugcucaaguucgacaacuccuacucccugcugcgcaacaagacucucuacuuccacaucuacuacaccagcugaaggacugcugggacaggggcaggcuguauuugcuggcugaagcaggcugccagcuggugccucuuguuugggauaggcaagagccaaagguucauggggggcugcugagccucacacccugucuggcaugccugacuguuggcccacguagcuuuuuccccuucuuggcuucugcagguggugguguagugccccuguucuguagucccugacucauacccuucuugcuucagacuccagcaaauucccucuugaaggcaccuauggggcacaagccuaaaaggaagcagggcgauguuuuuuaaaaauagauucaucuuggcacagguuuaucauucagauugcugcccucuccucucccacagcccuuauugccagugcauuuaguggcacccacucucuucaguuguugaggugccagaagagggaaaagcacauugcccaugaaggagccccaucuuuugguuggagaaagcucuauccagccugucaccacugccauauuccugccugcugguuauucuuggucucugcauagcugggagaccacacugccuuuggagggcuauuacuauuccugaugguagacacccccuccuuucucuuuccuaagucuauguuuuugccauuacagcaagaacauucaugcaaucucaagugaugaucaauguaaccuaagaucuugugggaagaaaaacugcccccauuauuuccuauuccaagagcugguuucccuuacuaugggcacuggcagucaaaguggagagaguggaaauuagguacugaauugaugucagaacccacauauuugaaagucguguuacuuuuuuuuuuuuuuuugguauaaucaaagaaggaaugguaucaucugacagagaagaugaaaaacaaaaaacacuccagaguccccaccgcuuuuuuuugucuuuagaguaggagugcuguuuagaaauguugcuuuggaaucaaaugcagugaaacccaaucagguuuccaaaguuucugcauuuagcuuucuugcauugagggcuuaaagcuuuugguguucaaagucccuuaguuuaggugauaaugaagcuucacuauugcugcugauuguauuuguucuuuaccugaccaaagcuugcauuucccuggugacagcauuuccuacugugucaccccugaggcucaggagugccacagagugcagguagugcugcagccaguggucaccagagcaccagcugcugggcccccaggcggaggaggagacggaggugagaugggaccucagcagucucuguguuuguaccucccugucucuuacuccucguguuaugucuguuacugccuacgaauucugaagaauaauuagauuuauuuauuacuguauuuauuuuuuuagcacauuucauuuugccuuugaaacaguuuccaucuguuucucagaaggcuucccaucuguucugagccacugaagcccccucuuuuauggaguuaaagaugauauuuuuaggagaauuugggaagcgaugauguuuuauuucuguaggucaguccugugacggcuuugcgaggaguauggcccuucagagauggaugaugccaccuuacuccauguuugggguacaguccagcacuccccaugaaaaauucuaaguugugagggaaucugcccauuugcuggagauugagugcagaggaauucccuaaccaaucagagauaucccgugauuccaggauuucagaguccuuugucuccucugaggugucaccuucuuugugauguuuccuuugacucauuguuagauuccucacaccaagggucuaucccuacaguagcauaacucaaggaacgggacucuucccagugggucccuaguagcaucuacaucacaucaaagggcaauauauccugcaccugcucuuccccucggagcaaagccccaagugggauaggauguuggggacugccagagcauucccauucucugagcagcaucauaccuccauuauuuuauauuugcaaauguguuuuguagaggauuacacuggccaacauuuauauaccuuuaaagaaauuauuuuagugacugucuguugaggcagugaagagcugauuugcugugugucaucccauuggauagcugagugaccgcucuugcaucauugaaguugaaucaugccuuagcuaacugaauauaaucuuuguaaaauaauuuucuacugagcuguuuucuagucagcuaaagccuugcuuauuuuuccuguuuauuauuaacuucugccuuucucucaaauugaaacagucaggccauacacagcaagcucccaaggauaacacuuguuauuauuuauuuucaccaugagauucucugcuuauuuucuuuggaauccuaguucuguugcaucagggaagccuaagggacuuguuccccucaccucugugugccucuuagggucuggucacuuuugaaguccugggcaugguuacauuucauucauacugguuuuucaccaacugucaggguuucuguguuccauuagcacaaaauagcuaaaagaagauauuuucacugucuaauucacuauuuucauguuacauuucugaaauaauugaacuuuaggggcaagauacuacuuacugaagcacagguaauuacugagaacccacagcccagcaaauucuaagagacagucauuuccucagccccucccaguccaaauuuauagacccaaacaaugaaaugaaaaccguuugcuuugauccucacccuguucucuagagcacaaacaaauaguaacaaacaauugaaagaaagugcuucauaguaggagagagauuggaauucucuauagugacugaguucuuaaauuucuuuaguuuuaguuuugccacuuuguugagagaugggccuuuuagaaaggaagacauauuuaaaguauugauuucuuuucccccaguguuuuauugugaaaaaauuucagcaaacagcuuaaaagaaauauaaauauauuguaaaccaaaaaguaucugagacaggucucaauacauuuagagguuuauuuugccaagguucagagcccaugauggggccucaggagguucuuagaacaugugcccgagguagucggguuacaguuuuauacauuugagggagacagaagguccaggcaaagccauaaaucaauacauguaagguauacacugguuuggccuggaaaggcaggacaucuugaagauggggguuuccaggucagagguagaucaaagaguuccugacuggcaguugguugagagaguuaaacuuuaccugaaaagaugaagucagcuuaaguuaaaguaagggaggcuuggcuuaagucauguagaugaagccuccagguagcaggcuucagagagaacagaugaugaauuuuucuuuuuaggccuuaaaaggugucagacucuccagaaaagaccuaauaagagaaggagauucucuacagaaugcaguuucccccacaagagacagcuuuguagggccauuucaaaauacgucaaauaaauauauugggggguaaauuuccuuuggggccugcugucaugugaugcuauaccagagucagguugggauuugguauuuuauugccacaaagggucuguuugguuagucuuaagaucucuguuuuaauguuaaugcuggucaguuguauuuaaauuccaaagggaagaggguaauaugaggcacccuguaaucugaccauaauaugaggcacccugucuucccaucauggacuaguuuuucagguuccuuugagauccccugggccaagacagggguccauucagccgguugggggauuuagaauuuauuuuugguuugcuguauauauauguauacacacacuccccgcauaaauguaaaaauuuuaaacuaccaauuccuaggcaaagaugauucuaacauucuguuccuuuugacaaguguccaauuagagaaugcugagaauguccccugcauaucggcucuguuggagagccccugauuuuuagcagaccuguuucauucaacauggguuacccaggagguggucuucauaaaaauguuucuuggaggccaggcgccguggcccacgccuguaaucccagcacuuugggaggccaaggugggcagaccaccuuaggccaggaguucgagaccagccuggccaacauagugaaacuccgucgcuacuaaaaauacaaaaaauuagcugggcgugguggcgggcaucuguaaucccagcuacucuggaggcagaagcagggagaauuucuugagcccaggaggcagagguugcagcgagccgagaucaugccacugcacuccagacugggcaacagagcaagauuccgucucaaaaaaaaaaaaauuguuucuuggucuccaucuuucaagaaaauacaucugugcuguauuuuccccuucccucaggccaugaucucugcuguuuuccuuacuaacuggcaugucaguacaagagugauugugaagcugcuccggaagggcuuuaugcuaaccucuguugcuugaugacauguccucaggacucugauauuaaaacucaauccuuagauaacagguagcuuuaucauggaaguagguagcaauuuggaauuagaccauucuuaguuauuuuuuucuuaaugaauugauacaugcacuuuaaaaaauauuuuuguuauuuugggaagaaaaacucagacuuuuaaaaaaguguauauugucccauuauaauauguauauggaagagugaaaucugaacgcugucuuauauuaagcaguagaauuagguauuaucauaaaaagucuuaaucuguagggaauaugaguuuauguuuaugaguccugcucagucccucuuugagagaauuaguugaaacccagacucuaaagucugcuuuuauauuuguuuguuaagaccacuuaucugcagaagguugccuuuuaaccccagugguucuaagguguggaauugagugacccuaauauuuacauaagagacuuguuuuaguggagcauaagggaggggcauaaguuacaccguuuugugcugcuugagaacugucuuuuaaaauugaucacaacgagggaaaacaaaauaaaauuagggggcaaaggguaggaguauggggggaggggagagcaaaccuaucgaauauaucuuagaauuuugcucagaaaucacugcugccucucaaguguugcauugucccugccuaaaccaagaaggcuaaacaaagccccuccuguuugaauucuuaagguaagaaauuucuaagcuaagaaaacacuauugccuaaaaccaaugauaguggagcucauuuacaaauaggcaugccucacacacacaguccaaaggcaagacacuggcuuugaaauuaggcucaugaugugauuccuauuauauguaccugauuuuuuuaggccccagguauguggaccagaguuaaugucaugacucuucaaagauaugaugaaaaguugcccuagaaaucuagagaugcauguuuauuuaauuccauaguuuaaaaaaaaauuuaagcagguaguuguggcuuaucugggggcaaaauaauauaugugaaauugcuuccagaggacaaaguauauuuucuaaaguccugaaauaggaucaugaacccuucugaaguuuugguuugaaauauuauaguauaugauauuaccaaagagcccuuaauucagaguuuaaggggcucucuuccugaacucucuucaucacucaggguugaauguguaauguuccuugcuauugauuguuauuguugauucuuaggaucaggccaagaaucaucuggaaaacauuaucuuaauuccgucucucauauccuaaacaguacauuuuacuaagaaauuccauaugaaaaacuccacucaugucuccugagauuauccuguaagugaaguagcuuucauuuaaccaagcuaaauuauuuccauuuagccauguuaaagagaagccaagucuagagaaagcaauccuguaacccaugaaucugguguacccauuuucccuuaacguaacgggaaguguuuugaaauucccagaagagagcuguuuuguaaucaaagugauggauuauaagaaagccagacuuuggaaaaggauaauuggaauaaagggaggugcuugaagauuuuccaaacuacuuuaugucauuuagcuucuauuuucugaagggcuuucuuuggugccauguacucagaucagucaguugacugaaagaugaucauguuuucuucguaaagauuuaagcaauuggcaacuacaaagacauuauuuucuuacuguucuauaucauguacuguugcugacauuacaaaaagggucuggaagggaaaccgugucacuguuuuaucuuuuuucuuuaaaauacaaaaguaucccaacuaaucauuuauuauggucagcuuguuuuacauguccccuaucaugagaaaugcuaucaacaucugugauuucuaagagucuuaccaaauuguuacuuuaauucuuguguccugcugagugguuuuucuuuuaaaauaccauuuuuaucacccuguggcacuggguguguuacugcgauuacacugaugauucugagcugugcuucuucaaguagcucaguucuugcguuuuauauuagguaacaguuuugugaugcuuuugugcauucuuugucaucucuucugaguuuucgaaucugucauaaauaaacuuuuucacuaugcaccugguaacaucugaguuauauuuuaaugaaccugauuuacauuuuaaauucuuugucuuucauguaucuuccuuaagaaagguauucuauaagcccauaugaauuauuucauaaucuauuaagauugugaaaguuaagaagaacuaaaaagaaaaaaaauugagaauaagauuaauaauagaucuuucaucugcauuuaaauucauggcagaguaucaugaccugggaacugggaauggaaaaacuggguuuauagugaugauuaauaaguucugaguuuuaugucagcauuuggucccagugaggccuguuuccccaugaagauauucuguucaaauuuggaaccucgacuucggauaccaggccaaucauuaacguaaucugggugauaugaauucagccuauuuucauuuacaaaaagugacaccauaauauaucuuugcugucuuuuaaaacacugccucuccacaucccuagugucuguugcagaauaaggacucacaucugagcagggaaggguggcauuuaaauauuuccuucagugauaucugugaugcuaaaaugaaccuguuagaucauucucugcuuucuguugcaacauauuuuagagguugaagcaugaaagagaagggaucugaaacaauucaguugaauguaaucaccaaacuacccuacaaguaacaaaaagcccaggcagauuccauguagcuggagaucauuaaugauucauguuuggguaugcuggauguaauaugucacugugaacacauaauauauuuaagauuauuauuauuuuuugagauggagucucacuuugucgccaggcuggagugcaguggcaugaucucggcuuacugcaaccuccgccucccugguucaagcaauucuccugucucagccuccugaguagcuggaauuacaggcacaugccaccacgcccagcuaauuuuuuguauuuuaguagagacaggguuucaccauguuacccaggcuggucuugaacuccugagcucaggcaauccacccgccucagccucccaaagugcuaggauuacaggugugagccaccgcaccuggccuuaagauuauuuuuuaacuuuuaaaagcauucauaugugucauaucauugaccuugacauagcucaggauuacaaaaggcagcucacacauuacagcucuugacauucagccuugauguucuuuaaccugugcacuucuggcuuaaacucagcagcuauccuuaguucaaaguauucucugaaaguagaauugcugugaccuuggaagcaagagcuaaauaaguuauguuuagaaguaagagcuggcccagcuacuugggaggcugaggcgggaggaucaagaucagccugggcaacacagugagacuccaucucuaaaaaaauuuuuuuuaaauaaaauaucuaggccgggcgugguggcucacaccuguaaucccagcacuuugggagaccgaggcagguggaucacaaggucaagagaucaagaccauucuggccaacauggugaaacccugucucuacuaaaaauacaaaaauuagcugggugugguggcgugggccugcagucccagcuacuugggaggcugaggcaggagaaucccuugaaccugggaggcggagguugcagugaaccgagaucgcuccacugcacuccagccuggcgagagagugagacucugucuccaaaaaaaaaaaaaaaaacaaaaacaaaacacuaaaaguuaggaggagccguaucuuggccaggcgugguggcucacgccuguaaucccagcacuuugggaggccgaagugggcagaucaccugaggucaggaguucgagaccagcuuaaccaacgcgccuguaaucccaguacucgggaggcugaggcaggagaaucacuugaacccaggagguggaaaguugcaaugaaccugagcucuuaccacugcacuccagccugggcaugacagagcaagacuccaucacaaaaaaaaaauaaauaaauaaaaauaaaaaaaaauaguaugaguauguguaucaccuguuuauccaguaaguuugccacuuuccuuaauggauauguaaaauuucugaggaacacagccuauaauuuuugcuuuguucucagguauuuccugauagcaccucccuacugcuuuccuccuccugaaguauuucuggggacuuguuacuuccauagaguuggaauuaccaguaucaggccccuccaucauuguucuuccuucacuguggccacucccacucugggaagaccacguacauaucuagucucccugugccucuagcauaucaggaucaggugucugcugagugugauauggaaaggaaggacuugacuuaccacucauccguuugagagaagccccuacuggaaaauguccuguaaaaaggugauggucuuugcuacgauuuaaauguuuauguccccucuaaaauucauguugaaacuuaaucuccaauacaacaguauucagagguggggccuucaagagguaaagcuccuaaaaagucaucucauuucauccccagaagcuaccccaaucucuguacggcaucucugcccagaggugguccugguucugccugaacacugccaagcaugggaacuugcucccuccagggcagccugugguacacugcuaccugcuuggucuccuaagcuggccuggucaguagcugcucacacugcccacgggggagccugccucccauucccagcaccaucugugacuggauuuaccccgagugccuaauccugggacuggucuggagaaugcuggcccugaagacgagggacugguugagagggccaaauggccucucagugcuggaguggaauauguuuuuuuuuuuuagauggagucucacucuaucucccaagcuggagugcacuggugcaaucucggcucacugcaaccuccaccucccagguucaagccauucucccaccucagcugggacuacaggcaccugccacuacacccggcuaauuuuuguauuuuuaguagagucgggguuucaccauguuggccaggcuggucuugaacuccugaccucaagugauccaccugccucggccucccaaagugcagggauuauaggcaugagccacugcgcccagccuggaguggaacauuuaacaacgguaccauuccuagcccugagaacucagccagucacuagaugcuuuccugcuucuaucuguuaucucccuggaucuugucugauucuuucaggcaggcuuuuggguauauuucucaucauugcccuuaggucccaugggccaggccugccacaggguaggcaaguggcugacugacuuccucuacugguccaggcacaggggauuccagcuagggacaguguucaucuucuggaaccuagcucagucuuagacaaacaagguagaggccugggcuucaguuuaauucacgccaaauuucagcgcgggcauucuuuggagucacacacaacaaaagcggaugagaaaaggcacacagccuuccccgugguguuacggugagcacgccaggcauuuuaauccgcauucucaucucagccucacgacugccccgucacauagauaacaguauuccugcccacccugcuccccgcaucucccuacuccaccccacaugcgugugacagaugaggggacugagguggaacaaguuucagcaggaaggcagauccagggcuagaguucgagucucccaucuccucaauuaagacucucguuuccaggccucuucagcccacccagcuucugcuccuguggcccugugccaacggggcaggauuugggagcuaggcccucagcucaguggguguaucuggcugccggcaggggugagacaccuggaaggccuccaagaccagcagccucuuguugauggagcugaugguaggguagggggugagauccaccuugaaucuguaguagagaaacaccugcuaagcuaagguuuucagggacacagggagacugcccugaugcagcagggggagcagagaggcagggcuggaugaggucgagggagcuguccagggaaggacgauggggcagcccuuauucacaggggauggguaggucuugugcaguaucauuuggcaucuguuaccuacuguuccuauuucuuugugaaccugcuauguguaaggcccagugcuaggcauuuauauauacagacucucuucccccauguuguaagcuucuugggggcagggaaugugccauacguuuccauaucccuaacgccuagcaugaugccuuccagagaggugcucauuugugcccuaccaaaggguucacggaaggaugcagagguagagcucacuacugcucacagacacaccacauuugaggacaucaggcaggugcucuuggggguccaccaggugagccaccuccucuuaggagcuggggcuaucuauacagguucaucugggcuguggugggcguaguaggagcacugccccaauuucuucugcccucuuccaggcagaaguggcuauguggccuggcauggugggcuccuuggcugguuggcgaagcgucugcaugagaugcuaucucgccagcugaguggggccugacugugggcagagccacgagaagggaggguggcggggcucucucuuaccuuucagcauuugccaccugaggcaccaagcacagaucagccauggucaccugaaagaggucccgguggguucccaucagggugcauaccccagagucaguggcuggacuggguguguccacugcgacucuacuggggguaccaacaaucugcuucggcucuuucacccaucccaccuccaauucuugucugcccuaggccugcaugagucugucccccggagcugaagugcccucccaggccaugcuccaguugcccugacaaccaacucuguggguugagagggccagagaagauggauugccuugacugcgcagacaucaucuagcacaaucccucaacugaugcuggcccgccucauccucucacagccagucuucuaccuugaguaacucccucuuaagacgguuuagugggagugagcugaggagugccccauggcacagagaucccccugcagacgccuucucaggaagcucugagcuugagggaggucagcaugagggaggcagccacuguggcugggccuggggaggucuggggacagcuuaccucgucuccuacacaguauaugcccgcugugcucuguaggaucugcuccagggcuguggggaggccacauaaacaucuuauucugggcgcagggaggggacacaaagcuuucugggccuuggccuccauaguuaugaaaugggcgcccaacugagugacagacugggcauggcugcuggugagaauguggcagccaggucucgagagagcuguuagggaugagcugcuguuuccugaggcuccgcacagacaaucaccauuuccccacucgaguggacaagcccugccacuggccacggugacagcucucacucugauggcuggcgcugugcuggccuugguuucccagcuggaguaggcagugaagcugaaguugggccauccagcuaugaagggcugugggcucagggaccgagguucccagaagugcuggagcuaaggucuggaugcccacccagcccauugccuccccaguccugcccucauccaugcaacugucaggcccaaagcagccugggaggcugguucagauacccaggccccugugugcgagggccauaccucuaagaggccacuguggggcagcucacagaggugaggacucaccguuaaagccacaagugauggcguucugggcccaggucagcugcaucuccucucccacuugcuucaggacagacagguucugugcagcccaaagaaaaucugugauugcgcugacagcugggugggggcuaccccuucgccaaacccccucagggaaguucacuucccaucugccccuggcuggaugucuaucccuucucccccaggcuccaugagccccuuccuucaaccaagggcccugagguuggagggagguagccaucccagcagccaccuuugcaggcugccccaguggccucaaaaagccacgugauucugucagagaugugcaagaaucccuauucaugugacacaggacgcggccauggcuguggcaggugugcccacaacucgaggccugucucccucacuucucccuugcauggucccuugugaggagagggagugugaaagaggguggggcugggaugagggagguccacaagaccggcuuccagagauuuccagccuggcuccaucuuggcaccccuggagccauuuucccucuguuuccucauuauaaaauggagaugucugucugcuccaacauccuuuguuaaagcgacaugcggguagagggcauaggcaugcagggauucugacuuaguccccacuuuguuaugaccuaccugugggacuccuaagucacuccaccuuucuggggcuauuuccucauucagaguagaagcuggcacagaugaacuguuuuuaauacuuaguugucuguuuuaacagugacacuuaaaaaauaaaauccuacaaguaucccaguauaugacugagauagcacagaugaaacggaagcugcucugguuaaaggcaggaggccuggacuggggccugcucagucucuccccugccauucuggcccuuuccccaccccaagcaccuguacaugcguccuuggaaacuagagcuucucggaacgcagcgggggacccgcuggggggcugaauucugagauugcgaucuucacccccuucuuucacaugguccaggucagaggcccugagaaucccccucccucccuugacacccccgcccccacacugggcagcucacagccaaugugugaguguaagagugugucaggugugcaagggugcaaguguacaagugccacaccugcaggggcuggaugccaccagcgaugaggucagaaaucauacgcacgcuggcccucuucuuuggguccugaggcagaagucgcggagugggacgcaucuccucuagauacucaaugauggccagcuguccagaggggagcagugaggcagggagagggcccaggaccccuggaccagaggggacagggccagcaaacuccuccuucuccucuuccagcaccaucacuacaccucuuccccccugcuucugcucagcucaagcccuauaagccuuuuuggaccuuaucaugcagaacuugguucuccaugugcuugaaucuucccuuauuuuccuaaauaaccucgcacccuccccacgagucuuguauugagccucuccuaugugcuaggcaccuugacuguacacaggcgaggaagagaugucaggcgcucucauucagggcacugcucucaugagggcccucccccaggcccugcacucacugacuggugaauggugauuccaucaaucuucaggguuggcaccugcuucauaggauucagugccuggaaguccuuagaaaacuguggagacaaggcccuggugggcuggguggccuggccugaguuggccagaggaaagccaagcaagcaggagaaccccaggccugccacccacccccaucucccuucccugggaaggcccuaaauccuaggcccaggguaaucccugggggauccaugcagucucccaaagcccagcugcugcugagccauaggcuucauccuaacagccuggcuaugggcuuucccugcaucucacaccguggccaccaaggcagcuccuacccuagucagccauccagagggcccaguaugggguggggacccacuagccacccacccucccagggucaggcacuggagagcccaggcuaggguacacagucuggaccugggcccuucccaggccuccugcuacugcacaccuugccaccuugucccacaagggagagccagcagccuccugcagugauaguccacaagacacagguucacuucucuggggcagagccuccccuuuuuccccugccuggugccuguucaaggccuccaauucccacauuguggucugggcacagccuucuuaccuguuggcccccauccuuuaugagauugaugggcaccgucucguagucgaugccuuucaaggccagagcuaggagagaccgcacauagcggagucaaagaacagccucucgccguacucuuaaaggaaagagcccuucuaaggugacauuaaggccaaagagggggaggcuucucuaacacuucuggguggucaaggcucaccguggcacuauccccuucucucagcuuuccuugucaccacgugcucccuaccccagaugcacgaugcucugccucacucaccccugaacucuuagagaccucaagaucuggacccccccaauggggcccucaugcccccuggauggugauaaagguguaugcccuggcacucugugggcuccuggaguucagcaaggcuguguuguguuuaacucugcccccccagggccuuaaacaguggugaccagugucuugguugaagacaugcaauuacucccucaagaaggcaacuaagggccaagggaaggagcucagguggccacacacagcacacacagacagauggcacucuuguucuguuggagaagaaucucuuccaaucuauucucucuguucucagggcuguuuacuagagauucuagacaggcaucaggcucuuugguggccucagagcauuugccgugacuccagucaccagauuuccucuccaucccuuuugauaauuuccccuggcaagcugaggguaaaaaaaacuugggugggucaacacuaguggagaagacugcgugcgugugcaugcauguguguauuacacacacuugggcauucaaguauggugauggccaaucucagggaagggcaaaggaaugaggggaggaggaccagacaugucaugguguggagagccugggcaauaccaggcuccuccuaguguuggucagcuccagucuggggagugacaguguuuggggcuggaggagacaccuggaggagggaaggccaaagcacacaggccguacagacagcaccuauauugcuccggcuucuggcucagccagggcagagguacuggcgcccagggauggguucaucuucuuggaggaaaguuucuccuggcacccagugcucuugcuuacugaucccagcaaauaccaagugacuaugggauggaggaggggucacggaggauggcuuugccuccacacucuggaggcaagcuucuuggguucaaauuucaucacagucauuugcuaacuguguggcccugggcaaguaacuuaaugggccucuggagccagacuaccugguucaaauuccaguucugccucuuaguaacugaaagaucuugggcaaguuacugaauguugccuguuuuuugugccucagcuuccuccucuauacaauggggacaguaauaauaguaccucccuccuaggguugcugagguuuaaauggaaucaggcacacaaaagcacucagcacagagcuuuuccucaguacaggcugcuuugguuaugaccuuugccaaaggcuguguuaagccaagggagggaagggucaaacaaggacuagccacagggcccuuguuucugcuuuucugaagccuccgaggcugaugcuggcccguucuguuugcuuugccaguucaaauaaaauaagaacugagaagggccagcuguuccccugccaguuaccaggggcauguggauuuugugacccugcuuuaaacaugguugccaaggggcuuuggagagcaguguugggagaagugucagucccaagggaaaaaacaacccccuuccucccacccucacccuguguuuccgggguggagaugccaugcagggauggggguucuaggagccgggggaugcugguugcugggggugagguccucucugacagagcaacccuuccaucccaggccagcuuugcacccgggcuuauccgccccaguccaccccacuccagcacucauccuggaggaggcacaucucuuaccaauucgaacucuccaugagcaggagcuucggaaauaggaauagaggaugggcugaggagagagaggaugaaggcgcguguuaacccaugcugggugggcuccagcuugggaggagucaaccauuucuuccuguccugccaggccuccucucucaggccugcaucugugcaaaucagggcagacuccaagcucucugagaggcucaugaggucccuuggcuccaaaauuaugcugguuugagcuccugagguccaagaggcccccaaaggggcagcuagccugagagugccuuccauaccuugccagacucugucaugguaucguggugacccucagccucccaggaaauguccccucuggcacagcuucugagcagggaaaggaaaccuaaagggguggauuucaggagccaauggggaagcugggcuacccaggcauugggggaacuuugacucuggucagaaagggcauuucuggccaggcacaguggcucacgccuguaaucccagcacuucgggagccaagguggguggaucauuugaggugaggaguuugagaccagccuggccaacauggugaaacccugucucuacugaaaauacaaaaaaaaaucagccaggugugguagugggugccuguaaucucagcuacucaggagguugagguaagagaauagcuugaaccugagagguggaggucacagugggccgagaucgcaccacugcacuccagagcgagacugcgucucaaaaaaaaaaaaaaaaaaaaggcauuuuuuuccaacucgcaggaaguuucuuacgcuccugcuggggccagguuugguguccccccaacagagcguggccugguuuugaugcaguauuuugagugguggagcgggcugggagcuggcaucuggagucuggaccuggugcaggaaccagcucugcaugaccuuggacaaaccucugccuuuuuaaaucuucggcucccucauuuguaaaacaaagguugcccuaaaaugauggcagggcauccucuagcaaugcagcaagacaaggaauucuaauuuuuugacgcuuugguacauaucuccuucaaccccaccucccagcaguccuccgggcucucggcuguccccauaaaaacagcuggcagauaugcucacucaccccaaaggugaggucaaaagcuggcagcucacuggggcccuaucuggcccucagaauuucuguuugcucaacacaguaguuuaaaauguuucaaguaguugccaauguuuaaaaaucaggacauuucauucuaguauggugggucaugccuguaaucccagcacuuugggaggcugaggccagcagaucaccugaggucaggaguucgagaccagccuggccaacauggcgaaacaacauggcuaaacaaaaauuagccaggugugguggugugcaucuguaaucacaccuacuugggaggcugagguaugagaauugcuugaacccaggaggcggaggauacagugagccaagaucgugucacugcccuccagccugggggacagagcaagacuccaucucaaaauaaauaaauaauaaaauaaaauaaaaauaaaaaucaugauauuuuauauacaacaccuguuuguuuuuuuucuuuaaaaaaaucuggagacagauuuggguuccuaaauagcagcaauugaugggaacagacuaauggcccccaucaaccagcguaugcgcucucaggucugccauggcccauaucuggcccacuuuucucauuuuuguuaccuuugggcccuugggggcagcugggugugcgaucucuacuccaagguuuaaggggcucaaaguuaauuucucugguacuucuucgggagccagcauuucaaaguggaacccaggaaagacucgccagugauuagcacucaugaaucuucccaccaaaacauguguaucccuauggauaggggagaacuugaaagaacuucucagaugcccuguuuacuaccccucugacuauagacauuucaccaaagcucccucuccccucugccaccccuagcauauuaagcugcucucugaacuugcuauugccaucccuguacuaccaacucagucugcuagauggcaaggguguaagugggaaccuaggcccuuccaagaugguucccaagcccagcagucccagccuguccugaagguaccuuuuguggagaaaguaaagaugguccuggcacagaaagcaggugaugggcagaaagugucuuucgaagaggaggaauuggguggccacaacuggaucuuccuuauuuggagaugcaacucccuuuccuuaccuagccaggcuacagggacuccuggugccaagggacagggacugcuggugaccacuagaguguggcagacauuaauuagcuuagaaucccugaagaaaugccuuaccuaauggcuaaaugccuuuggauuacaccuuuggaucuguacuacgagugaccagaagcaugguaaaugcugcugcccuccgucacgacccacaagcaggaaaccugaaaucucuuaggcaauuucugccuucucuuaccagugauaacuauguaaaccaugccccguuccuuucugcacuuguagaacuaaacuuuaagcccaaguauccaucucaucagcacuccuagaagaccuguguuuccaauucaaauaugcauucugauuacuuuagcagauuuuauuuuuaaaccaugucuuacacaugauuugagaaaaagacuccuaaaaucccauuuggaagagggaggacuauacauuauuaacgugacgcaaagucccaucuaacgugccaccuuccuuagugccacaaaagugguucucaaacuucauggcacguuaagaaccaucuagaccgcuuauaaaaacaugcagauucucgagcccguuccaccagagaugaacagaguggcucuggagcaggccccgggaagaacaugugaaagccgugaagcuccccaggugauugucaugacugccucuccucgcucggggccuuuuuuuuuuuuuuuugagccggagucccgcucuuucgcccaggcuggagugcaguggcgcgaucucggcucacugcaagcuccgccuccuggguucacgcuauucuccugccucagccucccgaguagcugggacuacaggcgcccgcuaccacgccuggcuaauuuuuuuguauuuuaauagagacaggguuucaucguguuagccaggauggucucuaucuccugaccuugugauccgcccgccucggccucccaaagugcugggauuacaggcgugagccaccgcgcccggcccggggacucuuaaaauacaaacauuacuggaaggucaccuccugcuagggccaagagaagagcaugaagggcugcgagaaauugggaggcuuggggcgacguuuggaagccuuaguggagggaggggucuguuauggggagcagggagggcggagcagaagugaagcgcgaccggacagcgacuccacccugcuacgcacucccuaccaggaccgccuccucuggcccaacccucccggaacuucgagccccagcgggcagcgcgcagcacgcaggcgcagagcgugcccggcgcaaagcacugcaugccgggagucguugucggccugggcgggcggugcagcucacuucugaccccgccccccagggucuccaggugucuaaccagcuucccuccacccgggugcgcgucacagaccuuccccgccugcaucuggcacuucgcgcgacccccuccuccaggccgagaaacuucgcgccugggaccugccgacgacuaaggcucagugagacucgacgaaucaggcccgugucuuucguccggguaaagcgaggggcuggacuagaaagauccuuccggucgccucuggcucgcccagcucucccgccacgccccguaccugggggcugcugggaguugcaguucccugagcccgaccccuccugcccagucccccccgccccgggccggccggcccucccggucccgacaugcucugcgccuccugccgccuccuagcggcccgggccgcgaccacgcugcccgccccgccccgagcccggggccccgcgcuccgcugcagugaagggcguugcauuucccgggguaccccgagcugcccucuugugacuccuuggcggggcggcuggucagacaaagugugccuccgggccggagggcgacccagaggagggggaagaugccgccggccacgggcggaggccuggcagaguccgagcugcguccccggaggggccgcuguggcccccaggcugcuagggccgcaggccgggacguggccgcugaggcuguggcgcgaagccccaaacggccugcuuggggcucacggcgcuucgaggcggucggcuggugggcccugcuggccuuggugacgcugcuguccuucgccacccgcuuccaccgcuuggacgagccgccgcacaucuggugagugauggg

SEQ ID NO: 17118 - RNA, 3131 nt, Homo sapiens
aggaaagagcccuucuaaggugacauuaaggccaaagagggggaggcuucucuaacacuucuggguggucaaggcucaccguggcacuauccccuucucucagcuuuccuugucaccacgugcucccuaccccagaugcacgaugcucugccucacucaccccugaacucuuagagaccucaagaucuggacccccccaauggggcccucaugcccccuggauggugauaaagguguaugcccuggcacucugugggcuccuggaguucagcaaggcuguguuguguuuaacucugcccccccagggccuuaaacaguggugaccagugucuugguugaagacaugcaauuacucccucaagaaggcaacuaagggccaagggaaggagcucagguggccacacacagcacacacagacagauggcacucuuguucuguuggagaagaaucucuuccaaucuauucucucuguucucagggcuguuuacuagagauucuagacaggcaucaggcucuuugguggccucagagcauuugccgugacuccagucaccagauuuccucuccaucccuuuugauaauuuccccuggcaagcugaggguaaaaaaaacuugggugggucaacacuaguggagaagacugcgugcgugugcaugcauguguguauuacacacacuugggcauucaaguauggugauggccaaucucagggaagggcaaaggaaugaggggaggaggaccagacaugucaugguguggagagccugggcaauaccaggcuccuccuaguguuggucagcuccagucuggggagugacaguguuuggggcuggaggagacaccuggaggagggaaggccaaagcacacaggccguacagacagcaccuauauugcuccggcuucuggcucagccagggcagagguacuggcgcccagggauggguucaucuucuuggaggaaaguuucuccuggcacccagugcucuugcuuacugaucccagcaaauaccaagugacuaugggauggaggaggggucacggaggauggcuuugccuccacacucuggaggcaagcuucuuggguucaaauuucaucacagucauuugcuaacuguguggcccugggcaaguaacuuaaugggccucuggagccagacuaccugguucaaauuccaguucugccucuuaguaacugaaagaucuugggcaaguuacugaauguugccuguuuuuugugccucagcuuccuccucuauacaauggggacaguaauaauaguaccucccuccuaggguugcugagguuuaaauggaaucaggcacacaaaagcacucagcacagagcuuuuccucaguacaggcugcuuugguuaugaccuuugccaaaggcuguguuaagccaagggagggaagggucaaacaaggacuagccacagggcccuuguuucugcuuuucugaagccuccgaggcugaugcuggcccguucuguuugcuuugccaguucaaauaaaauaagaacugagaagggccagcuguuccccugccaguuaccaggggcauguggauuuugugacccugcuuuaaacaugguugccaaggggcuuuggagagcaguguugggagaagugucagucccaagggaaaaaacaacccccuuccucccacccucacccuguguuuccgggguggagaugccaugcagggauggggguucuaggagccgggggaugcugguugcugggggugagguccucucugacagagcaacccuuccaucccaggccagcuuugcacccgggcuuauccgccccaguccaccccacuccagcacucauccuggaggaggcacaucucuuaccaauucgaacucuccaugagcaggagcuucggaaauaggaauagaggaugggcugaggagagagaggaugaaggcgcguguuaacccaugcugggugggcuccagcuugggaggagucaaccauuucuuccuguccugccaggccuccucucucaggccugcaucugugcaaaucagggcagacuccaagcucucugagaggcucaugaggucccuuggcuccaaaauuaugcugguuugagcuccugagguccaagaggcccccaaaggggcagcuagccugagagugccuuccauaccuugccagacucugucaugguaucguggugacccucagccucccaggaaauguccccucuggcacagcuucugagcagggaaaggaaaccuaaagggguggauuucaggagccaauggggaagcugggcuacccaggcauugggggaacuuugacucuggucagaaagggcauuucuggccaggcacaguggcucacgccuguaaucccagcacuucgggagccaagguggguggaucauuugaggugaggaguuugagaccagccuggccaacauggugaaacccugucucuacugaaaauacaaaaaaaaaucagccaggugugguagugggugccuguaaucucagcuacucaggagguugagguaagagaauagcuugaaccugagagguggaggucacagugggccgagaucgcaccacugcacuccagagcgagacugcgucucaaaaaaaaaaaaaaaaaaaaggcauuuuuuuccaacucgcaggaaguuucuuacgcuccugcuggggccagguuugguguccccccaacagagcguggccugguuuugaugcaguauuuugagugguggagcgggcugggagcuggcaucuggagucuggaccuggugcaggaaccagcucugcaugaccuuggacaaaccucugccuuuuuaaaucuucggcucccucauuuguaaaacaaagguugcccuaaaaugauggcagggcauccucuagcaaugcagcaagacaaggaauucuaauuuuuugacgcuuugguacauaucuccuucaaccccaccucccagcaguccuccgggcucucggcuguccccauaaaaacagcuggcagauaugcucacucaccccaaaggugaggucaaaagcuggcagcucacuggggcccuaucuggcccucagaauuucuguuugcucaacacaguaguuuaaaauguuucaaguaguugccaauguuuaaaaa

SEQ ID NO: 17119 - RNA, 43114 nt, Homo sapiens
cugguuuggucaucuuugguggcugaagaucugucucuucaagugauucuccuaguuucucacuuggaaaaucuuguuuggucugcucuggaggcucuagaccugucucuucauguugcacucuaagugauuccucuggaacccccgguucagucuccuccucuaguaauucuaaauuucucucucugacuguggcccccgaaaccucagacaugguuuccguugguggcacuggaucuggaucuguuuccauagcugacucuaggaacacauccucuguaacauuugguuuagccuccucugguggcucuaggucugacucuuuaugcguuucauccauaggggccuccaaaucuuugaaaaacucucccaucucucuggauguuuccgacuuuaccucuugguguaucccugguucaguuucgcuugguacgucucucuuggacuccuuggcaauuccuuccugggacgucccgccagguuucagcugcacguucuuagcacugucuggcucccccucuuugaaguccucuuccucggucucuggcuguggcucuugguaaaucucugcugguagcuucgagucugccuuugccauggugucugguucggcauuuucauacaauuuaugaaguccaggcaguucaggccucucaggcuccagcucuccaucuucaucugggccggaaucauaauccuccgggacuucagccauuugcagcuuagcagacgcgccgcggcuuccuagcaaccccaacuuccgauagcgucucuauggauaccacgauuuccggcagugucuuccugacucuuccccagguuuuguuuguucuuucaagcccugacuuuaaaaaucgucugucacaagcacgcaguaacccucccugcggccucaucgccagccucagcgggccagagcuccuguggccgccccugggucagcuagcuuuucaagcggccgccgcgccgcuucuuccggccugcaggcugcgcucggcugugcucggcgcucgcucggccuucggcuguuuccggagccacucgcggcuggcagcggagagcuccgugcgcgggcugcagaugucugaccugcaggcggcugaggggccgggcuccuggagccccacagcccgcccagggucggcuggcggcgucggggacugccagggaguggaggggagccaggcggccgccucagguacgcaaggccggggcgcuggcgggugggugccgcccggccucagggccccgcaccacggcgcgagccuccgccgcgcucuguccugggcuuccccgcggagcggacccaccucggcagccccuucgcgcgcggggccccuuccccgccgcugccaccacccgggcccugggcucgagguuauuuucuacucacuccuguuucgaaaugccuugauuccugccccgcuuccuuucugagaucugcccaaaugguagugacaggguggcucugccccuggcgccucuucagcuucaguuucagcuucagccgggguucgggucccaccuccgucugcuaaucacaucuagacugccgacccgaacccuacuggccucgccgcccccugcuucuggcuccccacccuauccccaucucaguccccugccccagccuuaccacgcgccucucggcccccacccggguuggcagccuugccuuccucugccagaagcccacugcgcccuagccuuccugcacauaggcccccuggccuugcugccauccucuccaucgcuuagagugggaaaaaugaaaagcagaguugaaauagguagugucuggggucuuuugcuugaacacaguagccaaagcaagagcaggaauuaaaaauuuggccuaccucccucauucucaagacccucauccucuucuuguccaggacgacgucuccauuucuacuaacgcgaguuccuccguguguauuauuucaguguccaaagacaaaagaguccauccaucacacuuucuucuuucagccuccugaacaccacacacgaugcaacugaaaggaugcucuuuugaaauacgaaaggguagaggggagagaacuugucuuauuuaaguagcaaauauaaauuaauuuucuaggucugaaauuaaaauagacaccauaaaguauaaugguugaggcacuacuguggagccagggugccuggauuggagucugaaacgucaguuuccucaucuguaaaaugugauuacuaaaaauaucugccucauaggauuauugugaggauuacuugagcugcuuugucuaaggcauuugggguauaguccaugguacacacuauacucgucucaaccauugugacaguaaggucucuuuuuguucaguugaacuuccugugccgccagagguguucuuggauguauggcuuccaacauggugccuuuuucugucuucuacucugaucccaaguaucuucccucucauaaugcugccuuauucaaacacacacacaacucacccagcucuuucccaugauuuuauauucuuuuacuuuaaaacaccugacaaauuuugccuuuuuuucuuacgaacucugcuuuguauuaaauuaaaaaucguuggcauauauuuaacauagcaguagaaauucuaagcauaaugucuaaaagacuaagcaaguaaacacagaaagguaagucuuauaacacuugucccuugcaugcgccaguauuuacaaauuaagcauguuuuuacuuccccuuuagguucucauguguuuauggcaaacguacccacgcguuuuagauagaugaguguguuuuuuuuucccccugacaucuaauucauuccugcauucacuuccucccaggacauugguagagaugcuuacuuuccuuccucuuacccucagaaugcagggugauaauuuuuuuuuuuaaugucauguagggguuuauuauaguagcccagagcaagcucuuccucuugagguaggauuuguugcuaauaaaauaauaguaaugauaaccuacagauauugaaugcuuauucugugccagagguggaaaaaaauuuauauuuucugauuuagucaugucaacaaucauuuucuucccauuuuacagaggaacaaacuacagcugagaaagguuaacuuaccuguucaaguuagcgcaaguuuuuacugucuggaugaaauugucaucuuguuaugaugaagucuauaauuguuuguuuuuauuggccaugaaucaaguauugguacucgcagacagguuauggucucuguccucaagguguuuucaguuugaugagaugagagauccauuucagggagaaacaauuaacaauucaaaacauuauauaauugggcgucuuuuauuacaauucuuuaucuacuaagaaaccugcuuggaguuaggaacggaaucucucuugcuuguuuauuuaucuagagcccuugauguuguguuuuagagguuucgcaaauauuugcugaguuugauggugagagaaagucugaaugcagagaucuggaugagcaucuaaugaaugugaagaauuaggguugagauaaccaagaauguuccuuggguuagagcaaugguuuucaaccagguacgauuuuguauccccagggcauggcaauguuuggaaacauuuuugcucgucacaacugguggcagcuauugcugacaucuagugaggauaggcuagggauguuugcuaaacauccugcaaggcacagggcaauccccauaacaaggagguaucuggcuccagaugucaguggugcugcuuuugggaacgcuguguuagaguuaagcugggcuuccaaagcaguguggaaauacuauauuuggccuggaccagaggcuugggcguaaaccccaaaaaacugcuuuaaacuuggaauucguuugauuggauccuucugccaucuuccucuagaaaaugauacaaugaguaagcaauagagcucuaagaaagaaugaaauuuaaugagauuucucucacccuuucagagagaaaacagcaguaagaaauggaauuggauauucagguguucuguuaguccauuuggaauaccugagacugaguaauuuauaagaaaagaguuuuaauuggcucaugguauugcaggguguacaggaagugugguguugguaucuguuucuggugagggccucaagaagcuuagaaucauacugaaagggggagcagguaugucacauggcgagaguugggagugagagagagagagacgggaggaggucccagacucuuuuaaacaaccauaucucaggugaacuaacugagugagaacucacuuaucaucaagaggaugaugccaaaucauucaugagggauucaucuccacgauccagucaccucccaccagaccucaccucuaacauuggaaaucacauuucagcgugagauuuggagggaacaaacauccaagccauaucagguauuguugaguuaaggguuuugguuuuuugguguaucuuauuccuucaaagcaggaaugugucauuauccagaauaaccauaacuuguuuuuuaaaaguguucucugcagagaauaccuauugagugucuucauguuuguuagcugagguuuuggugaaaaggaaggaaaggauuuauguucuuaugaacuaagcucuccaguggucaugguguucuuauuguuuuaugcauuguaauuguuuuuaauagucuuuuauuugaggcaccuggguucuucaguuccccagaggagagauaaaucauucuuuaauuaugaaacuaucugaggcauacuuguugcaucacuuaaaggcagguuuuuuuguuuuuguuuuuguuuuuuuuuuaaguuuaaaggaaaauaaaacucuauugugauccugaagucagcaguagaacuuaguuugguguguaugucccccagagcuaucaauacauuuagauguugaggauggaaacaggucagguaaacuuguucaugguucuaagguagaaguuagaauauuacaauaagucuuuuugcagugaugaaaauauuucauaucugucccagcuacucaggaggcugaggcaggagaaucacuugaacccaggaggcagagguugcagugagccgagauugcaccacugcacuccagccugggcgacagagggagacgcugucucaaaaaaaaaaaaaaaaaaaaaaaaaaaaaaauauauauauauauauauauauauauauauauauauauauauauauaauaucuguggcuauuucaaugugcaugaauuaaaauucaaaauuugguggcuaccauguugaaugguaagaauaauagggagucaaugacaaacagccuugauguuuuuuaguuuucuauugugguuuuaugucaaaauguuaacauuuugucugccuguggcuuucuuuuucuuacagugguuguguuuuuaguguccagauagucgauuagucagauaguugauuauucaugucgugauucagucuaaacaguauaaccaaaggugcacaaucugagugaccucucaggagcaugucccacucaagggcugaagagaaauuggaucacauggucacuagauuugguuggaacauaaacucacuuaauuuguuuucguuuaagccucuugagucuguaaccacauagccugcuuuuaguucuucugcacuggaaucuaaaaugacaggcuaauuaucucuuugcagccuguuuacugagggggaaauccucugaggccuguucuaaagaacccugaccugauauucaaaugcuuuugaaaaaaaccugcuuuuugguucuccuuguagggaaaguacgaaguacacaguaaguuugaaucccuagcaugaucagaaugucugaaaccagacccuuugguaauguagaaagaaaaugcacauuuaaaaaguugucaaauauaaaauaaguuauuuuaaggaaguuccuuuuuucucucucaccuuugcuuuaguggccaucaaugauaaauuaaguuauuguuaagcuuccauuuuuccuccuccguucauuguuuccgagauuucggccacugaggaaccaugguaaugacuuugccacacuggagaauaccguuacaguauuaguuauuuacuauuuuuucuugacauugacauuuaauugacauuuugauugacacuuaaaaguuucauucuaaauaauaccuacgauauuacuaguuugauauauccauuuuucuuaauauauacuagaauacauauuuuuaaaaauaaaaaacauuuccccacauaccaucuaaauuugcaaagucuggccugauuucucugaucucuucuaggaauacuuucagaauuggcuuauauuuggcuaauauaauaaaagcuauacuauaggaaaauuggcuuuuucuucugcauaguggcuuaaauuucacugaagaacuucaggaaaccuaaaaggcugugcucauaauucucucucacugaaacagcgcugcaucucccacacuuuauacuucuggaaauaaaguuauguuuuucuuucuccuuuucuuacuuccugccucucugaauccaauuauaaguuguuuuaccaguaguucuuauguaauuuagggcauucuuuaaaauuaaaaauaauuuagggcauuccuuuaaaguuaaaaaucaaaagcucaacuccuuaugggauggaaagaaaaaaaaucaaaagcauauuuuuuuccaguauacauuaaguuguuaaaaugcuaugagaaguggugcuuaccaugugaaaaaugcucaaccuaaaucauaauaagggaauuggaaauccuaacuacacuugguaguuugcuaacucacuuuguuggucggugugcagaagcagacacucucaugcuuugcuaaugagauuguaaauugguacagauucuguggagggcaacuugucaauauccaucagaauuacaauauaugccccuuugacucauucuuuccaggaauuauagauuuauuuauucuccuguuuaaugacauagauacaagguuauuauggcauuguuuguaaugguaauacauuauggaauauucacccaaugaaauacuaaucagcuguagaaaagaaugaagaagcuuuucaugugcaguuauggaaaggucuuugagauauaaguggaaagaacaaaguacacaguaguauguccagcaugcuccccccgaccuuuuuuuuuuucugagacagagucucgcacuguugcccaggcuggagugcaauggcgugaucuuagcucacugcaaccuccgccucccggguucaagcgauucuccugcaucagccucucaaguagcugggauuacaggcacgcaccaccacgccuaagcaugcccauuuuuuguguaaaaaagugaaaaaguauacacacacacacacacacacacacuuuuuuuuauaugcauaaaacaucuuuggaagacuacacaaaaccaaauaacauugauugcuuuuggagguagggacugacaugggaggaaauuuuucacuguauacuuauaugcuuuuugaauuuugaauaauguggauaaauuauucagaaauaguuaauaaaaauagucuuuaaaauauauaaauauauguguacauagauagacacacacacaaacuuggcaugagacuucacuaugucuauauccuaaauaagagccuuucuauaggucuguauucuguuucugcucaucaggaacugacauuuucuagaccuuuuucucucagugaauuuuuuuauaaaagguuauaagucuccuuagagauuaauuuuguuauucuuuaaauccacuacugucuuucauuauuuuugugcuaguuucauuucugucuaaaaauuuaaccuuuuugaagucuucauuacgauccaaaggacaggauaagccaaagggggauagacauaguagauaaacugauauuauuaaucaaugacagagagagggcagaauuuuuuuuuuuuuuuuuuuuuugaaacggagucucgcucugucgccuugacuggagugcaguggugugaucucggcucacugcaaccuccgccuucuggguucaagcgauucuccugccucagccucccgaguagcugggauuacaggcaugugccaccacgcccggcuaauuuuuguauuuuuaguagagaugggguuucaccaugcuggccagguuggucucgaacuccugaccuugugaucugcccgccucggcccucccgccuccgccucccuuacaggcaugagccaccgugccuggcagagggcagaacuauuuuuguuucuauuuuauucacuaagguauauucagauugauauggguaaauaggcaauauggauuucuguuuucaguaauagcagacuagguaauuaucucucaucagggacaauuagaaaauaugggugaaauauaaacaucugcuggaagauacuggagagauagaaagaucaugaagaauuaccuagcugugauccaugugagagcuauagagauccaaggacaagagucuauuuuggggcucuuuugucuccugaggguacaugcuggauuccugaguggggaagcugagugacaaggucaugaaaagugccucuuugaacuaaaguaacaggaaauggauuaguguucaggacccgucaagggggagccuggugaacuccauuuccuuuggguuagggccaugaaaggccaugcccuaaaaguaggucauugcagggagugcaacucagcuucagaaacagcuaaguucaugaauugggauuuuuggguggcuuugacaagcugguucuaaaauacauauagaaauagaaggccacaaauagcaaagacacucuugaauaagacaacagggaaagauuuguuccauccaacaucaagacuuauuuuaaaguuuuuaaagaguagucaggcucuaggaauagaaucaaaagcuuagaaacauguuuauacggacacuugcuuugcaacaaagauuguuaacauagagcaguggguaagguaagguaaauguuucugggacaauugaauauucuaagagaaaggaaaguaaagaaacguaaucuuuaccucacacaucauacacaaaaaaucaacucgguagauuauagaacaguaugugaaagguaguacauaagcaccuaccuauaggauaugggagaauauuuucggaucucaauauagugaaagacaucuuagacaggacauacaaagacuaaggaaggcaaauuugauaaauuuugaguacacaaaaguacuuugguucaucaaaggccaccauuaaaugggaaaagucaugucacagaguggaagcagguaauuauaauacauauaccugacaaaagguuuguaucuaaaacuccuauaaauaauaaaaagggacugggcuugguggcucaugccuguaaucccagcacuuugggaggccaaggugggcggaucaugaggucaggaguucgagaacagccuggccaauauggugaaacccugucucuacuaaaauacaaaaauuagcugggugugguggcacgugccuguagucccagcuacuagggaggcugaggccgaagaaucucuugaacccaggaggcggagguugcagugagccgagaccaugccacugcacuccaacuugggugacagagugagacuccgucucaaaaauaaauaaauaaauaaauaaauaauaaaaaggacaauccaguaauaaaauuggcaagagacuuggagaggcacuucacaaaagaagauuuuuaaauggccaagaaauacgagucauuggugaaauacaaacuaaauuagcauacaucuaccagaauggccccccaaaaaaauuuuaacaugaccaagugucagagaagguccagaguaaugaaaugaugcuacaaugcugguagcauuauauuugguacaaccccuuuagaaaauaguucggcauuaucuacugaaauuuaacauucaaauuucuaugacuuaaccguuuccauucugacauuuauauccaacauaaauguaugcacuguagccaagacacaagaauauucauagcagcauuauucauaauagccccaaacuggaguuaaccuaaguaucaucaacaauagauagauagcucaugguggauucauggaauaacguacagcaaugacagugaacaaacuggcugggugcgguggcccaugccuguaaucccaguacucugggaggcugaggaaggcggaucaccugagcucaggauuuugagaccaaccuggccaacauggugaaaccccgucucuacuaaaaauacaaaaauuaguugggcgugguggugggcgccuguagucccagcugcucaggaggcugaggcaggagaaucgcuugaagcgaggagguggagguugcagugagccgagauugcaccauugcacuccagccugggcaacaagagugagauucugucucagaaaaaaaaaaaaagaaagaaaguuaacaaaccuaccuacaauuacaugggugcauuuuuugaugcagauuuugauggaugcaucaaucaaaauaaugacugaaauaagcaagacccaaaagaaaacauucuuuuucauuuuccuuuauauggaauucagaaaacaggcccagugaagcaacaguguuuaggaaugcuuacuuagguggcccagcuauaaagaaagcaaggaaauaauguccauaguugggauagugguuuucuuaccuuaaggaggaaaggaucagguaaugauugggaaggucaugaguggugcuucuggaguguuagaaguguucuauuucuuggccugggugguguuugugauaauuuauugagguauacacuuuuguguacucuucuacauuugcguuauauuucacaauagaaaagauuuaaaaaguuuuuuuuuuuuuuuuuuuuuuuuuuuagacagagucuugcucugucacccaggcuggagugcaguggugugaucucggcucacugcaaccucugccucccagguucaagcgauucuccugccccagccucccaaguagcugggauuagacacacaccaccaugccuggcuaauuuuguauuuuuaguagaggcgggguuuuaccauguuggccaggcugcucuggaacuccugaccucaagccaucugccugccucgggcucccaaagugcuggaguuacagguauaagccacugcgcccagccuagaaaagguuuuuaaaagagucaguguauaauguaguuaguaagaaugcugacuuugaucuuggauugccugagugcauaucacuucuauucguauuugcuggucaucuugggcaucaugauuucuccgagcuucaauuucuuaaacuauagaaagggaguaaugauagcaucaacuucagugguucuauaauucagugcaauucagugacuauucaauauggugaugccuacaaaaaacuuagaaaauaauugacauauaguaagugaccacugagucuugguuauaauaacaaagaugaucagaauaaagguagaauagcuagguacuuuaauuaaguucagauuucuggacccagugaaauucuauccaggaauuuuugucagaguucuuuuuacaagccauauaaguuaauucuggcugucuuaagcagaaagaggauuuauuagaaggaaaaaggaggcucacuaaauuguuagaaggcuggaggacuccagaggcuaagcagcaagaacaacuuggcuguuuggcugccacuagaugaauucugucucucauuugucccacuccuguuucaccuuuuccaggugggaauauuuuagauuaugugcuuguucccugacuuccugguacugcgaagagaaggaucuuccauuuugacuuccacugaguacuauugucagugacaguucuccccaaggaggaaaagguugaguauuuuugaaagccagaagauugacagaugacuucuacgucugggguccugaaauaacuugcaaauauacuugugcaccaucuuugagggaugucggggacuagaaauggacauaccuaguuauccugaagggaaagaguauaauccagaauuuggagaccauuaaacuugauccagauuuucaguagaauaugucauuugaauguaaagaaaauaaguguugcuaggagccagcaugggcgaacuaaaaacacauuugacuaucuaauuauuuucuaauuauagccuuucuagucuuucauuacuaguuagguccuuucucucucucauggacuucugcagaggccuccuaucugaucucguaaaauccauccuaccuauggcugccauagaauuguaccaaaaaaauacagguuugaccaugucauuuacuagcuuaaaauuauucaucaccuuugggacaaaggaccuucacacacuuuuuccugcuagauugaaagcaucaugagagccagaacugugucugcuuuggauauucucuccaguaccuaggauguggccaggcacuuacuaggaauuugguuaaguaucaaguuaaaucacugggaccuguggcucucagcucaucucucugcauuggugcaguggccuccagccacacugagcugccacggugguauuuuuuuguguucuugguuuuguucauucagccuccuuugccugcagugcccuuuuccacuugacuuggccaaguccuggucauuuuugaauucagugcaauugucaucucuuucaggaaaccuuugauacuuuuauucccuaaauuaguuaacuauauguguaucugugacaucuagugcauaauucuauccuaaaggauaccacacuuauauuacaacugucuguuuaugaguuuaucuuccucacuaggcugaguuccuugagggcacaaaucaugucuaauuuaacuguauauucccuacauggaauauacugccugacauauagcagggguccaguaaaguucuguugaauuuaggcaaagucauuaacucaaauuucccuuuuucaugugguugcuguauauacaguauauuuugauuuuggcaaaauauuuggcugagugauaucugaaggagauucagugggcugcuuuaaauggauaaauaucauuguugaguggaagagguagguuaaguaguauguguggucagaauucccuuauuaaacaacaaaaaaggcaacugauuuuuaugcauaaaagagcuuguuucagccauaugagcucuuaaaggaugacaaauuaaaacaguaguguuucaucguguucuaucuauagaauggcagcaguuauaaggaaugauuauaucuaguguuagugagaauguggggaaaugguuacacucggauauccacuccuaguagaagugaauuuuggagagaaauugggcaauguguauaaaaguguuaauguguagaccuugacaagguuuuucaguucuggggacuuguccuauagaaaugaaguaaaaaaaggcuuaaauaacaaaaugcaagcuggggguggugagggugccuguauucucagcuacuugggaggcugaggcaggaggaucacuugagcccaagaguuugaggcugcagugagcucugauuaugccaccagacuccagccugggcaacacagugagacuccaucuuaaaaaaaauaucauggcucaugccuguaauccuaacacuauggauggcccgugugggaggauugcuugagccuaggaguuugagaccagccugggcgucauagggaaaccccaucucuacagaaaaauuuaaaaauuagccagauguggugaugcauaccugugguccuagccucagccuccugaguagcuaggagcuacucgagagguuaaggcugcagugagcugugauugcaaaacuacacuugagcccuagaggucaaggcugcagugagcugugaucacaacacuacacuccagccugggugauagagcaagauccugucucaaaaagaagaagaagaagaaaaaaaagaaaguggucuaaugcauuaaaagauaagagaagugcaaauuaaaauuaauauacuauucuucacauaucaaguucugccaauuuucuaacaguuugacaauguacucugaugugccagguguggggaaacgggcacucauauauugaugcagugaauguaaaauagaugauccuuguggagaauuugguucagaaauuccacucucaggaaucuaucccaaagauacacuagcaaaaauaugaaauaugcacaaggcauuguagcacaguuugcaauauuaauagacuggaaauaacccugaugucuauugguagggacaugaguaugguguacauccacacagucaaguaugccaguuuaaaaaguaaugagccagcugugguggcaugcaccuaaauccuagcaacucaggagacugaggcaggaggaaugcuugagcccaggaguuugaguacagccuaggcaacauuaaaaaaaaaaaagaggaauaauguuaggcuauuuauuugagauacuauuauuaugauuauuauuuuagagacugggucugacucugucacccaggcuggagugcaguggcaugauuauggcucacugcagccuggaacucaagugauccuccugucucagcuucccaaaguacugggauuacaggccugagccaccaugccuggccucuucuuuuuuaauguaagaauuuauugcuaucaacauucuucuuagaacugcuuuugcuuucguugcauccccuagguuuuaguauguuauauuuccauucucuuuugucucaagauacguuucucuuuugauuucuucucaaccaaucuauugguuguucaggagcagguuguuuaauuuccacaucuuugugauuuuucccugaauucccucuguuacugauuucuaguuuuuuuaccauugugguuggaaauaauacuuguuaugauuucaguuauaaauuuguuaagacuuguuuuguggccuaacaucugaucuauucuggagaauguuacauaugcaauggagaagaauguguauucugcuacuguuguauggaaaauugggcccauuugguccuaaguguaguucaagccuaguauuuccuuauuacuuuucugucuaguugauguauccauuguugaaaaugggauauugagguccccuacuauucuuauauugcuaucuauuuucccccuucaugucuauuaaaauuugguuuauaccuuuaggugcucugauguugagugcauauguauuuauaauuguuauguccucuugauggcuugacccauuuaucaucaaauaauggccuucuuuguuucgugugacaguuuuuagacuuuauuuugucuaaguacagccaccucugcucuuucuugguuacuguuuacauggaauaucuuuuucaauucuuccacuuucagccuguauguguucuuaaagcuaaaaugagucucuugugggcagcauauagguuggaucuuaguuuuuuuuaauccauucacccacucggugucuucuaauuggagaacuuaauccauuuacauucaagcuuauuauugauagggaaggacuuacuucugcuauuuuguuaauuguuuucugguuguuuuguagagcccuuguuccuuucuuacucuuguuuuccuuugugauuuggugauuuucuauaaugcugagcuuugauuccuuucucuuuauuauuuguuuaucuggggugguuuuuugcuuugugguuaccaugaggcuuauguagaauaaauuguaguuagaauagcuuauuuuaaacuggcaacaacuuuagauguagaaagaaauuuacucaacguaauaaagacugcuuaugaaaaacccaaagccagugucauaaucaguguggaaaaaugaaaacuuuuucucuaugaucuggcacaaggcaaggaugaccacucucaucacuucuauucaacauaguaauggaagugcuagcaagagcaagcagacaagaaaaaaaaaaggcauacaauuagcugaaugguagaaguuauguccauuugcagaugacaugaucuuauauguaaauaaccccaaaaacucuacaaaaaaaacuuagaauuaauaaaugauaucaauaaaguugcaggauaaaaaaucagugcacaaaaaucaguugcauuucuguacacaguaacaaccuauccaaaaaaucaagaaaauaaucccaauuuacaguagcauaaagaauacuuaauaaauuagccuagcgugguagcccaugccuguugugucagcuacucgggaggcugaggugggaggauugcuugagccauggaggucgaggcugcagugagcugugauugugccacugcacuccagcauggcuuacagagacccugucucaagaaaaaaaauacuuaugaauaaacuuaaccagaaagaucuggacacuuaagacuauaaaacacugaugaaagaaauuaagaagacacaaacauaugggaagaucuauccuguguucaugauuuggaaaaauuaauauuguucaaauguucauacuacccaaaacaauaugcagauuuaacacaaucccaauccaaauucuaaugacauucuucacagaaguagaaaaaacaauucuaaaauuuguauguaaccacaaauacccugaauauacaagcaauccuaagaaagaaaacauugaggcaucacacuuucugauuucaaauucuauuaaaagcuauaguaauuaaaacaguauggugcuaguauaaaaacagcagaucagaauugagagccuagaaacaaacccaagcauauaugaccaacuaauuuuugacaaaggcacuaagaggacacaguggggaaaagauagucucuucaauaaaugguucugggaaaacuggauuuccacaugcaaaagaauggaaaugggccgggcgugguggcucaugccuguaaucccagcacuuugggaggccaaggugggcagaucacuugaagucagaaguuugagaccagccuggucaacauggugaaacccugucucuacugaaaauacaaaaaaauuagcugggcaugguggcaugcaccuguaaucccagcuaccugggagccugaggcaggagaaucacuugaaccugggagacagagguuguugcagugagccgagauugugucacugcacuccagccugggugacagagugagacucugucugaaaaaaaaaaaaaaaaaaaaaggcaaaggaucugaauggguguuuuuccaaagaagacguaaaaauggccaacagguacaugaaaagauguucaacaucaguagucacaagggaaaugcaaauuaaaaccacaaugagauauaucaccucaugccuguuaggaugacuucucuuugguaagagauaacaacuguugguacaaauguagaugaugcagccauugugaaaaauaguauggaaauuccuaaauaaaaguagaacuaccacaugacccaguaacccccauucugaauauauacccaaaggaagugaaaucaccgccucagauaccuguucauugucgcauuauucacaauagccaagauaugaaaacaaucuauguguccguugacagacaaaugaauaaagaagcuguggugugcauacauacacacagaggaauauuauuuagccuuauaaaagaaggagaucuugccauuuaccacacauggaugagccuggaugacauuauauuaaguaaaauaagccagacacaaaaagaaaaauacugcucgaucucucuuauauauguaaucuaaaaaaaaaaaagucaaguacacagaaacaggauaaaauagugguuacuagagguggugguggugguggugaugguagaggaaagggggagguguaggucaaaggauacaaaguagagauacauaggaugaacaagucuagagaucuaauguacaauaugagaacuaugguuaauaauauuuugcuugggaauuuuacuaaaaggaaauuuuaggugcuuuugccacauacaauggccaacagguauauaaaaagauguucaacaucacaaaaagagaggauagcugugggaugauggauuuguugauuugcuugauaugguaaccauuucaccaucuauauguauaucaaaacauuauguuguacaccuuaaacauauacaauuuaaaaauuuaaaguaaugaggaagaucuguguaaucuuuuccagacacaccaugaauggaguuccaaucuuggaaugccacuuuuucuggaccuaacucuugaaugaccauguuaauucauucaauuuuuuuuucuauuauuugucauaguuguugaaagccaaagagcugcugagaacuguaaauuuuuucucacugucagagugcccaugaugauaucauccuguaccacagaaugugaauuacauuugaaauuggcagauugagguacuccauuuaucaaaacaucuccagauaaucauguggaucuuuucuuugcagcucagacaucuaacaaccaugguuugccuccaccuguguguaccagaauggcguugaggccagguuucauuacuccuuugauauucauuaauauuucuuuuuaaacuguuuuuugaucaaguagaaagccacucuucaguuuuacucgauagcagauauuaugaaaacaacacagcuccccaguaaaugucuucaggucguuguagguuguccuggguaggucauguuguuucaucauugguauuucuuugugacacugggauaaaaacuuggacauuacugggagacaucuggagaauuucugccuguuuuuauauaauaaaccaguguuuauuauaaaggauaaacagccagaugaagagguaaauagggcgaggccuggaaggguccugagugcaggagcuuccgucugcauggaguuggguugcaccacugaauguggauaaauucaccaacuugaaagcucuucuaggcuguguuguuaagugauaaaaacaaguuguagcugggcgcaguggcucaugccuguaauccuagcacuuugggaguccggggugggcauauugcuugagcucaggaguuuugagaucagccugggcuacauggcaaaaccccaucucuacagaaaauuuaaaaaauuagccaggugugguggcaugggacugugguuccagcuacuugggagccugaggcaggagaaucgcuuaagccagggagguugagacugcauugagcugugaucgcaccacuguacuccagccugggucacacagcaagacccugucucaaaaacaaacaaacaaacaaacaaacaaaaaaaaguugcagaagaagaauguguauuuuuuucuaagaugggggcaacauacaacuauauguauauguauuuccuuauguuuucaaaaacaaauaauggaagguuaaaagcuaaggagaagaauguuauaauauccauauccuuaguuauacuguuauucguuuaaaacuauuauauuuacauuguagaagaaagcaaauauguauauaugugaauauuauuaagauccaggauuuuccacaacaagaccgaaaaauacaaauauagaauuaaaguuagguuaaaaaucuuguaaucugggcuaggcgugguggcucacgccuguaaucccaggacuuugggaggcugaggcgggcagaucacgaggucaggaguuugagaccagccugaccaacauggugaaacccugucucuacuaaaaauacaaaaauuagcugggcgugguggcaugugccuguaauccuagcuacucaggaggcuaaggcagaauuacuugaacccaggagguggagguugcagugagcagagauugcgccacugcacucuagccugggcgacagagcaagacuccgucucaaaaaaaaaaagaaaaauccuguaaucugaauuagaaguauuugcaugaauucauuuuacauguauauuuuuauaugugauauuaauauaugacauuuaggauauauauauauucgugugugugugugugugugugugauauauuacauugauuguggucuuuaaauacaauuucuuuuuuuuuuuuuuuuuuuuggagacagagccucacuccaucacccaggcuggagugccuuggcacgaucucagcucacugcaaccuccgccuccuagguuccagcgauucucaugccucagcuucccaaguaccuaggauuacagaugugugccaccaugcccagcuaauuuuuguauuuucaguagagaugggguuucaccauguuggccaggcuggucuccaucuccugaccucaggugauccaccugccucagccucccaaaguguugggauuacaggugugagcuaccaugcccagccuuuaaagacaauuucuaaugaaaaagaaccaggacuccuuagagaaauaguugauuccaagugugggacaggcauuuauaagauuuuaaagcucagaacuuaugcuauaagcaagaccaguggugucaucuuaaaaggacacaagagccaacuuugaggagcucccacaggccaaaauuaggaaaacuugaagcacauaaaauaugcuaaaauucauguguuucuaacgauacuucaaagaacaaaucauugguuaccuuuggagguuguuaugauucuaagucaguuggugaaggaucaagucuuuauccugcuuuucucuuaugacugugucagaguagccaaauaguugaugaggggaaauuuuguuuuuaguagaauuccaacuaagaacaacuguagaaagugcuagaauuggaaaagucauuuucuaguuuuuaaugaaauccuguaucuauuuuagacaaugaucaugaaugccugcuaaagccacuaggugcaggguuaaugaggagcuugaugguggauuaggcugaaaacaugaaccuaaucuuuuuaucauuaaacuuguaauaaccauagauuaugugccucuuaauguaauacaauaggaauuacauauguuacuucuggaauauucuugcaagaacaaaacugaaccugaauugagucaagccucuagaucaacacaguccaauagaauugcuuugauggugaaaaugugcucccuggcaacaguagccauuagcaacucauggcuauugaguacuugaaauguggcuaguugagauggguggaccgaauuuuaaauucuuuuaaauuuaaauuuagcuacguguacuaguaauuacuauacuggacagugaagcucuacaucuaugaccgguuuauaggaaauauagugcauaaaauaaucuguuaagugauaccgugaaaaggcagucagccaaauucagaauguuugaaaagucugcagaucaguuuuuuaaaaugucaacaaauauauuguauacagacccaugguggugaggauugauguagauuaagagauuauaagguaaauuuagugugugaacuuuauuuggauucugauucaaacaaaccagcuccuaagaagaaauucugggagacaacuuggagaaauuugaacaugggcuggguaugagaugauauugaggaauugccaauuuuguaggagugauaauguuguuguaccuguguugaaagucuucuucuuuagagauuuguucuaaaugaauguaaugguagauacaaugaugucugggcuuuguuugaaauaaucuguuggugaguggggcaagaagguagggcauggaggaaaccaggccaaguaaaaucuuguugaaaacauagguagggugcaugagucuucauucuacugugaucuaauuuugugauuuuguauauguuuaacauuuucuacaauaaagguuuuuaaacagcaguaauuaguuaaaauauauaaagaauagcaaggaauaauuuacucagaauuuggaacagggaauauaggauaggaaagggcauuggguaggggaauucuaaaguacuaauaauucaccuaguuaguagguaugcagguauuuguauuauuaauauuuuagcucuguaucuucuuuucaugcaaucuuucauaugugugguuuauuucacaauaaaaagaaaaaaagagcucauuguuacuauguaaggccucuuacagacuccaguuggaggagcacacuugaaccucaugguguuacaaaguagccucucuggucuguuucucuccuagacucagagguccccuuguuuuucuuucccuuuacuugaaugcaucauuguacuuucugaaaauuaucuucucugcuuagucaucugcuuuuauguggccugugaaggcuucucccaaaaggcaggcucagcuccuaaacugacaaaguucuccacagucuguuuccgucuuggauaccaacuccagauuuuacggaagagaaucggacugacuuuugggcaggugcucaccggaaaccaaugaacuauggccaacacaauguaccuugaucauaggaacugccacuuccaaggcuguugaggggggagguucuuaagaaaauguuguagauaaugccaauagaacaucauuaucucuaacagucuauaacaaucuguaauuguuauagacagcaucauugccuguaacaaugaaagauuuggaauaagcacuagcucuaccaguagaagguuaagaauuggugggacaacguaugggauaauauguagccguuuaaaauuaugauauagcccuaucuuuauugacucugaaaaauguucauuaaaaguguuuauuggccauggugggucacgccuguaaucccagcacuuugggaggccgaggcggguggaucaccugaggucaggaguuugagaccagcuuggacaacauggugaaaacccaucucuacuaaaaauacaaaaaauuagccgggugugguggugugugccuguaauuccagcuacucaggaggcugaggcaggagaaucgcuugaacacggagacagagguugcagugagcugagaucaugccauugcacuccagccugggcaacagagcaagacuaugucucaaaaaaaaaaaaaaaguguuuagugcauguccuuucagaaacacacacacacacacacaauacauauacauuuguauuuguaugcauauauguauaaauguauuucucaagggauauacaucaaaauguuaacaguuggccagaugcugugcuguaaccccagcacuuugggaaggggaggugggaggaccgcuugagcccaagagaucaagacuagcuugggcaacauaaagaaaccucuugucuuuuuuuuuuuuuugagacagaguucuuccuucgucacccaggcuggaguacaguggugcaaucuuaccucacugcaaccucuuccuccaggguucaagugauucuccugccucagccucccaaguagcugggauuacaggugcucgccaccacaccuaccuaauuuugguauuuucuaguaggacaggguuuugccguguuggccgggcuggucuugaacuccugaccucaggugauccaccuuccucggccucccaaagugcugggauuacaggcaugagccacugcacccagccaaccuugugucuuuuuuuaaaaaguuaacagugguaaucuuugguuagugggguuacgguuaguuuguuguuguuuugcuuaucuguauuuccugauuuauuuuuuuuacagugaacaauggauuaucuguauauuaaaaauuauuuuaaaggaaauaaagucuggaaggguagaugcaaaauguuuucuuaucuguacuuuuuucuacaaugaacaaagcauuauuaguauaauuucaaaaaguuaauuugaaauaaguaauaggguauauaaaguccugguuuuaaguuaaaaaaucaauuauuuuccaaaagucuauuuuaaaaauagagcauaggagagagugggcuuagaaaaaguuuauuuuuauaagcccuggagaucuugauugacuuauuuaggccaacaguaaguuugcaguuaagaaaucuagugccugguuaagguauuaugucaagaaauauuguguccuuuuuaagagguuauugucaguguagucugcacggauuggaacacaccuggaaaaguuguucauuuuggcuccuuucuuuaaauggaacaaacuaaguggagcggcuaaagggagccagcauggucacaggcuauauagugugaagaugaccagccugaggagaaggaacuuguggaaaugugacagccagcugucaauaugggaaaggauauugucgggaguaguggucaaagaguagaauuuauuagaaagcacacuucacuuaggucaacagaggggagaacuuucucuuugcauuuucccucagugaaugggccucuuuacagaguggcagagacuggggaacaguguuucuuuguugggagaaaaauuagauggcaggagcucuaaggucuuucugccugugagacugaauugacccaaagaaaaauagaucuuggaugggcacaguggcucacgccuguaaucucagcacuuugggaggcugaggugggaggaucacuugagcccaggaauucaagacaagccuuccugggcaacauagugagacccccaucucuacaaaaaaaaaaagaaaaaaaucagucuggcaugguggggugugccuguggucccagcuacucaggaggcugaggugagaggaucgcuugaaccuggaagguugagguugccaagaggccgagagucauaauugugucacugcacuccagccugggugauagagggagacccugucccccuccaaaaaaaaaaaaaaaacaaagaaaagaaaagaaaaauagaucuuguucacauauaaaacaugagacuaaauuaagcuuggauuaaaaauuuugccugucauuuucacuuugaguuugcuaccaaacucugaaacuuucaauguuugaaguuuacuuaaguugcauuuuguauugagaaguaaacuucagucuucagugucuuguugucuuacacagagggaguuuaaugaggggcugucuaaaugcacuaaaccauaugcuaucuggguguucaaggaaaggcuaaaugaauaacccacaaaacuaaguagcaucugaugguuaagggcacaacugccuggguuugaauccugucucuaugccuuaaguuccuuacugcaaaaauggcugugauaagaccagccauacauaggcuucuuuugagcuugagaacauggccuucauuaugcauuucaccuauauacuccuugagggcaccuaguuauucaguaaaucauugguaaaugagugauugaauaaauaaaugaaaauacaaaaguccuuuaccugaccuuggguacauugaucugagcuuauugaauguagaagugacacuuuauacuuugaugcuaaauucaguuuaucuuacaucccacucugcccucuauguucugccuaauuuaaccaucugcuuucugaggaauaugauuucuuucuuuuuauuaauuuuuuuuaauugaguuggagucucgcucugucgcccaggcuggagugcaguggugugaucucagcucacugcaaccuccaccuccuggguucaagugacucuccugccucagccuccugaguagcugggauuacagcugcgugccaccaugcccggcuaauuuuuauauuuuuaguagagacaugguuucgccauguuggccaggcuggucucgaacuccugaccucaagugauccgcccaccucggccucccaaagugcugggauuacaagugugagccaccgugccuggcccuauuuuuuuuuuaauuuuuaaaauuuauuauuauuauuuuugagacggaguuuugcuguuguugcccaggcuggagugcaauggugugaucucugcucacugcaaccuccgccucccggguucaagugauucuucugccucagccuaccaaguagcuaggauuacaggugugcaccaucaugccuggcuaauuuuguauuuuuaguagagaugggguuucacuguguugaucaggcuggucuugaacuccugacucaccucagccucccaaagugcugggauuacaggcaugaaccacugcaucuggccuuaauuuuuuuuagagacagggucuugcucuguugcccaggcugguuuugaacuccuggucucaagcaauccuccugccuuggccucccaaaguguugggauuauaggugugagccacuucaccuggcagaaauaugauucuuaaauuaggauuaauuuuuggagccuuguuuuagaaaugauuuauuuuuuaugaaugagauaugacugucugagaauacuuggaugugaugacuugaauaauuuauguguugggccucugagaguauaaaguucauaccagaauauuuuugggaagaauuugguugaaauugcuagauuuuuuuaaagguacaagauaauuaugauuguauucccucucagauauugaauucuuucuuucuaugguuuucuagagaaugaagaucuagaaaacaaggauaccucuuuauuggcuucugccaccgauccagaacccugcuccucaccccacagguaaccacuuuggauagaaugcuuucacagguuuuaucuucugagaugaggaacuggugaaagaaauagguagugacuuuaagcggggaggcaaguuaaaguaaagaaugugggccgggcgcaguggcucacgccuguaaucccagcacuuugggaggccaaggcggguggaucacgaggucaggagaucgagaccauccuggcuagcacagugaaaccccgucucuacuaaaaauccaaaaaaaaaaaaaaaaaaaaaaauuagcggggcgugguggccagacuacacgccuguaguagcugggacuacaggcgcgcaccaccacgccuggcuaauuuuuguauuuuuuaguagagacgggguuucaucauauuggacaggcuggucucgaacuccugaccuugugauccgcccaccucggccucccaaagugcugggauuacaggcgugagccaccgcgccgggccagggauuuaauuuuuaacuuuuguuucuaacauuugcugagugaagauaaaaauccagugaaugugaugccugaggcuuacuucuuaugcuuaugugucuauuggaaauggaaacggcacaacuuucuaucuuuucuagugaggcuggcuugccggccaggcucuccccuuccuuugagauggccucccugcuccaggucaguacaaaccagaagcuuaaagcggaggcuuuuccuuuauguggcuuaucaccagcaucaaauaauuugaaauuaaucuuuccccaaaugcccuuuucuaauucuccagagcauaaaaugcuaauugugaauauuaaauuuauguggguggcacauauccuguuuaacauaauuuuauuauuuaauuauuucuugagacagagucuugcuuuguugcccaggcuggagcacgguaggcagucauaacucacugcagccucaagcuccuggaccaugcaacccucccaucucagccuugugaguagcuaggaccacaggcaugagccaccacaccgagccuuaaaauauguuuuuuaaauaagcagaaccauguuuuuucagaguagcaugcacaaagacaaagagacaauuuuagaugucacacacaguaagucaagcuaaugauucagauagccuguuguagucucaccuuuccaauauuauaaaugauagucugauccagaauuucucuuuuauucccaggcaaaaauuaacuuauucauuuuuuauucaacaaauauuuuggggcuaauauuuauucaacagauguuuguugggagccuaccauguaccugauacuguucuagguacuaaagaaaccacaaaugaacaaaauaguccaucacugcucucagggagcuuauguucuagugggggaaguggacagaaaacaauuacacaucauacuucacagacucuuaaguugccgucaacuguaaguugugcuuucacgucccaccaagagaggaagaaaugcuuaagauggaucaucuaauagaccccccauaugcaacugggauaccaaaaaccugcaccuucagugaaaauauaaagacaaaaaucccccacacagaaaaggacagcaaggaagcuugauugucucaaacuugacacugugucauaggaggaaaaaauaucuccccugagaauaggaaccaccaguugguauuagccagugucuugucuaaauucacucugccaggaggauuaaacaaaacccuaaacagagaacuuaauuucaagaagucucagauugguagcauuccuaaguacuggcagaagcaaaugcaaaucucucguggaaagaguugaugucaauccaggcccacggcacuuuuaagauaucaucaauuuuuaagacauccuaucuuucaguuguguuaaaaucuaaaagccagugugcaucuugcaaucaacaaaauaugcuccauaucaugucaggcaguaauaggugcagugaagaaaaaugaagcuggguaagggcagaaacagugacaaggccaggaaggggcacacauuuuauauacagaccucugagaaaccucucagcagaaaaccugcaggaaggaagucuucaguuaacuaaagaagaguuaauguccuagaagaguauucuaggcagagauuacagcaaaugcaaaagcucucaagugggagaguacuugggguguuugaggacuaucaaggauugaagaggcuguuguggcuggagggaccagggcagagugaggauucugagaggugaggucagagugcaaagggccuuagggcugggcgagguggcucacgccuguaaucccagcacuuugggaggcagaggcggguggaucaucugaggucagaaguuugagaccacccuggccaacauggugaaaccccgucucuauuaaaaauacaaaaaauuagccaggcaugguggugcacaccuguagucccagcuacucaggaggcugaggcaagagaauugcuugaaccagggaggcagaguugcagugagccgagauccgagaucaugccacuacaccccagcuugggcgacagagcaagacucugucuccaaaaaaaaaaaaaaaaaaaaagggccuuagaguuccagguggcaggcuugguucccagugcugugcauacagaggcagugagacccagugccugccaccaagcuuacuuucuaguagaggaggcagaugauacacagugucaagaaacagaaauggacuauaauuucuggguugaagagcauuaaaauagacccacagccuaggccaguuuacagcuuacacugaauuacccaagugaaccuauaaagaucaacagaaucccacagcucugauucuuggagugaccuccucuugucuguccugagguagguuggaguaauuuuggauauuccaaaagauggcucuguuuuaucugaaggagugauucuucuuguuuauguuaaaaaagaaaagaaacaaacuaauaaacucuaaaaugaagccuccguuucccccaugagguguauacuaccauuuuccagucauuuacucaaccucuuugaggaaaugaugcccucaagcagggauucucagaccuuuauacucuuaaaaauuauuaaggacccaaagaauuuuuguuuguguggguuauaucuaucaauauuuacuauauuagaaauuaaaacagccgggcgcgguggcucaugccuguaaucccagcacuuugggaggccaagguggguggaucacgaggucaggagaucgagaccauccuggcuaacauggugaaaccacgucucuacuaaaaauacaaaaaaauuagcugggugugguggccggcgccuguagucccagcuacucgggagggugaggcaggagaacggagugaacccgggaggcggagcuugagugagcugagaucgcgccacugcacuccagccugggcgacagagugagacuccgucucaaaaaaaaaaagaaauuaaaacugaaaaauuagaauaugguuauuuguucauuuaaaaauaauaacucaugacaugcuauauauaaaacauguuuuuacuuaaaaacaacuaauuuucaaagcaaagaauguaguacaaagagagacauaaaucucuuuaauguuuggcuuaauaaaaggcaguuggauucucagcucugcuucugaguucauucuauugcgguaucacaugucauauagucucuggaaaauuccacugcacacucuugagaaaaugagaaugaaaaaagggaaauaacauuuuaguguuauuaugaaacaguuugaacuucauagacucccccgaagggccccuagaccauacuuggauaacugccauucaaaaaaauccaugucaccuuuuaucagcaacagauucccaaaaggccuggguuauuuugcuacaaccguggcacuaauuuucuaguuuuugugaggccaggggaaauggaagagagcauaaaucauucccuugcaucuuuauaaucaacuauucauggcugagcacgguggcucacgccuguaauccuaguacuuugggaggccgaggcaggcagaucaccugaggucgggaguucaagaccagccugaccaacaacauggagaaacacugucucuacuaaaaauacaaaauuagccgggugucguggcacaugccugugaucccagcuacucgggaggcugaggcaggagaauugcuugagguuguggugagaugcaucacuggugcacucugccaaaaaacaaacaacuauucacauagcuguguuugaagccauugggauuguugauuaaugugcuuuaaaaaggagagaaagugaugaccccuagcacugaacggggacaggguaugaaacggaucugcugaaagacugccucagggauaacugcagagaggguugccuugaucaucauuuuguacuuuguuuuggugcccagucucccuuaggcagaccuccuccuuuugcuucuagccaguggcuuuguguguagaacugaacugagauucuaccaauuccucgguuaaaauucugugggcccugugggccgcagagugaggaauaacauuggaacucacagaagccgagggcaggauggugguuaauagguguuggggccagggggugggauggggagauguuggucaagugguauaagguguuagaaggaggaacaaguucuggagaucuuuguacaacauggugacaauaguuaauaacaauguauacuugaaaauugcuaagacaguagauuuuaaauguucucaccacaaaaaggaguaugugaggggauggauauguuaauuagcucaauuuaaucauuuuacaauguguacauauaucaaaacagcacauuguacaccauaaauauauacacuuugucaacuaaaauaaauaaauaaaagaaacaacaaugacaaaaaaaaaaaaaaaaaaaaaaaaccagaccagcaguccaucucagaugauggagcuguguguuuuccaugguucuccuagccuuugaccuggccuuguuagucuuuguuuucacacugucaacacuuuacuguggaccaauucagcccugggcaguggucggcuaaggugacaguagagcuaaauaaaugccaggggcagguggggcaggggguaucucgaauguuguuuuauuucaaaguuucuccaggaugauugagucuuuucaaagaguccuugaauuaacaugcucucuuccucugagaggccacagaugguaucuccagugaguaaggaugccacggaagaucugcggaaagcaacugguccuuuggaggcucaggccuuggugaaacaggauuugcugccugcagaccaggcccagguccucaaugagguagggggcagauucuggcucuuucuuaugaaaggaggcaccagaauguggacacauagugguuggguuggaauuagaaagcacugcgaggguggcucccggaauucucucuuugcccucuaauuuagggcaucuuggucuucauuauuuuuuggagaaugauuauuuguaucuuccacagggcccaucauuguacuggcacccaguaggcaccgauucagaaaacgaaguguuagagugaauguucauguguucucuaaaauccucuucauugaggagccugaagucauuggacuauuuugcucuuacuuuucuugugguagaucuauuuaguauuuaugauaaagauuccacagaagcuuuuuuuuuuuuuuuuuuuugagacagggucucccucugucgcccaggcuggagugcaguggcacgaucuuggcucacugcaaccuccaccuccuggguucaagugauugucccaccucgccucccgaguagcugggauuacaggcacaugccaccacacccggcuaauuuuuguauuuuuaguagaggcagggcuucaccauauuggucaggcuaaucucgaacuccugaccucaggugauccacccgccuugaccucccaaagugcuaugauuacagaugugagccacugugccuggccuugauuuuuuuuuuuuuuuuuuuuuuuugagacaaaggucucacucugucacccggcuucagugcgauggugcagucauggcucacugcagccucaaaauccugggcucgagugauccuccugccucagccuuccaaguagcuguauggaagugaugguguaguggugccccugccauggagggaugggggcgggaugggguuguuucuaucauuuauuagcauauguguuagaauaaugguugguauuagugucaaugaagacaccaccaggcguuauaauuagauuuguauaauacuuuacaguuuacaagcauuuguaucuguaacacuucauuuacuccugagaacaaccuugucagauaggugccauugugucuccauuuaagaaaugaggaaacuggcugggcccgguggcucaugccuguaaucccagcacuuugggaggccgaggcaggcagaucacuugaggucagggguucgagaccagccugaccaacauggaaaaaccccaucucuacuaaaaauacaaaauuagcugggcguguuggcaggugucuguaaucccagcuacucgggaggcugaggcaggagaauugcuugaaccugggagguggagguugcagugagcugagaucgugccauugcacuccagccugggcaacaagagcaaaacucugucucaaaaggaaugaaagaaagaaaugaggaaacugaggcugagggcuguuagagacuuuacuaaggcuauguagcuaauauguugcaaccuaauccuuuauuuagcauuuuagaaaaggaaggauuuauuuaagcacgcuagccaaagucugauucauuucaguuagcaaaggagaugagaacuggagggcuuauucuccagaaacagauauuaugagaauacagccugggaggauuacaaacuugauuuauuuauuucucacaaauacaauuccagccucuuaacuggauugcugacucacugaugugcucuccccugugggcaauagguauaguuuucuuguugaguugccugccaacuguuuggagaaggggcagaaauuaagguauaauagcaugaaaccaggaacacuaaucugagugauuugaagggaaacucaccagggagacauuguaagcucccgcauggguuagugagggcuuugaguaucaaaugccauuugcauucuuccauguaagucagacgucuggcagcaaauguacuguuuaaaugcaaguccuggggcuggucuaaggugaaauuguaacuauugauagaacacuguuagugacuucaagacugagacaaucuguagcccgaggugggcuguggaugagagagaaagacuauaaaccagauucugucucugcagugcuuuggagagcugauugacaguaauguagaaguaacccuugagugggaauuguagcaggaggauguguggcagagugggagucaaacuaaacccuaggagcaagagcuauuaaugagaggagccacagggagguacugugcaggugagguaagaccaaggcauggcccagaaucacagucaaugcaaauacuguuaacaaccugcgaggguguuggcggacaaggaccuuauaaaggguuuggagcaggaaaguugcaaaagguaggaaacagucuuuaaacaauggaauauuuugauggcuuuaaaaaauuaguagaauuuauuagcaacuucuauuuggaagaaagagaaggaacauugacuaguacauuaagcuuugaguggggauaguggagauaauagagcagggguggggcagccuucaugcaaaaagagauuaauuagaaucugccacucgaauacuccuuuaaccagaguucuguugugcagauggcuaaguaucaaguuccacagaggucuggggacaucguuaugauccagucugaacauacaggagcuauagauguucuuucagcugauuuggaaucugcagaucuucugggggaccacaggaaaggugagaccuuugggaguaaaggaggugguuuguuuccaguagauacucaaagaaaggcaggcagacagacaaauggaaggaaagaaaaugacuugugaaaggaagucaagccaguagaaagaaugucugacugugccagccucucuuagcaaaaugcccgggguacucauguuuccucaugguuucucagugcuaagcugcuuguccuuucagucuccccaccucugauggcuccuccaugcaucuggaccuuugccaaggugaaggaauucaaaagcaagcugggcaaagagaagaacagccgucugguggugaagcguggugagguggugaccauccggguaccuacucauccagaggggaagcgugucugcugggaguuugcgaccgaugacuaugacauuggcuuuggaguuuauuuugacuggaccccuguaacuagcacugacauaacugugcaggucagugauuccagugacgaugaggaugaagaagaggaagaggaggaagagauugaagguaaauuuaauuuuaaccuaauuugcaguuuucuggcuuaaucugauuucuggugaccauuuuguggguuguaccaguccuccucuuccuuugaaugcaguugagaaacucagcauuacaagcuaagcugagugguacaggccaaagagaacauucuggugggguugauacugcugccuuaauugaaagaaagccucuuuuuccuuaucgguaccucauuguuuucccaacaccuuccugggggcagggauggggcaggagcagagagagggugagucaugcggcaguuuagagggauggucauucaggucgcauguaagccagagauuauuuuacaucucucucuuaguuuguagauauuuauucuuggccuggaaccaaagugagugauuacaguuugcuaaagguauccauucucuccuuaucccaaacucucauagcuggcuauugguuacuucuuuacuucaugcccagacaaguuuuaaaagggucuccgggcuccauuccggcuguuauuuguagugucuacacacuacacaaaggauggcccagaggcauuuuucagauaacguaagaguagguccuaagcauuagucuuauuccucuuauuccuugauuuucuuauauaaucuuaaagucaguccuuuaacgugcuucuucauagaacagcaagcgggcagggaaaccuacagguaucugggaaagcggagaaccuuguaucuuauuugcugcuuuucaggaauccuagggucacuuuauagcacguuuaucugcaauuccuaucuucguuagcuaguccuuucaccuacuaaaugauagaauaucgggaucuuuucuucuaaauaucucuuucucccucucagaaauguccagacacuucugaagcuaggaaggcuccucucaggcuaaaucauuuucucaguggagacauuauuggcauuugggaugggacauuguuuguuguguagguacuauccugauuuuagcacuccuggacccuuggguacuaaaugcagauaucaccuaauagucacugugaugaccaaaagaucaccagacauuuccaaaugucuguaggagggcaauaaucuccccgcucugugaaagccacugggucaccugguccuuccgcucaccuucaggcaggacuuacgcagucucugaacacuuugccauuuugcucacgcagaacccguuccagcuggagauguggagagaggcuccaggagcuccuugcggggucgcuauggggaggucaugccuguguaccggcgggacagccaccgagacgugcaggcuggcagccaugacuacccuggugagggcaucuaccugcucaaguucgacaacuccuacucccugcugcgcaacaagacucucuacuuccacaucuacuacaccagcugaaggacugcugggacaggggcaggcuguauuugcuggcugaagcaggcugccagcuggugccucuuguuugggauaggcaagagccaaagguucauggggggcugcugagccucacacccugucuggcaugccugacuguuggcccacguagcuuuuuccccuucuuggcuucugcagguggugguguagugccccuguucuguagucccugacucauacccuucuugcuucagacuccagcaaauucccucuugaaggcaccuauggggcacaagccuaaaaggaagcagggcgauguuuuuuaaaaauagauucaucuuggcacagguuuaucauucagauugcugcccucuccucucccacagcccuuauugccagugcauuuaguggcacccacucucuucaguuguugaggugccagaagagggaaaagcacauugcccaugaaggagccccaucuuuugguuggagaaagcucuauccagccugucaccacugccauauuccugccugcugguuauucuuggucucugcauagcugggagaccacacugccuuuggagggcuauuacuauuccugaugguagacacccccuccuuucucuuuccuaagucuauguuuuugccauuacagcaagaacauucaugcaaucucaagugaugaucaauguaaccuaagaucuugugggaagaaaaacugcccccauuauuuccuauuccaagagcugguuucccuuacuaugggcacuggcagucaaaguggagagaguggaaauuagguacugaauugaugucagaacccacauauuugaaagucguguuacuuuuuuuuuuuuuuuugguauaaucaaagaaggaaugguaucaucugacagagaagaugaaaaacaaaaaacacuccagaguccccaccgcuuuuuuuugucuuuagaguaggagugcuguuuagaaauguugcuuuggaaucaaaugcagugaaacccaaucagguuuccaaaguuucugcauuuagcuuucuugcauugagggcuuaaagcuuuugguguucaaagucccuuaguuuaggugauaaugaagcuucacuauugcugcugauuguauuuguucuuuaccugaccaaagcuugcauuucccuggugacagcauuuccuacugugucaccccugaggcucaggagugccacagagugcagguagugcugcagccaguggucaccagagcaccagcugcugggcccccaggcggaggaggagacggaggugagaugggaccucagcagucucuguguuuguaccucccugucucuuacuccucguguuaugucuguuacugccuacgaauucugaagaauaauuagauuuauuuauuacuguauuuauuuuuuuagcacauuucauuuugccuuugaaacaguuuccaucuguuucucagaaggcuucccaucuguucugagccacugaagcccccucuuuuauggaguuaaagaugauauuuuuaggagaauuugggaagcgaugauguuuuauuucuguaggucaguccugugacggcuuugcgaggaguauggcccuucagagauggaugaugccaccuuacuccauguuugggguacaguccagcacuccccaugaaaaauucuaaguugugagggaaucugcccauuugcuggagauugagugcagaggaauucccuaaccaaucagagauaucccgugauuccaggauuucagaguccuuugucuccucugaggugucaccuucuuugugauguuuccuuugacucauuguuagauuccucacaccaagggucuaucccuacaguagcauaacucaaggaacgggacucuucccagugggucccuaguagcaucuacaucacaucaaagggcaauauauccugcaccugcucuuccccucggagcaaagccccaagugggauaggauguuggggacugccagagcauucccauucucugagcagcaucauaccuccauuauuuuauauuugcaaauguguuuuguagaggauuacacuggccaacauuuauauaccuuuaaagaaauuauuuuagugacugucuguugaggcagugaagagcugauuugcugugugucaucccauuggauagcugagugaccgcucuugcaucauugaaguugaaucaugccuuagcuaacugaauauaaucuuuguaaaauaauuuucuacugagcuguuuucuagucagcuaaagccuugcuuauuuuuccuguuuauuauuaacuucugccuuucucucaaauugaaacagucaggccauacacagcaagcucccaaggauaacacuuguuauuauuuauuuucaccaugagauucucugcuuauuuucuuuggaauccuaguucuguugcaucagggaagccuaagggacuuguuccccucaccucugugugccucuuagggucuggucacuuuugaaguccugggcaugguuacauuucauucauacugguuuuucaccaacugucaggguuucuguguuccauuagcacaaaauagcuaaaagaagauauuuucacugucuaauucacuauuuucauguuacauuucugaaauaauugaacuuuaggggcaagauacuacuuacugaagcacagguaauuacugagaacccacagcccagcaaauucuaagagacagucauuuccucagccccucccaguccaaauuuauagacccaaacaaugaaaugaaaaccguuugcuuugauccucacccuguucucuagagcacaaacaaauaguaacaaacaauugaaagaaagugcuucauaguaggagagagauuggaauucucuauagugacugaguucuuaaauuucuuuaguuuuaguuuugccacuuuguugagagaugggccuuuuagaaaggaagacauauuuaaaguauugauuucuuuucccccaguguuuuauugugaaaaaauuucagcaaacagcuuaaaagaaauauaaauauauuguaaaccaaaaaguaucugagacaggucucaauacauuuagagguuuauuuugccaagguucagagcccaugauggggccucaggagguucuuagaacaugugcccgagguagucggguuacaguuuuauacauuugagggagacagaagguccaggcaaagccauaaaucaauacauguaagguauacacugguuuggccuggaaaggcaggacaucuugaagauggggguuuccaggucagagguagaucaaagaguuccugacuggcaguugguugagagaguuaaacuuuaccugaaaagaugaagucagcuuaaguuaaaguaagggaggcuuggcuuaagucauguagaugaagccuccagguagcaggcuucagagagaacagaugaugaauuuuucuuuuuaggccuuaaaaggugucagacucuccagaaaagaccuaauaagagaaggagauucucuacagaaugcaguuucccccacaagagacagcuuuguagggccauuucaaaauacgucaaauaaauauauugggggguaaauuuccuuuggggccugcugucaugugaugcuauaccagagucagguugggauuugguauuuuauugccacaaagggucuguuugguuagucuuaagaucucuguuuuaauguuaaugcuggucaguuguauuuaaauuccaaagggaagaggguaauaugaggcacccuguaaucugaccauaauaugaggcacccugucuucccaucauggacuaguuuuucagguuccuuugagauccccugggccaagacagggguccauucagccgguugggggauuuagaauuuauuuuugguuugcuguauauauauguauacacacacuccccgcauaaauguaaaaauuuuaaacuaccaauuccuaggcaaagaugauucuaacauucuguuccuuuugacaaguguccaauuagagaaugcugagaauguccccugcauaucggcucuguuggagagccccugauuuuuagcagaccuguuucauucaacauggguuacccaggagguggucuucauaaaaauguuucuuggaggccaggcgccguggcccacgccuguaaucccagcacuuugggaggccaaggugggcagaccaccuuaggccaggaguucgagaccagccuggccaacauagugaaacuccgucgcuacuaaaaauacaaaaaauuagcugggcgugguggcgggcaucuguaaucccagcuacucuggaggcagaagcagggagaauuucuugagcccaggaggcagagguugcagcgagccgagaucaugccacugcacuccagacugggcaacagagcaagauuccgucucaaaaaaaaaaaaauuguuucuuggucuccaucuuucaagaaaauacaucugugcuguauuuuccccuucccucaggccaugaucucugcuguuuuccuuacuaacuggcaugucaguacaagagugauugugaagcugcuccggaagggcuuuaugcuaaccucuguugcuugaugacauguccucaggacucugauauuaaaacucaauccuuagauaacagguagcuuuaucauggaaguagguagcaauuuggaauuagaccauucuuaguuauuuuuuucuuaaugaauugauacaugcacuuuaaaaaauauuuuuguuauuuugggaagaaaaacucagacuuuuaaaaaaguguauauugucccauuauaauauguauauggaagagugaaaucugaacgcugucuuauauuaagcaguagaauuagguauuaucauaaaaagucuuaaucuguagggaauaugaguuuauguuuaugaguccugcucagucccucuuugagagaauuaguugaaacccagacucuaaagucugcuuuuauauuuguuuguuaagaccacuuaucugcagaagguugccuuuuaaccccagugguucuaagguguggaauugagugacccuaauauuuacauaagagacuuguuuuaguggagcauaagggaggggcauaaguuacaccguuuugugcugcuugagaacugucuuuuaaaauugaucacaacgagggaaaacaaaauaaaauuagggggcaaaggguaggaguauggggggaggggagagcaaaccuaucgaauauaucuuagaauuuugcucagaaaucacugcugccucucaaguguugcauugucccugccuaaaccaagaaggcuaaacaaagccccuccuguuugaauucuuaagguaagaaauuucuaagcuaagaaaacacuauugccuaaaaccaaugauaguggagcucauuuacaaauaggcaugccucacacacacaguccaaaggcaagacacuggcuuugaaauuaggcucaugaugugauuccuauuauauguaccugauuuuuuuaggccccagguauguggaccagaguuaaugucaugacucuucaaagauaugaugaaaaguugcccuagaaaucuagagaugcauguuuauuuaauuccauaguuuaaaaaaaaauuuaagcagguaguuguggcuuaucugggggcaaaauaauauaugugaaauugcuuccagaggacaaaguauauuuucuaaaguccugaaauaggaucaugaacccuucugaaguuuugguuugaaauauuauaguauaugauauuaccaaagagcccuuaauucagaguuuaaggggcucucuuccugaacucucuucaucacucaggguugaauguguaauguuccuugcuauugauuguuauuguugauucuuaggaucaggccaagaaucaucuggaaaacauuaucuuaauuccgucucucauauccuaaacaguacauuuuacuaagaaauuccauaugaaaaacuccacucaugucuccugagauuauccuguaagugaaguagcuuucauuuaaccaagcuaaauuauuuccauuuagccauguuaaagagaagccaagucuagagaaagcaauccuguaacccaugaaucugguguacccauuuucccuuaacguaacgggaaguguuuugaaauucccagaagagagcuguuuuguaaucaaagugauggauuauaagaaagccagacuuuggaaaaggauaauuggaauaaagggaggugcuugaagauuuuccaaacuacuuuaugucauuuagcuucuauuuucugaagggcuuucuuuggugccauguacucagaucagucaguugacugaaagaugaucauguuuucuucguaaagauuuaagcaauuggcaacuacaaagacauuauuuucuuacuguucuauaucauguacuguugcugacauuacaaaaagggucuggaagggaaaccgugucacuguuuuaucuuuuuucuuuaaaauacaaaaguaucccaacuaaucauuuauuauggucagcuuguuuuacauguccccuaucaugagaaaugcuaucaacaucugugauuucuaagagucuuaccaaauuguuacuuuaauucuuguguccugcugagugguuuuucuuuuaaaauaccauuuuuaucacccuguggcacuggguguguuacugcgauuacacugaugauucugagcugugcuucuucaaguagcucaguucuugcguuuuauauuagguaacaguuuugugaugcuuuugugcauucuuugucaucucuucugaguuuucgaaucugucauaaauaaacuuuuucacuaugcaccugguaac

SEQ ID NO: 17120 - RNA, 488 nt, Homo sapiens
caggaauccuuguuucgggacacccaguggacagcgaaaggagagagaccaccacaggcaaacggccggaaagccgcgcagucgcagcccgcgcgcuucacuccgcccaaauaagccacuaccgucaccaaccccaucucguucgcccgagccgcggaccugagggagcgcuguccgcuccccgcaagaugcucacgcgaaaaacccacucuucagugucugagaccacuccgcagcuuucggccucggugagcgggugaacuaaacccgggaaaccgcugaaagaccccagcuucgacuaggccuagucguagcggcggccagcgggagggcguagccguagucuuggcccacgucauucugugccccgggucaggucaccgcccggaggguaugggaagagaaaugaagaagacugguacucccagacccuuccguaucgaggaccccaaucaacaacccaccuggugagcgccaucuucuuccgc

SEQ ID NO: 17121 - RNA, 488 nt, Homo sapiens
gcggaagaagauggcgcucaccagguggguuguugauugggguccucgauacggaagggucugggaguaccagucuucuucauuucucuucccauacccuccgggcggugaccugacccggggcacagaaugacgugggccaagacuacggcuacgcccucccgcuggccgccgcuacgacuaggccuagucgaagcuggggucuuucagcgguuucccggguuuaguucacccgcucaccgaggccgaaagcugcggaguggucucagacacugaagaguggguuuuucgcgugagcaucuugcggggagcggacagcgcucccucagguccgcggcucgggcgaacgagaugggguuggugacgguaguggcuuauuugggcggagugaagcgcgcgggcugcgacugcgcggcuuuccggccguuugccugugguggucucucuccuuucgcuguccacugggugucccgaaacaaggauuccug

SEQ ID NO: 17122 - RNA, 14153 nt, Homo sapiens
acgcacgcuuuguugucgcgcuuugccuccguccuugccccuacucccgccuuaccugacuuccuuuucggaggaagauccuugagcagccgacguugggacaaaggauuuggagaaacccagggcuaaagucacguuuuuccuccuuuaagacuuaccucaacacuucacuccauggcaguucccgagacccgcccuaaccacacuauuuauaucaacaaccucaaugagaagaucaagaaggauggugaguucucgggauaguccggaguccagacugucccgcacgggcuggccccucuuccguccccugcacccgccucucuuucuaaguguuuguccagccaaacuucgaguuaacuccuuggccuuuacacaaacuacuuccugucuucaacacuccauuaguucaucuuacacucugcccuuuaacguggucacugcugcucaucuuacaagguuugaggucacaggacccuuccuccaggaagccuugccuugucccuucacguggcugccgcugacuugccguacgcugagaccaucucccaucaagcccugauuccucugagcugucguggggcucucucuccucccaguggccuuugaacuccgugagggcaaggacuggggcuuucuuggucaccggcuuuuucagugaucagcccacaaugaacauguaccauaaugguggcuaacgcucuguaucaugggcuggucugugugcuuucauauaaaucuugauaacauuuaauucucacaacaaucuuguaggaagaaggcuauuguuauucccauucgucaacuaagaaacuggggccgggcgcgguggcucaccccuguaaucaaucccagcacuuugggaggccgaggcgggcggaucaccugaggucgggaguucgagaccagccugaccgacauggagaaacccuuucucuacugaaaauacaaaauuagccgggcaugguggcgcaugccuauaaucccagcuacucgggaggcugaggcaggagaauugcuugaacccaggagacggagguugcagugagccgagauugcgccauugaacuacagccugggcaacaagagcgaaacuccgucucaaaaaaaaaagaaagaaaagaaaaagaaacugagacaggggugaugugacuugcccagggucacauagcaaguaaagugguugaggccacccguauagaauucugcuuaggaacccaauuuuuggccgggcguggugguucaggccuguaagcccaacacuuugggaggcugaggcaggaggaucacugaaacacaggaguucaagaucagccuaggcgacaaagccagaccuuuucucuacaaaaaaaaaaaaaaaaaaaaaaaaggcugggcguggguggggugcgucuguggucccagcuacuugggaggcugaagugggaggaucgcuugagcuagagagguugaggcugcagugagcuaugauugcaccacugcacugcugccugggcugagcaagaaccuaucugaaaaaaggaaaaaaaaaaagaacucaauuauugaaaucggaaagacucucucacauucucaaguaaauuaucaccuuuauugaaccucauuuuccagaucuaaaaacugagcaaaaucauaauaccuuuuuugcauggauguugggggagauuaaauuagcuaaaccuugcaguauuucuuuuuuaugguaacuggcagcuaguaaagggcuggauaaauguuagcucuuaucacuucaagaaaauuaucgggagaaccgaaggagcuuguugggauucaguuugagguuaccagugaaguugcuguugaagaaagcaaaaccagcagccgggcacuggcucacgccuguaaucucagcacuuugggaggcugaggugggcagaucauuugaggucaggaguucaagaccagucuggccaagauggugaaaccccgucucuacugaaaauacaaaaaucagcuggauguggcggugcgcaccuacagucccagcuacucgggaggcugagcaggagaaucacuugaacccugggaagcagaggucgcagugagcugagaccgcaccacuguacuccagccugggugauagagacugucucaaaaaaaaaaaaucaggaguguaaauuuugcauauguuuuuuuuuuuuuuuuuuuuuuuuuuuuuugaggcagaguuucacucugucacccaggcuggagugcaguggcacgaucuuggcucacuacaaccucugccucccagguucaagcgauucuccugccucagccucccgaguagcuggaauuacaggcacccgccaccacgccuggcuaauuuuuauauuuuuaguagagacgggguuucaccauguuggccaggcuuuucucgaacuccugaccuuaggugauccgcccaccucggccucccaaagugcugggauuacaggugugagccaccacacccggccugcauauguuuuuagaguguggugcccaaccauuaucgggcagugcuggggacacauuggugacauagaacccugguuuuuuguuuuuaaaucuuauuuuauuuauuuauuuauuuuugagacggagucuuccucugucgcccaggcuggagugcaguggcaccaucucugcucacugcaagcucugccuugccuccuggguucacgccauucuccugccucagccucccgaguagcugggacuacaggcgcccaccagcacacccggcuaauuuuuuguauauuuaguagagaagggguuuaaccauguuagccaggaugguguugauuuccugaccucgugaucugcccaccuuggccuccaaaagugcugggauuacaggcgucagccccagcgcccggcguuuuuuuuuuuuuuuugagaugagacggagugucgcucuguugcccaggcuggaaugcaguggugcgaucucagcucacugcaaccuccgccucccgaauucaagugauucucugccucagccuccugaguagcugggauuccaagcaccugcuaccacgcuuggcuaauuuuuguauuuuuaguagagacgggguuucaccaucuuggcuaugcuggucucgaacuccugaacugugauccacccgccucggccucccaaagugcugggauuacaggugugaaccaccgcacccggccagaacccugguucuuuaggacagugacagcccagaguagucagggccaucaggcaggaagcuuaggcagaguguugagggcugggauugggaacuuagaaagacagagagauccauucagcuuccaggaaaaggagacauuuuggagagccugccagguacaguaagcaguauuuauguuacacugagggagaagagcauucuuaacuugguccagcuuguucagauguuuagggucaaaagagccuggcguauucugaguauuacaaguaguuuugaggcuuguaaaucauggggaaacuuccagugagcugugcacugguggcucauggcugugagguguuggacuuugcccugaggguguuggggagccagacugcuucccuguccuggcugccucccugguggaauauccucccagcuguggaggguaaaugcgaaugggcgaggggaggcuggagaguagagagaggcccagagucccguggaaugagugaagucugagcaagauucauggggauggaguacggagaggaaaaccagaaaugucaccaccaggagaauuuuugacuaauugcuuaaaaacaaccuugacugcugucccugcccccacccagccuacacauuuucuugcuucuuuccuagccugguaucuauuuuacaaguggcuucugcuucagcuuagcuuuuuuuuuugagauggaguuucgauuugucacccaggcuggagugcaguggcgcaaucucugcucacuguaacuuuugccucucugguucaagcuauucucaugccucagccuccccaguagcugggauuacaagcgcccuccaccacgccuagcuaauuuuuuuucuuuucuuuuuuuuuuuuuuuuuuuuuuuuggcauuuuuagucaagacgggguuucaccgucuuggccaggcuggucuugaacuccugaccucacgugaucugccucagccucccaaagugcuggaauuauaggcaugagccaccaugccuggccaguuuuuaugaagguuggaguccaguggugaggucauggcucacugcaaccucugccucccaggcuagagugauccucccacuucagccucccaaguagcuaugaccacaaggcaugcaccacuaugccuggcuaauuuuuguaucuuuuguagagacaggguuucacccuauugcccagacuggucuugaacucuugagugcaaaggaucugcccaccucggccucccagagugcugggauuacaggugugagccaccaugcuuggccaucucagccaucuucuuugcauaagacauuggugcccuuugcagaccuggguggugagagggaguccauccuuguugagcuugaaucucacuugcugucaagugaugcccuuugcuggugagauguggugguaccggguucagauggaauacguggacugggcucugccauacgcuuccuuaugcccuccagauugaugcccugggccagugaggaauccucugagaaccuguuuccaguaaaauugggacagucauaguugccaccuaauggguuuguugugaggaagugaaguuaccuccauaaagcauuugaugggggugcgaugacucaugccuguaaucccagcacuuuggggaagccaaggcaggaggaucacuggagcccaggaguucaagaccaaccuggccaacauaggagacugugucuacaaaaaauaaaaaauuagccgugcgucgugcugcgugccuauggucccagcuccuugggaggcuguggugggaagauugcuugagccugggaggucaggccuguaguaagcuaccaucaugccacugaacuccacccugagcaguagaaggagauucugucuuuaaaaaaaaaaaaaggcacuugaugguaucuagucaaauguuugcagccaggugugguggcacacuccuguaaucccagcacuuucggaggccaaggugggcuaauugcugaagcucaggaguucaagaccagccugggcaacauagcaagacccugucucugcacaaaauccagaaauuagcugggcaugguggcauacaccuguggucccagcuacuccauaggcugaagugggaggaccgcuugaguccgggagguugaggcuacggugagccaugaucaugccacugcacuccagccugggugacaaagugagaccuugucaccaaaaaaaaaaaaaaaaaauugugguggagucugugcuaggcuuggcauacugcaguaaacaaaugggacaggcuuauagcuccucaggcaagauagacaaguuaacguaccaugacaggaggugggaaauagucaugaaagaaaaggaaguagaguaagaaugacaugggaagaaauuuagacgucguggucagagguggcaacauuuccucugagacugggugacuagaaggaggccaccauguaaaccucaggggagggauguuccagguaaagagagcagccaguucaaaggcccuggggcaaaauuggugugucagaccugggggccagugugguugggaacucaggagggcgguggaaugugggcagggaugaggugggggaaaucugccagggccacgucaugcaggcccaugucagggugcugguggcagugaaaagaaucacucauuuaucgaguguuuacuacgugccggaugcuguccugagcacuuugcauguaugugcacauguucauuauauagcagcucucuguaagcacaucuuacagaagaguagaagaguguacuuggccacuugagugguuccuggcugcuucugugauuguuaggucuugagagauuauggacccgaggcauucuggguaccccaucaauuggcugauggucuucuauuugggcugcgcuucuucuaaaaaggggagcucaaaggucuuuuuuucccccacugcagagcuaaaaaagucccuguacgccaucuucucccaguuuggccagauccuggauauccugguaucacggagccugaagaugaggggccaggccuuugucaucuucaaggaggucagcagcgccaccaacgcccugcgcuccaugcaggguuucccuuucuaugacaaaccuauggugagcauugcggguacggaggcuguguggguguguaaaauguuauaggagacugggcgggccuggauuagaggaggggauauuacgguucauuugccaaggugaggcuggaccaggcucccacugcaccuugccucauuuaaaaaucuuuucuuuggccgagggcgguggcucacgucuguaauccuggcacuuugggaggccgaggcagguggauuaccugagcucaggaguuugcagccagccugggcaacaccgugaaacccugucucuacuaaaauacaaaaauuagcucgguguggcagcaugcaccuguagucccagcuacuccuguggcugaggaaggagaauugcuugaacccgggaggcagagauugcagugagccgagauccugccacugcacuccagccuaggcaacagagugagacucugucucagaaaaaauaaauaaauaaauaaauaaauaaauaaauuauuuugagacagaaucuuccucuguugcccaggcuggagugcaguggugcaaucuuggcucacugcaaccuccaccucccggguucaagugauucuccugccucagccuccugaguagcugggauuacaggcacgugccaccauaccuggcugauuuuuuuauuuuuaguagagacgggguuucgccauguugcccaggcuggucucaaacuccugagcucaagugaucugccugccucagccucccaaagugcuaggauuacaggcgugagcuacugugccacacuaagaaucuuuaacauaccuuccccuacugaauaagcaccaugaaagagggguuuuugucuauuuuguucauugcuuuauucccagagccuugaauggcgccuggcaucuggcagguucuccuuaaacagcuaagugagugagauugaaccuggaagacugaaguauucuugugugacaggaaaucccccugcacugcacuccucuccuagcauugucuccucgguccuuuggccugauguuuauugcuguuccagcuucccuuaaaaauaccaacagccuuucuacugaacacuugcuuacugugugucagguacuguuccaagcacuuuaacucauuuaguccucacaacaguccuuugaagugggaaguaucauaauccccauuuuucagacaaggaaguuaaggccaagauauuucuguguuucucaguaagcuccugauaaggucugaauuuuuuuuuguuuguuuguuuuuuguuuuuuguuuuuugcucuguugccugggcuggagugcaguggugccaucucagcugacugcaaccuucgccuccuggguucaagcgauucuucugccucagccucuugaguagcugggacuacaggugcgcaccaccaugcccagcuaauuuuuguauuuuugguagaaaugggguuuccuggccaggcgcaguggcucaugccuguaaucccagcacuuucggaggccgagguggguggaucaccugaggucaggaguucgagaccagccuggccaacauggugaaacccugucucuacuaaaagcacaaaaauuagccaggcgugguggugggcgccuguaaucccagcuaguagggaggcugaggcagaauugcuugaacccgggaggcagagguugcagucagcugagaucucaucacugcacucuagccugggugacagagcaagacaaugucucaaaaaaaaaaaaaaaagaaaagaaacaaagaaaugggguuuugccauguuggccaagcuggucuccaccuccuggccucaagugaucugcucgcuuuagccucccaaagggcugggauuacaggcaugagccgcagcaccuggccccugauaaagguccaauuuugaaucuuggcaauugggcucugaauccacgcucuuaacccguucugcucucuguuugguagcguauccaguaugccaagaccgacucagauaucauugccaagaugaaaggcaccuucguggagcgggaccgcaagcgggagaagaggaagcccaagagccaggagaccccggccaccaagaaggcugugcaaggcgggggagccacccccguggugggggcuguccaggggccugucccgguaagccaggucccggagaccaacccucccacugccagaccuuccucagccacauggacuggcuuugggacaggguggggagaguucuccccuuggggcuucagaccccuccuuuccauuucuuuauagagauguguuucucucucucuuuugggggguauugagcaccuagaugaugcuaucuccuuucgaaacucuuguucccuccuugugacuguuucucaaggucuuucuucauggcuaugacuugguuucgcucucuccguggccuugauuuugucgccugugucuuguaacucauugugcauguagaaaauccaagugucuacuaagcaacuguuaggauuaauaagugaacuuaaauuuagaaagaucgcuggauauaaaggcaauauggaaaaaaauuaguuuuauuuauuuauucauauuauguuuugagacagggucucacugucacccagguuggagugcaguggcgccaucacagcucacuacaaccuccgccucccaggcucaagugauacgccucagccucccuagcagcuggaacugucaguccgugccacuccacccagcuaacuuuugcauuuuuuguagagacggggcuuagccauaucacccaggcuagucucaaacucacugucucagccucccaaagugcuaggauuacaugcaugagccaccauggcuggcccccaguuuuauuuuuauaugccaguaacagaccaguagacuucacauugaaaaguagcacugagggguaaauccaacaaaagguuugcagaacgacuacacugaaaucacagaauguagcugggagaaaucagagacucagcaauggauaggaagacucaguauugucaagaggucaguuccauccaaauuaauugaagauucaacgugauugcaaucaaaaucccaccaggaauuucgguaaacacuggacacugauuggcucuuucuaaauguguggaaagacaaggccaagccaggcgaggagaauaaagcaccaggaccugcaugaccaggggaagcuccagcaaccaggccaggcccaauggcucaugccuguaaucccagcacuuugggaggccaagauaggaggauugcuuuaggucaggaguucaagaccagccucuauaaaauagcaagaccucaucucuacaaaaaauaaaauagaaaacugggcguggugacucauuccuguagucccagcugcucaggaggcugagcugggaggaucgcuugagaacuggaggucaaggcugcagugaacagugguuuugucacugcacuccagccuggguaacagagugagaccuugucucuuuuuuguuuuguuuuguuuucuuuuguuuuuuuucgggagggagucucagucaaucugucuccccaggcuggaaugcagucgugcaaucucggcucacugcaaccucugccucucaaguucaagugaucuucugccucagccucccaaguagcuggaucacaggcacaugccaccacguccaugugcaaaaaaaaaaaaaaaaccugcagcaaccaaccaggaugauauacaguuggcagaaggguaggaagacagaccaaggggacaggaugaagagucuagguacagcuacacuuguauaauuacuugaugugugaucgagguaccacugcacuucacugaggaaaggacuuuuuuuccccuaguucaugaugcggggcaguuggguaucugcaaggggaaaaaauuagcccuaccucauacuauaugcaaaauauaacuugaagugaauugcagauccaaaugugacaacucacaaaauauaguuucuuuucucuuuucuuuucuuuuucuuuuucuuuuuuuuuuuuuuuuuuuuuuuuuugagacagagccucgcucuguaguccaggcuggagugcaguggugugaucucagcucucugcaaccugcgcuuccuggguucaagcgagucuccugccccugccucccgaggaucugggacuacaggcaugugccaccacacccagcuaauuuuuguauuuuuaguagagaugggguuucaccauguuggccaggcuggucucgaacuccugaccucaagugauccgcccuccucacccucccgaagugcugggauuacaagcgugagccacugcacccggcccucacacaauaaaguuucuagaagaaaacaggaaaaugucuaaaugaccuuggugagggcaugaaaaguggaaacauccuguuuuccaaacaggauacaaaaagcaccgaguacaaaagaaaagauggaugaaccaggcccacuccuuaggucucugagccuccgugucucucuggcuuucaugagucucauggcucugacugggucaugcucuauucggugccacucacacuuucuccaaguuggugauggugucuggauuacugugggcuccuguuaaccucucuccucuucccugcaccuaguuuucuguccacuuuggacuucagauugugauuccagccccugagugugcugccugccaucuguugucuucccucuuccccuugcugccacgcguuuuguucugcaccugcccugagugucccuuuccaucacugcccuccuuuguuuuuguuuuuguuuuuugagacagagacuuacucuguugcccaggcuggagugcaguggugugaucucggcucacuccaaccuucuguugccggguucaagugauucuccugccucagccacucuaguagccgggauuacaggugcccaccaccacgccuggcuaauauuuguauuuuugguaggggcgggguuucaccauguugcccaggcuggucucaaacuccuaaccucaggcgauccgccugccucggccucccaaaguguuaggauuauaggcgugagccaucgugcccggccuaccacacauuucuuucugcaccugcccugacugucccuuuccaucucuuccucuccuuugauuuuguuuaagagacagggucuugcucugccucccaggcuggagugcuguggcacaaucagagcucacugcaugcagucuugaccuccugugcucaagugauccuccuaccucagccucacaaauagcauuuaacucuuucugauuuaaugucccacuagacccuggguuuguuuugcucugucgggcccucuuugggugccuuuugcgccucuuucuggguguuuuuccuuacaucucucacccgcuagguuuccuuucauggccucuucucugccuccuggggcugcuguaaccacgcacucuccucccucucuccacagggcaugccgccgaugacucaggcgccccgcauuaugcaccacaugccgggccagccgcccuacaugccgcccccugguaugauccccccgccaggccuugcaccuggccagaucccaccaggggccaugcccccgcagcagcuuaugccaggacagaugcccccugcccagccugugaguaucuagucccacccaccaggucucauauaaauagugagaauacaggacuagaaagggaccaguuggggggcugcuguagguuggguggucugggcaggcccccugaggaggugguacugaaugaggaaguagcagugggggugggcccugggcagaggaauuggcaugcugguuggaggguacggaagguuaggguaggcuggaguggugccagcaccuagauugauuccaugagcuauugagcgccuccuuacgugccaggccccguucugcacuguagggcugcagcagggacugagauagaaaccucugcuguccuguggccuauagucuguaggggcaaagaggugggaggcagacaggcaacagacaacaauaugugguauguuggguggaaguaccagagugaauucaagcagggugagggauggaggaaguggcaguacuaugggucucccacuggacucagggcucuugugcucaccgacuccccuauacccccgcagcuuucugagaauccaccgaaucacaucuuguuccucaccaaccugccagaggagaccaacgagcucaugcuguccaugcuuuucaaucaguaaguggggccuguggcuggguggucccuggagggugauggccaggaggcaucuccauggaaacaggccucagaacucugccagcagagcucugagccaaguagggcuuugcagaagggacagcgaccaaagaugugaaaggaggaggcuguggcugggcccacggccugugggggacaugggggugaggcuggaaaggucuccauggccagggcuugccggcuuuuuucagccuuguuugagggcugagggaguccaggcucugggccucauuuucccagccccuaaaaugggggcaugcaaggcaagguauguguaaaacugcauugagauguccuugaacauuggcuaagacuggcagaagucagcgugcucagaaacagcaagugugggagauggggaugcgugaaacucuugugccuggcgucaggguggaggccggugcagccgauguguagaggggcuguucaccauuguugagugaagucgugggugugggugaguucaucuggugguucuguuucaggggcugugaguggggcauucgucaguguuugugguggggaguuggagggugucugggagaagggauggcuacaugcagcaucucaccaugcugcacugcguggcacuuagaagaacagaaagcgcaacuuuauaauagugccgagagaagauugugagaaccugaaaaauacagaaaaacaauaccacaugugcagccuguccacaaagcuguauauuuugugagaaugccgauggaaaaaaggauaccuaguaaacaugaggauggcugcuuaauggagaaagaaguauggaaugagaagagggaaauuagagaaacagcauaucagaaaagugaggguaaggccgggugcgguggcucacgccuaaaaucccaguauguugggaggcugaggcagguggaucacuugaggucaggaguucgaggccaaugugggcaacuuggugaaaccccuucucuccuaaaaauacaagaauaaaaauggaaaaagugaggguauugguuauuuuuuugguguggcggguggguuaugauuuaggaagggcccaggagacugcgguguacuguuucuugauuuagguugcaguugcauggguguuuguguuuaaauuuuucauuaaaugcuauguuuacauuagaguuuuucaacuuaguacuaucugcauuuugggcuggauaauucugaguaauggggcccugcccugugcauuggaggcuauuuggcaucauuucuggccucuguccacuugaugccguuacguuagggggaaaugcugagucccugaggucugucguucucuuucagguucccuggcuucaaggagguccgucugguacccgggcggcaugacaucgccuucguggaguuugacaaugagguacaggcaggggcagcucgcgaugcccugcagggcuuuaagaucacgcagaacaacgccaugaagaucuccuuugccaagaaguagcaccuuuuccccccaugccugccccuuccccuguucuggggccaccccuuucccccuuggcucagcccccugaagguaaguccccccuugggggccuucuuggagccgugugugagugaguggucgccacacagcauuguacccagagucuguccccagacauugcaccuggcgcuguuaggccggaauuaaaguggcuuuuugagguuugguuuuucac

SEQ ID NO: 17123 - RNA, 1064 nt, Homo sapiens
uaaaucaggaguugagagcugagccuaguuaaaauugucuuuuccuucacaguucaauugcugcuauuguguuucuucugagccuugggaugauugcaagauuggucuaccugccuugcccuguaaccaaaagucuaauuuuucuugacuaugucguguugaaauauacaugggacucagcaccucuucuggaggaccaaagaaaaagggaaagaaggauaauuccauauauuccuguuuuucuugagcuuuugaggagggugggacuuccccuccccugcucccugacauugaguccaucagacauuuuugacauaaacggcaguaucaucaaaucaaggaacugcccgaggcuggaagaaguucguuuauggcauccaguuagcuguggaagugggcagucgagggcauccugaacugacaaagcaggguaaggaggaagccuacuuuuccaauguaaauguauccuccagaccuaagccaagaucagugguguggacuucagaaauuucaauaaggagaugguuugguagagaccauaugucaaaaaauagaacugggagaggagaucaggugacuucucuaguauuagaaggggcuccagaagaggcugagaugaagucucuguucuugcaguuuagugagggagggaagggccaacagcaagugacuaugagguggacaugaguaggggauguaccugauguugaccagugugcaggcagcuugagagaguuaagcacaucucuuugaggaaccgagcucuaugaauugcuggaauuugauggcucaccuuuggugacaaguuacaccagcaaaagcagacucuuagagucccaauaagccccuccuacauucuuuuuuccccuccuacauucuuuuuuccccuccuacauucuuuagccuuaugaucccacgugccccuugggaguucuccaagcuuuuauaguggcuuggagaacugagugcaucacaucauagggcagaguguggcaaaugggauaggcugauggggacuuccuugaucuugauuuaacuuauugcagacacacugaugcagcaug

SEQ ID NO: 17124 - RNA, 1581 nt, Homo sapiens
ugguucaguauucuuuguaaaaucagacucucaacuaaaucaauguccuugacugacuggcugaaauagggcuucagggugucucauucuaccacuguacagagggcacaugcaaugugcaaaaaauaaaaacaaaaacagaccucuguccccaccagcuuuuaacacuuacucuuuucuuucaaguaauauauccacaugguugaaaaaaagucuaacacuguaagagggcacagugaaaaguaagucacccucccacuccagaauauuaaucccgcaaauauacuccccaaugacaauuuuauaguuccaaagagacuuuaugcuuacuggagcauauauacauauaaugcccccacgcccccacacuuuuacacaaugauaacauaaugcacccucuauccuguuccuugacaauuucacuuaacaaugugaccuggagagcuuccacaucaaaaccaaaagcaauaccuuguuugcaaggccugccuaauauuccauuauaacgcugugccaucugcuauugauggucauuuagguuguuucugguauuuuacuaagggugcuucaguaaaucacuuuguaugaaguaugugaauccaugcaacucgaucucucuugauuuuuauuugcaagcuuauguuguauaacuuucugacaacacaagaaauuggccaggagacaaaagaaauucuguagaaauauagaggcuuuuuuggagcuugugugcacaucagauguuucuucagauaccuuuuugguuccugugucucauuguuucucauguuguuuugggcuauguccugaagccucuuuuugggucauuuuuccaggugcccagugagugauggauggauacuguuugcaagauugauucacauggcacuuuuguuuggcuuuugacagguuguuuauaagaauaaugacauccgucuggagcugucucgccuggcccggauugcggacaccaagaugaaaaucuauggcgaaguuguguuuaagugugagaauguggccacacuggaccccaucaacuuugagaccccagaggcuuacaucagcuugcccaaguggaacacuaaacguaugggcuccaucuccuuugacuuccgcaccacagagcccaauggccugauccucuucacucauggaaagccccaagagaggaaggaugcucggagccagaagaauacaaaaguagacuucuuugccguggaacuccucgauggcaaccuguacuugcugcuugacaugggcucuggcaccaucaaagugaaagccacucagaagaaagccaaugauggggaaugguaccauguggacauucagcgagauggcagaucagguaggaagaggcaggaugugugacugagacuagacgaaagcuguagcuucucaguuuguuuuuuggcuuuauguuucuuaauuuucacccuugcaugcuuguugauucuuuugcuacucucuuuaauggcuguuguaaaauuauguuucugaaaagauaccugucucauagauggcucacauucuccgcuuaucucucuugucacucacugcgcaauugucucagugauagcucua

SEQ ID NO: 17125 - RNA, 1391 nt, Homo sapiens
gcuuuuagccaagacaauuuuuuuuaaauuuugagacagagucucacucugucccccaggcuggggugcaguggcauaaucucggcucacugaaaccuccgucuuccagguucaagcaauucuccugccucagccucccgaguaucugggauuacaggcaugcaccaccacacccaacuaauuuuuguauuauuaauagagacgggguuucaccauguuggccaggcuggucucaaacuccugaccucaggugauccaccugccuuggccucccaaagugcugggauuacaggugugagucgccaugcccugcccaguucuuuauuugaauucgaguuuuaugacuaacacuagcugagugaccuugagcaaguugcuuagcuuguccaagccuguugccucaucuguuaaaugagaaugacaugacuaguacugacauccuggaguacugaagauuaaauucaauaauggauguaaaacacuuagcaucugucacauauuguguucagucaauggugaagaugacccgcagaggaaaacagccucuuucauuucagucuuucauucauacucaucuuuaaauucauuuuacacuucagggucuggaagauaguaggugauuaauaaaggcuguugaaugaaugcccacaugaaaccuuauguuauaaacuuuauuuuaaauuuugagacagggucucacucugucacccaguuuggaaugcaguaguaugaucuuggcucacugcaauuuccaccucccaggcccaagugaucuucccaccccagccucccaaccuuccagguagcugagaccacaggcguacgccaccaugcccagcuaauuuuuuuuuuuuuuuuuuuuuuuuuuuuuguagagacgggguuucaccauguugccuaggcuggucucaaacuccugaccucaagcgaucugccugccucggccucccaauguguugggauuacaggcaugagccacugcgcccgaccccuuauguauaaacuuuaauauugaccucuuuaacauaaacuuuacuuauaaauuguuuggagucaaccauuuuaggacaguggaauguugucauuuccaccaggaagccuuguaaagggucuggugucaguggaauaaaaagucaauuugguuucuuuuggcacuuaagaccucccacagcuggacaggaccuuaaggaccauccccaguacccagucucuugaugccuaugagaacccuguacagcgaaugacuugucuggggucacccaaccacugugaagacucgacugcaguccagaacuuucucgcuauggcguccuucccguuuuccuucgcauagggccauucaguggggcuaggacugacuaucacuaaucuguuugggaggggauugggca

SEQ ID NO: 17126 - RNA, 447 nt, Homo sapiens
uggacauggcagaauggcucccacaaagaaggguggcgagaagaaaaagggccguucugccaucaacgaaguggugacccgagaauacaccaucaacauucacaagcgcauuuguggaguaggcuucaagaagcgugccccucgggcacucaaagagauucggaaauuugccaugaaggagauggaaacuccagaugugcgcauugauaccaggcucaacaaagcugucugggccaaaggaauaaggaauguccgacaccgaauccaugugcggcuguccagaaaacguaaugaggaugaagauucacaaauaagcucuauacuuugguuaccuauguauuugcuaccacuuucaaaaaucuacagacagucaauguggaugagaacuaaucgcugauagucaaauacaucaaauaaaguuauaaaauugcaaaaaaauaaagagga

SEQ ID NO: 17127 - RNA, 50078 nt, Homo sapiens
cuugacaaucuuaaacgugagccuuugcacauguagguuuaucaucauuugaguauacgacuaagcaagucaaugaacuuuuuuuuuuuuuuuagcaguuuaauuugguccugagaauguugcagucuuuauuaccccuuuugcauuaauccacuuuucuaaccaccuuuuaagcuuuaauuuuuaacacuauacaccaagucuuugaaaucagugaucuguuauuuaacucuaaagcauuugacacuucuugccuuaacaguuuuaaaaaccacacacaaaaaaacucuguaaguaauacaguaggccaaaaguuucauccuaucuaucuugcaguuuaccuaucugaucugaucucuguaauuauaguucugucauuuaaaauauacuauuuaaaucuaauuuuuacauuucaaaaauuaucuucaguaguaacuaaguauauuuucuguggauucugagaauguuauuuuucagaaugugagaauauauauguacauuuauaaucuugugacuuuaaagucuguuuucagauacaguauguaaauacuuguaaaaaaauuuguauaauuuugugauaauguaguuucccaaaaaaauuauuuagaaggcauuauguuauuaguaaaugagagcacuguauagaacuguuccuauuuucugcacuugccauuccagcugccuccacuguccauacccaccucauucauccugucacagaaggcaggaaaacugggaacuuuaccaaaguagcacucagccugagaggccuguauaaucaugcuuuucaaacuaaauucacuuaaaaauuaaaaagcagaauugaauauuuuaagcagccucaguaccuuuggccaaugcuguuuucaugguggauuaugaacauuauauaaucuuugggaaaagugaaaguaguacaauuuuuagaauaaugacaacugccucacugcaucucuccacucacacagcaaccguguagcccccuaagcugcaguaccaugacuaaccaugaugucaauuucauaugcugauccucacaacagcagugcacaaacaugccccaaauauuuuaacagaauuuagcucuuccuuaagcugucuuuucauaguaaaaacaaaacaaaaacacccaauguuaaaaccacauaauaaacuuacaaacuugaaaaauuagacacuucagauagauaggcaauaaaacuucauauuaugaaagcaauauauuccaaguuucaaagauuugacaaguucuguagaguaucuuucaucaguacaugaaaacuuccaaacugcaugaucuucugccaggcaggacugggugcuauucgcugaaugaacagaaccaaaaauuguuuuaauuaucugcuuuguauccauauauaccauauaucucaguuuaaaaaguugacuaguuuuaagcaauaaauauuuggucauaagauuacaauauaaauggcagauuuuuaaaaauaauucaauuaugucagguagauaaaagauaauaccauauguaauuaaauuuucuggccacacuaaaauauuuugaaacuuccuuucaguaucucccaguugcuaaugucgaagaaaauggaugugaaauucaaguacaguacacauauauauacuccugcuggccuuaguauauguuugcguaguauauaaugagaaguuaaaaucuggcugggugugguggcucaugccuguaauccugguacuuuggaaggccacgguggaaggauaucgcuucagcucaggaguucaagaccccaucucuacuuaaaauaaaaaaaauuagccagguauagaggcacacgcuuguagucucagcuacaggugggaggauggauugaacccagggguuugaggcugcagugagcuaugauagugugacugcacuccaaccugggcaacagagcaagauaaucuagguuaaaaaaguaaccacuggauaauguaaaauuuagcccauguaguaaauuauuuugccaaaggagccuucuauaauuaaacagcaaagaaaaaaauucaaaguaacagucuaguuuccaauuuugugugcuuauaaauuuagaaacugcaaauuagaaaaaagaauuugaacugacaugagaaaaacgaauuugaauguuuaccugguuugaggucgaauccauuucaaggcaugucguggugggacauuaauggugggaugguagaaugugcaguccggucuuguacauugaguguuaaaccuacaaugcugaauagagauaacagagcuucaacaauauccacaaggcuaauauaaguaaacacauuauuuuauuauuugagacagggucucacucugucacccaggcuggagugaaguggcaugaccucuugccucagucucccgaguagcugggacuacaggcgugugcuaccaagccuguuuuuuuuuuuuuuaagagauggggucucuuaaauguugccuaggcugguuucaaacucccgggcucaaacgauccuuccacuucugccucuaccucccaaaguacuaggauagcaggccugacccaccucaccuggccaacauacaacuuaggagacaauaaccagcccacccuaaccauuaacagaguaagagauuccaucuauaaggaccauuuuaauacuagugaagccuugaaaaauggacuuaaccuugagacacaaaauucuagucaaagaaucacagcaaguacaauuucaaaagguaguuuagcauaccacaaaaacuucuaauuaucccuuacacucuucacugaguacccucaucuacgcccaguuacagaugggggcaagugaaggccuucauaugguccucaagcuaccggggcaagaaggagauaauucauuuugaccaacuaaacaucuggagauucaucaaccaucaucaguacaaguuuggaugguuuuaagcaguaccuacuggauuucuucaucucaguucugacauuagguucaaacugccccccagcccccgcuaaaacccauccauauacuuaaaugcagggaauaauggaaaaugugacuagcaaagauaugcuuccccccacugagugcuugggauacuaacauugaacaguuucagaccacuuggccuaaggggccagauggagguucagugacgaggaacaacuuaauaguuuuacuggcaaaaaucgcaauuacuuuugcaccaauguaguaacucugacaaaaaagaaguuaaaugaggaaauugagauguugucacuaaauugauuugagaaaauagaaguucuuacuuuuggaugauagaagggacauuccaucuucuuacaagcagggaaguaacggcagagcugacuacuggaagguggugcugguggugcaacugcuaacaaaauaaaaaccaggacugaucuccaaucuguuuggaaaacccauuuuuaaugcagucuacugauguuuuuuuugaaagugaaaaccauuuuuaaauuagaaugguaagguuuauauauucacuagucaaaauacuucggaauacuacagauaggcacacuugcucuuuaaagacugguuggauuaacugauccugccaaaauuauuucugaaaccaucuuuuguuuguucaauuccauuuacagucacaaaaugccauuuuauauuuuuuacccaaauguaguagcacagucacucacucaccugguuuuggagacaguacuggaauucuucuacucacaugagugaagggacaaucugguuuaguacacuuugcaucauauuuacaauuugggugaacaaacaaacauuuuucagcaaauuuacaauuggggaaggcucuacaaaacaaaaaaaaagcauauuucauauucaaucuucucaaugcauuauuaguucuguguauaagggcucuuuacacuccccaucacuacuuguuuugagaaaugcaaaaaaaacagcaacaaaaagaauauuuuaaaauaagaccauauaucaaaauaggacacaaucauuuauuccaaagcuugggauaacacaaacacaggcuuuuaacucaagccaagccaccaagaaagacaagcuuuugugauaaaaaucacaccacuuaauaaaaaagguauauauuuuaugcagugaacucauuaauacaauaaacacauccucuaugcaaggcuuugugauacaaaaagacucaucccauacucuccuuauauguacagcuguauuauucccacaucauuuccuuaaaagaauuaaaaaugaagauuccauccauaggaccuacccccggcaaaaaaaagaagccccaaaaagccaucucauaaagcucauuacauugagccagccagcuuguaaggaaaaauuuaacccaaguccaaaauguuuucauuacccauaacuaacuuuucccucaacuccucaaaaucuguguauacugcguguggccaaaaugcauacaaacuggggcaguuaccauauacccaucugcuuaaacguacagaauucuuaaggaaccccagguauuucaguaucucacagguccgaggcacaaacaaagcccccccacccuugccucucaacaaacauacaugaacaagaaauacgcuacucuggagagggccaugguaauugucacuccauuuaguuauaaaacuaaaaacuuguccacagaaaaacaaaaacaaaauaagguguaagauacagacacuaaacugaaagccaaaaucagcuggcuaugacuugcagggugagauggggaugguauucacuugcaggaugagauggggaugguauucacuugcagggugagaugggggaugguauucacuugcagggugagauggggaugguauucacuugcagggugagauggggaugguauucacuugcaggguaagaugggggaugguacuugcagggugagaugggggaugguacuugcagggugagaugggggaugguacuugcaggaugagauggggggaugguacucacuugcagggugagaugauacuugcagggugagaugggggaugguacuugcagggugagaugggggaugguacuugcaaggugagaugggggaugguacucacuugcagggugagaugggggaugguacuugcagggugagaugggggaugguacucaauugcagggugagaugggggaugguacuugcagggugaggugggggaugauacuugcagggugagauggggaugguacuugcagggugagauaggggaugguacuugcaggcugaggugggggaugguacuugcaggcugaggugggggaugguacuugcagggugaagugggugaugguacuugcaggguaagaugggggaugguacucgcacuuacagggcuagaugggggaugauacuugcagggugagaugagggggugguacuugcagggugagaugagaugguacuugcagggugaaaugcagggaugguacucacuugcagggugagaugggaugguaguuacagggugagauggggagaugguacuugcagggugagaugggggaugguacuugcagggugaaaugggaugguacuugcagggugagaugggaugguacucacuugaggguugagaugugggggaugguacuugcugggugagaugggaugguacuugccaggugagaugggggaugguacuugcagggugagauggggggaugguacucacuugcagggugagauggggggaugguacucacuugcagggugagauggggugaugguaggcacacucauccccauuuuuacaagcaggccaguacuugcagcgcuccaaaaguuuuucugguuucugugccacacucaguucacucaucucagcuacaaagggaaaggaaauaaaaguauuucauucauuaugaucaauucaguacacagcaccuuuaacauauuucccucaaaccugucuuagaaucuucuguuaaauguacagucauauaaaauaagugagcucaaauuaugggauuaacacuggccauagaauccuauaaaagguugccaggaagaagacaacaguucucacugugaaaaggaaagaggacagugacucugcaacuacggccaaauuuuucaccaaaaauucuaauucucaauacuaauucauagcugaauuaaaaauagagaaggacgucaaguggggaacuaauaaaauuaaauaaaaacugaaaacagguaaggugauaaggagaugugaauccucacacgccagcaagaugaugaguggcccaaauacaaaaggauucccaccugcugagcuguaaguccaggugcgaaacucagcaaugucuuuuacuuuuuuuuuuuuuuuuuuuuuuuacgacaggguccugcucugucacccaggauggaguacaguggugugccagugguguaaucucggcucacugcaaccucugccucccaggcucaagugauacucccaccucagccccuaccaaguagcacgugccaccacgccuggcuacaggguuuccccacguugcccaggcuggucuugaacuccaggacuuaagcgauccacccaccucggccucccaaagugcugggauuauaggcaugagccaccgcgcucagccagcaaugucuaaaaaggggaaaacauuuuuaccuacaauggggucacaaaugccaucacuuacagagacugggcaguuccccuaacagcaagacugacugggcugaagaugauaaaugcaauaagggacagacggggagcagcagccuggaaagcaagugcacacccauccacuccacucccugugccacauccaaucacagcuucgauuacuaugacagggcaaagugggaccccuguugccagauuuuuauccuguuucaguaagccaaaaaucugccuucaucgaaauuguaaugcuggcaauuuauuaaauaacacugaauaaguaaaauuacagcuacaggcaauaaucagcugcuaauuucuggacugagacaccuuaaacuccccacaaaauagcaucauggguauuauguauuaugguucacauucauguucaugaaagcaaguaucacuucaacuguauuccucuaguccucuugccagaggucaguuaaaaucugacucugccacuuaguugcucagccagacacucugugcaaauguuagcuaacuuuuuggaauucuguuuccucaucuauacaaagagaaaauaaugucuuccuuagagucugaugauuaaacggaaaaaaugcaaaacaggcaaccagucguaauagcagcagcagcuaguucuaugaguacuuacuguuccagugacccacauucuguccucacuacaggagaacaaggcacacaaauguagucaugcagcccagauaggagcagcaucaaagagcaauuaugacuaugccugauacaaacaguuuucuaugcuacuuuaaaaauaguaaaaguccuauuuaagcuuuaaauaggaugugguggcucaugccuguaaccccagcacuuugggaggccgaggcgggcagaucacuugagcucaggaguuucagaccagccugggcaacauggugaaaccccaucucuacaaaaaauacaaaaaauuagccaggcaugguggugugcaccuguaguaaccaacuacucaggaggcugaggugggagaaucacuugagccugggagguggaggcugcagugagccaugacugugccaaugcacuccagccugggcaacaggagggauacccuuucuaaaaacaaaacaguauaagucauuuuaguucuaagauacaagaauaaucgguuccaaagaaaaugugagaugacuggaaguuucucuaauuuuuacagguuuuuugugucauccccgcaaaguaaaugugucuuacccuuuuccuauaauaaauuacacacagcagacuauaauauauacacaagaacccaguacaaauaaaagauuaagagaauacccaagagaagccuagcuggaaagcaaaguagcuagauacucaggaacaauauaauacuuuacaaagaaaugugauuauuacaauaauaccuuacaaagaaacuuuaucuuucuuuuaaaaacauuaagucauacgaaggucaugccccuagucuucacuggcugacaccgacuuuguaaacuauuaaaacuuucuguucaaauuuuaagaggcaaauucaccuuuuauugaaagcuauaggccaggcacgguggcucacaccuguaaucccagaacuuugggaggccgagguugguggaucacuugaggucaggaguuggagauuagccugaccaacaugguaaaaccccgucucuacuuaaacuacaaaauuagccaggugugauggugcaugccuguaaucccagcuacuugggagacugaggcagaagaauggcuuucaaccuggaaggcagaaguugcagugagcugagauggcuccauugcacuccagccugggggacagagagacucuaucucaaaaaaaaaaaaaacaaagaaagcaagcuauaaaaucugugcugccauaugacagugagugaaaagacagcagguuaaaacagauguuguuguugguagcauccuugaaacaacccaacauaaaaccaaccagaagcaauugcaguuucaaacucccugcucacaggggaaguggugcagagacuagagacuccugagaacuguucugcaggagucucuccagccacaccccuaugcuaaucuuacaaagcuucauccuugagcagcagggaaacacugaguccccagucaaagcaaugggaaaggaggcucaccacucaucauggcugucagcacaauggccacagcacuggcaagaauuuuuacuaacauauuauuuauggugucacugcugcuacauguauaccccauaaagccucauauggacaccuacauuuaaaugaaaccagauccuaauagaccaaaaaauuaagguaccaaauugaaaaucaagaguagugaaaacacuggagucuucucuuuagacaaaacauacagagucaauaaaucgggacugccuacugcagcuuuuacuauuuuuuaaguuuuucuuccuguugauagggucagauuuucaacucccuccacuaaucaaaaccacgacacuacgucauugauucacaguaggaaacgcaaccaauuaaaauaaagcuaaguguuauugcuccacuaacauaugauuucccucugaagucuauucuauuuuuaaugaucgagaaagguauucaauacauuuucauaucucuuccaagaagaggauuacucaaggaaauguuucaaaauccauuacuguuuuuccuuugaaucuguacgcuuuuaagauugaguaauuaucccuccugccaaugaagaggugcuucuaaauauuuuagaagauauaaggaacauaauuaccauucucuaucaugaauggaaaugaucaguggcguugcagcuaccacugauacccagugaaagaaacggugauaagaaacugucaccugccaaaaacuauggugcuaucugaaaugaguucaucugaguucugcuaaauauuacucuucaacauuaauuuaaacaguuccaagaucuugauagauuaggugagaaacuccuuucaaagaaauuucacugagguagaaauagcaucaaaucuaaauuuuucucucaaguuaauugcaagagacuauugcugauaaaagggcaaaguggcaguacaguuucugaagaaaauacaaagguaaagaaggcaacaagaauggugguucauccuuuagccagcauaagcggaagaggucucucagguuccauggcugaacuccguuuucaaacuggaguaacagcccaccuaugaaaaagacacaggaaaaagagucugaaauguacuugguggguuugucugaaagaagaaaaaaggccauuacugaauauaaauaaaagcaaggccuuuaaccaauauucauucaagguagagaaacaagucaaagauucccuucacaaugacagcacccugaaaaucugagcucucaacacaccguuagaaaagcuaccauuuggguccucaagcugccugcucagcaagugcaacugcuguggguggaggagaccucugagucccuuguuugaggcugcaguuugguuuacggguuucauuccuucaaagcacauguccuccucuugaucugacauguauccuggggggcuggggacaccauccagcgucacuauaaacuugggacuugcagguuuaucugguuguacaagaucucugccagacagauaaaaaauaccauagaauuagggaaacaaacacaaaacgcugagcccccuaaagugcucuucagcagaacuaucacucccuuggcuuugcguuugguucaauaaaaaaagacuagguagggcuaccaggugcagcacugguggguucucugcuaacacacgauggccaugaacagucacaguggcaucaccagugacccuccagccuguacuuacuaaggacaaucuccccucaagccugaccccaucacccauucgaucuucauagggucaacauggaaacaaaccaaaaaauuagcaucaaugcucagaacacaagggccagcagcauuuaugcuaauuaucuguauguuucuucuuuuauagaaacagucaauuuucuaagggaaaaaucacccaaaccugaucugccaacucucuuuagagcugaccugauuauggucagcuggcuuuuaaacuugcauuuccugaauuugcauaaagaaaagaaucuuuaauagaguuaaaucauacacugaguuguaauuuguagguuaauggauuucugaacaagaaagaugaacuggaauucuugaaaacugaauuuggcuaacuauucaugggcuagcuacugaaucaaugaaagcacucuacgcuagcgguuagggcggggaggagggaagcugcaaacgaaugguuaaccuuuacuaucuaaucacacaaauuaacuacacaagaaaaagaaaccaucuaccgugucugcauaagguguccugaaaguacccgaagggaaucugcagucuucauccccgacucuugguuuggugccacuacuacuuccucagacagcuuuggcuucuucagaauaaaugaucuugugucugcauggaccauggauuccaugucauaguaaucugagccaaaaaaauuggccacaaauguuuacuuuugaauauaccuuacauucccaacauuauauaugugagaagaaugucaaucuuuuauauauucaaauuauuucaaaggaaaaucacaacugguuccacucaggaaaacagggcuauaauucuauuccaaacauguuuucaaagaacucaaggaguccuucucgcguagggcacggcacaagugauucugauuaacacucccuaaccacagcagagaaagguucucaggugaggcaucucaacagauauuaacaauauacccuuaaaguacaaaaaucuuuucuaaaaaccuggagaauuugaguccuaaugcucccuauaauuagaauacacagacugcugaaccacuuuuccaaaaucugguuuguucacuucgcacaguaccacuuagaaucauguccugauaaaaagaauucaagugguauaauuuccaguugguuauaaaccgaggacuacuuuaaaagguaacugaaaggugaauggacacuuaaacauauguaucaagaaaaacacuggccuuuaaugcaaauaaccauaagcucacaucaucuacuauuuuauaaaauaugccaagaccuacaacccagaauggcugaccuaucaauacgccaucaacggacugaaguuaauacacuucuuuuaaagcuuagagaccaaaauuuacaggguauucauuuauguucauucacugaguauuuacugaacaacuaagagaacugagcuagauacacaaagaaaaaaagaaaaacagacacauauacaauuucagaauagcaugacccaaaagggaugugaacaaggugcugagaauacagaacagcccacuccagccaagaaccaacgaaaagcuuagcaaggaggaacaucugaagucagcaguaaaggaacaagcaggaauaaacaaggagagagacucggagaaacgaacacagcacuucaggcagaggaaaacgcacguagaaggaaaggggcuuucacaaggccgaaggcaucugagaaagguuagaauguggaauggcuggaaggguguguguggugggcucagcaguacauaccaaggaaggcugacacauauaauaaagguucuucuaugucucagugacucucgauucuggucuauaauuaguaagaaaucaaguggccugguguggcgguucaugucuguaaucccaacauucugggaggccaaggcacaaggauuccauaagcccaggaguuugagaccggccuaggcaacauagugagaccucccaucaaccagaaaauaaauaaauaaauaaaauuagccaggcgugggagcacaugcccgcagucccagcuacuugggaggcugaggugggagaagugcuugggcccaggaggucaaggcugcaaugagcaggauugugccacugcacuccagcacgagugacagagggagacuccaucucaaaccaaaaaaaaaaaaaagagaaaagaaaucaagagagguuccuaaggaaggaaguggccugaucaaacugguuuuuagaaaaacaguguuaaggaagaaccagaguucucgaccugcuguugcccgggacagagggugaggcucugaaugaaaagauucucugcugucuguccuggucucacacaccugacaggaagagaagacaugcuccauccugggaaggggcgugcccgccuuccccagcaagggcaguacagaugguaaagggagacaggcggaagagaaagcugggaugagaaacuuagcaaaagaaaaagagcaaaguuaaaaggggcaaagauacauuuccauguuagauuuaaagucuuugugggacucucccauguuuaagaggaaguagaaaauucagauuugaccuguagguggggggacagaaauaagaugcugagucaaaaccgaaggugacagaaguguuuaacauauucaggguggccgucucucacugaauccucacucaaagccuacaaagucgguuuccucccauguuacagaugacuguuugcagcuccaaguuauuaaaugauucaccgaggucucacaacugucaaaggugggucccaacaguggcccaggggcugcuucacuccuucccaccacucugcacuuucugagacgaaggaguucuaccaguucauagguugggugaacacagaagagaugaaaauaaugcugaaggugggagagagcaaagcuaaccuuuugaggaggaauggaggagaugcgcugacacaugagaaugaaagggaaugagaagaauaaagacagagugaacuggaagccgaaaggucaaagcuuggagaaaguaugggaacccaaguguaacaugcuccaggguugaggaaagcgugcaccggucccucccgcacaccucucugcaagcggaacguuagcagcccaggucacauggagaccagacagacgggggaguaaguaacaucuucugaguagagaccacaggcugaccccaugcauuuacuuuuuguucccuccugaaagcccacagaaaugucaauaaggguuuuguuuuuguuuugaaagcauaaacucacaaagaaaauaaguguaaaaagaaauuuucaaaguggaaaacagaugauuaagaacucaggggaucuguaaaagcugaauucuaaggcaauaaugaagcaauccaauucagaccacaagauucuccaaaggcucaggaacuggcaguaaaaggaccuuaggaagaaauggaagaaauggcaggcaaaaaagagguguauuagauguguccaagaagcaguuaguucuucuucaacucuaauuccauguaucuguuuucuuuguuugagacagucuugcucugucacccaggcuggagugcaguggugcgagcucagcucacugcaaccuccgccuccuggguucaagcaaggcuccugccucagccuccuuaguagcugggauuacagaugugcaccaccacgccuggcuaauuuuuguauuuuuuaguagagauuggguuucgccauguuggccaggcuggucuggaacuccugaccugaagugaucugccugccuuggcuuccccaagugcugggauuaugggcgugagccacugcaccuggccacuguuuucuugguuuugaugcuugccacaccaaucccgaccucuacacugaagacaccugggaugacuggugaugugcuuuccuguagauaaucuucggagaggccuauggaugaagcauuagggucucugccagaaagaugcuacgacaaaaucaccugaagguacacuguuaaaaauuuuuaaaggcaauuagauuuccugauaaaucuuuacccacugcaugcauucucccuuggagaaaguggagcuuuagacucuucagaggauaagaacagagucccuggaccaagagacaccagccaugaugaaagaaguacuggacugacaaugguugggggaggguuaaauaaacauuacauaauaauuaauggugaggugccucccccagccuucuuuccccacuuaagcucgcagaacucugacuaccaggcuauuacuugaaaaacuuuguuuuggagaagcugaccagccugagaggaaagucuugaaggcagugacaucagggugcccacaaaccagacaggcaggacaaaucacuuuccaccacagggucuaguuucaaacagaaagucaaagugccccaugccccaacucaugaacccagaauaccagugaccuucugagugcuccacucuuaaauguaagaccaccuaggauccccagacaucagaggggaaccuccagcauaaaagacagccaaaacagaccacuuagagaaaacaagacgaagcagggaggggaaaaaugucaaaaccaccuuucagaccacagagaaauaacaaagaguauuguguacacaaaaucaguauguuuuuagaaaauuaauagaauaugcagaaacaaagggaucuuagaauaaaaaaugugauaggagcuaaggacugcagucauucauaagccucacagaacuacuugcuauuucaaacugcgugcaccauggguacaaugaaaagcugaaggaggcagaagagaaaacaugcacaagagcugaugaaguggaucccacacacagaucucggcugucaaccuuuucaaauacuccuguggaggaagcaggacggacugcugggagaugagagagcaaaaucacgggcagagaaugucugaacaccucuacagagagaagacaggaggcagagaaugaaguuggaggagugggugacaugccaguggcucaccaacccagugggaucuggccucugguggaggcugacccuuagggaggaaaagcacacuuucugagcuggaaagcugggggagggucggggaacagagugacugacuguggaguccugacugagaggggucuagggaccagagcuucccacaaaagacagacuuaggggaaacagaaggacugagaugauuccgggucucucaugguugccuguguuuauccugcagucauuuuuaagacauugaacaugcaucuggcaggggcugggcacugaggacagagauaauaaaaaugaaggcgucagcuccaguccuggaguagccccuggcaugugugucuguggggagaggaaaggagacaggcaaacuagaguggcucuagaacacuagaacaacaaguuccagguguggcccuggugauaagacuccaaaaugaaguacaagaggauaaggcuaaccaggugaaaaacaggauacaaaagccacucauggcaaugacaaaagcuggguagagugggaggguaaaucagaaacgcaggucacuccugacagcaggagagugacagccgacagugcuagggacacacuuggaauggugugaaaggaacaaaguuuuccaaugaggcaaaaaauuauaacacuauauaacaugaaagaaaugcagaucuuaucuccuggcccuaaaauauuuucacagaucuaaauauaacaucuuagggcaggaucuaagagauccgagauacguuaaaugggguguaagaaauggaaauggcaacugaaauggcuggauuacaguacaacuugaaacauuaccaaccuugacucaucugcagaguuucugccauuacugggucgauuugcagucgggauaauaauugccucuguugaguuccuagaauauaaauuuuaaaacuucacuaagcuuacaacacagacaauaccagcaugugguucccaaaaaucaauccuucuggguucuuaacuugaagucuuaaaaguaacuuaaagcuucaacaauucaauuuaauaguauuuauagaccaaagacauauccuguaagacaaaaaaggcuguacucaggguuaaaccacaaaugccaauuuaaaacacuccugguucucccucuaugaggacaucaguuuuccugaauuugaauucugcggggaaaguaaagguggcaaacggguggaaaauccaggaaaaggcaccuuguggcccagcagcucgcauaacagccaacugcacaauaagcauggcaagcaccucccuccaucaccugagcucuuaccaucacgacuaacucaugaccuuugaagauaaucgaaauagcaaaacaaaacacucucaucaucuaaacaagaguuccuaaaagacaaacucugggcuucgaugcaugcaaagaaaacaauaagacacucagcucuacaauccacacccuauguuagcaaagcaugauaauaauucuuugccucuuccacaagaaaagauguucaacuacuuauuucuucuaaaauaggcuccuaacauuaauuccuauuagguucacuauuccuaacaauaauaugcccagcagucugacugcacaaaauagggacaaagaacugauuuuuuuccauccucgauuugauguuaagcuccuugaggaugggagaaugucacacuuuucuguagcccccacagcgcuuagcagacaucaggcacucacuugcucauuauaagguacugcacuacaguguacaaagggauguaacugauaggguugcaaauacugaaaucuuacuaagaugcccacaugcugauuuuggguauauccauuacagguggcuucacaaggacaggcuuugcuuacucagugcaaagauguuaagugggccaucucccaccaagcaccacauuucauuaaaagguguuuuuaaauuuuaaaaccuauacucgauuugaaauuguaucaguuaguuuccuuuaaaacauaaguuauaugaaauuuuacuggugcgucccaaaaaagucaauuccuuccagaauuauuaccauaaaaaaacacacauucugaggaacuguaacgaagaugacacuuaggucaaguugcauuccugugggaagcuuggaaaacugaggugaaaaguuacaggaagaaugcucuuuccauccaaauacugcaacaggucuccuucacaucaacaguacaugaugaaagaaugagacauuuuaaaauaauuucacaagacacaugaaagaccacacuuccacauuucaaguuuugcuucauugcucuagguucaucugucuuuucaaaacaucguuuuagagagcuccauuaaagaggauggaauucugaucaauucuagauugcuaagcuaaaucaagcagaauccaaauuugucauuaaagguccaugaaaaauucaaguucucuguaacuugcucccuccacaucagagcuacagucaacauacguggaaagauacagaucaaaggauggguaccuagaacauaucauauauuaagaguuuaccuuucucaacguuucuaaggaagccgauuauuuuuacaucaguaguucuugacugugauucaguaucuucuucuugaucuucaaacugucuguugcauucauauguuguugaauauucauucauuuuaaccuccaaagaugaaauuuuugcuucauucuuggacacucuaacauuuagaucaaaaagauuugcuuccacugucaaaauagcugcuuucauuccuuuaauuucauugauaucagcugauauuuuccuuaaaaggugggaaauauugucuagcucauucagugaacaagaggagcuuguuauggaaccuaaguccacuggcuccgguggaagaaaaauugguagagguggugauggaaacuuugaagacauucucauaaaggugacaggaaccucaaagacauuuucauaaaauucucucccuuaaaaucugauaauuuuuucuucacagcucauuaaguuauuucaucgaaaguaaaagcagugaucaaggcuguuaccuuaagacguauuaagagcaaauaacaucuuaaaaccuguaauucaaaagaugggguuguacauuucuagagucagaauucaaaacuaaaugugaaaaagcuaaacguaccagaccaauugcucuucgcuacaacuaagaagcccuaauacguagggcccuacauccucuaaguaccaucuguauagcuccucuuccaguaaacccuauuauuacauacaaaauaauccugguuucugauuggcugaaaacagacaugugucacacaaagaauuuucuauuauuuacuucauaugaugagagcacugaagcgcuacuuuauagguuaagcaauauaacauuaagugcuuuacaucuaaauaugauaugaauuaaauguacuuuucccuuuucaucaucuaaaccauaacauuuuuaagcuucagauuucugauuuguuuugaguuguauuuccccuugaaauuaguauauaacauuauugagagugacaaauccucuggagggaaagggcggagaaaguaacuggacccgugauccacacaaacuucuuucaagauacaugugguaaugacagaauucaacuucacuaauauaguaucguguaaacuuaaggauggggaaauaagaacucagccuuggcuuaauacuagaccauuauuagacagguguuucuuaaauauucucucccauuuuguugucuuuuuuuuuuuugauaguaucuuuugaaacacaaaaauacuaaauuuugaugaaguccgaguuaucuuuuuuccuuugguugcuugugcuuuuggugucauauuuaagaaaucauucuggaauccaagacauaucuauuuuuuucccuaagaguuuugaaguuuagguuuuugauccauuuugaguuauuuuuguuuaugacauaagauaagguuccaacuucauucuuuucauguggauauucaguugucccagcaucaccuguggaaaaaccuauucuuuugccaauaaacugucuuaacaccgcugccaaaaauugauggguugugaaaguaugcauuuauuucuggauucucaauuccgguccacgggucuguauggucauccuuaugccaguaccacacagucuucauuacucuagcuuuguaguaaguuuugaaaucaagcaacauaaccuugccaacguuacucuuuuucaauaguuuuggcuauucucagucccuuuuuauuuccauaugaauuuuaggaucagccugccgauuucuacaaaaaaaagcaauuugggguuuaaacagggauugaguugaauccauagaucaacuuggggacuacugccaucuuaagaauaguaaagacaucuaggcugggcguggugacucaugccuguaaucccagcauuuugggaggccaagguggguggauuaugaggucaggaguucgagaccagccugaccaauguggcgaaaucccgucucugcuaaaaauacaaaaaucagccaggugugguggcgcacgccuguuaucccagcuacucaggaggcugaggcaggagaaucgcuugaacccgggaggcagagacugaauaagcagagaucgugccacugcacuccagccuaggcgacagagggagacuccaucucaaaaaaaaaaaaaaagaauaguaaagacuuccaauccauuaacacagaaaaucuuguaagguccuuaauuugacaaaggacguuuuuacuuugguuuacuccccaagcaaacaaauaagauaugcaacauacaaggaugcaaguugguagaugcugcucacuauagucucuuaaaagaagaauccuggccuggcacagaggcccacaccugucauuccagcacuuugggaggccaaggcagguggaucacuugaggucaggaguucaagaccagccuggccaacauggcaaaacccugucuccacuaaaaauacaaaaauuagccaggcgugguggcauaugccuguaauuccagcuacucgggaggcugaggcaugagaaucaccugaaccugggaaggcagaggcugcggugagugagacugcgccacugcacugcagccugggugacagagugagaaucugucucaaaaaaaaaaaaaaaaaaaaaaaaaaaggaauccuuauaaagaaugguagucuuugguuucccaaauagaugucacaguaacagaauaaagaaaaugcuaagugcuggaauuuguaaaauaaaaaucuuuauucauuucuccacuuuaugaaucaguucuucaaaauuccagacagaaaauaauguucaaaauucaaggcuuuggauucacagacuuuuuuuuaacagaaccagcuggcauaugacauccauaguaacuguuaacagcaagacacucucagaaaagcaccaccugcaaaccagcugguucacuagaggacagauaaacaaccucaaggaaaaaagcaggaaagaggucuaacagaacgggucacagagaaacaagagcccaucugauggcacccauauggcccacuauguccagcccaacuuuagaauagaaaauaagcaaggacccuuccuaagacuccaguguaaauauucaucagcagagaaagcuuauguauuuuaacauuuacuccuaccaagaacucugaaguaaaugcuaccguuauucuucauuuauagauuaggaaacuaggguacagaaagguuaaaucaacuaguaaacugcagggucugcaccuucgguagucuggcuccuagguccacacucaaggacucucccaugauacauuaaguggaacaaaaaugucacagagaacucuggguaguauaauuccugcuuuauauguacaugugugugugugcguaaguaaacauguaauuccacuuuauauacaaagggugcacauguucacagauauaagaaaugccuagaagacgacaccaauacacaucaaacuuuuaagugcaguucuucccuccgagcaaagcagggggauuuuccauuuucuuugaauguaaaaucuccccuugacuaagaaucuuucacagugcuuccaguccaacacaauguaucaagcauauacaauuauaaucucuccuucugaagaguccauaaaagugaauuaaagaacuuaauaucuacaucucuacccuaugaucuuuggguuucuguucuuuuuuuauuuuauuuuccgagauggagucucacccugucgcucaggcuacaguggaguggcgcaaucuuggcucacugcaaccuccgccucccagguucaagcaauucuccugccucagcuucccaaguagcugggauuacaggcacccaucaccacacccggcuaauuuuuguauuuuuaguagagacggcgguucaccauguuggccaggcuggucucgaacuccugaccuaaugaucugcccgucucagccucucaaauugcugggauuacaggcgugagccaccaagcccggcagauuucuauucuuauguuuucuaauauucauaucaauacagcauguguacguaaguaaaauacauauauugguauacauacuuaaaaauggcuacuguacaaaaauuuucaggucaaaaauaugauggagaucacugguuuagagauggggguuacaaggugcagcagaugagaugucaacaaucucuggguaauagaaaauauauggacaaauacuggcuguaaggcacagcaggcaaaaccacaaaugagccccugugaaaacugcagguuagaugcaaggcaggagugacauuuacucagacaacaaacacugacugagcuccugcuacuauaugccagacacugcucugggcacucaguaacagccauacagaacaaacacauaaaucccugcucaaaaaggacagacucuguugagacggggaaggagguagcucucaagacccccaaaaaaauacaugcuaaaagaaaacaauucacguuaaaacauaaagaccuacguucggauaaaaauaccuaaacuacaaaaacauaaaauauguauuugauggugacaaacguuauggggaaaaauaaagcuucagaaaagagggaguguggggauggggccagagaaggccucaaagaugacacauggaugagauaugagaacauccaaaguaaacauucucaggagagggcaaaagcaucugagacgcgcagcucuuccaacguccugaaggacaagcaggccagugugcaggagcagcagcaagcacggggagccagagcagagggaggcaggugggugaugagaaggcagaacacugugacuuacagugugacagggagccccugggggguucuaagcugcaaaguagcaugaucuaauuuacaguguaaaggaucacugcugcugcugugugggauggacugaaggaaggcaaguuugaaagcaggcacaccuuguaagaacacacuauuccaauaaucaaguaaccaaggcaaaucacagacggugacuuuuuuuugccuuuuuuuuuuuggagacagagugucacugugucaccaaggcuagagugcaguggcaugaucucggcucaccguaaccuccgccucccagguucaaccaauucucguaccucagccuccugaguagcugggacuacaggcaugugccaucaugcccagcuaauauuuguauuuuuaguagagacgggguuucacuaugccggccaggcaggucucgaacuccuagccucauaugauccacccgccucggccucccaaagugcugggauuacaggcaugagccaccgcacccggccagacagugacuuugaugggugguagaggcagaagugauaaacgguagugaauucuauaaaucuggagguagaggcugacagguggaacaagggaaggagggagacagagguagagagggaagaggaaggaaaggagaaggagagaaaaaaagaauggcaacaggauucugucucagaaacuggaaaggugaagucaccaauaaacuaaaaugaggaagacuacaggaagaacagacaggagaggaaaauucauaguugagcuuuggacaaguuugaaaugauuuauuacaccuccaagaagaaauauaaagugguuggacagaaaugaggaauucagggcaagguccaggcuggagauauaaaaaugugagagucacagugcagagaugauauaucaagccuugaauuuggaugaaacaaagggccauccaacugugagagauugcagcaaugaguaaaaaccaagaaggauguaaggcagagaagaaggcuugugaaugguacugccagagacagacauuuaaaagacaaaauuuuaauauuuuuaauagacaaccaguaggaguguaagcauaccaaccugcucccccaagaaauuccucuacaacugcaaggccaauugcagcuccuugucugcuucauugaaagcuaaaccugccugcagaaaagcucagcccacagcacaauucuagguaagccucugcacuaccuuuccuuaaacuaggaaccacuaucugcagauguuuuugaaaaaaauuccauaaucgaaagagcaagaaaaaaagcauaaaaucugacucugacuccauuaauuagaagacaagagugaauuccuugaaaagaaaaaaaaaaucccuuuaauuaggaucuucagacaguugagaugauucuguauccacaaaguaagauacuaugaaaaauagaacaagaaaaaguuuguggaaauuaaaaaauaugcuugccuacauuuuuaaaauguucaguaaggagacuaaagaucaagucaagcaaguauucaagaguagaccaacaagaucaagucaaaaaucaagagagaaaaaauauacaacugacagauuaaaguaagggcuuaucauccaacuaacagaauuuccaccagagaacaaugaaaacaaggacagcaaauuuuaaaacaaauaaugcaagaguauuucccacacggaagagaaugaauuuucaaauuaaaaggguaccuaauguaccuaacuagcaucuagacauaccacagugaaauuucagacaccaggaacauagaaaaaaaaaaguucccggagaaaaaaaucccagguauuacacaauggaauaagaugggcaaccaaguucucagcaucaacacugaagccucaagauaaugaaacuaugccuucaaaguucugaagaaaaugacuucaaccuauaauucuguaccuagucaaaguaucaaacaaguacaaggauagcuucagauuuccaagaacucagaaaauuuaccuucuauacuuucuuaaggaguuucuuugugacgugauuacaaaacggagaaaugcacugagaagacaaaauggaauucaggaauugcagagccgacucaggggaggagggcgccucgggaugauggccuugagcaggccuagagcaagcagugaggucagaaaaggaggagagaggcuccaggaggaagguaccuaagaaaaagugggaaacccaaagauuucaaagcacagagugauaagacuuuuaggcuacaguacagguaggcaaugaaagaagggaaaaaagaagaaccuaagggaaacaaaaaagggggaaaaauuaaaaaaacucuagagaguucccacacaaaacuguacaagaaacagaauguaaauuuggccuuguaauauuuauauagucuuuaaaauuuuuuuuuuauuuuuagagacagggucuuggucugucacccaggcuggcacaaucacagcucacuguaaccucgaacuccugggcucaagcaauucuccagaguagccaugacuauaggugcacaucaucacacccagcuaauuaaaaaacauuaaaauauauauauagaugagggucucgcuauguugcccacgcuggccucaaauuccuaggcucaagcaaaucucccaccucagccuccuaaagugcugggauuacaggugugagccaccaaccaugcccagacuaaauagucuuaacaguguaaaugcuuacuguuucucaacuuagagucaaucgacuaagucuuaacuaaaguagggaacaaaauguaaauuugaucagcuuugacaauauaaaagaacaggugacaauuuagaagguggaggcaggacagaauguagguggcggcaagaaagaaaauauaagacuugaaagagaggccuggcaugguggcuuaugccuguaaucccagcacuuugggaggacaaggugggcagacugccugagcucaggaguuugagaccagccugggcaugauggugagacccugucucuacuaaaaauuuuauuaaaaauuccagguguggcagggugugccuguagucccaagcuacuaaggaggcugaggcaggagaaucacuuaaacccaggaggcagagguugcagugagccaggauuacgccacugcacuccagccugggugacaaaagugagacucuaccuccaaaaaaaaaaaggaauugaaggauacauaucuuucagaagucaaaauauacugaaauauaaccagacaagaaauauuuaaguuacuacuuaaaauuacuaaaguaaccaauaaaugaauuaaaaauugauuuugcuguaugagcuuggaagcaagggaaaaguauaaaugggcuagaaccugacauacagcaagaaaucaacagguacuaucuaguuggucaaugaagaaacaguauaaagcauauuauuacaacacggagaaagaaacagaagcauuuaaaagugggggauucugcggagugggacuaguauagagaagaaugaaguaaggaauguugcuuuuuauuuuuaaucuuuuuuauacuauuugauuauuuucucaucuaucaggagauauuacauugauaugcuuucuuuuuccagauuuucuauggugagcauguauuucauaaugcauuuuauuucaaauauaugggaugcuuccauacauuauaccaaacaggaaaaauaaaaggaaauccacgccuagacacaucguagugaaacugcagaacaucaaacacaaagagaagaucuugaaagcagccagagagaaaggacagaucaccuacaaaggaacgacagacaauuagaaugauagaaguccacucaacaauggaaagcagaagacagugggauaauaauauauauaagguguggagagcaaauaacuaacaaccuagauuuggguauccagcaaaacuacugcacaagaacacaaagaaagaaaacacucacaggugaauagacucuuggaaaauauauugccaacagacauguuucagugaaacuuccaaaaaaauacuucaaaaauacuucaaaauauuggaaaauaaugauccccaaauaacacucagagauguuaagaauaaguaaaaugauaaacaggagguaaaccucaaaaaacauugccuggaaaaaauuacaaaaauguuguccaacuuguguauuuuauuuuacuuauuuuuuuugauaaggagugucgcuuugucgcucaggcuggagugcagcggcgcaaucucagcccacugcaaccucugccuccuggguucaagcgauucuucugccucagccuccugaguagcugggacuacaggugugugccaccaugccuggcuaauuuuucuauuuuuaguagagacaggguuucaccauauggucaggcuggucucgaacuccugaccucaggugauccacccgccucagccucccaaagugcugggauuacaggcaugagccaccgcacccggcccaacuugugcauuuuaaaaaagaucaaauugaaacacuggaaacaaguaaaugaggaggauaaagacugaagcucuucauagguauucaaaaguccuuuuacuguuugagaguggggucaggauauuaacuuuuagaauacuaaauuaaauuugugugguaaaauuucacugguaacgacuaaaagaacagaaaugaggccaagcaugguggcucacaccuauaaucccaacacuuugggaggcugaagcgggcagauaacaaggucaggggaucagagaucaagagauugagaccauccuggccaauauggugaaaccucgucucuauuaaaaauacaaaaauuagcugggcguaguggugggcgucuauaaucccagcuacuugggaggcugaggcaggagaaucacuugaaccaaggagucggagguugcggugagccgagaucgcgcuacuacacuccagccuggcaacaaagugagacuccgucucaaaaaaaaaaaaaaagaacagaaagggaagguuuaaacaguaaacuaguuuaaaauuguagaaccaggguuaggguugucaacaauaacaguaauuaaugaaccuuaaaaaacaugagaaaaaacagaaaagcaggcaaaugcaaaucagcaaugaugacagaaaguaauccaacuauaccaguaauuguaauaaaugugacuggucuaaacucuccaauaaaaggcaaacucagaugagauuaaaaaacaaaauccagcuuuauaauauuuaagauauaauauauaguugacccuuaaacaauaugagggcuaagggaaccaaucccccaacaacaguugaaaacccacauacaacuuuugacuucccaaacauuuaacuacuuacuguugccaacguagcugcaguggcagcuucauacauuuuuuucuuuuucuuuuuuuuuuaaccaugguucuuauguuaaauucauuuauccagaaauggugaauaacugcagccacaguuguaacauguaucuuugguacauacugagcaaugguuucuuguaaugucaugacuuuucucuacuucuugggagcauguccagcaucaccaguagcacauuauggguccccugguguuauucaagguuuacaguauugcacuaaacaugaugaaaaauaugcaagaacugcgagaucaccuuucacugcaauucacaauuuacuggagagcugaacugucgcagagaugguugcaucacacagcauuuuaaguggacacucaaaacaccuuagcuuaccauaaagcaacaggagguaacuacaaaauuauuacaguaguacaguauguacuauaguaaaucuuauguagcuauuacugcaucuuuauguuugcuuacauuucucucaacuacaagcgguaucauguaaagucuguguuugugugcauauauuuugauaaauuaaacuucauaauagauguguauguuuuaagauaguaaauguuagucuaguagcuacauauauuuuauguguucaugacauaccuaaauuuuucuuaauuuugucacuauuucuaggcuauauaguuuaucuacaaguuuuuucaaauugccacaucucaaaaaauauuuccaauauauuuauuuucaaaaauccacauauaaguguaugaguggacccacacaguucaaacuugucugguucaagggucaacuguauauaccuaaagcaugagagagaaaacugaaaacaaaggcagggaaaccagauauauaaagcaaauauaauuaaauggcuauauuaauaucaggcaaaacugacuuugagauaaaaacaucuuuuuugcagagggucauaaaucaagauaagggauucaauuugcagagaagauauaacaaauuuaaauauguaugcaccuaauaguauauaacagccuaaaaauaaagcaaaaacuugauauaaguacaagagaaauuaagauaaaucugucaucauguugggcaauuucaacacccuuucucaagugguaagucaagcagcacaaaaacucagcaaggucaagauuugaauaauguuaacaguagagcuuuaucuacugaauaaauguaaaauuccccauccaauaauuaguccacuuucuuccaaaaugcauguggaagaugcauaaacuugauuaugcacuaagcaaguguuaacaauuuucaaaaacuaugcauuguaaaaauuacauuaucuaaccacaaugcaauuaagucaggugucuauaauaaaaaggauuaaaagacaaaaacacauaccacuuccaaauacuguauagaaaacacacuuucaaugaugaaaauuauaauggaaauuaaagacacucugauaaugaaaacaugaugaauuaaaaccugucauauguauucuucucaaaugcuuacauuugagaagaagacagccugagguaaauaauuuuuaaaauauggaaggauaaauuaaaagagaagucgggccaggugcaguggcucacaccuguaaaccuagcacuuugggaggcugaggcaagagggcugcuugagcucaggaguuccagaccagccugggcaacauagugagacuccaucuuuacaaaaaaacuuaaacauuagcugggcgugguggcgugugccuauggucccugaggugggaggaucauuugagcccaggcauuugagguugcagugagcuacaauugugccacuguacucuagccuaggugacagugagaccucgccucuuaaaaaaaaaaaauaaaaaaaaagcacaagucaaugaaauagaaaacaaaaacaccaaaaaaaaaaaaaaaucaauaaagccagaauaauguuguuaagucuuugaaaagaucggcaaaauaaacuucuagugacagacugauggcaagacaaaaagcaaaaaguacacauauuaugaggugggugcgcuaguaaaaauaaagacaccagagaaaugagagaaugcuaucugcucaaacaaaagaagaaaaaaaauuaacaacuuaugccaauacgagugcauguuuauauuuuaaaaaccugccccagauuauaccguacaacagugaguaaccacauuaacagauaacaguugcuugcaguaucacuucacacuugugaauauaucuaguaauaccaaacuccucaucagcaaagguaccugacaccauuucaauuauccccuuuuaaaacacaguauagaaaaccacacaaacauauagcuuaaugaauuuuuguaaggcaaaacacccuucugacuaccauccaagucaaaagagagaacgucaucugccaccccagaagccucucugugugcuccaucuuuaucgguccucuucaaaagcaaccacuaugugcuuuuuauauuaacgccuagagguucuuuauaauuucacacacacuggguaucccuagccacuacaauuuaauccugcuccuuuuauuuuccuuugauuugccuuuuaaucucaauuucucaggcuauucaacccacagugucccaaacacuauuuuuccggcugcacacucauggugaagcucaaccaacauacuccucuggccucugcaacuucuugcaaacugacugcuggacugggagcuugaugacuuagguuuacauuuuuggcaagacaaaaguucuguucuuuuguaucaagaggcacaaaacaacugguuuucacucuuaaaagcauaacucuaauccuaccaucuuguucucuuaucagcugaaaucauuuuaaaagaaaauguuucucucaucuacuauaucagagguuggcaaaucuuuuaggcuauuuuaggcuaugcaagcuauauggucuguugcaacuauucaacuaaggcuguaguaugaaaguagccacggacaauacauacaugaauaggcacgguuugguuccaacagaugccaacuccuguccuaugggguuacccagugguaucguucucacagaaaagacagcauaaauguucaauuauuuuauuuacccaguuuucaagacaaugaaugauuaucuacuaccuuccagaaggugacuaguuagagcuuauuuuuuuaaaaugucauuaugaaauuguggauuuaaaugggcuuuaauucaccgcgauauuuacaccuacugaaucucaaauaauuccauuuuuggccaauggaaaccucuaaguuggcgccugcauccuuuggacguggucuaccauucauugacagcuucuuugcuaucugggauguugagccauuccaggaucauguuaacauuuccugccccagaccuggaaaaagacauuucucaagaagccuaguucuuuguuuuuuuauuuuuauuuuuucuugagacggaaucucacucuguugcccaggcuggaguacgguggcacaaucuuggcucacugcaaccuccgccucccggauccaagcgauucuccuggcucagccucccgaguagcuaggacuacaggcgcacaccacaacacccagcuaauuuuuuuguauuuuuaguagagaugggguuucaccacacuggccaggcugcuuuugaacuccugaccucaggugaucugcccaccucggcuucccaaagugcugggauuacaggcgugagcaacugcacccagcccaagaagccuaguuuuuuaaauaggaaguauuccaagaccacaaucugggaacuacagaugaugcuaaggguugaugaauguuucuaugccuucuaguagacagaacuagaaaaaaauguauuuauauauaaaauacacugugaguuccgaaacauuuccaauguaaauucaggacaacaggcuuuuacuugucugaagcucauccuccauuagauuuccuaagaaaaguucaugggaaugagucucugaauuucugcauauagauaacaguuggugcuggaucacuucuaaaggucacuuuugcuggacauuaaauucuuggcucacauuuucuuuucuggaguaucuuaaauaugcuaguccauuuucuuccagcacaaaagugaugcuguugaaaaguuugaugauaaucuaccuuuccuuuucuucuaagucaugugccccuuuugccugaauguccaaaucauuuuuuuucuuuuuaaaauuucauuaauuauauaauacaucuuaguguuaugguucuggguaaauauucucagguauacuguacaauuuuucagacaacaguuucaaacauguuuucacuucaugaaaguuuucuugaaagacaguuaauguuugcucuguuccucugaauauuguuucuuuggagauuccuacuauaaaaacacuguauuucuauugccuauuaucaauauuugccacuuucucaugagcccuuuuagacuuuuaaaauguucuugucuuuuaucuucaauuucucugaagauguuuuaauuuuauuuauuuuuaaauugcuguuuucuguagccauaagguuuugcuauguugcccuggcugaucuucaacuccuggccucaagugauccucccgccuuggccucccaaauugcugggauuacacgcauguuuuauuuuauuaagacgcacuaauucuuucgaguucuuucuaauuuagucuucauuuauuuugagacacagucucacucuaucgcccaaacuagauggcaauggcaugaucauggcucacugcaaccucagccuccugggcuccagcaauccucccaccucagccucccuggagggcaaugguaugaucguggcucacugcaaccucagccuccugggcuccagcaauccucccaccucagccucccgggcuccagcaauccucccacuucagccucccaaggagacaggacuacagguguauaccuugcccagcuaauauuuuuauuuuuugucgagacaggguuuugcuaugcugcccaggcuagucucaagugauccuccugccucagccucccaaaguguugggauuacaggcaugagccacugcacccagccucaaaguucuucuguuuuauguuuuucuuggcuuugucuuguauuauuuaaauaaugucuucuagcucacuuugaaauuguauuucuuuuugguauaccuuucagcaugcuuucauugaaacaaugcuguuuugucuuuuauucccuuuuaucuuuuaauucggcacaggacuugaccuugauacuuuucuguuguucauuuuaggggaaaguuugcuuuggauagcuauucuaacuucagaaucaacaaccuucuucuguugauuuugugauguuaaaaaauauggcaccuugcuuugagauuuccuauuguuuuccucuccuauuuuuaucugacauucuuuccuuuucucuauugucuguuucccugcuccaucugauuccacuccaagacucucacguagaguccuguguuugaagaaaaccuuggugcaacacacuacagacuccacagggaguagaccacugcaguccuuuuagaucagccucaucugccacugcacugagcaaaaucccuccucaguuucagcuccucuucucaauuuggcccauucacauuuuccaauugguaccuaucugcuguuuggggaccaaacaggucuuguccucaggccuaucaauuaucagaauaguauauaacgcugucauggcaaacugaacaauacagucaaaaauuuuuaaagagacacaaugaggaaacaaauacagaauugacaauucugaaaucauaagguuucaugaaaccuggaacaauuuaaaggacaguuuugaagaaaugaaaaaauauauuccaagguucuugaaaaguaugugagaaauaacauaauaagcauauagauuuuuuugguggggucuuaaaauucaaaucuuaguagaaaaagaaacagaagaaaaaagaauccuucuugacgacaaaagagacaaaaggucugaagagucauggagaagggcugugcaggcccaggggucagauaacagacaccaaaaguccaaacuaauagcguuaguucuggguaaugaggaggaggggagagauacuuucacaaaggagucagaagaugagagacacacuuucaaagucaaaagauuguauaggaauugggggagaaagcugagaaaaaagcaaaaaaaaaaaaaaaaaaaaaaaaccuggaagcaaacugaaguauguuaggcacgaggggauaaauuaggguugcugggacacauaugggaggucagagacaggaugcuuaagagacgggagauuuaaagguaacuaaaauuucaaguucagguaaacgggcaggaucaacaaaaagagaaaaagaaagaaugcagaaauaaauauaucuuuaagaaggagcuaucuaaagaccagcaaaauucugauaauaacuaaggcuuaaugacuggguucaugagaguucacuguacuagccuuuccauuuuugagaauauuaaaaauuuccacaauaaaaagacuuucaaaaauuucuagaaagggcugggugcaguggcacacacuuguacacaccuccagcuacuaaggaugcugaggcaggaggacugcuugagcccaggaguuugaggacugccugggcaacacagcaagacccuaccucuuuaaaaaaaaaauuuuuuucugaaguguugguaugaaccuuccucaugguauucuucucauucuauuucugggcuuaaucaucacuuuuuucauaguguaauauuucauaaaaauccauuggaaaauauucaaugccucaugaaaaaacuguaguaaagagugaaacaucauuuaaguuauuaccuugauuuuuuucuacagaaucuccuuuuguuuccucuucuuuaauggggggacuuauucuggggguccuacuuugucccuggaccacuucugcuagcaauucuucuugagaaguucgaguucugggagcaacuggaagugucuguuucuguggaacuuucacauaaaagcaaaaaagauagaaauacaaaugcaguaauacgucaaaacuccacagugacuaugucauauuaaauauaaaugccuccuuugguuuaggacauaugaguucaggcugggcgcaguggcucaugccuguaaucucagcacuuugggaggcaagguggguggaucacuugaggucaggaguuugagaccagccuggccaacaugguaaaaccucguuucuacuaaaaauacaaacacuagccgggcauaguggcacacaccuguaaucccaacuacucaggaggcugaggcaggagaauugcuuaaacccggaaggcggagguugcagugagccgagauugcaccacugugcacuccagccugggcaacagagugagacucugucuccaaaaaaaaaagaaaaagaaaagaaaagaacauauauaugaggaguucaauccauagauaccauucauuuuuucuuacguuacugagauagauaccugaaccuauuuauccaaacauauguaaacaauauccauacaaccacauaccaugaauacaauauaguacauauguauucauuuucaacaaaaugcgguuuauuuaagcuuagcuucaugaucuuauaugaguuucaaauuguaauuuagauaaccuagguaaagaaagaaaauuucaaagucauggaacuucucuaaacuucucaucauucuagacaauuaauauugcugauagaucaggaaaugaaauguagauauaucauuaggucaagagugcgccuuugccugauaaucuuuauucuauaugccaaaaccuguugaauuuuguguucaagguuaaauuagggaugaggagaaccaagaggacagacaaguaucaggaucaaaaacugauggugccaggcgcgguggcucacgcuuguaaucccagcauuuugggaggccgaggaggcaggugaucaccugaggucaggaguacgagaccagccuggccaacaugguggaaccccgccucuacuaaaaauacaaaaaaauuagccuggcaugguagugggcgccuguaaucccagcuacuugggaggcugaggcaggagaaucgcuuggacccaggaggcagagauugcaguaagccaagaucacaccacugcacuccagccugggcaacagagcaagacuucgccucaaaaaaagaaaacaaauaaaaaaacugauggcuacaguuuaccucauuuuaggaaggggggucacaaaaaaaagcgagagaguggauaagcagggcaaugcuguaaguacacccaccaaauccacagcaaaacuuaaaucuuuuuagaguagcucauuaccaucagcuucuuaacacaaguuuacacauuggcuacaacaggucggccagagaguacagaauuugacaacacaaaaugacacccaucaguuguuugcauuucagaaucagcuuuccguaagaccagcuuacagcugauucaucuccuguuuugaaaacguaauacuuuuauauucucucauaaaauuauucaguacuuccacuagaauuggagcaggaacaucacaaaugagucaauucucugccuuauauucuacuaaugaguuccgccaaaagggaagaaaccaaccuuguuuauauacuacuguuuaacaaauuucuauaacuucagauaccuaucauuguccaauuguacuccccuuuacacaucguaaauucauaucuaauguugaaucuaaugcuacuaauaugaaaguccuacuucaucaaaauucucuucaaaauauuuacguacuauauauuuuacacacauuggaaagauauaaaaggcauuauauggugcuugaaaaacuacaguccaauaacaguuggcgaaguuucucaaacuugucaauuuccuuuuaaagccauuuuucuauaugggaaccucaucuuggucuugacaucugacaggcaccuuuauuuuacaauuuaaggagcaaucauuuucaccuuacucaagaauuacagaaaugucuuaccaaguguaaacauaauacauuuaaauuaccuguagaguaguuaguuguuuuuguuacggauucuugagcuucagauauagccuucaaaaucagauucuuguuagcuuguuuagaagguggaagagaaggucuaaaagaguuaagaaagguauuuuuauuaaacuuuaaauuucaguuccucacaggccagccaucuauuaugccuuuaccacaaccuucucuagguuuuaaacagacuagcugcaguuuuuagaaaaugccaacuacacuggaaccuuauuuuuuuuuuuagacagacucuuacucucucacccaggauggagugugaugucacugcagccuuaaacuucuaggcucaagcaaugcuuccacauccaccucuccaguccaggacuacaggugccugccacaaugaccaacuaauuuauuuuaauuuuuuuuaagagacaaagacucauuacaucgcccaggcuggucucgaacuccuggucucaagcaauccuccugccucagccucccaaagugcuagguacaggcaugagccaccaugccuaggccccuuuuaguuuuuuuaaauaauaaaucugaaucuuaauugauguuguuccuccucaccccaccauauuagucaauauucucugcaauccucuccaauguuaagcaauuucucucauuaacguguuucucaaaacccaauggaaaagucuuacacgguauuacauuaaauauuuaugucaggugcgguggcucaugccuguaaucccaacacuuugggaagcugaggagggcagaucaccugaggucaggaguucgagaccagccugguccaacauggugaaacaccaucucuacuaaaaauacaaaaauuagcuggucaugguagugcacaccuauaaucccagcuauucaggaggcucaaucaggagaaucacuugaaccugggaggcagagguugcagugagccgagaucguggcacugcacuccagccugguugacagagcgagacuccgucucaaaaaacaaacaaaaauuauuuucgugauuauucucuucaauaaaucaggaagacuccaccaaggcaguuaaagauuaauuuacagccauguucaagguaccuccuuucaggcuuugcaggcacagacacacugcuggagaugcuuccuguucgagacccguaaucaucaucuucuuccuccucuucuccaucaugauugaauuuuuuuacuuuaacaacugaacuuaccacaggcaacuuucucuuccgaaaguuuucauccugcaaucagauaaaauuuaugcuuaccuaaucucagaaaauaacaagaguucuaccacaaaauguuuccauuuuaagaaaaaaacaguacacaguaauaugagaaauucacagaguauuucuugguuuuauguaaaaauauaaauaugaggcugggugugguggcucacaucuguaauccuagcacuuuggaaggccgaagugggcggaucacaaggucaggauuucgagaccagccuggccaauauggugaaacccugucucuauaaaaauacaaaaauuagcugagcguggcggcaugugccuguaguccgagcuacucgggaggcugaggcagaagacucacuugaacccgggagguggaggauguagggagccaagaucaugccacugcacuccagccugggcgacagagugagacaccguaucaaaauaaauaaauaaauaaauacuauaaauauaaauauuaucccuaacagucaaccuuuagcuaaaacaaaaauuagaacuuuacauuuauuuuaucaacagcugcauauagugcuauugaggaaacuaauaaaacagaguuaauugguugcucacuagcaauuaccaugaacaaucuaaaauugauugaaaccccccaaauuaauuuaagauuaauaucucaaaugcuggaaaucccaaaaagguauacagaugugauacaaaagaacucuaggagcaagccauggggaagaaaaucugguauagcaugagaaacagcagauaaaacaauuuaaaaauaaacuuggggccaggcgccaugguacaugccuguaaucccaacacuuugggaggccaaggagggcagaucaccugaggucaggaguucaagaccagccugguccaacauggugaaacaccaucucuacuaaaaauacaaaaauuagcuggucgugguaguacacaccuguaaucccagcuauucaggaggcugaaucagaagaaucacuugaaccugggaagcacagguugcagugagccaagaucaagguggguggaucacagggccaggauuucaagaccagccuggccaacacggugaaacccugucuuugcuaaaaauacaaaaaauuagccaggcaugguggcggguaauaccagcuacucgggaggcugaagcaggagaaucgcuugaacccaggagguggagguugcagugaguugagaucgcgccaucacacuccagccugggcaacaagagugaaacuccuucucaaaaaguaaaauaaaauaaaauaaauuuggaauauguguuuuuuuuguuuuuuguuuuuucuuuuuugguugagacggagucucgcucuguugcccaggcuggagugcaguggcacgaucuuggcucagugcaagcuccgccucccagguucacgccauucuccugccucagccucccgaguagcugggacuacaggcgccugccaccaugccuggcuaauuuuuuguauuuuuaguagagacgggguuucaccguguuagccaggauggucucaaucuccugaccucgugauccacccgccucggccucccaaaguccugggauuacaggugugagccacugugcccagccuuggaauauguguuuaguuacuucauauauuauuugguaucaagaacugccgauuuuuagccuaagccagaauuuaaaaguacauacaaaccuccauacucauuuucuccgaguuguuucuaaagaacggacuauacguuucuucuaagcuguuaagcaccucugguucacacaaacguccuguuucauauacccaacuacucugcauaucaagcugcuuggcagcaugaauacuauucugcugcuguugaaauugcaaccuguuuaaaugaacaccacuaucugcauuucuacuugcagguggucgauaaauuucaauagaagggcgagaagaaccauauguaagugucacuguagguuuuuucugagauaagggauucuccugcacaaaguugaggucuucgucaaugagaucaucugguucuggcuuaauaucaaucacaucuucagagggugcuggcucccucaaagguuucacuguugacauuagucggguugcagcuccaucaucguaagucugucuauuuaaaagaacaacaaaauguauuacagccaaauuagggcaauuaucaccaaaucuuuaaagaauguuuacuugaaaaauuucaaugaaaaaacugaggauacucccuuuacauauuccauucaaaacugcuuugaaauugcacuuucuuucaacuuugauuuacuaaauuugugauaaaagauaaucauacuuagaucuuauccauuauuuuauucaaaaaacuacucacgaucacuucauuguuucuaaaaauugcugagaacagcaaacugaaagauauaaaaacuaauauaaaugucacauacacagagccaucugcccccagcaggucuacaccagacucuuaccugacauuugugguuuuugacuccugcgaacuuguagaaacucuggaaucucuuuuuucaggucucgcgcuaggaauggcaagugguggcacugcagcuucaugccuccucucaucuccccgacugaaauugcucuuguuugaaggcacguuacuaucaaagauguugguaucagaagacuucagacuagaggguucugaaaagaaaaauacaguccuuuuaaucuauuuuuauuucuuauuuuuauuuauuuauuuauuuuugagauggagucucgcucugucgccaggcuggagggcaguggcgcguucucggcucccugcaaccuccaaaucccugguucaagcgauucuccugccccggccucccaaguagcugggauuacaggcaugugccacgaugccuggcuaauuuuuguauuuuuaguagagacggagauucaccauguugguuggccaagauggucuccaucuccugagcccaugauccgcccaccuuggccucccaaaaugcugggauuacaggcgugagccaccgugcccggccaucuauuuuuauuacuuuaagucguuuccuuccucaucaccaauucaaaagcaguauguuuauuguagaaaauuuuaaaaauauaauaaaaaucaccaauuaucucaaaggugauuuuucgggggaagagcauauauacacauuuuuuaaaacauguaucuuaugcguguauauucuguuauucuuccacaacauuauuuuuaauaguuaaauauuauuccacacaugguaauacaacaauuucguuuauuaugacugaacuuuuaaauuguuuucaauuauaaaauacugaaauauccuugaggcuaaaucuuugcacauauauguaauuauuuccuucggauaaagugcacugcucccucucccacacuuaaauuaucuuugaauuauguuaaauuuacugcucuuaaguucauaaaaguaugugcuuucuaaaaaaguucaaaugaaccguuuugaaauugauggguuuuucccaaagcacuaugacuuuagaaagaaacaaaucauaugccauagcaagcagaaauuaaaaaaaaaaguuaugaaucuuaccaguuguaacagagcgaaguuuaucuaauacaccaugaagccugaggaaaaaaacaaaaaacaaaaauaaaccuucuguuaagaaagauuucauuucaacugucacucuaaauuuaugacauuauauucagagauaauuuuuuaaauuuuuuuauauuuuuauuauuuuuaaauagagaugggguuucacuguguuguccaggcuggucuugaaguccuggacuugagagaaccaccugccucagccucccaaaguguugagauuacgggcgugagccaccgcaccuagcugagauaaauacugauaaacuguauuuagugaauaaaugguaugaacuuucaaacuucacauuuuuaaaaaagggcuuuguauaaauccuacagaagucaauaaaaaauuguauuuuuuucuucacuguuuucaacaucuagccucugcaaaaauaugggaaagaauaucaucugaccagucuuagucuacaaaauaugucacccuguuuguaaguacuaaagauuuacuguagcuuacaguaaaacaaguaucauaaacauguaauauugcuuauuauuaccaccauuuaagcagcuuauauuaacugcuuaaacuagauggugucuuggacaacuuaauucugagagguuaaaacaaguuauaaucucaaacuaugcuauaucauuucacucuauuacuuucaaaacugaugcuguaaggcuguaaucuugcuuguaacauaaccuguuuugguaguuauaaaugagguacuuugccuuacaucccuucccaguaccucucaaaauaugccagaaaccucauguuucaaugagaacccuagucacaugcuacuguccccacggacacaauuacuucaaggcuccaaauaaucacaauagucuguuuggggcugguguuaaugaacacuaacuuaagaaagcaaagugccaaaauggggacaucacccuuugcuucacuacauguuaaagaacucaauuuauggccagaugagaauguugaauuaauuugguuuuaaauucauuugguagucuguuuuaaaaaucuaaguauucuaucaaguuaucggagaaaaggaucuacucggucgcuuuagaaaaaaaaauaguacucacaauaaugguaauuuucccagucaaaagacccacagucuuuuuuuguggggggcugggagggaauaaccucuggggacaaauuguaacaaauggguugggucacccacagugaggcagcaguguaucauaacaacugaugaccacuauacaauguucuucaaauuugugcaauguauaaacccagagaauucugugcagaauuucaagacgguugauaagcauacaguugccuacuugggcaaaaacaccuugaagacgaccuuugguauaaaggcaagaacuuaaccaggcucaucuccccacucagugccuccucuugcacucaaauucggcaggccacuugcucacuucugcuacaucaucaccuuucacgguaacugguaguuccuagccugagaagccuaauaaaguauuucgucugucuauucucagcuacaucauuauccuccagcccucauccucacuuuaccucaaaccugguaccaggaccuagcaucuuaaguugaaucuuacucuucuagucaguauucucaacuaaaggcauauaacaguaauuuauguauaaaagcaaaguugccuauuuuaaaauuccaaacuuaaaaaaacuuauaaucucaaaauaugcuguaacauuacacuacaauuauuacucaaaaugaaggugugaguuuaacaaaaagcuuaaaaaguaagaaacagaaaagugagaaacagaaaaccuugcccucuaaagguaacucauuguaaaaggcaauguaagaagccaacccaguucaaaaaaacaucuguaacugguuuuggugggggaaaaggaacuauaagauacagaagcuggccaggugcaguggcucauaccuauaaccccaagacuucugaaggccaaggcaggaggacugcuugagcccaggaguucaagagcauccagggcaacauacuaagacccugucugaacaaaaaauuuaaaaauuagucaggcaugggaguucaggaaggaggggacugcaaugggaugaucacuugaaaccaggagaucgaggcugcagcgagccaugauuguaccacugugcuccagccuggugacagagcaagacccugucucaaaaaaaaagauauagaaguuuacaaaagaaacauauuaaguauagccgacauauacuaagaauuccuuaggaaaaugcuagggacaccuauaaguacuuuacacauauuagcccauuugauccucaauaauaauuuuauaaagcaaguggcuguacuauuuccauuuuauagcuagagaaaccaaggcaagacacagccaggauucaacuuuggcugucuggcuucagaggcugauaagguuuggcucuguguccccacccaaaucuuauauugaauuguaauccccaccugucaagggagggaggugacugggucaugggggugguuucccccaugauguucucaugauagugaguucucaagagacagugaguucccgaguucucaagagacagugaguucucacaagaucugaugauuuuauauaagucucuggaaguuccuccuucacucuucucuuuccugucgacuugugaagaaggugcuugcuuccccuuccuggggccuccccagccauguggaacucugagucaauuaaaccucuuucuuuuagaaauuacccagucucggguauuucuucauagcacugugaaaauggacuaauacagaggcugugcucucaucacucacaaacugccucuccaaaguaaaccuaacucaagugucaagaaccucucuuuggacagaauaucaacucaggcuugugccaaacuuuggucugaggcacaaaaauucagaaacauaccauacggugaaucgaauuguguuguucccuagaaacagggacagauccucugucauuugguccugacuuuucuuguuggccaccaucaccauaauguaaucaggaaguucuucaucuauuuaaaaggaaagguagaucaaaacuuuguuuccucaaaacuuucuucuuaaaguugaugugcuugaaaauauagauguagcucuaagcuuuagagucgcagagcucuacuggaauuacauuggacaagauggcuuagcuuuaauuuuuuucucuucauuccacagguauuucaaauacuagaagaauggaaauuaagaauaauugauacuuacaaaacuaaacauucugaauuauagggucaaacuugagcaugcauucacuuccuugaaucuuuuuaauaaugcuuauuaauuucaaagaagcuuaugggaaauauuugaacauuccccaagaaaaagaauugaguuuuguuuaguuuuaauuugcaaaguuucaaaauaacacucauuucucaagugaacaucuuuacccuugcuaaaggcagguuucaauuacucacaguaacaaacuuguagcaacaucgaauaaacaaauagacccaaaagcuccacaucauuuaaaaaaaucaauuuuaacauuaaauaaugucaacucaaugcacgguuuuacccucacagugguaauccuacaaugauuauaagggugaggucuaggauaaaaaaaaaaaaaaaagaaaaaaggccaggcgcgguggcucaugccuguaaucccagcacuuugggaggccaaggugggcagaucacaagguuaggagauugagaccauccuggcuaacacagugaaacccugucucuacuaaaaauacaaaaaauuagccgggugugguggugagcgccuauagucucagcuacucgggaggccgaggcaggagaauggugugaacccaggaggcggagcuugcagugcgcucagauccugccacugcacuccagccugggcaacagagcaagacucugucucaaaaaaaaauaaauaaauaaaauaaauaaaagaagccaaaaaacacccuccuagugguaauccuacagugauuaugagagugaggucuaggauuuaaaagaacaaaaaaacaaaaaccucacuaagaagauaaggaagcaaaagcuguuaucaggaacucuaaucucugacccucaaaacuccauuccaguucucuuuuuuuuuuuuuucuuuuacgacagagucuugcucugucucccagguuggaguguaguggcacaaucucggcucacugcaagcucugcuuccuggguucaagcgauucuccugccucagccucccgaguagcugggauuacaggcaccugccaccacacccagcuaauguuuguauuuuuaguagacaccagguuucagcauguugacuaggcuggucucgaacuccugaccucaagugauccacccaccucggccucccaaagugcugugauuacaggcgugaaccaccaugcugugacaaauuucuuuaauaccuuaaauacuuguaauauuucuaugcaggcagaaagguucauuucagaaguacuuuuuuuguuucaaagaaaacuauaaaaaaugcaguucaaguguugaaagaauaaaagaauaaauaaaucuugguucagcuuuauuuucucugagccucaauucucucaucuguuagucuuccaacaauccugacaacaaaucguuuaugaaagugcccagcaaauggugguaaguacuccauaaauuaccaauucucaaacuguuuggucuugggccccuucuuugguuuaugcagguucuauuauuuaugguguucaaaauuagaacugaucauuuuuaauuaaaaaguauuuauuaauucauuaaaaaauaaauccaucacauguuaaucacaaauccaauuauauuaacacaaguaacauuauuaaauuuuccaaaaaaaaauuuaggcaaggcacaguggcucacaccuguaaucccagcacucugggaggcugagacaaguggaucaccuaaggucaggaguucgagaucagccuggccaacauggugaaacaccgucuccacuaaaaacacaaaaauuagccggggggggggggcggggugguggcaggugccuguaaucccagcuacucgggaagcugaggcaggagaauugcuugaaccugggaggcggagguugcagugagccaagauugcaccacugcacuccagcccgaaccacagagugagaccccaucucaaaaaaaagaaaaagaaaaauuuacugcaaagacuggccuuguuucauauuuuuauauaucuuguucuaugugcuuaugacugaagaauaugaaaaaaucuggucucacagauaugcaguugaaaaaggaguauucugauagucuuuucagauaagguggauauucuucugugacacuacaccaaaacuaaacaagugguagcuuauuaaauguuaaagcaacguggaaugucaaauacgucaaugaccuuuuugaacuguugcacaaaaauccacugacccaccccagaguuuaaauaaaucuuuaauccacugcauaauuuuguaauauuaugcauugguuauuuagaaaagauugguucacuuagcuacaaaaaccacugacacguugauauauuucauuaugcaguauaaaauaauuauuuuuuaauaucgccauugaguuggccggaugcaguggcugacaccuguaaucccagcacuuugggaggcugaggcacgcgaaucacaaggucaggaguuugagaccagccuggccaacauggugaaacccugucucuacuaaaaauacaaaaaauuagcuggguguaguggcagaugccuguaaucccagcuacucgggaggcugaggcaaaagaaucgcuugaacccgggaggcagagcuugcagugagccaagaucacgccacugcacuccagccugggcaacgagugaaauuccaucucaaaaaaaauaauaauaauaacaaauuuuuuuuaaaucaccauuuauuuaaucagaaauuuuuuaaguacugggaagcugugaaauucauggaggcaggcucagauuuuccaaaauucuaauuuucauuugaaagcucacaugugauuggcaacaaagacuauggauucuuuucuuugcucacuuucaaguaaauaucugccaaauauccuaguguauguaaccaguuugucaguacuuugaaguuaaaaaugauguucccugaaagagguggcuagcuuaguucucaacuaaaaugauuuuccucagaacaaucguauuucaguauacaauaaaaauguuuuaugagcauuucuauuuccucgcacugaauacuaagaagauaaaaaauauuuuguaaacccuggacuucacaucuucaucaaugacauuuuaaguguaauuggcucaaaaagaaaaaaacuacaaggggggagugauuugaauaugauuucauuaugguguuacuaugcugacaaguuuuaucaaccauuaguuuuacacaauccaaacaccaccaccacagugaaaaauaacaaauaccaucuuaguauuaauaugaaaacaguuuugacuucagaggcccuuggagucucccacacuuugagaaccacugucauuagugguagcuauuauuuuuauaggaggcaccagcuuugggggcaaaccauaaaaccuugcucaaguaggcaaagccucaguuuccuuguuuacacagucaaagauacugccacuuaccuuccaggauucucguagggauuauccugaguuaauacauauacaauaguuaagcacaguaccugacccagaguaaacacucaaauuauaaaagaauaaagagacggaaaaagccuuacuguuucagagagagagggaaaacauaaagagaucggaaaauaaaacucacugaaccauuacagaagcaaaugccagaaagcaucaaacauucacauccaacaucagaguucuaaaaacaaaugucaagaggaaaguaacaagaauaggaaacuuuaaacaggcaugguggcucacaccaguaauccccgcacucccagcaccuagggaggcuaaggucagauaauugcuugagcccaggaguuaagaccagccugggcaacguagcgagacccgucccuagaauuuaaaaugagagagagagagaauaggaaaaacauaaaauaaaauucggucaaacagagccuuaacggaggaaacuaaauuucaaaacaccauaacagaaggagguuugggagaaaaaaaacaagguugcaaaaagaugauaaagaaguaaccagggaguauaagauuugaagaagguagaagggagucucucccaauguccaaaguacggugagaaauacgcauucacuaaaauucuauuagcugcaaacucuaaauucuguaagacuaacaaccaaaaaaacacuuaccaacauaagcuccuaauucuuguaauuuccccuuaauggcacucugagagaaaaagagcaaacgugcaugugagaaaggcggcucuaggaaaacaagaccggacucugcagcggcugaggccacuuugcuggugcgcgcaccucggaucccccgggcgggggcugggaggagccucgccugcaccgccccccaccccgcaccccacuccagcuccagccccagccccgcggcgcccaccucccgcagcggauccaaagcggcgccgugcgccgcggugguggcuccagccgggccugcgccuguccuuccauuucccggcggcuacuucagccgcagccacgcuccgaggccgcaaauguccccagggccgaggcggccuggacgaggaggagccgcagcccgccaggagcguccagcggaggccaggccgcggcguccacccgggcccacaguccccguuacuccugacaaccgcccgcucgccgagaccuggcuucccacccccgaccggcacgggccucacccggaucuugcggcugaucucggugccgaucuccauggcucugcggcgugcgggaacucagcacugcgcggcgcuuggcuuacccggaggcugccgcggacuccuaccccgcagccgggacaccaccgccuccuccuccguuccgcccccggccgcgcacacggcguauccccgc

SEQ ID NO: 17128 - RNA, 484 nt, Homo sapiens
auggccuuucucgcucccgggccaucuuagcagcagcuccugguugggggccaucccacaccuaaggcagaaagaugguggcugcaaagaagacaaaaaagucgcuggaguugaucaauucuaggcucuaacuuguuauaaaaagugagaagcaugugcugggguacaagcagacucugaagaugaucagacaaggcaaagcaaaauuggucauucucuguaacaacuguccaacuuugaagaaaucagaaauggaguacuaugcaauguuggucaaaacugguguccaucacuacaguggcaauaauauugaacugggcgcagcaugaggaaaauacuacagaguaugcacacuggcuaucauugauccaggugauucugacaccauuagaagcaugccagaacagacuggugaaaaauaaaccaugcaaaauuucccuuuaauaaaauuugccagugcuuguuaaaaaaaaaaaaaaaaagu

SEQ ID NO: 17129 - RNA, 28152 nt, Homo sapiens
uuaucaugauaagccugagaauguuucuuuuaugucaaggagaaaugacuuuaauauauauuugaaacguuucugcucagcgaugaaaaauccaaugucagaucacuuacagcaggcagacuugggcguuuuaagcaucucucccaggauaucauccaggcagcaagggcuguccccagaccugucuggcucugagagaaggaguccugugggugcacgagagagagccugugauuccagcaugucuggguauuccccagcugauggugcagacaugacaucauccugaguagcuaucuuagcucccacccccuacaugcacacucacguacuauccugggagcucuugauuuucuguaucaaugaauggauaauaugcacaagguagcaaaagcuguucuuccuuuuggauuaggggaaccaucuuucuccuuuugcuggaaaucuucccuaucaugauguuacugugcuagugcagacauaacaaaguaccacagccugguuggcuuaauaaaaggaauuuauuuucucacaguucuggauguuggaaguccaagaucaaggugucagcaggguugguuucuugcaggccucucuucuuggcuugcagacggccgccuuccccacaugucuuccacauggucuucucuguguaugucuguguccaaaccucuucuuagaaggacaccagucauaguggauuaggggucacccuaaugacuucauuuucccaauuacuuguuuaagacccuguguuaaaauagagccacauucugagguacucggggccagggcuucaacacgugaauugguuucaacauacgaguugugcaguucauuuuguaacaccuguggagauggguagagggcagguucucucugcaauaagguuuuacagauggucauuuaucuucugcuucuuucuuuucccuucuuauuuuuuacugugagaaaauucaaacaugcagaaaaguugcaagaauagcaaugaguaauuguuaacauguuguuguauuugccuccucuuuauguguagauuauaugaacugaugaaaacaaaguuuuaggcaucauggcaccucaccuguaaacuuuucagcaugaagcucagaacaaagacauccuuuucuauaaccccacgcuauugucacaccuaagaaaguuucaaauaauucaguucgaugucugucaucuaguccauauucagauuucuccaguuguccacuaagaccuuuauuuauuuauuuauuuauuuauuuauuuuuuaccagcauccagugaagaugugggcacugcuguugguuuuuauaucucuuuaaucucuuuagucuggaaugaucuucccauuuuccucucccccucugaugacaccgacuuuuuuucuuuuuucugagacagucaaggccaguuguuuuguggaaugcccacauccugaauuugauggauuauuuccuuguggugucuuucaccuugccuugugucccauggaagucagauccaaaugcuuauguaggcucaagcuuuuuuuuuuuuuuuuuuuuuuuuuuuuuuuuuugagacagagucuugaucuuuugcucaggccggagugcaauggugcagucucggcucacugcaaucucugccucccggguucaagaaucaagcaagucuccugccucagccuccugaguagcugggauuacaggcgccugccaccauacccaccuaauuuuuguauuuuuaguagagacgggguuucaccauguuggccaggcugguguugaacuccugaccucaggugaucuacccgcuucagccucccaaagugcuaggauuauaggugugagccacugcacccggcagcucaagcuuauuuaaacaauugccaggcaaugcugggugcuucuuaaaccauuaugucucaccagguuguccacuguuagugacgcuaagucugaucagcggccaaggguggucaugcugaucucuccauuggaagguguguuuuuggcaaugagcacauagccuacggagagauacuugggcacugugugcauaaccauugaugauucuugccugaauuauuuuaccgaaaguugcaaaauggugauuuuucuaauucuaucauuaguugauauuccugaaaaggaacuauaaugaccaauuuuuacaaaaaagaguugguguaauaaucgccucuaaugguggcaaauaaauaucugucugugacuaucacuauggacucauggguuuuuauuuagucaguuguuuuauaaucaauuauaauaauuguuuugaugcucaaauuauccuaaauuuggccauugaggcccuuuaagcugcuucuuuuguccuuugaacauacuccuuuuagucuuuaaguacuuucuugcacaaaaaaaaguucuggacucaucuuacacuuuucauauccagacaugagaucauccauuucuccaaaaagcccugauuccuuucaguggagaaugguauuuaaaaacugaaacuggaggccaggugugguggcucacgccuguaaucccagcacuuugggaggcugaggcagguggaucauuugaggucaggaguuugagaccagccuggccaacauggugaaauccugucucuacuaaaaauacaaaaaaauuagccaggcaugguggcaggcaccuguaaucucagcuacuugggaggcugaggcaggagaauugcuugaaucuggggggcugggggcagagggagguugcagugagucaagauugcgccauugcaucccagccugggcaacgagagcaaaacucugucucaaaaaaaauaaaauaaaauaagauaaaccgaaacuggacacuggguguauucauuauagcugggguauuauuauuuucaugaauuuauauugcuauugccaauucacauuuaauguuacugaguuuuuucuuagcaaucuuugauuuuguauuuauaucucuuugcuugguucuuaauacuauuaauguugugaacacauuuauuugcuuuauucuauaaugugcauaaaauaguuucaaaauuauacugucuugcuauuaguaauacaugucuggcugaaacaauauuucuuuguaguucaauuucaucuguaguauauggauguacaucuacuaggauacauaaucaguauugaauuaaaaugugguaugaaagaguuuuuuuucuggugagguuauguugcaaacuugcuuuuuuaguuagguuauuuuguguacuucuuaaaaaaauuuaaauuugugguuugcuuuuuuaaaaaaaacuucauugaggcauaauuuacauauaauaacaacauauacuugacgaugaacagagggauuagugaaaaauaauauacccauugaaaguauuuugacuaauauguacauaccucuguaaccaccauuacugucaggauauagaacaguuucaucaugaaaaguuuuccuucaguuccuuuguagucaagucaaucuccuaccccuccaccaaaacccucaggcagccacagaaguggugugaccacuuucugucccuguagauuaguuuuuuucuagaauuucguauuaaugcaaucauaacauaguacuuuuuuuuuuuuuuuuucugagacggagucucacucugucacucaggcuggagugcaauggugugaucucagcucccugcaaucuccaccuccuguauucaagcgauuccccugccucagccuccugaguagcugggauuacaggcgugcgccaccacaccuggcuaauuuuuuuuuuuuguauuuauaguagacaugggguuucaccauguuggucaggcuggucucgaacucuuaaccuugugaucugcgugccucagccucccaaagugcugggauuacaggcaugagccaccacgcccggcaagaauaguauacuuuuaugucuaacuucuuuuacucugcauaauguuuuugagaaucauacauguuguguguaucaguaaggaguucauuccuuuuuauuguugaguaguauuccauuuuaugaacauaccauaauuugucugucuaguggcccucugauggguuuuguauuauuucuaguuuuuggauguuaugaauaaagcugcucuaaacauucuuuuacaagucuuuauguggauaugugagcucguuucucuugaagaaauacccaggagugggauuggugggucauacaaguauguguauaacuuuauaagaaauuguccaacuguuuuucaaagugguuguacuaguucacauucuuuucucuuuuucuuuuucuuuuccuuuccuuccuucuuuuuuuuuuuuuuuuuuuuuuuuuuugagacaaggucucacucuguugcccuggcuggagugcaguggcacagucauggcucacugcagccucgacauucugggcucaggugauccucccaccucagccuccuaaauagcugggaccacaggcgcacaccaucaugccguuaauuuuuguauuuuuucuagagaugagguuuccucguguugcccagacugaucuugaacuccuggguucaagcaauccuccugcaucggccucccaaaaugcuggcauuacaggcaugagccaccaccccuggcccuaguuuacauucuuacuauuugugaauguuugcuugcuugcuucacaaucugaacagcacuuuguauugucaguguucucauuuuugccauuccagugguauguaguuguaucuuauuuuaauuuguauuacuuaccuuugacuuaauuuuuaguuugaauaguaaaacuuuuacuaguuccaaagacaaaaaucucuuaaaaaguauauguagugaccuaucaaacuuuuacuuuccucaauccuacuauuaaaggugugguuuagaugacuggagaauuuauuaagcaccuacugugugccaggcacuguguuaggcccugggucaugagcaaacacagagacagccccuaacuucauagagcuaacguauuaguuagagggcauagacauuagucacaaccucacaaauaaauguaaaauggucacugcuuugugcuguaugggaaagcuacagaaaagaguuaaggcugcuguuaccuggaucucaucauuggucuccccccacccccaccccaaaaagacuuucugcuuacgugcucccucucuuaauacuuguugcaaaauacuuccucugaaaugcuauaacuccaggaccuguagcaacaggccaaaacccugggaagguaaccagcaccccacuauagaacucaggucuuggaaagcugugauagcuuucacuugaucauuuggccuuagaugaagaagucuuacagacuuguuccuuauagaacccugauugaaacacgcuuucagugucuuuaaaaauauauugguaacacaugguuuacauuuaauuguuuuuuuucuuuuuuuugagacagggucccgcucuguugcccaggucagagugcaguggugcagucauggcucacuguagccucgaauucuugggcuugagugaucaucccacuucagucuccugaguagcugggaccacaggccugcgucacgacacccagcuaguuuuuaaauuuuugguagagaugggauuuuccuauguugcucaggcuggucucgaacuccugggcucaagcgauccuuccgccuuggccuaagcgcuggaauuacaggugugagccacugcaccagccuacauuuaacuuguugaaagccauuuuaaauuuuauuuuuaacauugugauauugaccuggauuugaauaguucccucagcgauuaaagaguaucagugcauauuguuauuagugugguguuuuuuguuuuauaucuuguagguuugcuggagauuuuuuuuuuuuuuaccccaugagacagcgcauaguuuuuaaauuugaaacuuugguuccuguuuuaauuuccuguggguuacccugaccuaguaaauaacaacaguggucuucaggaugagguugacuguuaagucuuaaacucuuggaaaguuugguuguauggugcucuuguuacaauaaaugaauuccuguuauaauaaauguaguuaauaucaacucuauauaguggcucagguaagauuuuguuucagucagcuguugucaaauuggaagccucacugacacuguuguccuauuugcaauuuuuaugugcguuuagacugacucugaaacauaauaguaaccauugaugaugcacuuacaaggaauucuacagagaauauuuuuaguaauaccauacuuuucuaauacuguaaucgaguuuucauguuucaaagcuuacugugcuuuuuaggaagaugaauucuguuuuuucaaguuuugcaggauaguaaauuauuaugguaguuucgguggcauauuuuuuuuuccugccugauugcuauccuuuaugacuuggggaaauugcaggggaauuauuauguacauacuguggcauguagauuccaagaaugaaauucugggauaaucaauuccguuuuuuauuuugucagucacgguccuggcagaagacagauggcacacucagaaagaagaaacuguggggagaggaugaguucucagugguaggcagggaugcgagaaacuagcaaagccgggggugcacucccccaggaugaggauggcaggcuacccccagggaacuuccauccccccgggaccugaacgggugaaggagaagagcagauaauagaugccagaggagaaaguagcugggcuaaugggugucuggugggggucauggucuuugauagcagggugcagcucacucacugcagcccagcacagagggagucaggggguuaacuuucuuauccucacucuccuccuccccucucugcuugcucuggugccucccuuugguggagcuugguggaaguccaugagcaggggagccuguagaugcauccauaaaugucagucuccuggggcuaggagcaggcaggaggaggcuaaagaggugcucugcggggcagguggaauauauccagcacacguacauaauauagacuggggagaggaccaacagcuguugcagcaguucccaugugccuugaauaucuaguagauuugugugcuuaaugccgggcacacaagaugaaugaggcuucugguggccaagugggucaugaugggagguuuucuuggauuguugguugguuuaauaucuaaggaucuuucuuuaauuaaaaagccuaaacagaaccccagacucuucucgguuguauucugauagucuuuauuuucaagcacuugauaguuacuuucccaucauuggaagaggguacaaaaucagaagagaucccucccaaaguuaagagcccccaccuuccuccccgggccacuuucgggcaggaagaggacagagcuggccuuucugaucagugagccucuucgcagccucucugacccuggugacucuugggugcuacuguucagauugacucaggcuucagugaucagagugaacccuuaaaaaaaauaaaaucaaaacuuuguaagaaagcugcuuaccauucaagaauaagcaagccgugaguugucccuaggacugccacauagggaaagacaguggugcugaaauagacgcacgguuuuguuguuguguuggggaaccgcugcacugcuggaaaacucaaaguacuuuccuuucuguugccuuaaaagguugauaacagugccuucuguguacuuacaaguuucauuauguacuuaaaggggguaaccaccagaaaugaaguuacguccucacugggguagauggacccuacgggccaugcagacccuauccggaguugaguguaauuuacggcucuguguguuuugccaaacaaauccaguguagauaauuccagaagaaugacacugggcucuagcuuucucucauucauuuuggaacaugcgcaucaaaccaaaguucuuucucugcuuauucccuuuaaacauuucuaaaguagcacacacuuugaagaaccugcuucuugccaagugaauucagaaaccuuggcuuccgcuugcuggggagacugucagcaugggcacagaugugcaugaguuucccacucuuugggauucuguguguuuugguacagcccuuugugcagccgugggaacccucugaaccaucccaaccuauuugaaaauauuucuagagggcugaauuuugucaugggggcaaccccaaagacccagguuugaagccuggcucugccucuugcugccucuugcugguugugaucuugggaaagccuguguccuuucagagaccauuuuuguagcuauaaauggcuuuaauaaucucaaauuccuucacugaguuauuuagggccaccugagauauuugaucacucuuugaaaugugguguacaaacagaugauuuuuuuucugcauauguggucacaugccagcagcacaaauacaaaguuguaauaaagacaauagugacuuugacuuucauucuuagcugaaaugaauaauuaaagaaaacgugugugcacacacaguauuagaaagcauuuuugugacacugcuguucaaggauguacauuuuagugcaguuggauaauccaaaauuauuugugauuugacuuggaagugauacaguuuuuguugcagcuaugcagugguguuuaucaauuccagaaucaagcugccugcauuucaccuuagacaaauucguuaacuugucugaacuuuacuuucugauacgguuugacucuguguccccacccaaaucucauguugaaucguagcucccauaauucccacguguuguggggagggaccuagggggagguaauugaaucauaaggacaggucuuuccuguguuguucucaugauagugaacaagucuuaugagaucugauggguuuguaaaggggaguuucccuacacaagcucucucauucucucuuguucucugccauguaagacaugccuuuugccuuccaccaugauugugaggccuccccagccauguggaauugugaguccauuaaaccucuuuuuuaaaaaaaaaaaaaauuacccagucuuggguauguccuugucagcagcaugagaauggacuaauaaccuuuccuuaucuguaggaucauaacauauacuaucucucuucuagauuuguugguagaauuaagugaaauaaauaauguacguaaaauguuuuggcuggugcuuggcacauggucgguuguaaguuaauaugaauaguuacuacugccagugcugcuguugcugcuacuaucacugcuacuaaagauguuuguguguacucuaaguuccaagcuggacugacacuuaggccaggugacucagcaguauaaugagugaguuaaaaauuucuuauguauaaagucuccacagauaaucaaaagcuggcuguuuuuggaaauccuaaucaauaauugaagcacggucugagagugugguugggaaguauccauguguguuccuggauaacgcaucaagcuucucugccucuccccucccccaggaagauugguagaguggcucuaggagucuuuccugaggcccagcucaggacucaugacaugguggccagagggcacuucggcauugucagaugaaacgcacuguguaaaguguuuguucagccagggaucuuuuccccuaugcuuccuaaucaaguaacucuuaaccccuggcggaguuucucucccauagcccucucguuggcuaucacgucaguuauuaauuaacuggaugagcuuuggguugacucucaggaggacuguucugugccccagguugcagugaguucucagcugagcugagaaggcuuuagaaacagguaugcuaucccagcugccccugugacccuguguaaaucuucuaggucacuguaguagcugaggugaauaccuuagugacugggguucagguuugucuuuuguuugcguuugaaacagggucucacucugucacccaagccggagugcaguggcacaaucauggcucacugcagccuugaccucccugggcucaggugauccucccaucucagccuccugaguagcugggacuacaggcguguaccaccaggccuggcuaauuuuuucgcauuuuuucuagagauuggguuucacuauguugcccaggcuggucuugaacuccugggcucaagugaucuuuccuccuuggccucccaaagugcugggauuauagguaugagccacugugccuggccagggauucgguguucuuuuuuuuuuuuuuugagacagaguuucacucuuuuuauccaggcuggagugcaauggggugaucuugguucacugcaaccuccgccuccuggguucaagcgauucuucugccucagccucccaaguagcugggauuguaggcaugugccaccaugccuggcuaauuuuguauuuuuuuaguagagacgggguuucaccauguuggucaggcuggucucgaacuccugaccucaagugauucacccgccucggccucccaaaguguugggauuacaggugugagccacugugcccggccugggauucguuuugauagcagaacucagcaguuucugagguagacacacaccugccgaggucagcagcuccuaccuuuugaucucacaggaacauaauuggugaggagcaugggaugcugggauugaggaagauacgaugcuuggguugagucauuuaccuuuuaaauucucuaccauaggccucugggagacgaggggaggguuucuggggcaggaggccggcuugcugagcccuggcucucuggacagccacugggacagauagcucaggcaucagugccuuuuccacgugguugcugccacuguucccaggggccaggucaguuggucuuucuggguagauucuguuuguuuaauuuuuuccuccaucccccuacccgugaaucacagugugaauuuauccccugcguccaacccccguucugucucccugacccuguguucccgcuggagcacuggucuggcagccucuuaccugcaguuuucccuggcaccccuguccucucccuggcaaccucgggcauauccucugguucccgggugcuuuguccauaucuuacccagcgcugacaagaacgcuggaggaaucgauaacacugacaauguuauuuggucccugcagcuucucacaugugggucggagaugguuucggauuuaucuuuggagccgggugccgccacaucagggugcagucgguguuagacacccuuuguugaaagggaucugcuucaugguuggagugagugcuuguucuagaauugagaggcacuguagaggcagugucuccuuaaaaguggauguguugguuggccggaugcuguggcuaaaagccaggcucacaacccaggaacucccaggaaaguucccuguugaaaauuagggaagaugggugacuggugaucucguggccaauggccacuccgcaagaacaaacaccaaacaacccagugucuguguuucacugagagagaagggcucaugauuauuuauuaaaauaaaaaaaucauaacugaagcucucuggcuuaguacacacacccugucacuguuaccuggccagguacuuugaacaacuuccaguuauggaaauauggugaucaaauuaugugccaauuugauaagaucacauuggaacauuuaaaaauagaugaguaacuacggacaaccagaagauaaaguggcaguaggugggccaguuguaauccaaccaagggcauccaugugucaggcccacguuaccuuuauugccguccauaaaaccugacucguuuguuacugugugcagcauggaaaucaccuuaaagaaaguggagguacuggaaggagugcgcgcccaguugcagccugaagucagagcuggcugucagcugcccccuccacuucauucaauaugcuuagaaauucuuuuacuaggccuugagcuuuaaaaaugaauauuuauguauuuaaacacauuauuuauguaaaugcaaugaguggugaauuuuauuuccccucaucccuacuagcacugucagcuugccuuucaaacuuuuuuuuaaaaaaggcacgaagagggcaauuuaauguaugucuuuuacuuuaccauuuauccucuuuguaauuugcuuaugcaauuucgacuuuaagauugugggugugauacaaacaacuguuagaaaaaaagaggaacaugcccacguuccagacaaguuuaccacaucauuguacauuccuguuuccuaucaggagacaaaacuuuucaaaugugcauguuuuuuucuauaauaaaguuuuuuuuuuuuucuuuuuuugagacggagucucgcucugucgcccaggcuggagugcaguggugcaaucucggcucacugcaaacuccgccucccggguucaugccauucuccugccucagccucccgaguagcugggacuacaggcauccgccaccacaccaggcuaauuuuuuuguauuuuucaguagagacgggguuucaccauguuagccaggauggucucaaucuccugaccucgugauccacccgccucggccucccaaagugcugggauuacagucgugagccacugggcucggccuauaauaaaguuauuacagaauaacuuuauguuaguuauucuaguuacuuuauguuucucuguaauaauuauuuaacuuucauguuaaauuuuaaaaucucuccauguguacuuuguguguacgugagaguuuauggcuucaugccacauaauauauugaguucauuugaguaauaguuugacucuuugaaguggcauagcauggcagcuauuagaaguauauaaaacgauccgcuuuuuagcuuccuguguguuuugcauguguuugaaguuuuuuuaaaugcuucugugccucuacccuuuuuagucagccuaugucaugcgaugagguuucagauggagaagaagaguuaaacccuuauuugcuaaaggcccucccaagacagagugguaaaacuaauuugggaggauccuaagauuuaguuggauaaaaccgauuuagcuagauagugauuuuaaagaugccaccucuuuggccuucugacuuggaguaugagggguguguuucuguuuccuuuucuuuauuagaacuuagcaguguagaguuugacaguauuucaaagucaauauaauuuggauguuuucaugaucauuuuaugauugaucguuguuagcgugcuagcucuugacugcuuuuggcacuugggaaacaauaguguagagaguacaaaaaaauaacuauuuucaacccaaacaaauacugaguagaucugucagccucgggaggugacacacugcagaugugugcuuccuguagccuccccccugugaaaaugacauugacgugugguggggagaaggaggaagaagcagggcucucucaaaauagugaguaacggaacagagauuccugcaaagcggaagcucggggaaauucugcguuucuuuuguaauucccgcccccacacaacucugucacagcaggcuuuuccuagagauuaauuugguuuuaggcaaaucaugggauuauuuugguuuuauuuagguguugaugcaagcagauuauugauuuuuccugcguccauucaaacacgcauaagcacacacacauaccguccagcuucucuacuacagaagaagcauuuacaagaguccuuacaauucuacccaugggccuaaaagaauuccuucuccaccuguuccacaugcguucccuugcagauggaggggcguucugagguauaugagguggauuucugaaagaccuguggggcauuaaaaucaucacagagcucaggugucugaauaucacauaagugacacacuaauagugauuuccgucuuuauagcuuuuagaacacaucuguaaaauaauagcaagacaggugcaagaguggaagccuuuucauaucugauauuuagaggacaugucggugaguuugaaauauucuguggcugggauuaucagggacucuguauccagcuccugaugccaagaaccuggugcugucugcagggcgccagagccucuccucccugccuguuggugcugaucccaggaacuagggcuacacugaggcucauggggccaggaucuugagaaagaaaugauaacuucucuuuuccaucuuuccuucugaaaaaaaacaaaaacaaaaacaaaaacaaaaacaaaacaaaaaaacaaacaaaaagaaacuauuagagagcaagguuggacauaaaacugaaacuuucucucaguuauuacagcaaucuuuuuuuuuucuuuuuuaaucuaaacugcuggaguaauugucgaucuuguuaugggaauagacaauaagguaucuagaaaaaaauucuuuguaaucaguuuuguucuuuuugccucucuucuucccucuuuuauguacuuggcugguuuucuuuuuaaauuuuugaaguguaaacauuuccccaaugucguuagacuguaaaugauagaauuuuagaaaaugaagggccuucaggaaucagucacuugcuaaacauuuugauauggaagaauauauauauauauuauauauauauauauauauauauauauauauauauauauauuuuacagacagggucuugcucaguuacccaggcuggaguacaguggcucgaucauagcucacugcagccuugaccuccuaggcucaagcaguccucccaucucagccucccaaaaguccugugaccaggcaugagccacugcaccuggccuuccuuccuuacauauuuugaagcagaggcuguaaguucauggugaauaacuuggcucuguucuguuuguucuucugcuaguaccaccuaacuucuacugugacgucccuugacagagaggagaauuaaguggauuaacugccuuucccaugcugaguaugguguuagguauauuguauacgucaucaucccauuuaagcccaaaaugacuuuuggagaagaugguauuuuugccaauauacagaugaagagauugugaagcuaagaggacaagugguuuguccauccaguaacacagcaaguuagcaguguagacaagaaccauaccacuugauccccuuguugggagcuacauguggggauucuuuccagaauguucucugggaaaguccuggcauugccuguggccccucaugggcacauagucauggguuaguuuguaguauuugucucucaugaucuugaaagagacacaugacccugggaacuuggaccccaugcagggguuuggugggaaggccagaggagguauggugacaagaacccagccucuaagaggcuggggauguggggguguuacuguggggauagcccaggugggagcuggaggggcuuccugagcagggaugugaggccccaggaggagcuggugcacaugugugugcacgccugcaguuuuaaccccuuccucccccagggcucaucucuuuuguccucuguugucuggcagcccauuggccagcuuguguaauccuuuguaaucacuucuuguuuguguuccucuagagguuccccaccuuaaggaaacggacccugccuuugugucacagggcccugcccaacuccugugcuguuagcucuuuacaagcgguguucagggaccugcuucaaaaucaggcccaacgauccaccuuucguuaggcccacggaaguuugaauggguuugugacccacugaagucugcauucuggccugguggugguggugguggagguggugguggagauggugguggugguggugguggugguggugguggugguggugguggagauggugguggagguggugguggagaugguggugguggugguggugguggugguggugguggagauggugguggagguggugguggagaugguggugguggugguggagauggugguggagguggugguggucguagagaugguggugguggugguggucguagagauggugguggugguggugguggagguggugguggagauggugguggugguggucguagagaugguggugguggugguggagauggugguggugguggugguggugguggaggaggaggugguggagcuggugcuggaggugguggugguggugguggaggaggaggagguggugguggugcuggaggugguggugguggagguggugguggaggaggaggaggagguggugguggugcuggaggugguggugguagagguggugcuggaggugguggugguggugguggaggugguggugguggaggaggaggagguggugguggugcuggaggugguggugguggagguggugcuggaggugguggugcuggaggugguagugguggagguggugguggagguggugcuggaggugguggugguggagguggugcuggaggugguagugguggagguggugguggagguggugcuggaggugguagugguggagguggugcuggaggugguagugguggagguggugguggaggugguggugcuggaggugguagugguggagguggugguggagguggugcuggaggugguagugguggagguggugguggagguggugcuggaggugguagugguggagguggugcuggaggugguggugcuggaggugguagugguggagguggugguggagguggugcuggaggugguggugguggagguagugcuggaggugguagugguggagguggugguggagguggugguggaggugguggugguggaggugguggugcuggaggugguggugguggagguggugguggagguggugguggaggugguggugguggagguagugcuggaggugguagugguggagguggugguggagguggugguggagguggugcuggaggugguggugguggagguggugguggagguggugguggaggugguggugguggagguagugcuggaggugguagugguggagguggugguggagguggugguggagguggugcuggaggugguggugguggagguggugguggaggugguagugguggagguggugguggagguggugcuggaggugguggugguggagguggugcuggaggugguagugguaggagguggugguggaggugguggugguggagguggugcuggaggugguggugguggagguggugcuggagguggugguggagguggugcuggaggugguggugguggagguggugcuggaggugguggugguggagguggugcuggaggugguggugguggagguggugguggugguggagguggugcuggaggugguggugguggaggugguggugguggaggugguggugguggugcuggaggugguggugguggagguggugcuggagguagugcuggaggugguggugguggagguggugcuggaggugguagugguggagguggugguggugguggugcuggaggugguggugguggagguggugcuggagguagugcuggaggugguggugguggagguggugguggagguggugguggagguggugguggagguggugcuggaggugguagugguggagguggugcuggaggugguggugguggaggugguggugguggagguggugcuggaggugguggugguggaggugguggugguggagguggugguggagguggugguggagguggugguggagguggugcuggaggugguagugguggagguggugguggagguggugcuggaggugguggugguggagguggugguggaggugguagugguggagguggugguggagguggugcuggaggugguggugguggagguagugcuggagguggugguagcugaggaugaguuuuguggaaacaugggggaaccugcggcugugaggguaucagcucuugccccagccuuccuuccuucccuccuucccuccuucccucccucucucccuuucuucuucucucucucucucuccucaccuccuuccgucacucccucugugucccuuuuuuuccuucucucucucaccguuuuucccucccuuccucuuuccuuccccucuuucuccuucccucccucucccucucauccuuucccuccucccuuccucccucucuuuuuaccucucucccugucuuccugccucccucccucccuuucccuuucucccucccucccucccucccuuucucuuucucccucuuucuuuccuucucuuucuuccccucucucucuccaucccucucucuuccucucucaucccucccucuuucccucucuccuuccuccuuuaggggcagcugggcccugaggaguugagccagagccagguccagaggaggaggcaguuuuggcgggaggggagggcauuuugugcagugggggcagaaacgcaaggccagugugcaggggccccggggaauuaacugggcacucauagugaaauaaaccuaggccguuuccaggagaagccuucaagccugccagauccugggagaccguggcauaugcuggacagaaugacagcuugaugaggaguaccaacucuaggccaccucucuauaaaguuacaaguaucuuuuggugaugaggaaguggaccauauccgcuccaguucccaccaugagcucaaggauccgugagagaacaguggccucagaggcccagcugccccagccagggagacccuucucuuauccaccucugcccacuccagcuuuauucucuaagucaggcuguugcccuguccugcucccuugcaguaucggggucagggccucuccuccuuaaggaaggagguggcaggugguaagcccuuuggggcaggaccucucuaggaagcccuggacugccauaccggccggagcaucucucagugugcacgaagacaugacucaaagcaaguagcuuucucaaagucccauguccuucuuggcacuacuccaguggcuggcucuuugcuuuguucuauuucgauccuuccauuuccaccucuaucuuagugcaucugagacaaaacgcuucuuuuggaccaaggaaauuaacaucagacuauggaaaacaaauagucaugugcaauuuuuuuagaugaaaucugcaugauuucacaauuugacaaguaccuauuccaucaggcaggcacugaaugguuuggagcucagugucaaggaaagcuggcuauuuaauauuuuguugccaucauaauaacaagagcugauuuuuuuuuuuuuuaauuuuauuuugagauggagucucgcucuguugcccaggcuggagugcaguggcgugaucucggcucacugcaaccuccaccuccuggguucaagcgauucuccugccucagccucccaaguagcugggauuauaggcaccugucaccaugcccagcuaauuuuuuguauuuuuagcagagacagguuucaccauguugacuaggcuggucucaaacuccucaggugauccucugccuuccaaagugcugggauuauaggugugaaccacugcaccuggcccgagagcugauauuuauugaacuguuaccaugugccaagcaagcacaauauuaucuccuuuaauccucacaacaaucuugugaagcagguauuauuaauucacucccauuuuauggaugaaaaauuugaagcucagagcaguuauguauuuugcccaaguccacacagcugagaaauugaaacaagacucagacucgggucugucugacuccaauguccaugucagccaaguaagggcuccccuuugaaagcacaauaauguguuucucacugaccccacacaugggugguacuggccuagaacagaaagcuggcuguguugaaacugugaaggaguuggagacaugaggacccauguauucuaauuaaucuguaaucacacguucccaaagcauagaaugaugggccuuugggaugauuucaucucagcaccuaauuuauagaugaggaaacuaagacccgggguggggagugagcugcauguaugccaugauuacucaaggcagugaugguaggugcagcccaaccagguauguguucuuauuacggaugggguaacuuacucuaguccgugucuguaucccccaaugggggucuuccuuuucgaccuuggagcacuugacuuaggccaucauccacaccccacccaucccacaggacccagcccaaaucccuuaacccugaaaacuccuucucugguuuuuaaguuuccuaaaacugggaguugugagucucaguccuggguaccaguauuggagcuguagggcagugggcagugaacuauggauaauguuuuugcaaauaaggucuuacugaagcccagccacguuuaucuguuuacauugaugguugcuuuugugcuaugauggcagaguuggguuguugcaacagagaccaugugaccuacagagacuauagaauguacuuugagaagccguuggaccuggccaugcauuagaggaccugguaacagaaagagaaguuguuuaagaaaaguuuacuaaccccuauuacagaggaaccaguugauguuaaaccucuaaagccagacaaucucaggccuaccaugacauuuaugagcuucugcuagaaagguuggggucaaugaggguauagcagaggggagagagguggcuuaugcaguccauuccuccagauacagucgcgcguugcauaauagcgagaauaaguuuugagaaauacgucguuaggcaauugcaucaucaugagaacaucacaaaguauauguacacaaacccaguuaguauauguuuauauacauauuuuuucauauggaaaaucaaaugaucccacaccauuacugaauaucaauuacuucuccuacuugaucugcauugccagugucaacugcuguuuaucagguuucuagcucucucucucucucuuuuuuuuuuuugagauggaguuucacucuuguuucccaggcuggagugcaguggcacgaucucggcucaccgcaaccuucgccucccagguugaagcgauucucuugccucaggcucccaaguagcugggauuacaggugcaugccaccgugcccggcuaauuuuuuguauuuuuaguugagauggugucucaccauguuggccaggcuggucuugaacuccugaccucagaugauccacccgcuucagccuccugaaguguugggauuacaggcgugagccaccacgcccugcucuaucuccuuuuuuuaagaaagagacagggucuugcucuguugcccagguuggggugcaguggcacaaucauagcucacuguaaccucaacuccugggcucaagcagcagucuagcuaauuuuuauuuguauuuuuuguagacauggggucucacuguauugcccaggcuggucucagacucccggacucaugcuguccuucugccuuggccuccuaaagugcugggauuacaggugugagccgcuaacuggccucagaguacauucgggagcuguccuccuuucuccgucucauugcugcccaccugaaccaacacccauggucaucuugguccuggaccgucauaucaguucucugcaggugcucuugccacuuccagcccauuuauuucucacacagcagcaacuuccuuucuucuaacucauggcuuauucuguuuccuuccuagcagguauuacagucugucauaaucuugcuuauuuauuucuuuacuuacuguguuuuuucccaucuauaauccaagcuucaggaggucggucuccuuuuuguauuguuuuguauucacaaguggacccuucauggugccuggcauguaguaggcaccacaggaaugaaugaaugaaugcaugagcguaugaaugaaggaaugaaugaagguggguaguguuagaagcacccuccaaaauggugugucagaaacaucaaaagcuauuguuucaagaucaccaacacacacccagcuccccacuccauuucguuuucaguuuuugucuuguuuuaauaucucaucagcuuuacaggguuacaauugucuuaaauauuucugaaguguaaauaucaucugcauaauaagguuguuauaaaauguaaacuuucuguguuguuuuaauuuaauuuaauuuaauuauuauuauuauauauuuuuuugagaucgagucucgcucugccgcccaggcuggagugcaauggcacgauuuuggcucacugcaaccuccgccuccaggguucaagugauucucccgccucagccucccaaguagcugggauuacaggcacccuccaucaugccuggcuaauuuuuguauuuuuguagagaugggguuuuaucauguuggccaggcuggucuugaacuccugaccucaggugaucuguccaccucggccucccaaagugcugggauuacaggugugagccaccaugccuggccugucuuaauuuuaaagucuaaaaaucauacuuuuuuuuuuuugguccuuuuuucuuuuuucuuuuuuuuucuuuucauaccugaauguucugcacaaacugaaauuguuacaggcuaucccucccuggccagggcagaacaggccugggcagagguggugccugcuccacuuugacauggggccugccuccuuauccccguucuuuaggcacugccccagagccacguguaagucccccacuguugcuaauagggggcuuucuuccucacaaguggugagaagggggaaaaaacacaaccagacacuacuguccuagaucaguggauaccaaacuuuguugacccggcuucccaguaagaaguguauguuacuuggugaucaguaaacauguauauacacaacuaugcaaauacaaauuucacuauauguuacugcagauauaugguaguccauucuauuugguucuaguuuguuacauucuguuccauuaaaacagugcugcuuaugauccauuccguucauuucaugacccaugaauguaucuggcccacgguuugaauaacaauguuuaaaguauaggcugggcguaguggcucaugccuguauuuccagcacuuugggaggccaaggcagacggaucaccugaggucaggaguucgagaccagccuggccaauauggcgaaaccccgucucuacuaaaaauacaaaaaaaaaagaaaauagucgggcauaguggcgggcaccuguaaucccagccucucgggagacugaggcgggagaaucgcuugaacccgggaggcggagguugcagugagcugagauugcgccacugcauuccagccugggcacgacagagugagacuccauuuccacaaaaagaaaaaaaaaaauuacuuuuuuuuuuuuuuuuuacauuuuugcuaaccauuucuuccuacaauaugggcucuuguuugcuuuucuuuuugugcauugauuuuuuauuuuuaauagagaguugauuuuuauucccccaggugguuuuuaauuuuaaaagaaacuugggcucauccauaauuuuuuuuacucauuuuuccauguaauuuuucucaguuuuuuuucuggggguguuaguguauauauacacacaaaaaugugagugugaauacacacgcauacuuuccuauaaaugaauauucuucgcuuauuauuuugaauuccccgacacuuaaugguguguggcccucacaguuauuuauuuauuuauuuauuuauuuuuugagacggagucucacucugucacccaggcuggagugcaauggcacgaucucagcucacugcaaccucugccuccuggguucaagagauuauccugcuucagccucuuaaguagcugggauuacaggcacccaccacaaaacccagcuaauuaugguauuuuuaguagagaugggguuucaccauguuagucaggcugguuucgaacuccugaccucaggugauccacccaccucggccucccaaagugcugggauuacaggcaugagccaccgcaccuggccuauuucuuuucuuuuuuuuuuuuuuuuuuaauaaaaagcacuccacggccgggcgcaguggcucacgccuguaaucccagcacuuuggggaggccaaggugggcggaucacuucagguuaggaguuugagaccagccuggccaacauggagaaacccugucucuccuaaaaguacagaaauuagccgggcgugguggcgggugccuguaaucccagcuacucaggaggcugaggcaggagaggcuugaaccugggaggcggagauugcaaugagccaagauugugccacugcgcuccagccugggcaacaagagcgagacucugucuaagaaaaaacaaacaaaaaaaaccaaacaaaaaaagcauuccauauucuugucuucagaugagaugcagauauuuuucuaagaaagcuccaacucucaaacuuacuacacaacuauaaucaaguuauagccuucucucuccuauuagaaacauuaaauguaauuuuuccuggccuaagaaacuugagcauucuauccuuugcauauuuccauuuuuaaaguuuucaaguaaaccauuuuacuacuccaaacuguuacaugaaacccaagaaaaugcuugaaaaugcaggaguucaagaccagccuggccaacauggugaaaccccaucucuuuccuuaaaaaaaaaaaguuagccaggcauggugaugcacgccuguaauaccaacuacuugguaggcugaggcacgagaaucacuugaaccugggagggugagguugcagugagccgauaucacaucacugcacuccauccugggugacagaaugagacugucucaaaaaaaaaauuuuuuuugggagauggccacaaugaacugaccaaguauggaauuaaaccucagcuugauguugacagugcagagaccugggcaaaagacuuucagcagccagguagucaugagucagugauaguagcuucccuagcaagggagaagucccaguagugaguguggggugugggguucauagaaagcagaugcagggagugaugaaaauagagggggagcugagaaugucaaaaagcucuucccagugaauuuguugagccaggaccaccacugcauucaaauagaugaucauuuuaucuucacucgucccaucuguuugcuggaggcccuucccaccgcugcuguuggagaugaaaaucaaucagauaugguucaaugaaagacauuguaagccaguuucauugucuuucuuguguccaaaaggagauuuucaugaugcugucugccauuuauugaguaccuguagguagggccgcuacugaagguguuuuauauuaugccaucucugagccucccagcuaucucuaagugggucacuguuuuaccagugaggaagcaagacuucccauggcgcugugauuugugcagggccacucaggaaacgucuguguggcuccagaucaccuguucuuacuauucuucagccugccucucugcaucuggaucaauuaccuugugaauguccugcacaguccuggggguuuauucugcuuagcuuuuguuuuuauuuuuauguauuuauuuguuuugagauggcguuucacuguucuugccccagcuggagugcaaauggugcgaucuccgcucgcugcagcuucuggcuccuggguucaaucugcuuagcuuuuaaaugguagcauacauuaauauggguauacaaggguacaguaaacaaacacuuagguuaggauuaggagaaaccacguucuuggcuuacgguuauuucccugagaaggccaaccgguuguccuucauuucuuugucauauuauuuuuguagcguuaagauuaaauggucccacccugaaagccaccaugaugagaacaaaagccauuggguuuccagaauugagacaauaucauugcagaaauguuugggucacaugucagccauggcccucaguguagcuauugcugguuuggagccuugggugcaagggaucagaaaggcaggucccacuggcccagggcuccaccgggagccuuugauggaaucaggccagaccccuacuguugacaggauuuggugguuuguuuuauguuuuccaaauuugguaguuaccugucuccugucuuuccccccaaaccucuccacuccuuagcuuuuggcuuucuucugcacagcucuuuuccaaaggaagggaugaagcuuccagggcagauuauugaguggcccgccugauuuacuugcaaagucucacugcucccccugaacuauucuggguuugagaaugugugcgugaaaggaaaaaacacguaggaauguugaauuuuccaaaguugaaaucuuucaggucuuuaaacauccgguugguuaaacugagaacauugauguuuaagcauagaguguccagccagacucugaccugugucuggggucaggccugcacgugggggugggugacuagaguggucagagguuccagccccuggcugugguuuugagcaauucuccuauucucauugcaccagaaagaguuaauuccaguugcacggcuugcugauguuguugauaauaaaguauuuuaaugggcucugugaauaauguuuguaaggaaacuacucgggugaacugaugaugaaacacagauuuuuuuaaacuuuuaaaaagauuuuaggaguaacuuguuuuuacagcuccuucagugggauuuucuuggauuguccccuucccccauguuaguuaaacagcuucuuguuugcuuucuaaauguuggaggacaacaucaaucuuacuguuggcugaaagcaggaggugggcacggguuuauguaauuuaacuucuuuucucugcaaaucaguaaauauuuacaaaugaccuuaucaaacaguuuggguacauucggucacuugaaagugugcggccagaggaacgauugcccgucggccugcugccaguuccggggggccucaaaggaaggacuuacauuuuuaaaaauaggcuguccauagaccaaacgcuucacaggaagugggccucacaggaagccucccucucuccacagaacgguuuuagaaaauuugcauuuuaaaguuugacuucuaaagauucaacucuuaauggcuggagucgauugcugggaacugaggaauccaaaaaauaaauaguggauucugaguugggcuuuaccauugcugccugaguucuuuuguugcuuagggaagguaauuacagaauucuauuccaagaguaaaugucauucuuuugugaguaagcuggaaagaaacaaggggauuacuuuucuguuuuuauaaaaugaucccgaugucauaugguuuuaaaacauaacuaaauuucuggagcagagauggacuuuugggggugucucggcccucuuuuuuuuuuccccaaacuuuagaaaucugacacaguuaaauucauuuuuagaagagaaugcacguguucuucaauguugacgcugaaaaacaaugagauucucauuuuauugguaguuuggguaugaaaauuguaauauuguuguaucaccauaaccugguaauaauauguucauuuugccuaucaaacauaauacaaguaagauugaagugcauuuuauggaguucuacugucaguauaauauuuaaggcuggcaaacagucaacaaaugagaagcuuuuaaaaauaaagaagugauaauagcuauacaucuacuuauugcaaaguacuuaauaauucucuauuaaugccuuuguauuuuaauuuucuuugcagaguauugggaaagggucguuguggugcauagacccagaguauagacaaaaucuaauucaggcuuugaaaaagacaccuuaucacccacacccacacguguucaauacaccucccaccuguccucaggcauaucaaagguaagcaauucagacuucuuuuuuuuggucuacugaaauggcauuauuuuggcagagaccugcgcggaaauuaauuuaauaggccguacgagauuuuaaaaauaacugcagguaaaugagaaagaaauuaaguauuauuaggaggcauauccacuguuguauuuccuacaaaccuuaccgcugcugcagcgucagaggaaugugcuuccagaaggcuucauggugggugaaaucaugucuuccugggu

SEQ ID NO: 17130 - RNA, 12829 nt, Homo sapiens
uggguaaaugaaggggggaagaaccgggcuccuuucuuaagagggcuuuugcauaccuuuuuuuuuccccuccccaaaacaaccccaugacuuaccuaaaaucaugcaccugcuuguggcaggagggggccaggaacucccauuccugacucaagacucuucccuucuccauuugcaccugagcuguuuaaaagcagaguagauagucugccuuuuacuauuuuuagcuuauuuuucaucucauuuagaauuuuaaaaguaauuugcauacacuaucacaguuuucuucaacauaauugugaagucacagaaagaaaucucugcauagcaucucauccaggcugacaagugcccgacacauguuccaguguagcuuucuaccacccauggccaacgggaguggucaguuacgugccccugccugcugagcagccgagauguccauuaugcucugggggguauggaaaaugucaccugugugucaucucuguuagccucuaaaauccuugauuggacaguuaggauagcagccugauagccagaugguucccagaagugacacagcccuugcauuggcuccuggacuguaaccugccgccuucuugagcccuggauugcugcccugacagaccccagcaaagccugcagaggagcccucgggcacugggaguggaggggcaggaggaaggguccccagcugaccugugggagcuccuccccagccccuuagacccuggacuccgggacugaugaccaucucggagcuuggggcagagaguggaaguggaggcccacagaccacugggcucugacuggacuuugucuucagccuccaggaagucguuuguguuugagcugaacgaaugugcguccagccgcauccugaagcuggagaaggagaaucagagccuccagagcaccauccaggggcugcgggacgcgucccugguguuggaggagagcggccucaagugcggggagcuggagaaggagaaccaccagcucagcaagaagguaccucggccuccuuaggccaccggggaagcacagaacccuugggcacccucccauccuccccagugauugucuggagcacagacaaggagggggccagguagagcaugcaggugucaggcaguggacagaauccaggcgcagucaccgcugauuauaauaggaaugggagugaggacuggggagagccagaggaggcguggcccugucccugcuucgcugccauuagaggaugacccggacaugugacuuucuugugccucauugucuucauuugugaaaugggguugauggggugccugccuguaaaaagaaaacucccucguucucuuccacgccacugcucccaguaccucacugcuuauaccaggggugugggguuuuccccauaucaagcaguucucaaguucuugggggacaccagcuggguauccuacaauuuaacucaauucugacacuacagacccugcagccuaagggcucagucccaccagacugccucccacuucaggugccaauccaaguccggauugucaccugugcuucugaucggcuggcugcagaucagagguucccaccacccccuucgugggcuccgcuauugccuagauggcuuaguauuccuuguuuauuacaaaguauacaacgcacaggcagaacagaugcacagggcggugggugcggggaguggugccacgcuacccuguccucugcgggugccccuccagcaccuccacauguucaccaaccuggacacuuuuugaccaaguccuuuuggguuuuuauggagguuucauuauauaggcaugauugauuacaucauuugccauuugauuagcucaaccuccaggcccugucuccucccuggagguaggggaggccugaaaguuucaucucucuaauaacaugguugguucccuuggcaaccagcucccauccugaggcucuccaggagcccccaguccucauucaucuuagcauacaagaaagacaccuaucccuuuggagauuccaaggguuuucgaaacuugugccaggaaauuuagcaacaaccaaacacacauuucuuuuuuuuuuuuuuuuuuuuuuuuuuuugagacugaguuuuguucuuguugcccaggcuggagugcaauggcacaaucucagcucauugcaacuccaccucccagguucaagugauucuccugccucagccucccgaguagcugggauuacaggcacccaccaccacacccagcuaguuuuguauuuuuaguagagacgggguuuugccauguuggccaggcuggucucaaacucccgaccucagguggcccacccgccucggccucccaaaaugcugggauuaccagcaugagccaccaugcccggccccagacacacauuucuuaugcuggcuguuguggggauuagaggugguagugugugugacggauucggcacauaguaagcacucaauaaaaagagagcagggcacuguuauaaagcaugcaauagggacccagggagaagaaccaguaagguaccgaauaccagacguugaguuguugacuaaagugauaaugaacaucuuuggggcugcaaagccuaggucuguaugugugaggccacugacggaacaccuuagggucuugcugugguaaaacaagcaggucagugcuuucucccuccccuggguuuaugggauggggaagaagagauagcugaacuguguucuguuuuaaugacagcuguuaggucuuccugggagcagaguagaagccagacaccugggugaacagaugagaguuugcaagccagucuuguucuacaguuaagaggaucccugucacauggcagauuccuucucaggugcaggaaggggccaaugagagacuagggauugccgacaggucuugcucauuccaggucagaggaccucucauccaccugccucacacuguggaggcacugguguacugugggcucugaaugcaccagcugucagauuccagucgagggaggaggccagaguguucuugcgggcugacugccaugcaggaugggcaacccucagccagcucagcucauccugaauuucccucuccaaccucagccauccagcugugaguccuggcagugucauuuacugaggcaugacuguggcaggacaccugggucccuuggcucugcagguucuuuuuuuuuuuuuuuuuuuuuggacggagucucgcucuguuguccaggcuggagugcaguggugcaaucucagcuuccuugcuaucuccaucuccuggguucaagcgaugcuccugucucggccucccaaguagcugggauuacaggcaugugccaccaugcccagcuaauuuuuguguuuuuaguggagaugagguuucgccauguuggccaggcuggucuccugacuucaggugaucugcccaccucagcgucccaaugugagccacugcacccagccacucugcagguucaugaucucugaggcugggaacaggucccccacuccugggaacuggucccuugaguucccucaugggacuucuacgaggcuccucacucuugucccuuugaacuuugugugccuugcagcguuugagcugccaggugguuuuuccucucuuuguaggacaacagaagacacccccgucucaugccacaucuucuggugcagggcagcauggggaaagugacucgguuuuuugagacagggucuugcucugucauccaggcaggagugcgguagugugaccauggcucacugcagauuugaccuccagagcucaaguaauccucccacaucagccucccgaauagcugggaccacaggcacguaccaccacgcccagcuaauuuuuuuuuuuuggaacuggggucucuuuauguugcccaggcuggucucaaaccccugggcucaagcaguccuucggucucagccucccaaagugcuaggagcacaggugugagccacuguggcugacucaguguuuugguuucuuagauucaugugggccuagcacgggaaaugucuucauaaguggcagcccaaccuuggccaugauaaaaauaauugcccuuuaggaagaugagaaccuccagcucugcagguccucacgacgcugccccagaaagccugcaguauuaucucucuggccuagugauauuuuggggccccuucuggcaggucaccaggguggugcccaggcaucucucugcccuguccugucugcuguggccccuccucuguacaaacaggaccuggcgggggcgucgcccacccaccacaacuccuuaugcugaucucucaggcccuacccacuuccucccuggcccgacgccagccucuccugccguggcccucgggaggcccugucuuggcacacacucucuggucgugggggcgccggaagggaggggccgcuguuugcaggcagggcuguccugugucugaagccuggagcucucuccucccucucguccuuggccugcccugagccuggcuggaaucuggcccgacccugcagggugguucucccuucacucucuguccaugucucacugacuguuuuauuggccccagugcccagcccagagucugacacguagagggugcucgccagcauuugacaggugaacccuucagcaccagcaggaggcaggcugugcuucaggccuggcaacccucagccagcucagcucauccugaauuucccucuccaaccucagccauccagcuggcauuuccuagucaguaagcaagcccguuggcccugcugagucccacagggggccccuagugccaaccuggcucuucaucucaccccgaauguagcccaggcugcacgcuugcuuuggucugggaccucuggaaaccauaguucccugaaguuaaaacaucuuucucucuaacucaaggcaccuccauggguccuagagaagcccccucccuccucugugucuguagcuuuguauugaagucauaagaguucauucuuugagucaggaaggaaaaagaauccuuauuuuuagaggaagaggggcagcccuuugggggccugucaugagaggcaggagcagcucaugugaagacaugcagccugggggcugaggggcaggguccuggcacccacaacucccaggaaaaccuaaugcugcaccacaugagacuguugcccaugccaguggcugcagggaggacaggaaacccucugggggccagaaagucugcagccaucccauaccuuagcccagcagguucaucaggugcacaggucuucuucggggauggaccggaguauaggacaaagaaccacagaaugagaaagaugagggguccaucagggguagguaggacccaggaaaucacaccuuuagaccagaagcaacagcaaucagaaaugcaaggguuggccgggcacaguggcucaugccuguuaaccccagcacuuugggagaccgaggcaggcggaucaccugugagaccagccuggccaacacagugaaaucccgucucuacuaaaaauacaaaaauuagaugggcgugguggcaggcuucuguaguccuaguuacucaggaggcugaggcaggaaaauugcuugaaucugggaggcggagguugcagugagccaagaucaugccauuguacuccauccugggcgacaagagcaaaacuccaucucaaaaaaaaaaaaagguugagucagaaucugcauuucagcaaggcgggcacucgugugcaacggggagcauaaggaccucuguuuagguaguucauguuuaggagggcugcgaacagguggguucuggcauaagaccuugaugucaaggagaucacuggguggcuguccaggccagacaaaauguggccuggccugugagggagaugguggaaguguggaagggguaagaaggacagggcuuggugacacauuuccauggaggugaaagaggaagagauauaacagagggccacuugagcagccaggugacaucaccaacugaggcaggaagucuccaggaggacaggaagcugggugcgugugaaacccccgagggcacccagcgguggcggccucaggcgguggagcacauggcagcaaggauggggcagagggacgcuggggggauggugaugguuugcuuccuggugacuuucugucuuaagagugacagcugugguguggggaguugcuacagaaugaugucaggaggucuucccuugagaaaagacccaucagugcauucuguuggggugguuucuguuuuguuuuaaaucaugguucacuucguaggacugaugucugcacugggcugggucuuuugguucugcagauugaaaaguuacaaacccagcuggagagagaaaagcagagcaaccaagaucuggagacccucagugaggagcugaucagagagaaggagcagcugcagagugacauggagacccugaaggcugacaaagccaggcagguaggugccuccaccacuaacgccucuccuagaaccccugccugcaagacggagagccgggauuacagccauuccugguacuguauuguggaugcauggauuauccguuaccuagcuuagccacagcuuaaaucagcaauucucaauuucccaacuggcggugggaaaagguggggugaauuuugccucccaagggacauuuggcaaugucucaagacauuuuugauugucgugaccccggggaagagaggggguggugcuccuggcauggaguggguggaggccaaggaugcugcuacauauucugcagugcgcaggucaggaacacuccaucugcaaauguucuuagugccccagcugagaacccuggcaaauccgugugguuuuauuugccucacacggcgggcaguccagggcugauguaguggcucagggaugccaucaggaaccaggccucuugccuacagcucugccagccuuagcaguggcugcugcacaucccuaagguacaagcaggagaaagguggagggcuuagcaucacagggaaacccucccaaggaugcuccguagacgucacguuggccagaacuaacguguggcuaccucugccugcaaagaaugccagggcaccaaguauuuuaguuuuuuguuuuuguuuauguuuucuuuuguuuaauagagaugggaucucacaguguugcccaggccggucucgaacuccugggcucaagugauccucccgucuuagcuucccaaaguguugggauuacaggcaugagccaccaucacuggccccaaguauuuuagcuuuuuggcaucuguaguagaggaauaaaaagcccagagaagaugguuagaauggugcaugguaaacagacggacagggcccugcccagauguugcucacagccaggaaggcacacuuccaggugacaggcaagaugaucucaggagggugcuacugagagaauagggugcugagggagagaauacugggauacacggcuaccuuagaaucaucaugccaggauguuuuggggaacugaccccaaguauaagaaagagccagugaggcugauagccagaggaaaguacuccaggcagagggaucagcaugugcaaaguguucacagucagcugggcuaggagcagugagcaggagguggagaguaguguaagcagaggcugcagaggugggcagggcccggcuaccagagaccaagagaaaccgcugaaacuuaagugagggagagagauguauuuacauuuuaaaaucauccuggcugcucugaguguauucugacuugaaccaucuaagugguggugucugugcccacucaccugugucugucaagccucuggggaacgcacaggcagugucugagcacagguaggacagccguucaaggccuucucucucccauccccagugugagcccaugucacugaaauagguuccugcagcagccuggguugugccuguuguguuuucccguagaucaaggaccuugagcaggaaaaggaccaccucaaccgagccauguggucgcugcgggagaggucgcaggucagcagugaggcccgcaugaaagacguggagaaggagaacaaagcccuccaccagacggugacggaggccaauggcaagcucagccaguuggaguuugagaagcggcagcugcacagggacuuggagcaggccaaggagaagggggagcgggcagagaagcuggagagggagcuacagcgacuccaggaggagaacgggaggcuggccaggaaggugaccucccuggagacagccaccgagaaagucgaggcccuggagcaugagagccagggccugcagcuggagaaccggacucugaggaagucucuggacaccuugcagaacgugucccugcagcuugagggccuggagcgugacaacaagcagcuggacgcagagaaccuggagcugcgcaggcugguggagaccaugcgcuucaccagcaccaagcuggcacagauggagagggagaaccagcagcuggagcgugagaaggaggagcugaggaagaacguggaucugcucaaggcgcugggcaagaagucagagcgccuggagcucagcuaccagagcgugagcgcugagaaccuccggcugcagcagagccuggagagcagcagccacaagacgcagaccuuggagagugagcugggcgagcuggaggcugagcgccaggcgcugcggcgggaccuggaggcccuccggcuggccaaugcacaguuggagggggccgagaaggacaggaaggcccuggagcaggagguggcccagcucgagaaggauaagaagcugcuggagaaggaggccaagcggcuguggcagcagguggagcucaaggaugcagucuuggacgauagcacugccaaacuguccgccguugagaaggagagccgcgcgcuggacaaggagcuggcccgcugcagggacgcagccggcaagcugaaggagcuggagaaggacaaccgggaccucaccaagcaagucaccgugcaugcaaggacacugacaacucugagggaggugagcaaacacaggcggcgccuguaaggggauuggcagauggugguaguggguucuguggugcaugguuucaggagagaaauaagacucuguguccuccuuaaaugcuuuaucuaauucuaaacagcaauaccuaaaggucuaagaacccagugaauaccacguauuacaaucuuacaacccagagauaacgcuucucauaguuugaguuguuucguuucaucauuuucccucguguguacagacacaugcuugaugucauacuuacacacaggugagcuguugugguuuuuauuaauuauguugugguuuuuguuauuuuagauuucaaagccacaauuucccaauggccguaagauauuuguuuguuuguuuauguauuuauuuauuuauuuuugagacggagucucacugucguccaggcuggaguguuguugcgugaucucggcucacugcaaccucugccucccagauucaagcgauucuugugccucagcaucccacauagcugggccuacagaugcacacuaccacaccuggcuaaucuuuuuguauuuuuaguagagacggguuuucaccauguuggccaggcuggucucgaacgccugaccucaggugacccacccgccucggccucccaaagugcugggauuacaggcaugagccaccgcgcccgacccuuacuuauuuuugagacagaaucuugcuuugucacccaggcuggagugcaguggugugaccccagcucacugcaggcuccaccuccuggguucaagcgauucuccugccucagccuccuaaguauugggauuacagacacgcaccaucacgccucgcuaauuuuuguauuuuuaguagaggugggguuucgccaucuuggccaggcuggucuugaacucuugaccucaggggauccaucugccucaggcucccaaagugcugggauuacaggugugggccacugcaccuggccaagauauuuaauccuauagguuuacuguaauuauuuuuuagauguuuagauuguuuuaguguuuuccacuauuuuauuuuuauuauuuuuuaaauuuuauuacuuuuuuccuagaauccuuuccugaaguuuuuuuuaaauuuauuuuuaaaauuuuauuaccuuuuuuccuagaauccucuuuuccacuauuuuaaauaauacuagacauccuuguauacauagaccuucaugaaucaaacuauuuuuuaggguauauucucagaaauggaauuacagggucaaagagugugaacguguuagucucuugagggauauaaaauccuccagaauuccauguuguccuuacccugguaaguguugugugggccaccugggcauuuguuuaguaugcuggggugaguagauggcugcucugggaaauggcuucagcagcugaguggcccagcaccguuuaucucacucgugaagggucuaguguggggacccugcccacaugggagaagccaggcgcuggagucacugcacuuaaggcccaguucaggcaccuggcuucugccaucuugaggcuugggcaccccuaguggaguccucuucugguuccucggccugugguggguagaggaggaagagagagagugaggaagaucaugcugcauggguggggcucagcagcacagccacacccaaccacagggugccacaugccacacaagagaaggaaauggguuuggugaacacugagcagucuccacacuggaaagagaugacugacgauccaugcaggcaauuccaugugcugugggggagagauccaaaauaugaaugcaggcagagccccggcucguuagcguagguuaguuaggcugugcuacgauagccaaccccagcaucucugcugcucaucacagccaaggcuuacuucuugcucaccagaguccaggggacccuucagggagucuguccucugcuugacccagcaguccaggcuguuuugaucucguggcuccacggucucuacaccaggcuugggcgguugccauggcaggugaaagggcagcugaaugucacacauaggcucuucugugcuccagucagggagucacccacaucacucccacuucauccccuuugccagagcuggugaccuggcuucagcugauacaggguggcugggaaauuugggggagcagguaaugagcaucacugucucugucacagugccguucaggucugaggauuugguaggaggguuaagcgugcaugcgaaugacugugacaccaggcagaaaacggucacuaucuagagagcuacaaagaggugcugacguaaacugggguggaggaagugaaccaccgacaugcauucaacacccauguuuugaaaaguagaccaaggccgggugcaguggcucgcgccuguaaucccagcacuuuggaagaccaagguagaaagauugcuugaggccaggaguucaagaccaaccuggaaauauagcaagaccccaucucuacaaaaaauuuaaaaauuagccaggugugcuggugcacaccuguaauuccagcuacugaggaggcugagguggaggaucaccugagccaggaguucaaggcugcagugagcugugaucacaccacugcacuucagccuaggcaaccaagcaagacgcugucucuaaaaaaugaaaaguaaaccagauccaggguuuaaaauaaaauauuuccccucuuuacacauuuucuguuucaaagugucuacaaggggccuuuaauuacuuguugcuuuguugaaaagucagccauauuaucagaaaucaaacauacuacuuaaaggucaacauaaguggcauuucaaauacaugacuuagagaaguggcauauuagauccauccugacauguagccaccuggucugguuguuuucagcaccaggagggcuggacaagugcauucauuggcuuuccucgggaagagcaucccugggguucagaguccccucgcuccacacggaggcagccguggcccgggaggacaguugcucacacccgggcgggacuggcgccuggccuuccugcguguuuugcugagcuccuauccagugcucucuccccaucauuccaggaccuggugcucgagaagcugaagagccagcagcucagcagugagcuggacaagcugagccaggaacuggagaaggucggccucaacagggagcugcuguugcaggaggacgacagcggcagugacacgugagggccucuucucccucuccccaucgugggagcacuuccuccacuguucagucugcaggcuccucacccuccccugagaccuccaugaacucucuacugccgagggcugugaccucacgcgguuccuugaacccaaaguuccuuggucguuucuguuccagcucuuguuccuugagguucucagauagguguggaaggagauuuugucugaugaaaaagcuucuuaauuuuuuuuuuuuuuuuuuugagacagggucuggcucuguuguccaggcuggaguguaguauuaugauuucggcuuaccuccauguccaccucccggguucaagcgauccuccagcccuagcuggagaccacuaccuagcugggaccacaggcaugcaccgccacaccuggcuaauccuuguauguuuuguauagaggggguuucgccauauuagccaggcuggucuugaacuccugagcucaaagcgaucugcccaccucagccucccaaaaugcugggauuacaggugugagccacugcucccagccacgcuucuuaauuuuu

SEQ ID NO: 17131 - RNA, 5979 nt, Homo sapiens
cagcccugaugugccucucaccaucaugaaaaggaaacugaugaacaccaaugaucuggaggaguccaggcagcucacggaggagauccagcggcaucuggaugugaguaguggugaaaggagcugugcccaggugcuguccccagcccaggugggcagcaugcaugagcacggcccugccuccuaugcucccugccacacaggaguauggggggacagaagccagccuuuguccuccauguaacggaagcgggugggcggagccgugguugccucccaucuucaugaguaaacuaaccuugaccucuucgguaguagggagcaguggaaugggggccuaucuccccuguaucguaccaagaagccauguacauggguguuucccucuuuuauaccuuguugcuuagaggauauuuuuauuuuguugcuuauuaaguuauuagcuaaucauauucauuuuaaaaauccagagacagguacgguggcgugcgccucuagucccagcuacuuagggggcugaggcaggaggauuccuugagucugggacuuugaggucagcuugggcaaccuagcaaaaccccuucucuuaaaaaaaaaaaaaauccaauccacaaaaauuucugcuguucucagaaaaacauagucaugccuaaaauucuuucuaaaaugcuuaugccguccuuuccaaucagugagucuguuuucaguagcucaucaguguguuuggagcuggcagaauugcuauguaaauuacagcugugugcucaccggaaugcugggcagagggcugccugucccuucccacaaagccaacucuguuagcccuuauccccauugucagcacagcacagugauggaugugcugaaauauggccugaguuuucuaggcaagauuuuuuuuuuuuuuuuuuuuuuuuugagacaagagucuugcucugucgccaggcuggaaugcaguggugugaucucggcucacugcaaccuccgccuccuggguuuaagagauuccccugccucagccucccaaguagcugggauuacaggcaugugccaccaugccccaguuaauuuuuguauuuuuaguagagaugggguuucaccauguuggucaggcuggucucgaacuccugaccucaggugauccacccgucuaggcaagauucuuuuuuuaaaucaaugugguuuguuuuaaaugcacauaucuaguuaucuccaaaauuggugcccugugugugaaaaacguauuaaccaggacauauuuuuaguuggugucaaacgcaguauagcacaguagugcucagacauuuuagucuugggccucuuuauuuauuaauuuuuuuguagagcuggggugucacuauguugcccaggcuggucucaaacuccugagcucaagugaucuucccaccugggcccugaaagugcugggauuacaggagugggccacugcacccggccaaaccucuuuauacucuuuaaauuauugaucccaaagagcuuuuguucaugguggguuaugucuauugauauuuauugcauuaaauuaagaugagaugaaaggacauuuuugauaguucacagaaagugaaccagagguuuuuuggugauuuuuuuuuuuuuuuugagauggaguucugcucuugcugcccaggcuggaguacaauggcaugaucucagcucacugcaaccucugccucccggguucaagcgauucuccugccucagccucccgaguagcugggauuacaggcacccgucaccacgccuggcuaauuuuguauuuuuaguagagacgggguuucaccacguuggccagacuggucucaaacuccuggccucaagugauccaccugcaucagccucccaaaguucugggauuacaggcgugaggcaccgcaccuggcucagaguuuucuuguguuugcuuaaacagcuguguaaaucauauaggacuucuuugguaucugcugcaaauuugaaaacuauuuccaagacuguuuaacuauugcauaauuauacuuuuauguaaaguaaaagauuaugaaaaaauuaaaacuaagauuuaaaaauauuuaacucauuuacaaauaacaauauucuuaacaaauaacauuuuacacuaauauauuuucuaugagaaauaaccauuuuccaaaacaaaaagcauugggugagaagaguggcauugcuuuacaugugggaguaucucuuuuguguccggcauugcuagacgacagcuggauccuugaacuggcuucugcuuucgccgucgggcgcuguucuuucggcugaaguguaagaagaaaauccagccuuguaaagauacagaguugaggaagggaagaccuucuggagccugagagcucuuggggagucugugguucuggaccacgccuggagaacugcuggucuaacacacaguggguggagggucuuuguggaauucagauaugaagcaagcaaacccuggcuggagagcggguaggacagagcuugcuuguagagugaagguuuuuuuuuuuuuuaguuuuuugauuuuuauuuuaauagaggcagggucuuccuguguugcccaggccggucuggaacugcuggccucaagugauccuccugccucggccuccuaaaaguacugggaguacaggccugagccacugugccuggccagagugaggguaguguagaagcauuuucuucuuuaugaugcuguuuuucauugucuggaaagaaaauaaaagucccucugugcccugcuguguaaccauucaauaguuuccugaaugggcagaggugcccguggacacagcacccucacggcacagucgucugcuuuggggcacagguucugccaccuccuuucuccacagcaaagguuguuuuuugauacaaauguuugcaucaugccagaagauccccaaaaggcaggucuuucugaccgucgcacaagugggcacagacaucucucgccuuucucggagcacauugauuguuauuuccucuaaccugcgggaggcugagggcuguguggagaguagccuuugaaugcacuucucaccgcaccugggucccugagagaccgcauucagggaggcacauucugacaggccgcguuucuccccaggccaggcaccucauugagaagucagugcguaagaucgucuccuugcuggcagcguccgaggcugagguggagcagcuccuguccgagagagccccgcucacggggcacagcugcuacccagaggcccugcugcacuuccggacccacugcuucaacuggcacucccccacggugagccagcaggcucuccccaugaccagaauccagaagcugaauucauauuguccccuggcagucacauugguuguacgaccuuauagaagguuccauccaggcugagaaacagugggcucauuucagagaggaagaagguuguccaaauucacuaauuuuaaaucuuggccccagaacacucuucuugucccaguggguaggagaguuuaccagagccauagaugacagcucucacuucuaguuugaagaacaguuacuuguguucacacuucugcugucccugccaaaccccacccucgucucuaccccucacacgagccacacacaucuucucccuucugagucuguucugaccucuucccaagacaguugaagucagguguggcccauggagaaguacugaguuucugcagauguagaauuggaaggcaccugaaaagccuccuggucaguagcauguggugcuucaauccuucuagagaaagguuggcaaacuggccuacaggucuguuucucccccauaaccuguuuuuguaaauaaaguuuuauuggggccgggcaugguggcucaugucugcaaucccagcacguugggaggccaagguggguggcucaccugaagucaggaguuccagaccagccuggccaacaugguaagaccucaucucuacuaaauauaccaaaauuagccagacuugguggugcacgcccguaaucccaacuacucgggaggcugaggcaggagaaucgcuugaaccagggagguggagguugcaaugagccgagauugugccacuauacuccagccugggcgacagagugaaacucugucuccaaaaaaaaguuuuauuggaacauagccacauccugcucaguucccuguugucccugucccuggcuucuuucacacuggggcagaguuaagguagcucgacuuuaccccuccagucuuguuuuuuuuguuuguuuguuuguuuuagacacaguuuugcucuuguugcccaggcuagagugcaguggugugaucucagcucacugcaaccucugccuccuggguucaagcaauucuccugccucagccucccgaguagcugggauuacaggcacgcgccaccacaccuggcuaauuuucguauuuuuaguagagacaggguuucaccauguuguccaggcugguccugaacuucuggccucaggugacccaccugccucggccucccacagugcugggauuacaagcaugagccaccgcacccggcccagucuuggucuuuugaccuuuggagucaugcacagugaaccucuuccuuuguucucagagaguucuuggguuccccugaaguuuguuucaagauaaacauccccgcugcuucacccuucccuggugugauccagcguggcuuucacacgccguccaucucccucgcuggcgugucccucccagaaucaaaaggcagacuucccggggagaucccaggccauggcggggagcagagccaucgggaguucccugucaggaguccugcccucagauuugagagugcagaaccccgccagccccccaacuugcaugcaaacccuggcaugugugccucuuuccugagggaucguccauaaauaucaccagauuaucuaaagguugggaaaggauccaugaaccaaaauagggcaagagccacuggucaagaugcuuccccucugcaauugcaaaaguggaguggauuguguggugagaugaggaaguuucauucuucucguuuguuuucucccaguacgaguaugcguugagacauuuguacgugcuggucaaccuuugugagaagccguauccgcuucacagguaacuaaugcagcggugacgcuugaaaggucgaugucauucugaaagcagaaggggcugccauccucuucugcaagugggcauuuucacuucugccaggagcucccuccagcuuuccucuacagccauuugucagcaggguccagaagccacguucucagugacagcugcugggcgggccugucauaacugccugccugccgcauguggguuugcguuugucugccuuucuucagaguugacacgguucaccaaguucuccuuccugucucucgcaggauaaaauuguccauggaccacgugugccuuggucacuacugaagagcugccuccuggaagcuuuuccaagugugagcgccccaccgacugugugcugaucagagacuggagagguggagugagaagucuccgcugcucgggcccuccuggggagcccccgcuccagggcucgcuccaggaccuucuucacaagaugacuugcucgcuguuaccugcuuccccagucuuuucugaaaaacuacaaauuagggugggaaaagcucuguauugagaagggucauauuugcuuucuaggagguuuguuguuuugccuguuaguuuugaggagcaggaagcucaugggggcuucuguagccccucucaaaaggagucuuuauucugagaauuugaagcugaaaccucuuuaaaucuucagaaugauuuuauugaagagggccgcaagccccaaauggaaaacuguuuuuagaaaauaugaugauuuuugauugcuuuuguauuuaauucugcagguguucaagucuuaaaaaauaaagauuuauaacagaacccaaauauucacguccga

SEQ ID NO: 17132 - RNA, 12194 nt, Homo sapiens
cgucauuuccggggucgggguauauaagcggggcgcgagggcgcugcugcugccaccgcuccugccacugcagugcucgagccccgugcaggggagcuugcgggaggaucgaccgacagacggacgcacgccgaggcacugcgcccccagccccgcgccggugccaccgcagcccgaccccggccgccaguccagccgccccucgcccggugccuaggugcccggccccacaccgccagcugcucggcgcccggguccgccaugcgcuccgccgcuguccuggcucuucugcucugcgccgggcaaggugagcgagcgcggggagcucgcgggagaggguuccgggcgccccugcccaccuugagguccgggcaccgcgcggcgccccgcaccccuccacacuucccuucgggcgcggcgaguuuucagcaccgcggacagcgccuccgccucccgccugacccugcaguguggccuccgccugggacccacaagacacuugggccugacucccaaccccccggggcaacucccccuugugcccaccccuugucugggcuuggcgccucgguugcaucagggccagugccgguugcgcgguggccggccaaggucacugcggggaggugggagcauggcugcucgcaacccuccaccccucuuccccuuucaucucacgcuccccgccuuucugcccuugacuucuacuucuccauaucaucccucacaauccccuuccuccaucucuucccccgccccccccaccucuggggucucucuccccuucgucugucucccacccgucccacugugcagcucuuggccuuguuugauggcgcuccccgcuccaaagcacacccgcuccagagcaagaguuuccaaagggggagggggaggaccucucagugcagccucuggggaccaccccacugugggcagcaaccagggaagggaaacaaaaucagcccuagccucucuuuuuggugggggcaguuuugagggguggcauugggugaacgggccccagugagcccggucagaaaggacuggccuccacuuggagcagaggagugaccccagcacucucuucuucuucccagucacugcgcucccugugaacagcccuaugaauaaaggggauaccgagguaagaaggggugcuggggaugagggguaggaggcuccaguggacacuucacagccaguucuugggcagcugcaggaguaaguucggcauaaagccaagagccagcacugcggcugcugagccuggggacagcuugcaaaagaagauaucaaagauugcuugcuuucccugcuguccugcuguggggacuuccccagcuuccucugagcugcacaugcagcggaagaggccugcaucuuaccugcugggccgaggugccuggcuucaggcugucuugaacacucugaauccaguaggcuccccaggggcugguggggguggcuucucuguaguuguaguuguccacagaccuguaaaaauggccuuugccugccuggcucuggccuccccgcuuugcucuuucucccugaaaggcucugccaguaacaacccacacccagcaggcucuccagcccuggcugucccaaaggaacacaagcaaaacaucuugaucauggcuccugcacccacggucccaccaauaggggcuaguuguggaggucacccaggaaagggccuuaggagacacuaguagggguuucucuggcagcaagagacacaccacgcuggguguguacuuggaauucauucauggcugagcuggggcuguuuuuuccaggcucuagugcucauccaaaucucugacuugagggucagagaaauuucuacuccccaccuucccagaaacuauucucuuccacuagacaccacaguuaaaauccaaaccauccaagagauuccaaccucuguuugcucaauuauauuuccuauguuuuaguugcagauaggacagaauuuaaaccucuaccacucauucuagcugugugaccuugggaaaauuccuuaauuucucugagcuccgccuuuuucuccuuuuccuugaggggagguguaaagaguaggaaucauggaugugaauugccuagcacauaauagguccucaguaaaugggcacuuuuauuccuagagcugccuucuugaucuccccaucccucuccagacccucuacccaauuccugccucccagaaaaugcccucucgaacaggugguuaucugauauucccaaugcaagguccgggguugcagggagauacaggguacaggcugcugugcucuccuugcuagaucccuuaugggagacacccuggucaccauauuauacccagcagccuguggucaggggcaccagagcagcuggcuaagaccugaagauucuauacgagguuguugugacuacaugcauuauacagcacuugccaguuugccaucuuggauccuuggaccgguugccuuggcaucccguagacacagccucccacccccucacucccugccgguguugccugaugccugucugacaccuccugcucucuacucagcucuaggcuguggaagcagggcuggaguugugaaccccucccugggcgugcugacacuccaugcuugaaagaguguuuuuccaucuguaccucauuacccugggagagcaguugggaagguauucucacucccguuuuacaaaugaggacacugaggcucagagagguuaagucacuucuccaagaucacacagcuaggauaccacauuacggugggcaccaucaucaaagaucacucauuuaucagaugccuaauuauccacagcaccuuugcaggcacaggauaagacuuucagaggcguggcugugguugaccugggauaugcucccagguguagucaaugugugcucacaugccgcccagggauucacccaucccaugaugaacauggagugagaauaugaagcugugacuccuugcauacgacaacaccauggguguuuggagacaguaaccuacauccuauuuccaaacaggguagagccagggaaggucuuugucuccucugggcaguccagaaggacuuccuggaggaccugaccuuugggcaucuucacgaucagagcacuuuuguaagacaucauuuuagugcccugaggcaguuuucucauguuuagagaaauagcacuuggggaugagaagguaccagguaccauucccuacaccccauucucacuaugauccaccuuggaggggaaccugcuggccaugugguuggaguggcugacacaugguaagcacuguguuaaggguuuucuauuaucauugcuaucacugucuggcuaagaaagcagagcugugucccugagccagggaucauggacucccaaagacaaaagcaaauacccucuguccucacuagaaauucacccuagagccuccagggacugagccccaugcucaaaccagccccaaccugccccugcacuguguucccaggugaugaaaugcaucguugaggucaucuccgacacacuuuccaagcccagccccaugccugucagccaggaauguuuugagacacuccgaggagguaugagcuggaggcuaggggugagggcugcugccugcugggcugggaggcuaggacauggguguguggcuuuugguggaauuaaugauuuaacucaacagucacugacugagugcccgucauguccaggcacugcaccaggguccaagguguacagacaguugaagggguuguagcccaggugcuuacagacuggcagaggggaugcauaugaacacaguuaacuagaacucugggcaaaauaaaaccagggcugaaacagcaagcccccagacugugagcucccuauggacaaagauuuugugugcuguaucccagugccuagaacagccucuggccucugcagacacccucuagaugugugaugaauaaaggaauguuauggguggacaggagaaggacgaaaucuuuccaggcaaccagucaaguuuuuacuaacugcuggauagagccagcagcauuucgguugggcuuuaaaagaaacauuggaaaccgaugaguggaaaaaugaagacaggguuguccaggugugguagacagugugaacacaggcauggagaugggaaccuguuguauuuaaagagaccccacucauccucagggguugccacccuuuggcuaaggucuggcugcuggggcaguggcugacuucucugauguaguaggaaacugacacauaccuuggaaaggagguaauuucaaaaguguuaucugaagacccaaucuugcugccaccacccugguuuugaguuuccagaguaaauuccuugugcucagcugaaaauauugaugguaaucucuuucucggcuguucucuggaaaccacccaugaugacucuucuucauugcagaugaacggauccuuuccauucugagacaucagaauuuacugaaggagcuccaagaccucgcucuccaagguauuuuccagccacugcacuugacucuggguaaauuccaguaacugagagucagaaaaucugguggaagauucagcaaguuccucucugggacugucauuuccuuuuaauuauaaagcggaaaagcaggauccgccgugccaccuggcucaaucuguuauugauauuguuaaagaaaucaaggcccagagagguugagugacuuguccaaggucacacagugaauagagacaugccaggugcagcuucccuaaaacccacggccucugcaguucagucauuuuaggaaauaccuuuaugaaguagugagccacucgucacugaugauauucaagccaagccuggacaggauacuggaguggaggguuaagcugccaucuucccacaguuagccucuaugcccagccccccagcuccuuccaggcuugaugcaaagcacggcccuagccuugcaagucaggaaaccugaguuuggcccugcaccugccccggcugacuuccugugggaagcggccguuuccaccagggcaggaccacuggugguggugugucucuccaugagaacagggcauuacagcaugaauccagcaucugcuucccaacgaagcgagaguguuuuucagggcugggcuugugucuggggugggguggggguacgaaggcugcucuggcuucaggaugggccccacucugaggccuuugggacagaccaggccaugugugagaacagagagggcuuuggggaggaggcacguaaacacagccacgucaguaggauuccuguggcccuuuccaagcuaacacacuguucuuccucccacucaugagccagccugggcagcaagcacccaccuccuacuguuguuggagggggcagggagugcugggcacagcugggacuauuauuaccuggauaguuaugucaucaucagugaccuuggacuaguguuuuguuuuguuuuuaacuaagcauuaaauauuuuauuacaauugauaacuuuaaaauuaaauauugaaugacuaacugauuacauuuaaauaauuaaauagacugucaacagagacuauuauaggagaauguguccugaaacaucucuauucacaugcacguguguaucccguauaagcaguauccaauauauguauauaugacuauuuuccauuaacagauuccuggauguauuucuguccauccgucuauccguccacucccucuugggcucccauaacaucuucugugugccucugucuuagcauuuaccacacagcaacccuauuuucuagacaagcacccaacucuuggagagcccaaguugcccauggagcuaggaaauagccagaaggggacuggaacccacguugccugagaccagggcugggcaugcucccuggcccacagcugcccaggaaagcccauuguuggggaagaaaugagcugggcuaacugaggggccaacaucaggaauaaggcacagguguggggacagucagaggaggcagcggcggcggggggagaggggucucugggucauggcugcaggcgccaacccugggcucagauguaggcacagggcuuggccuucuccccgggccuggacucagcguccaagguuagcagagcuugccugaaucaagagcugucaccauuacugccugcugcaggguuccuggagcuaccagccagguccugagggguuccccacccccaacuccugcccagccagguccugagggguuccccacccccaacuccugcccagccagguccugagggguuccccacccccaacuccugccccugggauccuugcuccauuugagccuuucuugcuguguggccacagcacgcuugcucuggccucccagggagaagcugagucuggcgaggcaggguggcugccugagggcccagcugagagaggugagggacgccaacccuucaccgcuccccaagcucacgccccaucagugucucauugggcaggcccugaacaugaugugcccagcuuacagauggggaaauggaggucuucacucuuauagacaaauaugccacagcugcacccaaugggacuuuucccuccuuuucucauaccaggcgccaaggagagggcacaucagcagaagaaacacagcgguuuugaagaugaacucucagagguucuugagaaccagagcagccaggccgagcugaaaggucugucccagccggucuggccggagguggggaagggaggguggcagugggaacaguggcuaugauggacccaggguuccagugagucgggagccccacccauaaucccuuauuucccucucucuacaaauggggaaacugcugcucagagagacuaggucccuugcccaaggugaguggcaugaccagggguuucgaucugguccugccucacaccaaagcccucgcucggucccgucugcccagaagaggggcuggcacucuagggcaggagaucucuggcauggcagguggacagcuucaacucugggucuacccaguggccacuguagcagagcccccacccccagugccuguccuccugggaagugguggggccucagaauagccaggaugcaggaggaccacagacagaguaggugugaaacgugaaaugaacccagaucaucuuucuugaaaccaaagagcuucuaggagucuaagaggucaugccuuaggucagugcgacacucugagccauccucccuucccggggagagccacaaacuggccccguggcgcuucugcucuccauguagaagaugggccgguaaggccgguguccaggagcuggauccuggugucucccaucuggggcugaaagggaaagcccgcaagugaagcccaggugcccccacuuugguugaagcuuuaaugaggcaggcagccaugugucagugcaaagagaucccgagcuugucauuuggaggcuuggguuccaggcucagcucugcugcccgcaaacugugagauggacaggucaucuuaccuuucugcagaucauuuuggguuucugugaaauaggcauaggagcaccuuucaccagaguccuggugaagcucagaugguggaauguacuugggagcacuuuguucagugguuaucauucuaaugacgggaggaauuuucacuuguucaaaggcugucuuuaaggcagccacaauaaaauaccuuuuaaugaaacccuaaaauauugcagaauugagcccuuucacaggaugcugaagacagagaagccccacauggaggggagaaugaaguugcagucauggugccucuuacacagagagguuaagcaacuugcccaagaucacacagcugacauuaauuuucaguucaggcuuuaucuccuggauuaaucuuaaggucugguuuuuuguuuuuguucuuugaauaauaaccuguuuuaaaagucaggauuaaaaagaaagaaacaaauccagcugugcucagaucaagccuggacauggacagagggguaacccuaaucguuguccugggcugggcucgcuggaagccaagaaacauaaugaguaacaucugaaauuagccuguggggaggccccacacguggcccaguccucagggccugacuuggcugugcugugucugcagaggcgguggaagagccaucauccaaggauguuauggagaaaagagaggauuccaaggaggcagagaaaaguggugaagccacagacggagccaggccccaggcccucccggagcccaugcaggaguccaaggcugaggggaacaaucaggccccuggggaggaagaggaggaggaggaggaggccaccaacacccacccuccagccagccuccccagccagaaauacccaggcccacaggccgagggggacagugagggccucucucagggucugguggacagagagaagggccugagugcagagccaggguggcaggcaaagagagaagaggaggaggaggaggaggaggaggcugaggcuggagaggaggcuguccccgaggaagaaggccccacuguagugcugaacccccacccgagccuuggcuacaaggagauccggaaaggcgagaguacguaugauggcgaagaccucaacgaacgugucugggagagggggaugggugggaggagagccuucuccauaaccucauuccaccuucauaacaacccugaaagguagguauuagcuccauuucccagguggacaaaugaggcucagagagguuaaguaauuugcccaaggucacacagcuaauuuguagcaaaagcugagguucuaccccagauuuaucugacuccaaaaccaugcauuucccacuauuccacauagccuccccccaccaaccccagaagcuaggggugggugaugggugggcuggcuuugggaacagagaccauggcaggagcgcacaggcugaucugggaacagugucagcuucaacuacgguuuaggagaggcccuggcucccgcugcgggccugucagggucuuuccucacucuccagcugccgggcuucuggggugaggaugaggggaagaggcaggcuccagcuaacccaccccucugagccgagagggucuugcaaagccuggcaucaagaagguuuuucccgcuaagcgucaucacuguggagaggcugggcuguggccgcagcagaggcccccagggaguggcagagacugggaaaaugguggucccccacccauucuccugcucuugcccaccaccugcuccaggucggucggaggcucuggcuguggauggagcugggaagccuggggcugaggaggcucaggaccccgaagggaagggagaacaggagcacucccagcagaaagaggaggaggaggagauggcaguggucccgcaaggccucuuccggggugggaagagcggagagcuggagcaggaggaggagcggcucuccaaggagugggaggacuccaaacgcuggagcaagauggaccagcuggccaaggagcugacggcugagaagcggcuggaggggcaggaggaggaggaggacaaccgggacaguuccaugaagcucuccuuccgggcccgggccuacggcuucaggggcccugggccgcagcugcgacgaggcuggaggccauccucccgggaggacagccuugaggcgggccugccccuccagguccgaggcuaccccgaggagaagaaagaggaggagggcagcgcaaaccgcagaccagagguugguauggggcgggagccagcucugugccaggccacggagcagcagggggcagccgcacccagacacacugccccugccccacugaggggacagggcccccccgccgaagucuggggauggagagaugcucagaccgggggcucucagggugggagaacaccccagcucacagggggcacccagcaaagcuggcugggagaugggaggagcucaggucagccuguggcagcgggggaggcgcugaguggggacguuguccagaaggcaguagggugcccuggaaaaaccaugcggugggucugaccguguccccuccuggcccccaggcagcccaggcacagccuccucccaggcucaggcccugccucuggcccaugaggguaacggggcagggcaggggcagggccaagggaucucuugccuguggggagugggugggagccacaccggaugugagcuggaagaccugggcucugccuccucuuggcugcguggacuugggagggucacuccccuccccgagccucaucaguuccauuuaugaaguagggguaaggagucuccucugcccacgucauuaccaugauuggaacacacaaaggcuuugaaaaccagggccccuggggaagacaaauggggcguggggacacagcccacaggagcaggggggaguuggggucccuggcagcuaggcggcugggauaccugguucaagccuaguguccagguaggaacccaggcucugugggaaggcugacaccuguccgcagcccugaccccaaggcucuucucugcccaccuagaagaggguguggccccuucacugggcccccgacccccucucugggccuggcagucugagaggaagaaggcuccauguuggcagcuguagcgggagagggcaucugcccacgugccugggagcccagggcgaggggcugaggacaaagcuggagagaaugggggcccagaggugccaccagcuuccuuucuccacaagcagagggagcucuggaccgcagggcagagaaacuggaccccugaggcauauggagaggauggggugggggccuccucaacacagcccaagggucuucuuagaaacccgagccucgcagagcaccugccccagggccuccuccaagacuaaggggcuguagagucuauuuccacggccugcaaugucggggucccugggccaggaugcccucggcagccucaaaucuggcagugaccccgggaaaaugaccccucccaggucaaaggaggcagccuucccugcgcuccugcucuaagucuugagguugugcucuuguggguguccaaguucugaggccugaaagcuucugcagacgggcauagaacagggcucagaggaggggucccugcuucccuaaacuuggguagccagaguucgggauccucucacaaucaggaccagggaucaaagcccagcccuaggcaggcugauguggggcagcucccccagcauguagcccugucucaggccccacauuccccucaggugggaaggcugcagaagacagacccggaagucccaggcuggccucacccuggguccuggcaaccaugggcuaggccgagggaagggggcucuucagggcacuguaagcuuuguuuuccaugugcccuaaaagaacagacucccaccugugcggaaccauuugagaggaaguggggccuggauaagaggccaccaagagcaguguggggacagggcccccggcaucagccaccuucuugugcauaaugaucccgagagcaguacaguaagcucauuaucacugucuccaugauggaugaggguacagagagacaaagccaccuguccgaggccacacagcuaacccagcgccuuucuggcuuacugugccuuccaugccacuggccaggcuggcccgagugaaccccaaugucucuccuaggaccaggagcuggagagccugucggccauugaagcagagcuggagaaaguggcccaccagcugcaggcacuacggcggggcugagacaccggcuggcagggcuggccccagggcacccuguggcccuggcucugcuguccccuuggcagguccuggccagauggcccggaugcugcuuccgguagggaggcagccuccagccugcccaagcccaggccacccuaucgcccccuacgcgccuugucuccuacuccugacuccuaccugcccuggaacauccuuugcagggcagccccacaacuuuaaacauugacgauuccuucucugaacacaggcagcuuucuagaaguuucccuuccuccauccuauccacugggcacaacugcaauaacuucugaccuuuuggugaaagcugagaacuccugacuguaacauauucuguaugaacuuuaucuaaagaaaaauaaaucuguucugggcucuuuccucuga

SEQ ID NO: 17133 - RNA, 7398 nt, Homo sapiens
guccaaguugaagaaggagcucauggccccaggcucaguguugugcccauccucagccccaggugccccugcaugugguccugagcauccccucccuccgcugccaugaaggcuggccucugagcagcuugagccuugcccagccuacacaggacaaaguugcacucaccuccuggcuccucucaguguguaaucaucuaaaguggaucugggaaggaagcuccugccccgaaggaugccggaagagaaugcacacuuggccacacugguucuucucauguugucccuggaaggaaaccauguguagccuucaguagugccuccccgaccccaccauccuccugaggggacaggaagugaguagggcugggagcuggugggagggggugauguuuggggcccucccugcuaguccgccaagcgaggccaggcuucgccacagggauagacagcuccccucacccagcacaggcuuagcugggcuugcaccacguggucacggaggguuaacuacagcuuugcagccugaaaugacagccgucauggcagagggaugagaaggcagugaggcuuaugcuggcucucagugucugcccuguggugacacggacucauccaucucacuggaccucccuacaggcaagggaacccaauacugcauaguuccuuuuucuucuuaaaaacaauuaaaauaccuuguaggguuauuguuagcauuaaacuaauuaaaauuugcgauuccccuagugccuggcauggugugaauggugcacguguguguaagggucagucagccacgcuuacugugaaugccuggcauggugugaguggugcacguguguguaagggucagucagccacgcuuacugugaaugccuggcauggugugaguggugcacguguguguaagggucagucagccacgcuuacugugagugccuggggugugaugaugcguacgagccacucaguacaggcccggcgccuagugaaccaucagucaccguggcuuaugucaauauuauuauuacagugacaguaggacuacucugucagccuuaucuguggccccagcugacuugagagcucucaguccuaauuggagucagugaggcagugauuaugaaaguguccccaaacgggagaugcauucugugcuagggcaguggaaaugccuaaaaggcagggccaggugggggucagagggacucaagugcuguuccuagccccacccuucaccugcuggcccaccugggccucgguccccuugccuaccgcauagggaaggugcaggauggcacagaacaccuucagagcuguugcgucugccuccaaaggacuacccaaggccgcgguucacguuugccacaaaugugauuucacagcugcauugaaucaaacccuguuggccccugauguuuauugagcagucgccagcacagggauggagaggaaguagaagaaacaaagguuuuuguuguucuagguguucgaguccgacuuggaagauaacaucuaaaccuaucagaggauaaauaacaccguagaaucuaagugggcuugugucggcuuugccuuugugccugcugaccaguggggucagaguaagaaccaugggccccgggaagggguuuguguugucaccagggagccaugggagggcucccuauuuucuaagaauguaccacgugacccauucugccacgggcguucucaucucuuaugucuuugguccccaucucagucccugagauaauggaauuauuuccccauuuuucaggaggagacaacugcggcccggggaaguuaagucacuugcccagggucagguagaaaguggcaaggucaggaucauagcucggaggggcuuuggugacagcugauggcacuguggguggugugaggguuggugauuucagggccaccuuggcaggaggucaucgucugggauugccucugacacagcuggugccgugugacgaugagacugcuggccagcagaugcuacgggaggcagaguuggacgcaucuggcagcccuggucccagagaaacagaucauguccuguucugggguugcugugaggucagccucucgaugacugcugcccugggucauaggcgacuccuccugugguggagacagccacacaaucuguccauugugcaccaaugccaggccaggaaucgcccuuucugcuucggggagggugggaccauucugugccguuagcccguugcaguugcuuccccuuguggaaagcaagccugguccccaggaagacauguggcccucuuaccaaccaggaacagagcuagacuuugugcagcccaguugggacaggggcaggagagggcaccccaaagccugcgcucugagccagcaugugggcugcagccccucugcuuguguguggacggucaggguuuuucagcucaaggucugggggcauguugaguuuuagaaauaucaauguuuaucaauaauacauuuuccccaaaguuuuagaaauaacuuuuaugcacauuauuucuggguuucuuaaccucaacaugauugacaucuugggcuggauaauucugcacugcuaggggcuaucccaggcaauacagggugcuuaguugccuucccggcugcucauuaccagaugccaacagcacuccccacccugccccucaugacaaccaaaaaugucuccagauguucccugguggagggagcccaugccaccccuggucgagcgucacugcauuuuguaagagauggguccagcagcucugagagcucaggugggccagucaaguuguuucugauuuuuguguggacacugaggccccacugggugcaguuucuggguuuuaguguuuggaaucacacaccaagaggacuaacaucuugucacuucuuuucuucaguaauauuaguaccugcggcagaaaggacacccuguuuucuguuuccuccugguuugugugaguggcaugacuucccaacguguuucugugcugccugugcaggcugugugcccgugauaaagcccacugugucugccuuugucuucauguaauaaaucccauugccaccucaccagccaagagcacagccggccggguaaaccacgcgcugggccucugcugaccucggcccucugggauggacagagugaggcaugaggauauccucugagccccucccuauaggucccugccccaggccucccacgccuccuggcagccagcccuggaucuggcccuggccccuacccguuugucucuccacugaucugugagaucauucaucaguaacuauuauguucauucagcaagucuuagugagaacuuacugucugccagaguucuccuaaaagacauuacagaugcaacaaugaauaagaccugguggacgcagccccugcccugcuggagcuguaucugagugugagugcaucggaugaugggaacaaaacauagguaaauagaggacaagguaacacagccccagugauggcgaguacuaggaagaaacacaccgaggccugggagaacagggagguccuuguuacugauccucugaagagcugacauugaguugaggccuaaagggcaggacacucaggaggggagcaggcaagggagcagcaccugaccaggcccuucagugaaacaggauggaggcauaaggacccgcaguagcugggugcagcuggagcacgguggauagggcugucugcagugggcuggcaggagccaggcugagccugggccugguggccuccugggagcgcuggguagcucuuugaggacacaaaauaucgugccagcuccccucuuugauggccccaaguugagccacagacaacgugccauuuucuaguccccaagcucucugaggaggaaggggcccugcccauugcagcagucagaggucagggaggagcuccuggggcggcaggacgacucccacuucugagcaugcccgcagccacugaagaggauggcugacauguggaacagaggccagugucauccacgggguagaugucguagccaggucaccccuggcagcaggaucugucucucuuauugugcaccuagagccuguaccagaaacuagaagacucggguggcuggaugcagaggugaggagcccagggguccucuggccucagugacccaguuggccuaggucagcagcaccaccgcaaacugugcccugauucuggaugacuguucucucccugcagacacuaguuuguaagcccugcuggcugugagucacauuugcaaacccagcaaugcaucacacggacaaggcaggggagcccaugggcugccaggaggcauuggcuuauucugggaacugaaagucagacucggccgggcgacugugggccagggugggguggguggggcuccagcaggcaugucaccuuuggccuugauguagggaagcugcucuucuguguauuauuguauacaggggaggggcagcugcauaggcccaccugagcaggugcgugggaaugcauguagggguucagacaggugcuuagggggcguggggcugcugcugagguggguggaacccagcuccgugugaccuugggcaggcagccccuuucuugcccuccuguuguucagcugguagcugugacagugggccagaugaccgaccccuuccagcuccaucugcguggaaaucccagcugucccuucauccugcgggauccuucccuggucgccuagaggaccugacuagugugauggugcugugacacagcauguggcauuugucaggggaauagcucuggcugggcaccuugccugccucccgcugacagaagguggagaaagcucauaaaaguuuggugugaaaucuggggacagaggggagguauuguuuucaguggcaggccuggaaaaagggggaguuugcugucuccaaauaauaguguucucuuuccuuccagcccucuccucuguagcagucaggguuauuuuuuggccugaacaccauuguuuugcaugggucuuccugcuggcucuugaacaacaguuucccccccagagagccugugguuucucccagccguggcucacaccacaugccaggcggcuaagugaggagcaugacacuguaaugccucaguagcccccaugggaggaugacccgaagugaccauuguggguagcacccaccuucaggaugggugugccugugaccugcaggccacaggagacacaguggggucugcaugcagaaucacauucagggugccccauuugcgugcucgggccccugcccugcuccgccccacacagccccuuuuaaugccuucccccaaucugaaauggagaaucauguacaguucauucacccuggaggcuggagccugguugcuuugaaucccuuauucuauauucauucuguucaccagggaggggauggguuguuguuggcgucugcuccagggaagcuuccccagcccuucccagggcuccagcguuuccccuaccccuuguugggccugggacaccgaguuugaccagcuugcacauggacugugagucugauggauccuaaguguggcuugcccugcgcaccacugcucggcucucagcaguccugaacgagcuggcacaugcauuuggaacaaguuugugaacagagucccucugcugcucagccagccgcuucccaucuuggggggcagccaucaguuccaguggccuggagccuuuccaggggguucugugggacugaacagagacagucuuccucgcugcacagccccuguacaauggggcuguacgguaugcccuggaagugaucucaucuuagucuuuugcaggcagccucauucuaacugcugcauguuaaacggccucccuguccuuuuuaccaagccagcucucuacugguguauaccuagggcauuucugaucauguuuuagaaacaugcuguagugaauagccuaguacauguauuuuugggugcacaggugaggaauucuguaggauaaacaccuaggaaucgggaugcugaguuugcgcauucugcauuuuggcuguuguccgguuucucucugcagaagcaguaccaguuacacugccaccaaccaaggacuggucccuuuccaccaccuuaggaagcgucucuaaucaguuuaccuuggcauggagucacagaguguuggagggugccaggauccuggcagucuccuccucuugccuguugguuuugcugcugggagcuccaggcccugggaaggguggugucaugcugccucacuuggcuugcccggacccugaaucugggccaucuugccccugucuggugcuguguucucaaacuucacuuuucucuuccgcacuccaugucugaccaccccagccugagcucauggguuuaaauauuggcucacaggagcugauagaccuagaggcagauugcaucagaguuuucuuuuugccagcucuaccaaaucacagagaucacuguauaaaagaugaaggcagcccaucaguucuuccugaacagugagguccagcacacauaccccuaaggccagcaccacaucugacacaccaccaagaccgcauccauccccagcuccauccuguggccuugcaggcugcuggacuggucacuccauaacccauagcuguccuugucacuucccagcucaggacccuguugcuuuagggucaaguccaaacuccucagcugguccgucuccugcucucuaccuuguccucacuuuucauguugagacugccguccgccccagcccugccaggcccccagcaggcccgugaaugugcuggacucccucaccccagaccucugcuuuugcuguccccucugcuuggaguacccuuucuccccuggcccaugccuguggcccuuugugguugacaucaccaaccucagcaggcuccuccccagcccccaacccugugccccccgcacccacacuccucugcuccuuuauugcuggucagccccacgccucuccuuugcucagccacauggccgccacuuaggagccucugggaggguggggagaauguggcugcucuauagcugaauaggugacauccaucaccacacacgcacgcacacacacacacucauaugcucucacacucauucucacacacacacacauaugcucucacacucauacacacacacgcacucacucacaagcucccacauacacgugcuucucagaggcugucacucuuucugcucucguacugucugggaggccucaggcugagugcucagacgugggagauuucucuggaauacaaaugaggguugcuuaagacccaagugucugcugaugggggagcucaacucucccaaggagccguuuuagaaaaguuagg

SEQ ID NO: 17134 - RNA, 4430 nt, Homo sapiens
uaaaaagcuggagaucugaagccaacauccuagguucaaaucggcucuuucacauacuggcuaugugacuauggacaaguuauuccuacguguuucagguuucuucuguaaaaugacacuaguagcaguauaauaccugccucccaggacuguugugaagaauaaauguaaaucacucauaaacaaugucuguaacaugcauacugaauacuuaaaagaugcaagugauuuggucaucugacccucacaaaaacaaguauuucaaacugcugcuuacuuugaggauuccacguguuauaucaaaagauauaucauuucaguaacuagaccuuuggaggcagugagauaaaugagacuaauugaucugaaggaucugaucugcuacuuuuacaucacaaagguaccugcuuuaucuuuuaaguaacagcuugcuauggaauacucagccuuccuuucggguucagucagauguaguggaaagaugagguugcuaggaaacuuucagauuucuaguagacaaauagagaaaaacuugucaauacuauugccauuuccauucuuuggcaugacugggcaaagaguacccagugcuaaaacauuugucauuugugagaagcgcuaugccucugugguuaguaacgauggcguuagaaugccugguuauaacccuggcucugcuacucgcugugaccuuuggcaaguuacuugacuucucugccucaguuuccuuaucugugaaaucuggauaauaauacccaucuuauaggguuguugggaggauuacauuaguuaauuuccauaaagcucuuagaauagggcccaacagaauaagcaucaaaaaguguugauuauuaaaagcauaaaauguuuuccaguauuaaugacauaacuguauaaaaauauaucuugaucucaugcagaaaagaaaugcuacuguguccauguuuuaguuauuuguauuaguaccagaugugagguaguacaaaugcaaaggagaagguacaggaacacaucuucauguaauuaaccuacugccugaugaccugaccuugggccagaaaagaaaaucagaaagauuaugacuugauagcaucuuuuagaggggucucaugcaucugauaaggacuggacuaaauuaccugcuauaggcuggccaugguggcucaugccuguuauccuaguacuuugggaggcugagguguaucacuugaggucaggaguucgggaccagccuggacaacauggugaaaccccgucucuacuaaaaauacaaaaauuagccaggcaugguggugggugccuguaaucccagcuacucgggagucugaggcaggagaauagcaugaaccugggagguggagguugcagugagcugagaucgcacuucugcacaccagucugggcuacagagcaagacuccaucucaaaauaaauaacauaaauaaauacagcuaggcaugguggcucaugccuguaaucccaggccuuugggaggcugacgcaaguggauuaccuuaguuaggugaggaguuugagaccagccuggccaacaugcugcaacccugucucuacuaaaauaacaaaaaucagccaggcauggugguggucaccuguaaucccagcuacucaggaggcugaggcaagagaaucgcuuaaacccgagagguggagguugcagugagccgaagguuccagugagccaagacugcaccacugcacuccauccugggugacaaagcaaggcuccgucucaaaaauaauaauaauaauuuaaauaaauaauaaauaaccugcuagauuuucauugaacacauuguuuccaucuucuauuuguaaguuauuucuagccuuucaacauuuaacacuuaguuucuucccagauaguuuucuaaaucaguagcauuggagcguacguucucagggccuucugagacugugucacaagucauggaaaaaaaaaauuuuuuuaauuaaaaauagcugggcaugguagcucacaccuguaauccuagcacuuagggagccagagagaggaggaaagcuugagcccaggaguucgagaccugccugggcaacauagcgagaccccauucuccacaaaaaagaaaaauauaaaaaauaaaaccauuaaaagcauuaauaauaauuuagccauuaccaagaggaagaacaaauucugcuuaucaagacagccauuuccucaauaauuuuuuagcaaugccucauaagcugacagcaagucuagacagcuggcuuagcugcaauagaaugaaucgguguuuuaagugugaagaauuuuaaagcaagccaaguaauuguauaaaauuuaaauuuuaugaucaugucuggaccuuuuuacacuuaacacaauggaaauguucauauucauuuuuuuccccaaaggaaaaauuucugaaucaucacuauguugcacaguagaauagaaauaugaauucagguacuuagucaaguuucuaaagaaugcaaauaacagacaugauuuaacuuccaaaaucugaagucaucaacaugauuuuguaguacucuaucucagguuuuaccuaaaaauucguuauuauucagauaaagauagcucccuaaucacauguuuuuaaaaagccucugccccacgacaacuuccugagaucugugaagaaacugcagucuugugaucagacuccauauaggacuggcaguuuuguaaucguagggaaaaaacggugacugauuuuacgugucaaucaguuguagucugcugaucugauuagaagccuugacaaaugccugguggcgauugcaaauaacugccaagcauauagggaugauacaguagcccacuguuuugggaucagcucuuguacaagaguauaggaacaaaaacaucuguaaguaagguaccagaaaaauaacuguccacacccaaaaaggcaaggagaguaauugagcuuucaaggaguguguccaugugguuccuucaaggggcuccucagggugcuguugaauguguuccaaggccagccuguuguaagucucacugauuucaaaaacauaguaaaaugcugcugcacuggcuaacagauacaaucccacuccaauccaucccauccgcugacggaaguucaucauucuccaugcucugugccuucaaauuaaaaaagaaaauacaauuagggucuaguaaugcugucacggcaacuacuccaaauguacuugcuuuaucuccaagaauucuaggccgggcgcgguggcucgcgccuguaaucccagcacuuugggaggcugaggcggguggaucacgaggucaggugauagagaccauccuggcuaacauggugaaaucccgucucuacuaaaaauacaaaaaaaauagccgggcgugguggcgggcaccuguagucccagcuacucgggaggcugaggcaggagaauggcgugaacccaggaggcagagcuugcagagagccgagaucacgccacugcacuccagccugggcgacagagcgagacucugucuaauuaaaaaaaaaaaaaaagaauucuaaaauaucccacuaacacacuuaagauuuaaaauaauuaaauuaaacaccuauuaagaaauguaaaacuuacagguuguuuuguguaauacuuacaaucaaguaaaacaacacacacaaaaaaacaaaaaaccauugauuucaguauauacugaguucugcuuuuuaacgggaaucccucagaauaaaucacugcauccuacuuaaacagguccauaauacccgcccuccagaaacuggaauuaaacuaguuucucacagcacauuucacuuugacaggugaaacacuuucuggcauaacaguacugcuucagacgugaacgcggggugcuacaagucaagcccccaaguuaagacaguaacuccuaagcacuuacaauggucccgaaaaucuuccuguucccacggcaagcguuaaagagucacucagcucugaauaaucggguggcuuuggcauuucagagaaagccaacauaaaauaaauccccugggucacccggcuaggagaaaggugagcgccgccagccuggagcaccagcuacuagugauuaagaacggcgugacugcggcgggucacgcgcggcccggcccccgucgccgccgccggagacccgcucugagaaccugacccggcagggaggcguccccgccacuugggccuccgggcggccggccccgcccccugccgcgcugcagcgccggcacgccgcgaccaaggcugcgcaggcggcgccaggcccgggccucgccgccuugcagcgccgcgagcccagcgcccgucagcggucgccggcggagccugcuugcaaagcugaggucccggaucucaccuuccugucccgugguggccagcccgcccgccgucccggaugccgccgcagucggagcuuc

SEQ ID NO: 17135 - RNA, 641 nt, Homo sapiens
cucuuccgguucuaggugcuucgggagccgcggcuuaagguguagacauggcgaaguccaagaaccacaccacacacaaccagucccgaaaauggcacagaaaugguaucaagaaaccccgaucacaaagauacgaaucucuuaaggggguggaccccaaguuccugaggaacaugcacuuugccaagaagcacaacaagaagggccuaaagaagaugcaggccaacaaugccaaggccaugagugcacgugccgaggcuaucaaggcccucguaaagcccaaggagguuaagcccaagaucccaaagggugucagccgcaagcucgaucgacuugccuacauugcccaucccaagcuugggaagcgugcucgugcccguauugccaaggggcucaggcugugccggccaaaggccaaggccaaggaucaaaccaaggcccaggcugcagcuccaccuucaguuccagcucaggcucccaaaggugcccaggccccuacaaaggcuucagaguagauaucucugccaacaugaggacagaaggacuggugugacccccuacccccgccccugggcuaccaucugcauggggcugguccuccugugcuauuuguacaaauaaaccugaggcaggaaaacaaa

SEQ ID NO: 17136 - RNA, 3281 nt, Homo sapiens
cgaugauuugcgggauucucggcauggcacggccagccugcccgagccacgggaggcgcagccagcccaccacucacggcaagcaggcggccgagcgcccuucgagaagguaggcgacgguacgcgcggaacaaaagcagucccccagauccuguggaccgggugcaagcucccggcuugcaacucaggccacuccaggggaaggggcaguacccgacccaggcgauacccccgagagccggagagggagaugggguugcgggagaccucggguuuccugaaggaaguccgccuuuaacucacaccuauuuuucgcgauuucucucaggcuaauuaaccaagggaccccgcaaaguugucugaagucgccgccguaaggcuaaguaagugggcugcccacuccccggcucaggggcaaaggggaaagcccacuugucaauuucuguucggguuucaaagagccauugcacggagguuuaguccuguccgagggcacuacuguggcggcgcgcagaagcggcccaguggagccaggcggcgacguuucuccuccuaggccucccagcguggaccucuguguccucacggccaccagcuuguggccugagaguugcuccuuccagugcugcgcaaacuagaggugguuguaaauggggauuaggacaugacggagaugggucucaauuuggggaagugaauagaguuuuccuuuuuuucuuuuuuaacaauaaaaacaaagagggagugugacccuccccuuagagaggucaggucuaggguaagaagugaggcaccuuccaucucccacugacuaggaugaagucuuuuuuauuguuguuccguucucagagacuuaagucaccaugcuccagggcagauacucccccaccaaucuuucccagguuuaaagcuacagggcaguugauggacgacaacuagaggcugcaacuuaucagugacugccugcguuuguguuggaggcugggugugcgcugcggugcgcgugugaguggaucuuuuaagaccuuugucugagccgggcagaggcacaagugccaccugacgcuuggggcagauuccucguccuguucuugcaaagaugccaaaucaggagagugucaagauuucaaccgcagaccuaaaaaaagugucuccauguuuuuaaaaguaucagacaaccaccuccacacaccccuccgucuccccuuccaccuggaacauuguucuuuuuaauaaccagguuuagcaaacugcuauacugcgccugugcuuuccugcagcccuccgcuguaccagcugagcccuguacagaaucugagcgucagaguugcagacccaaccuugccaccuugcaaaucaucccuucucuggaggccucaggauuuuaguugaucaaaccaacaccaacauucauugggucccuuugcaacccuaacauuuaaugagacuugguaauugucauccguucgccaaggagguuggggaugaacuugggggcauuuucuuguuuauuuuucauugagacaaaggagugugcuguccccaccuccgcccccagacaaggacaggguuccuacaucagcugggucuaaaauaaggaaaagcgagugcugccgcagaggggacuuuccgggaagggggucacaggaaccccaaggccacacagcuccagacacucugccggagcucuaggggagcucaccccugcgcggcgggaccucccccaucggguugccccuucaaucugcagccgcgcggaggcaggccccgggaaaggcagucggcgcucggugcucgcacugcgccucggcgggcggaaacucacaaguguccucaacgugcuaaacaaaccaucagggccccgcaucgccuggcgcaauuggaauaacaaaugcgacgcacgcaaauuguccaccucguguugcuaagcgauuguuugucggccccgcacgcacagcucagcaugggaggaccgcgagcguccagaggcagccggcgagcgcuuaggucggaaaugcaguaaacaugccgcugauuuucccuauuaucacccaaacacgauuucacacaaagcaaucaccacgcagaagucuaugaaaauguguuuguugaggagucacucgccccaguaauaguccucauuuuuaagauauuaaagaauagcucagcggauuccacaugcauaaggucuauuugccguucggcaucugucacggcgcuuuugcacugcggucaucacuaaauugauucauagaguguagauuaaauugcuucucugauuuaaaacaguguccaacuuuggaguaugcgugugaguaucuucucccgccccaagguauuuuugucagggagaaaacugucgccccacuauccuuacaccccauuccgcauaacuguaaaaaaauaaugcaucuucgaccccaacuucuuacgguucguuucaggaacuuucuuaauucucuccgucuccugcccggccacagagcagaguucacaaucggaugcguuuaagucggauuuuucgugucaugugcaaaaagccgguguguccuuuucaagguacggagcccucaucggagggcgcauuagcggggucagaggaauuaggagcaaugcgcagagcccccugcagcccgcgugcugcgccgagaccucagccguccucacugagcggaaugguuguguuguuuguauugggacuuuuaaaaaauccagucucaaagcuaagugcucaaaccccguuccauggcucugcugcuuucuggaggacaucuccgguagccccaggggauuguccgugugagguuggguggguggaguagagccagaggcgcaaaugccuccuggcuaaggggcagcgcgcauuagagcugggucuccugcuuucggagcggagggcguaagggagcuuucuagcugauuuuuugcuagaaguuuuccaacgcuccaaauaaaagcacccgauccccuaaggacgaaauaaucaagguguuagggaagcucaacagaagagaagagacgagaagagaagagaagagaagaaggggcuaucgaaaaaugacguguucccaaggccuuagaaaaauaaauaaauaaauaaauaaauaaauaaauagcuuggacuuuccgggguugcagaaauccgauuucagccgggcuauuuaccaaaauuuguuucaaaaugacugcaccuuugcuuuugcaagucacagaaugcaaaugacgauaauuuguucucagaagaaguuucucuugaaaugauuagcaaagucagucauuug

SEQ ID NO: 17137 - RNA, 71207 nt, Homo sapiens
gggucgaggcggaggcgcggcgcaggcugcugcaggcccaggugaauggaguaaccugacagcggggacgaggcgacggcgagcgcgaggaaauggcggcgggggcggcggcgccgggcggcuccgggaggccugggcugugacgcgcgcgccggagcgggguccgaugguucucgaaggcccgcggcgccccgugcugcaggugaggcgggcucccgcggagcagcuuuguguccggggcggggagcgggucgccuggccgcgcucccgccuccgcgcggaggcccgcgugccggccauggccccgagccgcgcguccgggccuggcgggcgcugacgaagggcgcggccucgccugccucgucgucccgcacagcgcggccuguggacccggcgucugcccgccucggcucugcuccugggcccggaccccggcgccuccccgcgaggcagcccugggagacuuuccgggccgccguggcguggugggggaugccggcgccuguccacuccccggccuggcgaggccuggggcucuugacaggucccgucacgcgcgcuaagguggcgcgggagcagcggagguggagacgcgcgccugaccugccggagcacccuggggcccuccucugauggggccgcugugccgcgcccggaggggacgaagcugggcucucggucccucccgggaggguccugugugauuacugucaggggaccagauuggggcccuggggggcgggcaggggccgaggccauucuuuugccucuccccucagauguuuuugugccaaaaugccuagacccugcggaggacccuuucuucaggguuuuugauuuuggggaaaucaguguauguuuuaaguuagcacaucagauuucuguagauuguccagaaaagcugaguugcccugauggcucugccuggaggucagagccagcaaaccacugaguguguccuuaggaaccugaagauccgcggaaacguggagaugaguuggaggguccuauuuguguaguguuaacuccgugcuuuuguggagagaguugugguuaaagggacacguuacuggucuacacgauaaguaaguguucuuaggacuuucagguuuuaaaaacauucaucugaugaaagaggaucacuuggacgccuaugcuucugucuucgaauauucugaaucuuuacaauccugauugucaggugucuucguggugcuuguuuucaaacaguggaaaaggacucagguuaggauuuaagcaacucggaaaauauuguuaaaaaugugcuguuaaaacagguuagcuauauugaauauguauugguguaaacguuaaguuuucuaaauaaaaauauacauccucaccaaaaaacucaguuuauuaaaagauggguucgggauaagccagguccuagagaauaguaauuuucaauauuauugauaucuuuggaaauuagguucuggaauagccaguuuauuuugcaaagucuacuuuaaagcuaccuguggcacguguguauuauauguaauaugugcuguguacaugcacauacauacacaauuauuucaaaacuucauuuuagggcauauuccauaaaacucaauagauaaaaaaacaaaaaacuaaagauugcuuuuaacauggucacuauaaacauugaucaugguaacauagguuuauagauuuacucacggcaccaaaaugcuguuuuaagaagagaacaguuaguccauuuuaauuuggggagaaaagacauuuuccuacaauccuuuuuaguaagggccugcuuuacuuuuuaugcuuccaucucauguuugaaggguaagcccugacugcucugcuguauuuugcccguggcucaaugugugaguuggguagcuagguuguuuugcuauuauugagcuuuauugucuugguuuuagaagacauugucuuuugauguggcucaugauucuuauuugacagugauuuugucauauaguggguuguacaguacuuguagugcuaucuucuagagagggugacuuuuauggcguugggauguuuuauucucuaccacuaucugacaugugaggugcuuguuucauuugagaaaguagauauuucguagacagucucucacuugcgacccuaccaugucauggucacguuuccacuugcucauggcaaaggagauaagggaaacguguuauugagugccuccuuguuaugcgccaagauguuucagguucuacguacauucucuucuaauccucacugugacccugcgaucaacucgauauuguccuuguuuuauaggcaaggaaacuaagagucagugauuauuaccccaaguuaggaaucucgaaguggcagagccgagaucgaauugugguuugguuucagaaucuuuggaggcaugcuuuuuguauugcauuacuguuccaaauggauuucagggcugcaucacguguagugacuccucaguuaagacuuguggaaugaaugaagcugugucuaaccuuaaauguucaggugaaugaaugguuauuugaauauuucagauaguuguuuuuuuuuuuuuuuggcaugguaaaauauacauaacacaacguugaaccauuuuaaguguacaacuagcuggcauacaguacauuuacauuguuuuuagucauuaccagcauccaucuccauacuuuuucaucuuucccaacucaaacuguccucauuaacacuaacuccugauuccauccuaccuucaaugccagagaaccaccauucuacuuccugucacugacuacuggagaaaccucaaaauaaguagagucauacaguauuuguucuuuugugucuggcuuauuuuacccagcauagugucuccacggcucaucugugaugauuuagaugucagaauucccuuccuuggaaaagcugaaugguauuucauuguaugaauauacugcauuuuguuuauccauucaucuguccauggccacuuggguagcuucuaucuuuuggcuacugugaauaauggugcugugaacguagguauacaaauaauucauuggaguccaugcuuucccuucuuuuagacauauaccucaaaguggucacauuguuucuugaucuucaaaacacuagacuagacucagaauuuauugcaguaugaguuuucucaggguuccuccaagcagugauaauuuccuacaaacaacuccucugucaguaaaaucuguaaucucucugaagcccagggucgacuccuuuuuacgaucuugguuccaaucauagugucuggcagguauucaaaaaacugaucaaacauggagugaugugcuuuauugaaugccagaggaagauauuggugaggucuuuaauuuguauaaagagaaaguuggagccaagugacuuauuuuguuuaccuuuugcugugcuuuuuggacauucaagagcuuaguucauccugaaagcccaguguauguauuauacucgcucuuauucacagguuucuuugcaauuuacgacuugccaaaugacuagucuucugaggcagcauuauuuucuugguauuccaccuccuuagccuguggggcuuggaccuuuugauuuuuugauggcuaguuuucacuucuuccaaauuucugcuaagacucuaguauuaguacauuuauuuaauaguuuaugaugucuauuuugagaaaggauuugaaauggucuuauaauaggaaaguauuagaguacuaugaaaaugguaaagguugguaguauagaauguggaggcagagaauuagaugaaugauuggggcaaggaaaggugagugcugcauguaacucacguugauuaaugaaaggaagcauaccaauuugaagcagauuuuucucuuguaugaagaauaaucaaucuuuuggauuauuacauuaaauaacauuagcaauauauggagaaaauguuuuacauuuuacaaacgauagagaaacauuuuuucacaugccauuuuagagaaacuggauaaaagccucaggcauaauagaaaagcuuuaguaauacagguguucacuguuccagugguuugauucauuaauuucuuuuggguggugucccucgaauaucaguugucucauucaggcuguugacagaugcuaaauaacaauccauucaggaauaagcucuguggacaacaugggcagugaggauuuuccaaauaggaauucucacccagucuuuuuuuuuuuuuugagacggagucucacuacguugcccaggcuggagugcaguggugcgaucucagcucacggcaagcuccgccuccugggcucaugccauucuccugccucagccucccgaguagcugggacuacaggugcccgccaccacacccugcuaauuuuuuguauuuuuaguagagaugagguuucaccguguuuagccaggauggucuugaucuccugaccucgugauccucccgucucggccucccaaagugcugggauuacaggugugagccaccgugcccagcccucucacccagucuuuaggaacguguguuggucuaaaaaguaagacugguuguaucgugguguauacuugaugaauuaauacagaaagaaaaagauuauuuuugagauguagcuggugaaauugacauuuucaguuauguaauaaagccuuuguuaaaauaauucugagugcaaaauggcuuccucaucuaaaauugucaaugaauuguugguacuccuuuaacaugcaguuaccucaauaugcauuuuaaauaagugacuaagaagaugcuacaaaacauucucugaggaugucaguaagacuguuacuagaaguaagacaugacaggcuuaaguuuggccuuagaguuuuuucuuuuuguuuuuuaggcuuauaacagcauuacauguucuugguuguguuaagguuuauggaauaguaaggauuagauucuucaugcauguucauuaccagacauggugcuugacauauaggagacacuccgauuuguugagugaguaaguuaauuuauaauacuuuuugaaguauuuagaagcuaacacaguuuuguggggaagaauauugcuugcauauuaaggcuuuuaaaaagauuauuacuauucugcuuuuggacaaaucaugcuacuugguccuuuuugcuuugugagguacguaugauuaugugcacagaaacauugcagacugagggaaguguuaagaaucgugggagaaaaucgccgucaaaauuggaguuuaacuguauugcagacuuucuccuuguuggcacagacuaacucuguugugcuuguucguucuuugacagcucaauguaugccauaaagcagggguuuuaacaacacauuugaacaauucuugaggauuagaaaaugaggucuguuaaccaguucagaauuuuaagaaaacaaaccgguuguacuuagagaacuugaauaaugagagaagacucuuaguuuaaaaacugaucuuugacaugauguaggaagguucuuugauuaagaaguuaaaugacccuguuugaagggaaaaagaaagguaguagucguauuuagucguauuuaguccucugagauguuucgagauugcaggauuucugucuuuccucuuuugguaacauccugggaggugagauuaacaugaugaacucacagccuguccgccucuuaugcauccugcugcccagccaucacugucaguugcucugauucaugguauuuuaaguucuuuccacuuugcagaguuaaauauuaauguuuuaucauagcuuuguagggaugcuuaagagcaaguguuuggcgucagagagaccaggguucaaauccugauucuucgacuuuauagccgaugagcacugggcauauggcaacgucucuugagucucagcuuccuugucuauaaacugucguagugguguuugccucuugagguuuugagaaaaaaaaggaguuucuuaaacucucaugguacauaacuagcauuugauaaaauuaauguaauauuuuucuuuuaaauacguguauuagagaaaauuuuaacaugcaauagucuuaaugugauuagauuauauugugagcccccaaauuaucaauauugaaauguauggucuaguaauauaauggaggaugaaggaaaagagggcuugagaacaauauuuuacagacaaguuuucgaggaggauuaucuauacugguucagcuaucuuaguuggucucuguaguagugauaccaaauguaacagugccuuaaacgucucuuaacuuucccuaaauaacacauucuucaucugcuaugcaugaauuaacacaucauccuugaaaucauacuucaauucaguguauaaagccaaguguuuuguaaaauaaaccucaaguuagguuuuauguuuccuuaugauuagauucagguuucagcugggcacaguggcucacuccuguaaucucagcacuuuaggaggccaaggcaggaggaucucuagaaccuaagaguuugagguagcagugagcuauaauugugccacugcacuccagucugggcaacagagcgagacucuguuccccucuuucccccggcaaaaauagauucaaguuuuguacuuucaguaggaaaacuacauuagguauguguugucaguuuguccuaauacuggugaucuuagcuuugucacuuggauuaaagggguaucuaucugguuuuuccacugaauaaaaauacuaguuuucauuuguaauuaguagguaaucugcagaaaagcuuucaggcuauguaaauauucuuuaguaaccuucacccaaugguuuuagcauccauuaaugauccuugcuucaaucacuaaugugaugguuaaaaauggugacuuuucugucauuccuucuacauuuauuaguugacauucaguagaguuucgccugaauuuuaaaccuaacaaaauacgauuucuuuuuuguuguuguuaaugcugagucuugcucugucucucaggcuggggugcaguggcgugaucuuagcuuacugcaaccucuggcuccuggguucaagcgauucuccugugucagccuccugaguagcugggacuacaggugcaagccacuauauugagcuaauuuuuguauuuuuuaaguggagacgggguuucaccauguuagccaagcuggucucgaacuccugaccucaagugauucaccugucucugccucccaaagugcugggauugcaggcaugagccaccgugcccggccuacaaaauacaguuuguaaaaugagaaacuaaguugagaaauaagacugucuugaguuggguuuucccaguugcaccuguaacuuuaagaacuuuaaaauuguuucugaaacaucuucaagguuggagucagauuaguuugcauuaauauggaagagaauuuuguagugguuggaaguuaacugagaaaacuaggauggguauagucagaugauaccaaaauuaucauugcacuaacugauaccucucuagcuuugacaguuucuaguuagccucgaauuauucuuuuggacuugggugccaagaucgaggauguuaagcuuguugaaauaauuuggguuguuuaaagucuuuuaauuuaaaagugucuaauuugaguuuuauauuugaccuauaaaaagcugcuuuaauucaauaguuaagaucaauaaagcuuauucucaacaucgaauuaauuaauaaaaaauuauucauggauauuuacuuuccuacauuccaaacuaccuagucauuacaaauuuacaguaacgugaaaaucaaacaaaucaugaacuauguaauaugaaugugaguauaguaugagauuaucuuucaaagaucuuaauacucuugagggagauggcaauaacagcuaauauauggggcaguaauauaaugaagcccgugaugauuuggguguuguagcuagcccaugugugcuaaaugagaggggaggggacuaaagugauagagguuuuuagggaaaguuguggggugggguucgugagagguggcgaacucuguugguacacacuuguuuugguguuacgggaaaggcagauaacaugagauguugcgcagaagcuaugaugauguagugcgucacacucuugccuggaccuuuuaauauauuugcuuuccugucucaauaaacauccaucuuaacucaguagucucuuauguucauuuugucucuggauugaccucccuuuaguauuuaaguauucauguuauauaucuuaaaacagcuugacaaagagaaaauuguggcuccuuuuucccaauggaugcucuuucuugguguaaagguagaggguagucgugaauugaauaaaauucuagcacucguugcacaguguuaagaguaaaguaugugccuguagucucagcugcucaggaggcugagauggcaggaucacuugagcccaggaguucaaggcuguaaugugcucugauggugccuguaaauagacagagugagacccugucuccaaauaaaaaauaaaaaaaaagaguaaaguacagaaacuuggaaucaaauaugaaccuuaaaacucaccuugaaagcuagugauguguuaaguauuuaugucucuugaaacaaaacuguaggacaaaugucauuauagguaacuugaaggggagggguggguaucugugcuguuuugauguguugaaaugucaucuuucugagaaguacuccaagaaguaagcggaccuuuggcuugcagccuggagacacuucuuauauggagaucuuugauggguggaauuuguuaagaugguauuugaccuguguuccacuucaauuuuggaccaaucuaauuuuaggcaugauuauauugaaaucuaaacauaacauauuuauguuagagauuuagagaaacccagaaauuuauuugguucagauacaguaaugcaugaaaagaaggcuaaugaauuugugguuuaaauuguagguacuaugauacuguaaaauauauauuuggucuguccucuacccuauucuuaggcauacaaggcuugaaauccuuagaaucuccaaagugauguguuuuuguaugcuaaugaucgacugguggccgguagcuccugguagcuucaaaaugggggcugguuacugggaagacuaaggcaugauuagagguuuggacucagacccacccuccaaccucuggggagggaagaggggcugaagguuaaucaugcccagguaaugagucuucauaaaaacccugaaggacagaguuuggaaagcuucuggauaguugaacacauggagguuccuggagggcaguuugcucugggagggcuuggaagcucuauaccccuucuccauaccuaacccugugcaugucuucaucuggaucuuuguaauauccuuuaccuaauuaauuuacuuauuuuuauugagauggacucucgcuguguugaccaggccggucucgaacugcuggccucaagcgauccucccaucuuggccuuccaaagugcuaggauuacaggcgugugccacugcacccagccuguaauauccuuuauaauaaacugguaaacauaaguaaguuuuuccccaaggacugugagcuggucuagcaaguuaaaucccaggagggcguugugggaaccccaguuaacugauuggucgggagcacgggcaaaaaauaaccugagguuugcaauugacacggaagggugggggaggucuugaggacuggagcccucaaccugugggaucugaugcuaucuccagguagauaauguuggaauucagucauuaauagaagacacccagcugguguccgcugcagaauugauggcuugcuuguuguuggggagaaaccccacacauuuggucacagaaauuuuauguggugugugagaacaaaggaaaaacaguuuguguguguuuuuucccacucagauauucagguaaauguuaccacauuuugugccuuaacgggggagguuuuuacucauuaauucauucauucuagagacagggucuuacucuggagugcaguggugugaucauggcucacugcagccccccaggcucaggugauucuuccgccucagccuccugaggaguugggacuacaggcacaugccaccacaccuggcuaauuuuuauauuuuuaguagagaugggguuuugccauguuucccagguuggucucagaauuccugggcucacgugaucugcccaccuuggccucccaaauugcugggauuaugggugugaaccacugcacacggcugggaggauguuuucaauaccuaaaacagaauuguaugucucuagcuuaucgucacacaaaucauccacaguuugaaaguuuguuuuccaauucccaauucuguguguucaaguuguaggaaauuuaaaaugcugaaaaguuuaaaggaaaaauacucauccaaguaauucaucauuaauuuuuggguaaacuaauuuucucucaccuccuuccucucuuccuuuuccuucuuauccuuucucacuuccuuuuccuucuuagccuuccucacucccucccuuuuuccuuuccuuuaguuuuuaacuaagacauaauuauagucucacuguaaauaaaaguguucuacuuuuucauuuaaagccauuuacacaggauuuuucucagucacuuuaccagcuggggaccuuuggcuggugacccccguguccgggccuugcuuggcuaugcuacccucccacuuggccugccugugccacaccuggcuugugcucuggcucagcuaguggcugggccagucaugccccagccuaccuguguuacggcucauacccacguuuggcgguuccugaguucuuguucugcauccaagaagaaugaggauaugcugacaacugaagggugaggaaggcagacguaaauuuuauugagcaaugaaacaguucucagcagaaaggggaugcgggggugguuccccacccgaaguugugugguuuuucccccaguguggcuggguccugggcuuuuacaggcucagaauaggggagugugugcugauugguuugugaguaugcaaaaaaaaguuaaaagcaccacucaaaggugggcuugacaguguaagaaaccaauuagggaaguguagguauauguaagauaggugaagggugaggaucaaucagaggaaagugugccaaauggcaagacagguucucaauccggucccuggauuuaucugggacuuguaguucucuugaaaaacaaacaaaaaauacuguguaucucgaccuucaggcuuuaaacugucuuugauuugaaggugggguuucacuggggaccuaccccugucugccuaggcauuugucugccugcugcugcucucaacauaagcauuuuuguucauuauaaacuuaccauuuuaaauggcugaauugaacuucaccauguaaaaugaaccaggguuuaccaaaccauuuccucaaucauuguuagacauguaaauugguggcggggaguguuucuuugcucuuauaaaugguaaugaugaagggagcguuucuauaugaaguuuuuuuugugugugugguaaugacuagguuaaugugcagcgaauuuuaauuaagaaugacagaaauguaaaguucauacccauaguguuaggguaaacuaaaaaaaaaacuuuuuaaaaagacaaaugacaauuaaaaguaaaaauauaaauaguucuuguguuuuguauuuaaauaugcaaagauaccaguguuuaaauucuugaaauuauuguuuuuuuuuucucuuuagucucuuaauccuugguuugaccuuaaucuuuucauagucuauauucacuaaauaauaguugauaaauccuugaaauacuuguuuuauauacuguggauauguuggauauuuucuuuugauuucuuuuuuauauuuuugaaauauccaugauuauuacuauuucuuguuucucugugaaacauuuuauugccuaagaaacaguucagugaaauaauguuuucagugaugucuguccagccaguaaguaguacacaguauuuuuuguuuguuuuucaagagaacuagugaauacaaaacuguuuaaauuuacuuuacguuagguaccauauuuugugauuuaauugcauugauuuucaucuuaauguaaaugcauaauggcuagcuuguuuggaauguaggggaggaaaacuuuuccuccacccacuuaggcucuauugcugggaucugugaauuaaacuaacaaaagacauuaacaggggaagaggucuacagcuuguauugauguuaauauuuuugcacgcacaggggcaucaaagaaaaagauguaaaaucccaaagaaacacuuagauuuagaggcucauauaccaucuuaacaaagagugauaaauuguggaaggacaaaggaggggauguuuggauuucuaggguugauaaacugugggaaggugauuagacgguguauggaggaaaccauugguagaaaagguuuauuuauuaagguuuguuuaugcagauucaucuuggugccaucucucugugcugugauaaggauuguucuuuucuuccugguguagaagaagggggaguuuaugccuuacucuuaaguagaaaaagggaaggcauagaacuuuuccugaaucuguugauucuuaauugcuuucagcucaaaauaauauaccaaaguggcauaguuggggguggcaucuccugauccccauucaggaguuugugguuuuucagguuaaucuggcuauaaauucuguauaaaaucuucuaugcauuauaugagaaugcauuuucuaugccgaaucuuacgguuaaugaaacauuuuagguuuucuuuaaggguuucauaaaauuuuaagaguuuaagaauuaugcuaaaaaaaaugguucuagguagagauauuuuguaugauauggauuuuguauguuccaagcauuuuauuuucucucuacuaaguuuaagaucuuguguaauccucguaauagucagguguuucuguuuuacaggcaaguaaacaauguuagcgagguaguggagucuggauuuaaaccuugguauucugacacugaacugcuugcuggcauuaagauaauuuuuaaaagaaagauagguacaaaggaaaaaaaaaagaggcugcuuccuauauccccaguugccuuacucagugccuccugcauaggcggguauacaugagaagggagugacaguguauagaugucacugaaaacucagaaucaguguuuugaggcaaauacguccauuaaauacauguuuauauguauauauaaguauauguauaaauauaaauguguauauuaagaggcaagagcaucaauuugcuuauuaaguuagcuaaaaacaucugagacuuuuucugcucuacaacuuagaaaagggaaguagguaggaguuguuuucaaacaacuuggauucuauguguggauucauuuucaguguggcuguuugcccacuuucauuuucauuuuuaaaaauuccuccauguaguuggccagcauauuuuagggcuucuccaguauuuaaguucuaagaaauggaauuuuauuauuugguaugaauacuguuugagauuugggcuauauuuaaaaaauaaaaaagcuaauguuagggaaauacaauuaaaaccaaaaucucccaacccagaaaauugcuccacaaagguagaaaagaaagaaaacaauguuauuauugaaugaacauuaaaucagacugcugugcccaucacaggcagucacuaaagggauggcaaagacagaaagaaaucuuacuguuuuauguaacuaaaugguuacaauccauuacauccauauuuucaagauaaaauugcuaauuuuuuuucacauuuuuaugacuagagguagguuuuacauuuuggagucaggugacagauuaggcccaucuccuccuaggaaaccaggcgauugaguguuauuucccauuucagagauggcuuucagguccuuaggaaacauagccaaguuauaagacuagagacuuaaauuuauauacauugaaagggagggagaaauaaaaucuggaaaagaaaaggggaaagggaccucuucccuuuuauuuucagcagggagaacuaugccucuuauuuuuaauuuguauuuguccuuacgucaacagucaguauuuuguaucuauaccauggcuguccuaagugauguaggcgugauugcaguuaaaauaaugccuuguaucucacauagcacuuuuguuacuaggaacuuaaagugcuucauacauuuuuuuaguuuucucuguuagcuuaccaugaguauugcuuauacuguuuuaaugucacuauauugugguuuuuuuccauuuguuuauccuggaacuuuauagaagucaugcauuuugggcuuugugagaguaggaaugaaaucuggaugguaauauuugcaaaguuaauaaugucagaaucugugaugcauaauaacauggaugaguugaaauuauuuugucaccaauuuugaaaauucacagcagaaaguucuaggugccuuuaggcuucagaucugaaugguuagcucuuucuugcuacuagccugugaaaggauacagccucguuacugcauuuaguugcuaauguggauuaaguuugcuaguuuguacuaaaacuugacugucugauauguggcgugccuguuucagaguuaucuuaaaggggccuaugaaacaggauuuugcagguuuguacuuuacuucacagugaucaauuaaaaugagaaaaugaccuauuagcuuugaauuaccaguauaaaauaaguugcuauuauacuugacauauuaccuuucuaauguauguauggaauuaucaauggaaauaauguggauaacuuagcaauaauuuuguaauaguugggugacauugaauuuuaaaggauuaucaacuuaguaauuugauuauggcauuucuaggaaugaggugagucugaauuggaaaucaucucuagagggugacacagcaggacauguuggugugcguggucuuugcauccuacuagguggcgguauagaaugaaauuaaaaauuaaaugaagucugagguagccuuagaaaacacaaauuuggcugguugcaguggcucacaccuguaaucugcaguauucaauacagcauguuacuguacugaguacuguaggcaguuguaaugcagugguauuuggguaaucuuuugggacuacagcacuuugggaggccacggugggaggaucacuugagcccaggaguucgagaccagccugggaaacaugggguggccccagcucuacaaaauagaaaaaaaaaauaaaaaacaaaaagaaaaaugaaaacauaagcacugacauauugggagauaggaagauaugcucauauacagcaugguacugauuuaucauaguguuuaaguauuuuuaaagccaaguuuuacugagggaaaagguaauuuaaugccaagaguuaucccuucuaucuaauuggauuguacuaacaaguuguuuuuccuggcuguauuagaacauaauaucccaauuuuaaagggcaguucuuuuagacaugcauugucuuguugcccaacagauaaagaauuuuaugagggaucuuaaaaaguagaacaucucuuaaaguucguuuuaaaaaaugaguugucucuucuaaaauuucucucugauugcuuuuagguuaccuaggguaugaauuaauacagacuuggaaacucugaaagaacuuagaaucagcauuuugagguaaauauguauaugccaaaguagugauaagguugccccagucugcuuuguugacuucuuagcaaaacaaauuuguguaugaaaugagaacuuuaaccuccaugagaaugucuuuuaaaggacuggaaguaguaaaaagaggccacugccaauuuguuuuuccugagcuuaugguaguggaggcauugcagaaggcucagaccugagcgcaaaccaagucugaugucagaucuaacaaaaucaguauuuguugaucaaauuaaacuuuuuauaucuacauuuuaugcuuucuuaguuuuugauuuauaaucucuuuuagagagccaccccaaauuuaaauuuaugcccgacauuaacauuaacaguguucuugaauuauuuuauuuauaaacuaauucuauaaaaauguauaguguagauguaacuguccuuuuguguuuuuaauuucauuuugggaaauuggaauugcugauggauuucauaccuguguuaaagaguuacuacuggguuauuuggauuucucagccaaguacgucuucuggugaccuucuuuauuucuuucguuuaugugaauuuaggaaauaauagcuauuuuuuucauuuuucuauaaaauaccaucuuuagacuuuauuuacuuugauuuccuuauauuagcuuugaaaucuuuuuuugaacuuugcucuagcucuuuauuucucccagaucucugggaauuaggcaugcuauuguagcuuauucucuuguucuuuguuuuaggguaagccuugguauccuaaaauaaucuaaaugccuuuuguuuaaaauuuaauucaaaauaauggccuuuuauucaacucuucauaucaguagggcucucuuguagauguguuucuguucaguuuacaggaaucuuaaacuuggcuauuuuugcauuuauuuuuagagcagaagcuugggcaugcugugauuuuccaauaaacugcuaucacaaugucaaaaugcaguucagacaagagcaacacagagaucucaaacauuaaaacgguaaaucugugauucaucauguggaaagaggaagagaguuuauucuugucuuucuugucuuuugcuaaauuacagucaugcauugcuuaaugacuggauaucuucugagaaaugcauuguuaggcgauuuugucauugugugaacaucauagaguguacuuaauuaacauaaaccuacaugguauagccuauuauacaccuaggcuauaugguaugaccuuuuguuccuaggcuacuaaccuguacaccauguuacuauauugaauacuguaggccguugugacacagugguauuuguauaucuaaauauaccuaagcauagaaaagguacaguaaaaauacaguaucauaaucuuacgagaccauagucuuauacggggucagucucuaaaacauuguuauugggugcaugacuguauuucuaagugcauaauauguggaaacuaugaaacaaccucacuaguuucaugaggguaaguuguuugaccagaaauuuaaaaucuauaguugaaaaacagucauguggaguuauuuuggcucugcaaaagcaguuaaugguagccaguuuaucugugaaacuagaaccuuuaccugccagcagagauucagaucuuuucauuaaggccaaguuuaaaaaaucuguuuaaacaugccaagaaaguaaaaauuggcaaaauuauagguuuuccuguuuuuauauuacagauuaccuguuggaauuuuaagucuuggauuuguuuucccuaaauagaaagugcauuacuggggccaguuauuguccacuaaaugaaugaaaauuaauuuaaacauuguaaccuuauggaaaauauaauuggaaggguuaaauuguuguucuuuauguccuuguacauccucucuccugcacucaucucucagggcugguaggagugggauagauguguguuuccaaaccgaauagaaauauaucuugauccauccaugauucuguucuguauauuauuguguggacauucaugagucucuaauucaguuugucaaauauuuacuuaaauguauauacagaacauuguagcaggaaauuuaagaggugcaaagaaugagacucaugucuuguucuuauggagcugugcuccaguaaaagaauaacauguauguuguguaugugugucuaugaauagcucuaaaaaucugugauagaaauuaugaaaggcaaauagaagcuguuugagguuuuaaugucacucagguggacauuguuuucauucuaacaaccugcaguuuuuguuuaccauguccuggaugugguucuguacaguggguaauacagguaaggguaagauaugcagcuccuauauccaaggaaauucuagucuaauuggucauauuuuagugagaacagaguuuuaagagaaauuuucuaaauaagaauucauauaaaauuacagaaguacauuuuauggauuaagacuauaccccaagccucuguaguauaacugcuaggaucacuuggauugagcacauaggauugaaauacaggauuaaacacuuucaguuggucagucagggaggaugcauaauaugcuauaggcuuucagccaacagggauuacucuucuguuguggaaauugcuggugaauggugaugaggcagcaauaggauagcauucuuuuuuuuuuuuuuuuauuuuuuuauuuauuuuuauuuuuuuuauuauacucuaaguuuuaggguacaugugcacauugugcagguuaguuacauauguauacaugugccaugcuggugcgcugcacccacuaaugugucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaagcugggugaauaaucugaacguaagguuacaggucggcagaagucaggcagucaugagugggggcaguacuuuucagaguacauuugggacuagauaucacagaguguagugcuuugcuuaauuuccuuuuuaaauaucaacuuuuuaaugaauuccauuccaguaguuuguauuauuuucuuacacaugguuuuuugugagagcugauagaaaccuuaaucuuuucagguauuuuugguuagagauguuauuucuguauuucuuuauuguuugauauuuauuuuuacuauauaauguaucuauuuucucuuuauuuagagccuaaauguugauaaauguaaccuuucauuucucuguuuuuuuuuuccacuuuuuuucucagauugauucuuagaaaccagcuaccuaucauuuuuuucuaaacccugugaaaguuuuagggugggguagggcauuuaugagaaauguuguguuugcuaagaaaaaaaaaaaaucucuguccuuugaaaugccaggaacagaaccuggacacugagugaauuugcaacuccuccuuuuccaagcucuuuaccugcugguuuguaggaauaggauccacauacuugagugagguuggugucuugaggugaaaccgggccugagaaacauuggaggucuagggcuuauuuuccagauagaauugagucuuuguuggucuugggccagcuucccugcccugccuguuuucuccuuugugauuuuaugagaacaaaggaggaaauaggcaggccagggaaacgaucucucucccucucuugugccgaggaagaacuguccagauuuuuccucaauuuguuuccgaaacaagcggcuuugcaguuucaaaaagaauuuacugauagcagaaagugaaaaaaaguauuccuaaggacaaauaaggagaacauuuucaaagucuuagaagcuucuugguagagcucaucccugguuuuuuggagucuaagacccuugacuuuucccuuacaaacaaagcuuuucaccuugcuuggggucuggcugcaguacuuguucauuaucucaauauuuguggccugauggcuuucugcuuugaucccugacuuuuuuccuuuccccuuccccuuucccuuccccuucuccauucccuuccccuuuuucuuucccuuuccccuuucccuuuuccuuccccuuccccuuucccuuccccuucccuauccccauuccuguccccuuuuucuuucccuuuccucuuccccuuuuccuuccucuuauucccuuccccuuuuucuuucccuuuccccuuuaccuuuuccuuccccuucccccuucccuuuuccuuccucuuucccuuccccuuccccuuucccuuuccucuuccccuuucccuuuuccuuuuucuuuugccuuucccuuccccuuccccuuuccauuuuccuuuuuauuuccccuuucucuuccucuuccccuuuccuuuccccuucccuuuuuccuuuccccuuccccuuuuccuucuccuuccccuuuuccuuccccuuccucuuccuuucccuuuucuuuccuuuuccccuuucccuugcuuucccuuuuuccuccuuuccuucuuucccuucuuuccuuuuuuuccuuuccuuucuguucauaucuguucuuugcuuuccucuuuucuacuuauaccuuuuacaggaagugauaauagugauuuagagagugucauuugguuugcuuuuaucccagaauauucaacucaagcuagcuuggauaguuaaggaauuuguuggcucaguuaauuggaaaguccauuguuaggcugggcuuugaguuugguugauccagcaguuuauugaugucaucaaugacccagguucuuuauuuuugccaucugcggugcugguuucauccuaaggcuggaucuuuucaugggucuguguaguguaauugcagcagcaaaugggacuaauaauuucaugagucaucuuuagagggaaagaaagacaacugcuucucuucaaccaucaaaugaaaguccuaaauuuuuugcuguuggaugagcaugaaccaauuccucuggccagggguaaguuguaugcccaucagcuuagguuugggugacuggcagauggcagaaaauaagaaacuagagccuaggcagcauagugagacccugucucuacaaaaaauuaaaaaauuagccagucguggugaugcacaccuguggucccagcuacuugugagguugaggcugcagugagccaucauugcaccacugcacucagccugagugaucgagugauucucagucuuggugaaaaaaaagaaaaaaagaaacuggauccuugaucagugagccacuguuugacugagaccacgcugaguugagcauggcuauuaccuguggaggaaauggaguauuugagagcuagccagaaucaccuguccuugugcuuuugaauacauaaaggaaugagguauuuauuuauauuugagcagaaaaugaagaaaaagauuuauguugcaagaauaauaggacaaaaauaugugcuguacccauuuugccccacuugcuuuaucagcuguguguguguguguguguguguguguguguguguguguaucuacauguagauucuuuuucuguaccauuugagaauaaguuacauguaucauagcucuuuaccccuaaauacuucaguguauauuuucuaacaauaagaguauugucuuacauagccacagucaguuauaucaacuucagggaauuuuaacauugcuguuaucucguuuuaaaaaugaauucaauaauguccuuuaugaaugagaucacuauuuauguucuuugcaacauuauucauaauagccaaaauauugaaacaaucuaaguguccaucaacagaugaauggguaaagaaauugugauacacaaacacacauggaggaauauuauucagcgcuaaaaagaaggaaauccugccauuugcaaaaacgcagaugaaccuggaggacguaauacuaaggauaauaagccugucuguuauuuccaucuuuauguccauuuguauccauauagucuuuguuaaucuggaacauuuucauaguuuuucuuuguauuuuauggcauugacauuuuugaagaauacccuccccagcuuuaaaaaauaaaacauuccuaauuuauuuuuagacuauuuuucuaaaguuauuuauuguuauuacuaauguuaucuauaugagaagaaauggugacaguuguagggaggagggggugcugcugguuccuggacauaccugguuucuggaaguaggagaagauguguuggguauuuacaucacggcccucuuuucuccuuuguuuuauauuuucauccaucaucagaacuuagacuuguuucuugguaccuucuaccaugucuucaauaagucuaggauuagcauuuggguugggugaaagugaagggucaggcuuaagggugaauagugcuagacaguaugcagucuguagucaugaaggagaauuguggagguaucacgagaguggauuccaggugagaaggucagugaugggacccgcagaucuuagccuugggccuucagaguggccuccugaucucagacauuuugguaaaauagacuuccacauaggguucuuggcaguuguauuaagaaaaaaguuuaacugaugagccugcaaguccugagggcuugcugaauuugggaaaguggguacuaggcuuggguacuaggguaaaaggaauggcuguuggggcuuugauucagagagaauuagcacauuauuuuucgugaagaacauaguucucuuugauccagggaaauuauggguuaauauuaucucauaaaguacucugugguacuucgcuuguucccuucuggaaagaugaugagcgugauugugcugucaggcccgcagacgugcugucuuaccgggcucucagcuccggcaguggggugccccugcacugcuuacuugagauaguacuuuaugguagcugaauguugaauucuugucaacagaauuaauuucucaaaucagaauucaguauuguguuguauaagagacccuacacuugagacuucuuguugaaauaguugcaacaacuuaagucauguguuguacuuaacaugucaggagauucaaaaguuuugguuguuaaguaacagaguugaauuaucucuuccaguuucauagaguaauagcaaugaacacuccaaagcagugcaagagaggaaauucccuucuguggggcgaggaaauccugcugacaguaaagccagugguaggcuuucacacagauauuugaaucccugacccucuguuugaaggguaggaauuuuaaaguuucaguuuuuaucauuuuacauaaucaaauuuaucugugggaaaaacuauaugaaauauagaaagugcuuagauaccaugaaaaaauuuuuauuucacagaguggugucauuuguuuuaauuuaucuaggauauguauaauuuuaaagauacauauuuaaauaguugugcauuuauaauagguugucaauugagaaaaaggccuguguucgugagcuguugauaaagugacaauuuuagcaggugucuaaaucuuucguggugcaggcacagugcuaagugccuuccauacauuaucauuuuaucaguaacgucauagaauauacaaagaauguucaaaauuuauuuauguguauauuuacauauuuuauauauguacauauauuuaacaaggcaucaugcuguacauauuuucuuuuaaagguuuauuauggacauuguucugugucaggaacuacagauaugugcuauaaucuuaauggauucaaaguauuccauuauauagucauagcauaauuuauguagcuuauuuuuuaccaguagauuuuaaaguuauuucuuauuuuuaaguaauaaugcaacaacaaauauucauguacaucucuuugugaaguugcuugauucauucuuuaagacaaauuucuaggcauagaaucacuggguaagguacagaaugcuugacuccuaaaaugauccucuuagaucaagaaaaagcuaaaacaauuauaggaagaguuugaauggcucauaggaaugauauucugauguuucucuuguuucugugcuuucuuuguuuuuaacccugcaugauuguguaaugguauucuuuuucccuuuuguaguaagcugugcuagaacaaaaaugcaaugaaagaaacacuggaugaaugaaaagcccugcuuugcaaccccucagcauggcaggccugcagcucaugaccccugcuuccucaccaauggguccuuucuuuggacugccauggcaacaagaagcaauucaugauaacauuuauacgccaagaaaauaucagguacuaaugcgaacacuaauacuggagcauucuacacuaaaauggaauacauuagcauauaguugacacaacuuauauaaaacucauuuacccuuucaggccucccacuucugauuaauuuucucauuuaaaauacuuuuauucuuaauaguccuuuucuuuucuaacaucugcuggguaauuggauuugauaguuguauuugugaaguuucuuuuuucccccucugaaaaccucacuguuccuuaauauucacuuggaugugucuguccuagugagcuggguaggaaccuagauuaguuugaaaauguucagccaugaacuggcagaaccacgauuacucuaaguuuagucauucauguuauucuaaagaaguauucuguguauacaaaaauaaugcuuaaagaaaggguaaaugccauuucaacacguauuuacacaauacagcuguauauagcaggcauuuuauuccucugaguuauucucguauaaagacguagacugugggguuuuuuuuguaaauuuauuggaggacgauuuuagagaauagugaaauuuccugauuuaaaauaaaauccaauuuuauaaauuuuguacuuagguaagaagugcauaacuuuuuuuucaccauguuucuagguugaacugcuugaagcagcucuggaucauaauaccaucgucuguuuaaacacuggcucagggaagacauuuauugcaguacuacucacuaaagagcuguccuaucagaucaggggagacuucagcagaaauggaaaaaggacgguguucuuggucaacucugguaauaaaaaauuauuuuaucaaguugugcaggggaaauuggaugggauuuuauguuuaaacagauuuucuguguuucuuaaguuaaauuauugaagaaaguuugacagauaauguacucauuuaaucucuucuggcagaaauuguuuuguccuauuucuuuuugcuguuucucuuaaauguucugcuucuguauuucuuuugaauggauugcuuuuggaacauaaguauuggaacauauguacauuagaacauaaucuaaguuguuacauuuauuuuuuucuugauguuuuagcuucaccaaguaugucaaaaggugcuuaauuauggauaauuaacguuuguacuuaugauuuugcuaaucaguuguauuaauaaaguuacaugcugcuuagaaauuagauauucaguuaagaguuuaaaauacugauuuuuauaugcuuggauuauauauaaaaauaaaaaauauaaaaugugaaccuaagcugguagggcacuaauauauucaugucacugcucuuuuuuuagguugucucaguauaacuaucugcuuuaaauacauguuagacugucuuguuuccaucugauuuuauugaagaaaacaggaggguggcuuagaggaaaucagcuaugaagaagaaaggugguguaggguucucugaagcgagugacaaaaagugagguggcaagucuaguaggugccauuuuuuuggaggauaaccuuggaacugugguuuuaaagaggcuaucaaaaacauuguugguuaggucuaauauaauaauaaggauuucuguagacuguuaaucauuaguaguccagagagccaacuaggcaagauuucucauauuuacauggaguauuauauuuguaauuagcaaaccagguugcucaacaagugucagcugucagaacucauucagaucucaagguuggggaauacucaaaccuagaaguaaaugcaucuuggacaaaagagagauggaaccaagaguuuacuaagcaccagguaagacuuguagagaaauuucacuuuauaaaucccuacaaguucuugacuugguuuguaagaugaucuguagccuugguugucugauuuagguuugaaaacuaauuuccuauacuuaaucagccuagaagcuaguccugauguacuauaucuuacuguaagucuuaccuuaaaaccaaauaaaggccggaugcaguggcugacgucuguaaucccagcacuuugggaggcugagguggguggaucaccugaggucaggaguucaagaccagccugaccaauauggugaaacccugucucuacuaacaauaaaaaaauuagccgggcgugguggcguaguaguccuagguacucgggaggcugagacaggagaauugcuugaauccagaagguggaguuugcagugagcugagaucgcgccacugcacuccagcccgggugacagcgagacuccaucucagaaaaaaacccaaaaaacaaauaaauuacuaauuuuuauugcucuuaacuuuguagaaaagaaauagguuucaguaugaucugcuugcuugaaaaacacaaauuccuaugaccuauuuccaacuugcugauaaugcgcuuucaaaaaauuuagucuugaguuaaaugucuugaaacuggaaaaauuucuugcuugagcuguuuaggucuuugacggagacuuccucuaacugaauguuuccaugcagccagcaugugcuggaggcuccucuaacuuacauguuuccauguagccagcauguacuggggcuuuugguguguuggucauugggggauacacagugauuaagaggcgcuuccucacugaacugaaacagcccagccuacuagugugcuucacauacugggauaaguccucauuaauaaagcacuuaaauauccacauaaugauaggcuacaaaaauaacauuuagucugaguuuucuuccagaaaaccaugucaguucaacagaaaaaaauaaaaagugugaauuguuuugugauuugccuaaauugacagaucucaucagucauaauauggcuguggggaucuaagaaccugaaguaaauuuagauuugucgucaagacaugcuuuccauuaucaagauauuuuuucucuacucuuuucccaugcuuuccugauuuccuucuuaguucugauguauaaaauuauauguauuuaguauuuuaguuuuaauuuugacuaaugaauuccuuaauccucacuuaugauacaauggcucuaugaucugauuuuauguaaguauauccaggcagugaaugcuauguuuguuuacugauguugauuuuauuuuagguucucauuaugacuugcuaugucgccuugaauguuuugaaaaaugguuacuuaucacugucagacauuaaccuuuugguguuugaugagugucaucuugcaauccuagaccaccccuaucgagaaauuaugaagguaaguuuuagaccuaagucuuaguaauucuugguaaacuauugaguaaaugcagauuuuuguuuuuagauuucaaaagcaauaauauuaguuaucaauauugggaguuuggcugcaguguaugaaugaaugaauauuaaauuaauguucauuuaaaucuauaauaaacuuuuaaacaucauaauaaauucuauauaauuuucauaguguaucuaauugagccuuuuugaaaaacagaucuuuuaaacaaacuacaguaauucuaugaguaauuuuauguuguccuugguauaguggcauuuccaccaaacaaauucuuuuuuacuauuuguuagugauuuugauauguuuuaauauggcgaugucucucuuguuauagccuugcaaaaugaagucuuuacugucaguaucuuuuauuauguuagcucugugaaaauuguccaucauguccucgcauuuugggacuaacugcuuccauuuuaaaugggaaaugugauccagaggaauuggaagaaaagauucagaaacuagagaaaauucuuaagaguaaugcugaaacugcaacugaccugguggucuuagacagguaugcacuucugauugacucagcuuuaaugagauuaguugaaaacaauauuaagucuuugguguuuuuguaguaccuugcagagaguaccuauuuaagugaacaaauggcaguaaaaaggaaugggcaagaguaagaauucucuauaaguaccauuaccugugaguucaagaaucuaacguuguuuccacagagaguagcagacaggcauuucugccuuaagagauuaugugucagcucuuccuauuugcuguuguugccaaggacugggaacuuugacaguaaauuuguauuuuuuuucugucaauaugugugcuuuguuguucugaccugaaugucuuacaugaugcuuucaaagaacauuaaguuauuuagagaauucagcaguauacuuuaaaauguuuggaaauaccccuuuguuuugaaaauggguuguggauuucagagaaaguugcuguuugugauuucuagguuugacucuuuuugagaggguuacuauuuugaguuucauugaaaagcgcacacacacacaaaaccuucauaacuuagguugguggaagggagccuuuacaaauuaggaaaauggcuuuucaaaugcaaugaauucgauuuaugucaaaauagccuuccauucuuacuagauguagucuuaaauaaggcuaaagauuaccuaguggugguucuuaggacaguuacaauaaguagcggagacugauuucucaaguuguggaguuaagucagacauggguuugaauacuagcuccacuaauuguaagcugugugaccuugagugagucacuuauuuccuugaacuuguaaaauggcauugacagugguuucaugggauucuuugaugaucaauuacauugacacauagaaaaaucugcagugugccuggcauuuaguaagaauuugaggaaaauuuucuuuggagagugagaaggaaagguaauauuugggaucuaucaaacuuagguauccaaaugccaugugaaauauaaaucuuacgaccucuagaacgugcugugucugacuucuugagccaacacugugguggugaaguagaaggccgugcuugugcuuuugucugaccugaguuagagugcuucacuuguauugcccaaagguuuucugagaaguagaaguaguagagcguuuaaguaaaacugauaagcaaucuguugaauaagcauuaccuaauucugcaaauaaggacucuuugguugaguauaaauucuguuuuggguuaagaaaaaaagaacuauaguauauauguuuuugcuagauuucuuuuauuaaaauuaucauauguacuuuuaggauauuaugugccauucugguggucauuuuuuaugaaaggcauaaaagacccaaggaaugauauuagaaaugaaugaaaguugggggaguuuuccuuaugaggauuuaaaaauacauuaaaaauaaaagugauauuugcaaauauuaaaaauucacacagauauggaaauggauaaauugaaugauaaaacucccagugaucagucuucccauucuucuuuccgcuucugcgaagugauugaguuucaugaguauuuugaacacccuuguuccucauucugacaaaugccuaagggggcaaaagauggaagucuaaaccuaaaaaacaaaagaaaacaaacuaauaauaaugaaaucuauuggcaaaauuauuugaauaucagccccuguggucauuucuugagaccuaacaggcaagcguaguacagauugagcaacccuaaucugaaaacgcgaaauucaaaaugcuccaaaaucugaaaccuuuugagugcuggugugcugccacaaguggaacauuucauaucugaccuugugaugaacugaagccaaaaugcgaccaaaaccuguuucauucacaacauuauuuaaaaauauuguguaaaauuaccuucaagcuguaagguguauaugaaacauaaaugaauuucauguuuagacuugggucccauccucaagauacuucauuuuuuauaugcaaauauuccaaaaucugaaaaauauuggaaauccaaaacaguucaggucccaagccuuucagauaagggcacucaaccugugcagauaaacaugaguaccacuuuaggaaggcauguuguaagccugccuuuuauauugauuagauauacaaacugaaacuaggaagcuucuuuuuggaguuagaccuauaaauggaucauaaugcuguagugaguuuuuuagaaaugaaacaaaagguguucagggaggcaguaggguuuggcugaaagagcccucagaggaaggcaguccugaguuuuguuuagacagagucauguaaugucuuugaaccuucauuuccuucgucauccucccuguguguggauucaguuagaagguauguaaauucccagcaucaugcuuggggaugcaguggaugcucauuuguauucuuuucuuuccccucuucuccccuugccuuuugaaaacaucuuuuaaacaacacuuuacugguuuauaaaauacauuauuuacuguugagaaauaugguaauauagaaaaauaauaauuaaacaccuaaaaucucaccccacugcuaacauucuggcauuuuuuuuuuuuuuuaguaucuauucccuuuuuuuuuuuuuugcuuuuugaaaaacuuuuuuuaaauugcauucucacuacugcaguauugauaccuuuuguuucuuauguuaaagguauacuucucagccaugugagauugugguggauuguggaccauuuacugacagaagugggcuuuaugaaagacugcugauggaauuagaagaagcacuuaauuuuaucaaugauuguaauauaucuguacauucaaaagaaagagauucuacuuuaauuucgaaacagguaagcauauaccaaguagguauagugauuauauuuugaaagcuuuguuaauuuuuaauauugaaaugaaaauaugcuuaaugcggcucuuuucuuugcauuuuaguuuaaggucuuaaucuuuuuagacauuuuucauugaacauaccauauuagguugaguucauuguuauccagugcacauuuauauuaaguguagacuuccccuauuuaaggagcugagcuaggauucaugucaugguuauuuaaguauaaggagugaguccaauuuuuguuucuuuuuggucagaagaguuaguuccuguucaaacccuugaauuaaacaaauucuuccgcaguuuccuaguguguguaacuggauaugagccuauugucucucagugguacugcuuugagaagagaucccuuaggacagugauccuuccauugugggccccacaucaucaucagcagcaucugggugggguccucaggacugaauuuuacuguuugcagucuucaguuuugaauuucgauaagcccuccaguaaucugauucauuaaagcucgagaaccacugcccuagaacuuugcaaccauuugugaauguuaacacuguauuaaaugugggucuuaguuucucuccugaugauuuuuuucuucucgagcagcagugcccacauuuuucucaaucuuugcauucuuucuuccuuuccuuuucccuucccuuuccuuuccucuuuccuuuucuuucuuuucuuuccugucuuuuuuuccucucucucucucuuucucuccucuccucuuucuguaccuccccucccucccccuccccucccccuccuccccucccugucuuccuccccucccccucuuccuccccuccuccucccucuccccucccuccucccccucccuguccccucccuccuccccccaucucugccuccucuccuccucccccuccucccccuccuccucuccccuucucccucucuuccucuccccuccuccuccccuucccccaccuuuccccucucccucccccgaccuucucccucucccucucucccucucugccucucugccucucucccucucccucaauuccucaguuacacccuggccauggauugacuuucggcucucaauuagaguuguaagaugcagcacucugggaggguccaggaucagagucugaauuuagcugagauguuaauguugaggagcccugaccuuguggugguguuuucauugaaaucggauaacaggggcuuuuggagaacugugacagaguguguggaggcugccccagugcagcuguccuagcuccuuuuccacuuccaaccaauaaaggccuuuccuacuguuuagaaagaaagaaagaaaaaagaaaugaugauagagacagcugugcaguguuuuuacaacagucucaccguggcauccagaggugcugacuguagaucgaccaaaauucauccacaguuucuagucaguauaguggaaaacauauaaugcuggagaauauuguacauaaaguucaaggaaaacuguauugcucuuccuugaugccuaaaguuaaauuacugugcuacauaaauuuuauguaauuuggcaggaaguaaaugacucagguauaguuuuaacuaauuacagaucuaaaaauaagcuucauuaaccucauacaauugcaucuuuuaauuucuguuugauuauuuuauugaaaaaaggagaugguucuaggcauauacauacgaaaugagcuugaaaaggcuaauggccucuccccccaccuucagggacuuaaccuaaggcuggguuacauuuaaggagccauuugagaacaacugaaaucccaguuaaaccccacaugaaaaugcuacauuauuauuauuuggcauuagguuuuuucuuuucuuuuuuuuguagauacuaucagacugucgugccguauugguaguucugggacccuggugugcagauaaaguagcuggaaugaugguaagagaacuacagaaauacaucaaacaugagcaagaggagcugcacaggaaauuuuuauuguuuacagacacuuuccuaaggaaaauacaugcacuaugugaagagcacuucucaccugccucacuugaccugaaauuuguaacuccuaaaguaaucaaacugcucgaaaucuuacgcaaauauaaaccauaugagcgacagcaguuugaaagcguugagugguauaauaauagaaaucaggauaauuaugugucauggagugauucugaggaugaugaugaggaugaagaaauugaagaaaaagagaagccagagacaaauuuuccuucuccuuuuaccaacauuuugugcggaauuauuuuuguggaaagaagauacacagcaguugucuuaaacagguaaaucuguaaguugacuccuuucacaugagaacagggaggcguccuguguugugaugugaugcgcugcagcagcuguaagagcuagcaugaggguuauguaaguguccuugacuuggcgccaucauugcugauacgucaugcuguccugggauugacagagaggauguuuuccagaaggcugcuuuucauauggcugauauuuuuuucuuaaaggaugcuaaucuauucuaaucuaccuaaaauggaggacaaguaugguuuuuaaaaaaaucaguauacauuuaaguaaagcauuguuuuauauucaauuuuagauucaauucagauauuuauuaauccuuaacuauguguuagacauuguguuaagcauuucacaccaaguguuccccucagguagucuuaggagaaauuuuaucuggguauugugacuaauuuuuuaauguugauuuuuuucucuuaaaaauauggauucaacuuuucaaggcuagguugggcaugauggguugugccuguaauuccagcacuuugggagccagaggcagguagauuguuugaguucacaaggggcaacacaacgaaacccugucucuagaaaaaauacaaaaauuagccgguggugguguaugccuguagucccagcuacuugggaggcuguggugggaagaugaguugagccugggaggcagagguugcagugagcugagauggcaccacugcacuccagccugggcaguagagccagacuuugucuccaaaaauaaaguuuucaaggccacagugcaaaaaguuuagaacaauugaauuuauuuuggguugguucauagacugcauauuaaaauuuugugaaucagaagagaauaagaauguuggggaaaguucuaagacuauuagcaaaggugauauugaauccaaauuuuaggccguggauuccuacucuuucucccuucaaugaaagauuuuuuuucuaauuuagaaccagccagggagcuauacuucagauuucugucagauggucacuuaauguaugguccuuuugguuuguagauagauacucuuauuuuuuucugccaaaaaagguccuuauuuuguacuuaaaucaauuuacuuuucuaugagauccauuaauuggccacaguugaucccuaacuuuucugcaaguagugaucucuuaggaaaaacuaagcuuugcuuccuaagguaauuugggauuuuuuuuuuucuuuuucuuucuuugugugugugugcgcgcgcgcgcgcguacacgcacgcgcacacgcgcuuaacugcuucugaauguuuagggguuuuaaaaacuuuuuugaguaacgagaaauuggacucgagggucaucaucuggcaguuuuuagucugguaauuuucauagucauugagccugauccuucugaugaauacaaaggaaaauaacuuuagggaccaaauuacauuuaaauuagaaguugaagauuggaaggggaccucacugacuaucuaauccaacccacuuauuuuuguaaaaaugagaaagagccucaggagagagagugauuugcuguaaguuaaauugcuagucaauggcagagacaauucuagaauccuaauauccugacuccuaguuuccaguucuuucuaucauaguaaugccccugggcaucacagaacacuaaaaaccagugcuuuacagcaggaagauugccaggagacggaccugggagagcgugacuaaggagggauuauuucuuagggcagggaaaaagcauuuugggagucaaaaaaguuuaaugcuggcgcaguuguaagccuaguuauggacauacuccccgucuccauuuaggauuauauaaggauuaaauaaauuuucuggggcuuggagagaagaaauggggguguauuuuccgccuuccuccuguuuucugcauguauuuuuagguaaagaugugccaguuuuuauugcaggaauauuagccugaaaagguuuauccagaaucagucgguuacuuccuauugacuuuaaggaucagaugaauugugaucaacuuucauaaaaugugacuggaauuuagugcuguaugaugaaucaagagugcucugaggguugacuuuaugagcagcuaauuaaauauacaauagaggucuuguuccaguaagcuuuuuaauaagcuuagaaaaacuuccugaaauucagauucuuuccuuccaucaguuuaaugggaggaaaaacccuucuauagugaauaguuucaugggcauauaagcuauuguaauauacaugcaguuuucuacucuccuaauuaaaaaaaauaaaucacagccacuucuauauguaguguagguaugugcacagucuuauguuuauggguuucuuuguaccuuauauuuacauagggguuucuaaguuauauauauuuaagacauauucacaacacuccauaggggaggaaaguagauguucuuuccauauuacagaggaagaaaacaagcaucagugugugaccuucccccaaauuacacacauaucaaguggcagaaaauggcuuccagucucaaguccaguguucuuuucaccguguaauauacuaguauugugugauacuggcauuggacaaaccuggguucacauccugucucuaccccucccccuuuuuuuccuaauaacuuuuuauuuuggaauaauuugagauuuacagaaaaguuggaaaaaugguacggaguucucauaugccccucacuuaguuucccccauugauauuaucucaugucaguguuugucacaacuaagaaaacuaacauuggcccauuacuauuaacuccagacuuuauuuggauuuugacagcuuuucuacuaauguccucuuuuucaaaaaauuuauuuuuauuuuuuucuaaccacuagacaguaagggauaaugucuuuaauccaaggugucauaucacauuuaguugucaguaucuacccaguuuccucuggucugucacaguuuuucaguuuccgucuuguuuuugaugaccuugacagucuucaggaguacaggucagguauuuggugaaugccccuccauuuggguuuuucuuauguucuugggguuguacuggggugaucggauauggaagaauaccauggaggugaccugcucuucuagucacauuauaucagggggcucucaugguaucaaccacaaaacgucacucgucauguucaucuucaucaauggauugugauaguguuugucugcuuucucuacuguaaaguuacacuguuucccuuuucuuacucuauuuggaaggaagucuccaagucuagcccacccugguagggagggauuaaucuccacuugcuggagagggauauaucuauauguauuuggaauucuucuguaaggaaaacuugucugguuuauccuuuuuauguaacugucuacuuauauuuauuaauugaaucauguauuucaguuggugguuucauguuuauuuuauacuuugggccauaauccaauacuguguuauuuauuuguugcucaaauuguugcagcgguggccacugggagcucuucgaguuuagcacccgugucccuuugacauacccucauccuuuuguuuuugagcacuuucuuugugauaccacagggugcucugggcucuuguauuucucccugccuggcccuagaaucagccauuuugccgaggagacuugguuucuuuucugcccacuuuguggauguauauuuugugaaaguuauuuaacuuuuaaaaguuucaguauguucauucguaaaauggaaauaauaccucccucucuuacuggcuuguugguaagagacuuuguauuaaaaauggcaguuuuaucaaccagcacacaguagaugcuaauucuucagccgcuuaugcacccaucuagggagugcaacauccguaugcuauuauguaacugucagugaucuuuuuuuagugaaaucauagaggaauuauaucugguuuucuccacauugacaagaaaauguaaggaguaagggauacuguuaaaggaguuguugauaauguauuucaauaaccuggcaggaauuucaaauaauguguuuauaucuuugaauuucuuuuccucuuaugguugucugcauuaguuagcauguuuauucagaucacaauuuuuuguaauacaucuauuaguuuucugaaccuaccauacauauuuccuauuuuugguuauguuauuuucauucuaauuggggagaauuagauguacauauacacacaaaguauaggcuaugaauuggugccagaauuuaccuaugucaugaguuaaguacaaagauugagaagaagcauuuagaaacucuuagagcaguuugacaguaauuuuauaucugcugaauacaauaaaauugaugcuugaauuuuaauacuuuuuaaauuucauuuucuuagucauucacuuuuaugaaauucuacaaaacugccucugauggauuggaaauuuaaaaagaaaagcugguucuucacugcagaucguuucagaaacacugugcauuagggaacaguauacuuugcuggugaacagcuugcuggugaacagcuuguauaaacugaguguaaaaaccaaaagaaacaaauaauacauugucuuauuuuuucugugguguuacaaacucuuuaagcaguuugcacuguccauuauccucugggaguucacaugaugugacugccuggcuuuguuuucccugaagccuguagcuuuguccuggguacugguuaggcauggccaagauucaccaaguagauaaauacauuuuucucucuaagcauuauuagcauagguauaucccauguaauuauugcuuacaagagauuuuauuuauugugccuguugucucuucuguucucugugguuuugauguggguuucauuaaggaaaaaugaauugacuguuguugccucuauuucuuagcuaauugaagucugccagauggauaauuuauaauuuuagcaaaguaaaauacauucuuugccuaauuaacaguaaguuaaaacacauucuaaaucucuauuauauucaaauugaugcuuauuuauauaaaauuuggaaguauguauuauuucuaaggugauuuauuuuguauuuuagacuuuuggacauguuauuuguuugcauguaacacugcuuucuguuacaucuuaaauuuauuaaaauaauuaaacacaucuuggaacauaauaagggagcucugauucugaauauuuaaguacgugaacuguagagcuugaacuacaagcuguaguuuguagacucccaaacuaaccuagacacgcaaguguugugccgguugggaucaagagagauucuagauggccacuuccagcucuuuauuauuagucuguuucauguauuuuuuuuuuuuuuaaaagaaugauucaacuuaaaaaugcaauuuucuauuuggaauuuauacuauguaauaugacuucagagaaaccauguggaaucgcuuauaucagguguggaaccauuuaucccgugugcugaguuuuugaauguggauauuuccaaaauagcuguaauggcagcacuaacuguuaaccuucugcacccguguaaugugaucccgucccguagcucuuugccauuucuuagcuagaaggccagcuuucaguuacaggcacuguggguuaauacagaggagcaggcaggaagagagacagagcucaggaaucuccucuuucaugacagggaagggugggguugccuugccauuucugugcccuguacuaugcugugcagaauuuuggucaguggccuggggacaagaaagcaucagggauugagaggauacaacauuucuuucccaugggcucugcuucuaaugauaucaggugauaggauaagaggaaaagaaaucgcagcuggaacucuuguuacauuuguugggggugaagguuuccuuugguguugggcucacugguccuuucuguauaagcacaguagggccugcagcucaagcugugcauggucuagagaaggguguugaguugagagaugagcuaguagaacugguagagggaugagucgagcuuuuuucauuggacguccugucccgaggccaagaucuaugaggauccguguuucucucugacuagcucagucucauccugggccacauuucuauuaaaucaccgucgccaaaucagcuguuggagguaacgugaccauuucauuugucaguacaaaccaaucuuguauuuggcguuauaaguacuugguccacagaucuauguggugaagagugacagugauuucuguuuaagcaaguugggaaaaaaggaccaagaccguuuuguuagguauguuugcaaaaaaugcauguacuuccauuuuaaaggaggcuuuaaaaacaaaaguuuauuuucuuucagcaacguuuaacuuccaaauguguauaauuuucuuagauugauaaaggaagcuggcaaacaagauccagagcuggcuuauaucaguagcaauuucauaacuggacauggcauugggaagaaucagccucgcaacaaacagauggaagcagaauucagaaaacaggaagagguaacuuaaaucaaaauaaguguacaauaacaguuuucgggacauauacagacaaagugcccauagggucucccuuuuuucauaguuucccagaauuacuauuauuuuuuguauuauagaauacuucuucauauauuagaccagcuguccccaugagguagcuguagagugauuuguaugcucagaauuagaauagcuaucuggcaaaccaauuuugugucuuaauugccaucaaccaacuuauuuucugugauuggauugauguuacacaacugcauuucauggaaagacaaagcauguaugaccuuaacucuuguacauuccauaugacuaugaauuaacaaacugaaaucuuuuccuagaaaguguuuucuuuuuuucauuuaaaggccuauuuuguuucaauucuuaaaaaaaaaaacagcacuauauuuuauagauuuuagcuuaaauauuuuugugccuuguaaggucuuaauacaggaaacagcauuguaaagaugcuaaaaacuaauaccauggucuggcuuguacacaaaaaccuauuuaaaguuuauuauuuaacuuaaaauuagcagaauaauuccuguugaaggccuuuucuacauuguagcuuuuugauaauuuccaaauuuggagaguccaggagccagucugauagauauaacugucugaacacuagcuuauguuaccauuuaauuuauccugaauuggagagucucauuaaaucaguuucuuuguccauguuuccaugcaugcugaguuuucugugauacugucaucuucuuuagccuggccuuaaggauuuagaaugcccaagagcaugugugucagaaaugacaguugucauuuacuuuuacuaauuuuuuuuguucauuuuagaaauuuucuuagaagugcuuuucuugguggauuuuuuuuuucagguacuuaggaaauuucgagcacaugagaccaaccugcuuauugcaacaaguauuguagaagaggguguugauauaccaaaaugcaacuuggugguucguuuugauuugcccacagaauaucgauccuauguucaaucuaaaggaagagcaagggcacccaucucuaauuauauaauguuagcggauacagacaaaauaaaaaguuuugaagaagaccuuaaaaccuacaaagcuauugaaaagguaagaucaacauauuaacaugugccggcagauugggaaaaaaaauuaauguggcuucuuuguuauucuuuguauccauaggaacagauaaugaguuuuaucuacaggcaauaaucucaaaagagguguacucuguguacauuguaaggaaguugagaaugaucacaaagacccggcaguguuauacaaaguguuugaaagggcacaauaagauaacagugaaaaugaucaucacauauguuauuugggaugaacgucugggaaauugcauugcaaauauggacaguaacuguugacugcuuaaguuauugagugauuggaaaaugaugacaugguaguuacauucagaaagacuaacagucgugugugugugugugugugugugugugugugucuguguaggcacgguacaguauagacuuuguaccauaugguaagggucuccauacgauuggaacugggagggauucauuggaagaaggugucugcagcagguuacuuuggaguacugaaguauguuuaggagagagagagauauuuucaggagaguuuuuucuguagguacagaggcagacagcauacagcagagaggauguguuuucaucauaaguucuguuuuuuaaauguucagaucuugagaaacaaguguuccaagucgguugauacuggugagacugacauugauccugucauggaugaugaugacguuuucccaccauauguguugaggccugacgauggugguccacgagucacaaucaacacggccauuggacacaucaauagguauggcaucauaucauuuguguggaaaaccugggaauguugcacaguuuaagucuaaaccuguacauuuuguauuguugacauuuugcgguuaccagucuuuacuuagacuugccauauuuucgauaaagaaaaguuacuucuuuuuucauuuuuuuuuaaaucaaaaggcaaaaacaguaucgugcagcaauaaaaguucaguauuccuuggcaaggcuaacauaaugaaggcauuuuaaauuagguuuaauuuaauuuuauaauucucaccaauuuuuuucuaaauccugaaauuuuuuguuuugugccauaaccauuggguaauguugaauuuuccccuagcaauaaaguaagauugugauaaacuaauuuauguuuuuggguacauuguaauuuacuuuguccagagcugauaauaaaauuucuaagagcuaagaacagcaaaugcauuccuggauuauauaccaggauaauuucuauucagagacaaaagagcaaguauaagauuuucuuuguaaccuuuuauuuugaaacaauuucaaacuuuaaaguguuguaagaauacuagaauuccgcauaugccuuucacccagacaccaagagagacucauucaguuucaugagaauguucuuuguagccaaaguaucuaccuuagagucaggaguuguccucaacuccuguugucacaucuuccuagucuccuucaaucuggaaccauucuuuagucucuccuugacuuuaaugaccuugaaacuuuggaagauagauaggcugucauuuuguagucuuacugucagucuggguuugucugcuauuuucuuaugaugagacccagguuacaaauuuuugggcagcacaucacugagacgaugguguccucuccucauccuagcuuaccaagucgcacaccauguugauuugugcccuuaccggugguaacuuagaucacuugagugaagucugccaguuuucucuacuguaaaguucccuuucaccccuuuuauaauuaguagauauuucauggggagauacuuugagacgguauaaaauuuguuccuuuucccaguuugacucauuaguguaagcauucuuugauauuucuggcccaaauugauuauuacuaugauggcuacuaaaugauuuucuaacuccauuauuucuguauuuauuaguuggcauucuaccauccauuucuucucuccguuuauucauucuuauauuaucauuuuuuaaugucagugugaacuuauggacuccuguuuuauuuaauggguuauaaucuaucauuaucauuuacuguuuguuuugauguuaaaauuguuucauauuuggccagugggaaccccuuaaagcugguuucuuugucuuuuuaacaucucacuauuauuccuugaauacuuccuuguuuuauggcgcaagacauucuagacugccccagccuugauguuggcaauuuccucgaauuuaguggagaaaaaguuguaguuagaaaccaagaacuggauacuagguuuauucauugcuaccgguguguugcugcugccaggcguuuuaguggacagagcuagaauguuuguuuguucauguuuacaucuguauuuguuucagugucuaucuguugauaucucuauuuucagugugacacuagagguuucauucuagauuuccuccuuucugucuuuguaccuccuuucucuaauaaucagaaauuuggcucccauuguccucaaaauaauuaguguucagucuuccuguauguagccagucucccugcucuguagggcugcaacuguggucaggugcccuugcugcacaggucgcaaccucacagggcugcugcccauuccagcacccuccugauguggguccugucccagcaucccuuucugggcuagcuuucugcccuguuccaaccuucccuggugcuguugcucagugaguugcuaguucuacuguccuuuuugugucagcacugggcugucccgcccucugcugaugccuuccuuauaugugugcugguaguuggugggaaauguaagaugauuaaggaaaaaacauuggcaguauguuuucuuacuggauucugaacaauacuuugugcucuauuaugguaacacucgacacauguuacuauuuaaauucaaaauucaauuuaaaauaaaauaaaaaauggaguuucguaguuguacuucucacauuucaagugcucaccagccacugcccuguugggcaucgaagauauagaacaucuuugcagaaguucuguuagacaacacuauucugucuuauucgaaguuugaagcaguaaaguuuaaaugccacauauaaauacaaauucaguagaggggaagaggcacaugacaaaucaaacucgagguuauaaauaucaauauuuucucaguuguagauucagccucagaauuucuuuuucuucacagauacugugcuagauuaccaagugauccguuuacucaucuagcuccuaaaugcagaacccgagaguugccugaugguacauuuuauucaacucuuuaucugccaauuaacucaccucuucgagccuccauuguuguaaguuuagaagaagaaaugauuguuaucuuuuaaaaugugucauuaguggauuuuuucagcuuuucuaagacuugcaaguuauagguaaauuugauuuuaaaaucuacuuucaugagcaggagccuuguguugacagaccaaaaauaaaaauaaaaaccaaauuuacuuucaaaaguagauuuauagauugcuuuuguagucaucuacauguucauauuuguaauagacugucuaauuuacagauacuuagaacuggacuaggugaucucugaaguuucuucuaagguguuacuaacaugcacauuuuugacagaaucauucaacuguggcuuagacacuuagaguaauauaaaacuuauuauagaucguugcguuguccuaguuauuuuguuggugacucaaaaaucugcuuuuuguaaauacuguucuuggucucaguacugauuuccaaguguuccaaggugacuaauuucuauugcacauaaaaagcugcucaauacuguuaauguuauagcuauguuuugauaaaucuuucuuuuuguuacauauuuauugauuaguaaaaauaagauacuuuaaaaucuuacugaaauuuaaauucaucaaaauuguaaaaucuuaauuaugacuuaguuuuuacuaggcaggacuuuuaaagaugaauauuucaaauauggagauuagaauuuuuaaaaacuugcuggaauuuuucaaaauaaagaauuuuguuuugguaaauugaacuuuaaaaauguuggggcagugguuucauagguguuucaugugcuagagguaauacagcgaugugcauauauaauggaaagguuuuuguuauuuucaggguccaccaaugagcuguguacgauuggcugaaagaguuguagcucucauuugcugugagaaacugcacaaaauugguaaggauguuugaaaagcauauacgaaugaaaauaaauugcaaccauuguaaaaaaaaagcauauagaggacuuuauagaucuguaaggauuuuguagagcuauucacuugcugaucuuaaugugcuuuggugaauauaaacauaaguguuaguaacuugaagauccuacauuguugugggagcucuuuguuuuccauagcuugacugcaaacaacugucauuuauuugcucucuuuaaugacuccuuuuaaguacauaaaggucuuuucguaauuguugaaucaugcaccaugaacacuuguguuuuaauaugucagucucucaaauuagucuauacuaguauagaaauuaauccuuuuuuaaaaaaugaacucaguuucuuuuuuuuuuuuuucucaauccugcuccuguauaaguggacccauuuucuauggccauuuuauuuagcauugauauguggugaugucauguuuagauguuuuuguuucugaaccuuagaacagaauuugcaguccagcucauauuggaauauauggaugccaaaauagacuuugccugaagugugaaucugauuacuuuuaaauuguaaaaggcaaaggugcuuuaguuuccauuacuuuuccagguccuucuaacauaguucuguucuaaauucuuuacuaauuaaucaggcaaaaucuggauuguguuaauucucucuuuaaauuuguuaggcgaacuggaugaccauuugaugccaguugggaaagagacuguuaaauaugaagaggagcuugauuugcaugaugaagaagagaccaguguuccaggaagaccagguuccacgaaacgaaggcagugcuacccaaaagcaguuaguauugguuagaacagaguaaaaaccuagcauuucugacuuuguuuuccgcuacaucaaaucucaguuccucugcuuggcuggcuucccacacccuuacaguuuggcccacucuggaucucagcuccuuucuccgauucacagcuucucucagaucagccucuuuccuuccuaauguagaaugugugcucuuccacuucagagguugcuuuuguuuuucuucucaaaaggauucuuggacccaucugucauauucuauccagaaugagauuauuucauuuaaauagacauucuuuguuucauucaguuuaguggugugauucuuguuuuacuuaugauuuggggcuaagacagaagaggauuugugugauaaaauaagcaagugaaaagaugcccucucaagaugacagguacacuggaagguagaagcacaaauaucugucaggaguuaugucagauucccagugugggccauugggaaucgaaauaaguuauuuccauggaguguuuccagcucaaucugugggcauccuagcagaguucacacaugaaagcaucucuaaaucuaacuucuaguaauagacaaacuuggcugaaguauuuauuuuuaaaauauuuguuaauauuuuuaccucauaagaaccccaagcaaaagcagaauuuugcuguguguaguagucccgcuuacccuuggaggguauguuccaagacccacaguggaaacugcagauaguaccgauccuccagcagcucaacguuguuucauuagaacguugacaaggaaaaaaaaaaucguucccagccagggccacugucucuaugugggguuggcacauucuccucaugucugcuuacuccgguuuccuacuacaucccaaaacugugcacaucaggugaacuggcgugucugcacugccccacugugagugagcauggggaugcaugugcgugugcccugccacagagugguguccuguccgggauggguuccugcauggggcccugagcugccaggauagacucuggcacccuuggcccugaacuggaauaagugggugaauaaucaucuuccuuguuuuuauucaucuuucuuaaguguaucuauagcucacauuuauuuuaaugcuuaauauuaaaaguguuuuuuuuuaauuuagaaauuuggugauguuuuugugaucagaaaugugcuggaggaauuuaacugauuuaugucaauuagccugugggaaaauugguuucuuucuaccaauugguuguuucccuuagccaguuucuaagaaccugccgaagacauuaagugaggacuuacagcauauauuaugcuuuuuaaaauacguuuguacauauuuaugauaguuuaagauauaaauuaggcacaguaauaacaaaauagaacaauuguaaccauauacuguaauaaaaguuaugugaauguggucucucucaaaauacuguacuguacacaccuguuauuggaccgugacugaccucagguuacugaaaccauggaggcugcagauaagcggggacugcugugccuguauguuagccuaaauauguguuucuuugguuuugcuuaugcaguuuuaccaaguuuuuacuuuauaaaauuuugcacccagcuuagcauuuucaagauucagaaucauguuuuuaaaaaaucaugaauguuacccauuuucccaaaaugcauguuuuccucauaccaaauuuucacgugagacuaguuucaugugauaaagucguuaaugauaaguguuucuaaaagcauaguauuggcuggguguggugguucacaccugugaucccagcauuuuaggaggcugaggcaggaggaucacuugaggccaggaauccgagaccagccuggucaacauagugagaccuugucucuacaaaaaaagaaaagcauaguacugccuggcauccuguuuaauuaauagauacauucuuuauuuucugauucucuauuaaauauaacugucucuuuuaccagcauuuuuguaccuuuuaacuacagaugcaguucuuuuucauugaaccucaggaacugcaagaccauaaucugaaggauuguguuaauauugaaagccuagcagcaauguccauuuaauuaugguucacucacauaaugagguagccauuacaaaugaugauauuggcucauauugacucggacagauauucucuuuacaguaacgggauaaaaaucaggcuaucucacaaacacagauacacacauacccuaauauacaccaguguugugugauuuuauuuguauugaaaaauauaaauguauauauguuucuauguauuuaugcauagaaaaagagucuaggaauuauacaguguaucaaaauguuaauaaaggcugucuuugagugauaggauuauaugugauuuuuuaaaaauuugccuaacuucauuuucugauacucuacaguuaauacauaaaaagcccaaggaagagaugaguuuucuugucagaagaaauagaucaaaugaauaguauuuuuaaaaaggcccuacaguguuggauuguuuuauguauaauuuugguauuagcuauguagucagcacugcauuauaauguaugugaacuugggccaccgucagcagcccuguccugagauccgcugacuuacccagcaggguuaaguaauuaagaagugucaugccucggguauuuucuuagcuuauucucaucagcuuuuaguaaagccagaauuaauuuguuuucuugcugacaucuggaaaagaggcuaauaugcuugagcaugacgcuuaauuuuccuuuccaacucuagauuccagaguguuugagggauaguuaucccagaccugaucagcccuguuaccuguaugugauaggaaugguuuuaacuacaccuuuaccugaugaacucaacuuuagaaggcggaagcucuauccuccugaagauaccacaagaugcuuuggaauacugacggccaaacccauaccucagguagguauuucauaaugaguacuuaugucaaaaacgucuugcuuaggaaaaggaaaaaaaaaaaaacuaguaguaaguaccuuuuguuaccucaguauguuuaauauuuaaagaucgaggugccucuucuauuucuccacuagaaagcaucauuucuguucugaaguuaacuguaauggaauaaaauaccuguuaauuuugaggggugcuuuacauuuccuuuugcuaagauuccacacuuuccuguguacacacgcucuggagagguuaccauauccauugaguugaagaagucugguuucauguugucucuacaaaugcuugaguugauuacaagacuucaccaguauauauucucacauauucuucggcuugaaaaaccugcacuagaauuuaaaccuacagacgcugauucagcauacuguguucuaccucuuaauguugguaagaaaaaaaucucuuacuuugauaacucuagacacauauacaaacauacagcuuugguaugaaacuuaucuguaucauguuuuaacaagcuaaagagucguuuuucucuucuaaguuaaugacuccagcacuuuggauauugacuuuaaauucauggaagauauugagaagucugaagcucgcauaggcauucccaguacaaaguauacaaaagaaacacccuuuguuuuuaaauuagaagauuaccaagaugccguuaucauuccaagguagguauuuaaauggaaaggaaaaugguggugauacuuuguuuuaaaagaugcacuaggucgggcacgguggcucacgccugcagucccagcacuuugggaggccaaggcgggcagaucaugaggucaggagauugagaccauccuggccagcauggugaaaccucgucucuacuaaaaauacaaaaaauuagccaggcgugguggugcacgccuguagucccaguuacucgggaggcugaggcagggcaaucacuucaagcuaggaggcggagauugcagugagcugagaucgcuccacugcacuccagccuggagacacaccaagacucugucucaaaaaaaaaaaaaaaauucacuuauucacaugggaauauaagugggcugugauuuuagcauuguaauuacuaauaggaaauauauuagucagucaggcauggugaugcgugcuguaaucacagcuacucagggcugaggugggaagauugcuucagcccaggauuucuaggcugugcaguaagcugugaucacaccacuacacuccagccugggcaacagaucggggaaaagaaagaaacucuuaaggucgacccguucucuccaguauacuugcuuaaaaaauaauaccuaaaacguuauagauaaggaauuuuccuuuguaaagggucagauaaucuaauguugauaggcuuucuucuuaaaaucuccauccuuuuagucuccagagucuuauagaauuugauuauaaauaaugauuucauuucuuaaaauuuuuauaaggaauauuaagcucugugaaaauaguaaauccagaaugauuuuuuuccuuauuuuauaaaaauuuagggaauggaguuuuggggcaauacaauacaggcaguuuucaaauaauuauaauacuaguuguaauucaaucuuugauuuuuuuuuucuuuuugcaccucaaaaccauauuuuaaauguuaguuaucaggaccaucacuaucauagaugaugcaguaauacguuuuauaugacaagugucuuuaauguuuagcauuaguaauauacaaaguauuuacucuuuggauaguguaaauuuuuuauacuauuuauauagaugaaauagauauguaaaggugccauuuagcuucauguguuaucaaaauguagauauuuagaacaagaauaauaauaaaaugggacaauaauguguccauuuuuacuugauaaaaauacaguucuuacauacuugaaauauauuuggaauacagauguuuauuguuacuuauuuuuaaucuuuugaauucuuaaucaucauuuccauacuacaaacaguuguauuuugagaauaguugauuuaaaucaaaaagcaacugauuguuuuuuuguuuuucuuuuuuagauaucgcaauuuugaucagccucaucgauuuuauguagcugauguguacacugaucuuaccccacucaguaaauuuccuuccccugaguaugaaacuuuugcagaauauuauaaaacaaaguacaaccuugaccuaaccaaucucaaccagccacugcuggauguggaccacacaucuucaagguaaggggcuucagagaugacacuuggauugcacuugagggauucuuaccagacaucacuagacaugcagagguucacugucccccugcccacccguggacuaucugaaaucaggagaugcuuugcacacaaacuugcccaagggguagcccaagaggcuguaguugaaaugagcucuucaggugguuuuuggagaaccacugugaauauguacucauuuuuguguguuugauaaaauuguuuuggaauucuuacagacuuaaucuuuugacaccucgacauuugaaucagaaggggaaagcgcuuccuuuaagcagugcugagaagaggaaagccaaaugggaaagucugcagaauaaacagguaaugaguuaauuguacuagcauaacuuaguauuuguuugaguauuaaagauuauuaaagauaaguuugaauuuuaucuuaccaaguuaaaugcaugauucguuaauuuuuuagaaguuaccuaauccucaaauuuuguuuuguuuuguuuuaauuaguauuauguguugaauguuauuugaauguucuuuuugguaaguauugagaguuuuguuuuuauacuuggcccauuaauauaucacaaaaucauucucauaaauccuuugauaaaucccauuuggccuuagaggauuauuuuuacaaauauuuuuuaaaauuaaguuuuacuagcauuuaugauuuucuuuauccauuagugaaauuggucuuuuuuuuuuucuuuugugugugcgcuuuguauuuaucuguccauuuuuccccuuacuugaagauacugguuccagaacucugugcuauacauccaauuccagcaucacuguggagaaaagcuguuugucuccccagcauacuuuaucgccuucacugccuuuugacugcagaggagcuaagagcccagacugccagcgaugcuggcgugggagucagaucacuuccugcggauuuuagguaugccugugcagucagccagaaagaacacagaucaugagauccuguuugcaaaagaacagaauuaaguuaaaauuguauauaaaauaauucuuaaaagaguaaaaagaaaauaauggauaucuuaugucuugucaagucucagagggagaugagaaucugaggucagaaauaaccauuacugcuuaagccauaacaguuggagugagaaugaaauuguucuuuguuacugcaucagcauuuucagucuguuuuuucuuuuaaaaauccaaauauauguuaaaaagcaauagccuuagcauguucuuugucuucauuauuuucuucccauuaguaaaaucucugcauucuaaagaaacuguuggcuuaaacacucacauuaguucugguuauccaauuggcaauaucaagacuguucuagggauugaaggaauuuuaaaauauaauaggaauaaccacaauauuuauugguuaguugcuauagugccaaacacuagcuuaaaugcuguacccuguguuaguuagcucauuuaaucauuaagacagugcuaugagauaggaauuguuagcccuuuucucaggugcagaagcugaggcacagagaguuuauguaaguugcccagaguuacucagcggguuaaccagagugccugggauuccaacccgugaagcuaggccccagguccugcaggaugccugcaagcuucgugaccuucuuaacuaccacaccuagagucuagggccagggauuaaagcaguagauaaaaccaugucccacuuuauaauuuacacuguaaauuaaaaauuuggaaacuugcuucuauucuaaaguuuaggaguacauuuuugggaucuuuguuuuuguuuuuaaauucaaauugcuguugcucucagccuagcuguuuugaagaaucugauguaaaguuauaaaaaugucuuugcagauacccuaacuuagacuucggguggaaaaaaucuauugacagcaaaucuuucaucucaauuucuaacuccucuucagcugaaaaugauaauuacuguaagcacagcacaauugucccugaaaaugcugcacaucaaggugcuaauagaaccuccucucuagaaaaucaugaccaaaugucugugaacugcagaacguugcucagcgaguccccugguaagcuccacguugaaguuucagcagaucuuacagcaauuaauggucuuucuuacaaucaaaaucucgccaauggcaguuaugauuuagcuaacagagacuuuugccaaggaaaucagcuaaauuacuacaagcaggaaauacccgugcaaccaacuaccucauauuccauucagaauuuauacaguuacgagaaccagccccagcccagcgaugaauguacucuccugaguaauaaauaccuugauggaaaugcuaacaaaucuaccucagauggaaguccugugauggccguaaugccugguacgacagacacuauucaagugcucaagggcaggauggauucugagcagagcccuucuauuggguacuccucaaggacucuuggccccaauccuggacuuauucuucaggcuuugacucugucaaacgcuagugauggauuuaaccuggagcggcuugaaaugcuuggcgacuccuuuuuaaagcaugccaucaccacauaucuauuuugcacuuacccugaugcgcaugagggccgccuuucauauaugagaagcaaaaagguaagagaugauuuuuuuauuuugagcaguuaauuauucagugugccugaaagugguuugcaguguuggauaaucucagaggaugagaacguaucaugcucagaaauugcuacaccggccaagcacagcugcucccuuguucuaccagggccagcgaaagccuguggcagaacuaccuggcaguugaugaguauugcuuuacaccaaucccacacucagguuuuggggcuuagcugaucuccacgugccuuacuuuuugauugaaagucaguucaaaggaagcuaugcaaguguguacaccccuugauccugagggggauaugaagaaaugugcauuguagucagucaaggagcuucugcuuuguugaguuaaacauuuauuugagaggguacgucuuggcuuacaaggcauacagacaugaguaagacacaagucuuguggaggagcucaucuccaaaguuuuggagaguggagcggagaagaguaacaagcuucacagagcuuggcugcucuccagugugaagagggugacaccagaguucugaguaauuaacgcucgauagcucagagaaagggcgggcucuuaaacucagcauggacuaagacuuaagaaaaggaaugaagguaagauauucaaguuaugggggaaaaauggaaaaaagucucacaaggcaacaugagccuccuggacaaauaccuuagaaagcugcugaucacuugcagcacucagaaggaaggagcaucacuguugaaucaaggauggcauuaauggaggaggcaaguugacagugcauaagcaaagugaacagauggcagagcaugucagcgucagggaagcagccguggcagcagucagaaguguggaaauaccugagaaaaggcuugaaaaggcagcuggggugaagcuguaucguggaaggccuugaaugcugggcuaaggaguuugcacguguuuugaauguuguaggcacuguugaaggaauuuagagcaaggaacuauuaauguuaauaaagugguaguuuaaaaugauuaaucugguagcagaauguagugugaguugaaaagcauauccaaaccaacagcagaagcagagaaugggauagaacuagaguucugguagagaggaaggggcugaggugagugagaauuucagaagaaauaauuuuagcuaacaauuuaaaagugcuuacucugcacuacucuaaaagauaaccguauacgcacacacacguacacacacccacauauauacacauauaugcauauaaaccuaauuuaauuuuuauaauucugagagguagaaacuuuuauuuuccccauuuuauaggugagaauaggcuggagaaguuagcuugcccaaggucacuuggcaaguaaguggcagagcuugggucgaauccagacagccuggcuuuggagaccuuccccuuccccaucacacuaacugcuccggauagaaccaucacaccaggcagcacaccaagcauuucccaagugcucacucauucacucuucucuaagccucugggaaagagacaacacaucccuguuuugcagaugaggggacucacacuuagagagucgaaugggcuccugucaggucaccuaacuguucaucugggagagucaggaguguguccaaggccucccaggaugaucuugagguggacuggaggcgcagucauaacaaccacguaaacuggcaacuugggggcaguggcaguagcagggagguagggagaaaugugggaaguccauguuagaguugagauuuuagaccucauggaauaugaaguggaaauguucagauaauugaggcuguaggauucagauacgguuuuguagaguagucgccauacggaagcucugagaauggaugagauuuccaagaggugguugcaggaagaaaguaucagaggcuuggacaaguguggcauaggcaauaggauaggauacucuguuagacaagacagaggugacuuucuauuacaaaacucguccauuugucugcucagaaaccuucuacuccuuauuucugcagaaagaaugaucacucccucagccugcuguucaggcccuuucagcccugaugcguuuuggauccuaagcagguggaagccccuugcagcucauuggacagacuccacgcucagacccccagccuuggggcccuugcucuguccuuccuucugcagagggcuugccuccaucucuaccuguccagaauuuugccccauauuugagaccuuacguagcucuuucuucauccugcccaccauuucugucaacuuggaaugugauuucccucccaugaguccacguuguacuuuauccucuucuuggcgcuugugaugcuuuguucucuuagcuuggaaagggaagcuagcauuuauuucagccugcuacguuucaggcagagagggagaguacuuuuggcuauaguggucacacguacccuccuuuucccugcuagccugugugucacgaggacugccccucuguccugcugccaucguucccucaggguugcccaaucgagugccucucauauggggggugucuauuaaacaauaguugaguuacaugggaagagggcuaaugaaguacuuaauaauaaggaaccgagcuuuaugaaaaugaaaaugggauugacaauucuagacccuaguuuccaaguacuaacuugacagaaaugcaaugaugugagaaauuaagaaggagauagaggcauuaggaaaaacagaccggaguagaggguaagauaguaaagcuguuccauuaaugugaauaaacagaaaccuuuugguucauuuuuuuuaaguugaauaaaagugucuugaaauggcuguaaaacaaaggaauaauauuugagagagcauuacaguugaaaucccguuuguggcuucgauucuaggaauauaacauuguuucaguuuuguucggugccaguuuucacuuugcagcuagagcugauggcauccuccccccauuucauugaaaauauugugacaucuugacuuuuucuauggguucuuuucuacuuugguaauuccaguuagcaguuugcauuuuauaucaucagguuguauuuucaaggcuuugauauugucugaaguguuucuucucagucauucauaaggaguaugcauaguuauauacauuauuuuuucugcucugcaucuuauauucagaaauauuuacaccaaaaaagcauagaauaugugggaauuuaauauucuuuuuauaacaugaauggguagaaaaacuguagagcccuuauaauuaauugaugacauauaauuaauugauuaauuuuaagaacauuuaacugaggauauguuaauaugccuugaaugaauuccagcagugaucauuuauggauaaguauccuaauauuuucugcuaaaggucagcaacuguaaucuguaucgccuuggaaaaaagaagggacuacccagccgcaugguggugucaauauuugaucccccugugaauuggcuuccuccugguuauguaguaaaucaagacaaaagcaacacagauaaaugggaaaaagaugaaaugguaaguuuguguguguguguguguguguguguguguguguguguguguaacuggagggauuuacuuuucggugagccaaauaauuuguuuuauuaauuuuuuguuucauuuucuugguauguuuauaauagaguagauauuugauauauuuaauuaauuccuuuaauuacacugucuuuucacugaauucagaaauaguauuauaauuuugauggaggcaaauuucuauuuuuauuauuucuuuuccaaaggcauaagaguaugugauguuuugacuuugaguuuugcucuucuuuaaaaaaauuucacuuugcuguuauuacaauuuauccuagauccuuagcucuguucagugaaaugacuuuucagugaccugugaucuccagucugucugugaaauaauuaauuucaguaaaaucuugcuuuuguagcucaggguuuucccagucaggacuccugugaacuuaaaaaaaaaaaaucauccauaaagauuguuauuuucuggaaauaauuuaaaucuugccagugacuuaagaagacuccaaauaucagcaacagccacuucauuuugucuugucuugaaggccaccagagggcacuugggagggccuccaaacugcaggaaccagcgcaguggugguugacugggagaguucuagugccucuuccgaaguuaaaggcaaugcuucagacaguuucauuucuuggagauuuauuuugcauuaaaaauaaauuggcucauuguuacuucauuuuuaccucaggccaacaaugauaauaccguuuuuuucuuucaaagguuauauuuuuaaauauccauuuucuccaugucuucuuugugaugcauguauccuauauaucugccuuuaaguauuuccagguagcauguucagugacacuauuuggauuuuuaccuauuuauugaggauguuuuuaacucauguaguauuugucuuauuacagaauuagaacuuauuuggaaaagcauuaagggaauauuuuaaugcaaguuagguccgaacaauuauuuguuauuaauuuagaaauauguagaaccuuagaggaaaauguauagauuuucaacuuuagaaaugguaugguauuucuaugaauaacauuccaguaacagucauccuccuuuguuaauaccguuucauaauguuuuuggcucuuuuuaaaaacuuguagcaugaaggugacauuggcaugucauugauuuuuuuuuuaagauacaacacaaaguucaauuuauuuuucuuaauguuucugauggcacuuugguuauuggaauucauuagaaauacuguucagauuuuuauuuaguaaguuacuuuuauugaaauauaggcccuugcauuauauugaaaagauacacugugguuuuggcugguugcauugccauucucccuaccuugcucuggcccuucagcaaaugggcuuaaguggaaaccuuugcaugcuaaaacgccucuuaauagacgagaguaucaaaguugacuugaaugauauagaaaaggauuucauguggcuguuuuuucuuaaaaggcuugaagugcucuugaaaaacauuuuaugagacagaaccccacucuuuuguagaugaagcaucugaaacccagaggcacuaaaaggcuuugcccaggaucacacaguuugugauaaaagucagcccuuugugauuuuugugcucugccacuuuuggcuuaugguggcaccuuucuaaagauacagaagguuuuuuucaauaaaaaaaaaauauugucugauuuuuuaaaaaucgcaguuuggcccucuuuuucuuaaggaccaaucaaaaacaucuucauguugccuuggaaagucuaagauuguuagcaggaaauguuccuugaggucugccgcuacaguugcuuuugguguuccuuauucuugaaaagguguuucuuucuuaauuaaaaaaaugaaaagauaaauaguuagagauauggcuuggcuuacugcuauuucuuuucagacaaauguaguguuuauaucuugagucuaguuuaaaauauuuguaguauuuaaaaaaugcuugaagguugcaacuuuuuuuugucagaacacuggaaaguuguuacaaucaacauugaugcacacccuucgucuucccccuucacaaguuuuuugguuuuuuaaaaacuugcauaacagaaauuuggcaucuuucuaggauugcaaagaaguuacaucauuacugaaaucuagcccauuauuaagguugucacucacaaauaagcuuuugccaaagaaauuggaauuagcaaagaucuuuugacagaaauuggauuguuguguuucauguuagucuaaauuuucuuccauuuuugucaguuaugcuauaaucuguuccccugauuaccguaguucagaguggagggaaaaaacguaacuucucaaauucauagcuuagugcagugaucacuuuuauuuuuuaaggaaagcaguguaguuuuuuuguggcaaguauacuuugaaguggaaauagggacaaaaagcuuuauuauaaaauccuauuguacauuuuaaaaaaugauuuuaucuguuuuuauauuauauucuuaauugcaaagguaaugcuuuucuacaucuggaauuucguuuuauuaguuugaaaaucuuuuugaaaaucaaauuaccacauuuucaaauuuugucagcaaaauugaagaucugugugaucagcauaugagugcuuucauuguguguccuaccagaguuagacgacuuaguugaaguuuugcauuguggacauuaauuuuaacuuuauauccauguucaaaguccuuaacuuaaagcuucauacuggauaaaggucauuuuauaacuuagaaaacgaacauucaaagaacauguuuuacuuuguuuauaugauuaaauaacuuauuuuauguuaauugaaaacaaauggccaugauuuuaaaguugccuuuuaguauuugugguugucauuugaaauuauccauaacccuugcuuuuauugaguuucaaacccuuuuaaaaacagcagcuauguuuccccuccuuccccauucccccucguuucagacaaaagacugcaugcuggcgaauggcaaacuggaugaggauuacgaggaggaggaugaggaggaggagagccugauguggagggcuccgaaggaagaggcugacuaugaagaugauuuccuggaguaugaucaggaacauaucagauuuauagauaauauguuaauggggucaggagcuuuuguaaagaaaaucucucuuucuccuuuuucaaccacugauucugcauaugaauggaaaaugcccaaaaaauccuccuuagguaguaugccauuuucaucagauuuugaggauuuugacuacagcucuugggaugcaaugugcuaucuggauccuagcaaagcuguugaagaagaugacuuuguggugggguucuggaauccaucagaagaaaacugugguguugacacgggaaagcaguccauuucuuacgacuugcacacugagcaguguauugcugacaaaagcauagcggacuguguggaagcccugcugggcugcuauuuaaccagcuguggggagagggcugcucagcuuuuccucuguucacuggggcugaaggugcucccgguaauuaaaaggacugaucgggaaaaggcccugugcccuacucgggagaauuucaacagccaacaaaagaaccuuucagugagcugugcugcugcuucuguggccaguucacgcucuucuguauugaaagacucggaauaugguuguuugaagauuccaccaagauguauguuugaucauccagaugcagauaaaacacugaaucaccuuauaucgggguuugaaaauuuugaaaagaaaaucaacuacagauucaagaauaaggcuuaccuucuccaggcuuuuacacaugccuccuaccacuacaauacuaucacugguaaggagcccacgaccagacuucauuucugggaaaaugagacuuuguguugaucucaucguguuggccuuguaaaagugaucuaugcauguacaguguucaugcuuaauauucaagggauggggcggggaacaaaaggaauagaaagaauucuuuuccuuguuauuuggggagcacguauugcuuuauaacuuugguuguugggaguauggcuaucauauacccucaucagugucauuuuauaucugccuaauuagagaaauuuuaaccuuaguauuuugauguguuuuccccauuuuauccuccgcaaauaucuuucucuugcccauucagugcugcuuuugguuuuugauuuaguuguauauucuggauguauuuccacagccuuuuauuguucuuccuggacaaaaagaccccuccuuuagggucuuuuuaaagauggauagauuaaaagauuaaaagcaaugauuucacaagaagguugcguggcccuugcugugacucugcugucaucuucuacuucucacugugcucuguauuugccccucuuuuaauagacugucaacccauuagauuagaagggagaacaagccccucacacccaaaucagcuucaggcugugaaacacagcugaaguuuacauuucaauuucuguaucagaaaaauaagugccugaauucagaacaccaaagcaaaguauaaaguuuguaguuuauauaauaaaagcagcguagguuaaggugaucagcaaaauguaaaaaccaaaaagugaaaaacuaucugacucuggacuggaaagacugaugaaacuaaagccuaauuuucguuauggaggaaaaaugauacguggcuuucgacuacauucugcuggaaguuccgagaccuggguucucgccuagcagucccugcuucuuaauuccuugcuuauucugggacaagucaccaucggucccugccucaguuuccucagcuggauauauuauuuuaaucacugugagaaaauagagguguugauuuaacauugaucauuuucacauuuugacaaccaguuuaccugccuuugcucccuuucacaacucuucuuucucaaucucuugguuugugguaaauucauuucuauaauagcucaaguuaagaagagggucuucuuuuccugucauccuguguaacaaaaauagcccaggaauagugaggaaugguaucacuuaugcacagauuccagagugugaaugagacuuuagcgauggcagcacaguguagccacauggagaggugugugcggcccugguuucacuuaagugaugaugugugagggagacucgagaggaaggccccagcaccugcccagacagcacagugccagagaaaagcauucagugaucaugauagcaccugugagguuuuguuuuuccuucuuaacaagcguuagucuuuugaccacuugaagauuuuaugaccccaguuuauauaagaaauguacuuaauuugucauuaaaauuuaguuuccagaggcuuuuuaguaugauaugucagauauccuuuuugaagaauauauguaugaaaaugauuguaaauacaaaucuucuucggauuuggggaucaguugcuauguggggauaguguaaaugcuucugcacaagcuuacgguuccacuucggauccccucagauuguuaccagcgcuuagaauuccugggagaugcgauuuuggacuaccucauaaccaagcaccuuuaugaagacccgcggcagcacuccccggggguccugacagaccugcggucugcccuggucaacaacaccaucuuugcaucgcuggcuguaaaguacgacuaccacaaguacuucaaagcugucucuccugagcucuuccaugucauugaugacuuugugcaguuucagcuugagaagaaugaaaugcaaggaauggauucugagguuagugcuguucaaaacgauguugaaaaaaguggucuaacuaggagucucuguaguuucagaguucugacggcauaguggucuaaagggacagcaggaggucaggggugugggacccagugugcuguguucugugggagcacgagugaacugcaguuugcagguaggccucuugaacuugucugcccccacugugggcuguguggucauucaggugaagagaaggaaccaggccuuucaguuagguacccuucccacgccuucaugagggcuuccagcauugaggcaugccaaagaaguggccuccacugccggaccccaaggcagguuuagcuuuaguaaaagcccaguguagcuuauccuuccuuuuuuaaauggaucagaaauauuugcuaauaucucagggaagcaucauaaauauacauucugcuucuacuugaagugggaaaaucuaauuuaaaaaacaaacuucuaaauuuuugaccauuggaauuugggaggcuucuauuguaaguucagccaaaggcugucuggugacagagcuaauucuaauguguuugugagcuauuucgaauuuuuguaggaaaggauauugcuuagaucuuuccagucucuuaacauucaucugcauaccugugucccccagagagacucucauuuccuccucuucccauuucauuuccuuugauuuucuuauuuuuguagauuuucuuauaaggagucaggaaauacaaccuuaauacuaguagcuguuuuaguugucauugcuuuaauuuguaccuuccccuuuuuaauugcaccaaaccuuuguuggggaguagugacuuucuaugacaaaaauuaagaguagguuugaagucuagccgcagagccgaguucacgcccugccagcugcccagaugugcacuggaggagucaguaggcccugcucuuacuuuaacgcgccucugugcucuuguccaagaugaacagccugagcuggagcguggcaggcugugaggcgagaaggcgggaccagcucguagacuuccaaguguuaccuagucucauucuuuagaaauagcuaagcuugaaauuugaggaauuaguuaaaauuagauuuaagcucucuuuggaugccaguggggcauauugguuuuguuaguuuuuguucauucuuuuccuucccuuuguuuauauaaacauauguauagaaguuacaagaacugauuggaaaugucauggucuggcauuucuaacuuacuauuugaucuuaagaaagucucuuuaccucucugggccuccguuuccucagcuguaaaaagagagaauuaaacuugguaaguuuuaaaauuccuuucuaucucaaaaccauaaauaugaacaauaagucuguuuuuuuaaguaaucagcaguauaaauguauuauauguaacuuuguauggcuaaacaaccuauuagaaauuaguauuuucccacuuucucuuuauuuuuuucacaaaugauuuguguugauuuuagaaaaguuaguacaaguaaauaagaagaaaauuaguuaaauuugccugauuaugcuaccucggaaauaaccaauauuaacauuuugggaggaauuguggauguguauagauauaaacauaucuaaaauguaaaauggaauucuguuauguauaggauacugucaccuguucuuuucacguauaauauauuguggcugacuuuccguguauugauggguaucgugaugcucaggggccacacgcuagucaacacguggcugauugauuuaaacgcuucuuuauggccgaguaauuaaguaguuuuugguuaggauguuuaauaaccauggaggugauaaauacgcuuauguaucuaguuaccuccuuaaaauaaguucuuagagaugcaauugcugcaucaaagaauugugaacuuuucaaaggcuuuugaugcaugauuuucuuuuauuaauuugcauacaugcuaugucagauacucgguuauagugaacacauaucuaguggcuuaaugaagagggaacuuggaggaaaaaaucuuucaaauauaauuucccuauuucccuacaacagcgauuucugcuccccaaagcagcauacacccgugccagcaccagaccaauuaguacuauugaaugcuugccaagcagcuagggaguagaacuguuuuaaaguauaguucuuugauuacgagugaauuugaauuuuuuucauacuuuuauugacuauuucuaauucuuuguuaagguuguuuaaaguuagaaguaaucuuuuuucuuugcuggguauauagaauaauaaaugggguggggauauuuuuucuuuuuuucuugagaaguuugaaaaacuuuuuuaaaaauauaacauuuguuuuacuauuacaauauaguaggcauaccauaaaugguauuuccccccuuacuaaagaaguaacaaaagucauauauccaagaaaagaaacuacaucuguggacugccuguaaaaguggccuuuuugcuuacaagucacuuuucccucuguaauagcuuaggagaucugaggaggaugaagagaaagaagaggauauugaaguuccaaaggccaugggggauauuuuugagucgcuugcuggugccauuuacauggauagugggaugucacuggagacagucuggcagguguacuaucccaugaugcggccacuaauagguauuguuggcucccuuuagaaagaaaaaaacccacaaaauuaaaaacaacuucagagauauuauucauauuauucuuucauuuugauugcagaaaaguuuucugcaaauguaccccguuccccugugcgagaauugcuugaaauggaaccagaaacugccaaauuuagguaagcaaaaaauguacauggaaaaaacauuaacuuaaaaacaucaaaggggaaaaguucacaaagauauuguaaacuaaugauucugaaaaauauuuacacuguggugugcuguugucagauuucuguuuguaaucugauugacuucucuuuuuuccuucuguuuuuaugaaauaaugcuguaauaaagacuagacggcagcccugucugucggggguaugcaauugcaguaagucguaacgcguguuuccuuuguguggugucagcuuauacaugggacuccuggccugagagugcacacuaaaugcugauugacaaugauaauaaauacuucugacuucuaauucaagcuguuuggauuuuuuacagcccggcugagagaacuuacgacgggaaggucagagucacuguggaaguaguaggaaaggggaaauuuaaagguguuggucgaaguuacaggauugccaaaucugcagcagcaagaagagcccuccgaagccucaaagcuaaucaaccucagguucccaauagcugaaaccgcuuuuuaaaauucaaaacaagaaacaaaacaaaaaaaauuaaggggaaaauuauuuaaaucggaaaggaagacuuaaaguuguuagugaguggaaugaauugaaggcagaauuuaaaguuugguugauaacaggauagauaacagaauaaaacauuuaacauauguauaaaauuuuggaacuaauuguaguuuuaguuuuuugcgcaaacacaaucuuaucuucuuuccucacuucugcuuuguuuaaaucacaagagugcuuuaaugaugacauuuagcaagugcucaaaauaauugacagguuuuguuuuuuuuuuuuugaguuuaugucagcuuugcuuaguguuagaaggccauggagcuuaaaccuccagcagucccuaggaugauguagauucuucuccaucucuccgugugugcaguagugccaguccugcaguaguugauaagcugaauagaaagauaagguuuucgagaggagaagugcgccaauguugucuuuucuuuccacguuauacuguguaaggugauguucccggucgcuguugcaccugauaguaagggacagauuuuuaaugaacauuggcuggcauguuggugaaucacauuuuaguuuucugaugccacauagucuugcauaaaaaaggguucuugccuuaaaagugaaaccuucauggauagucuuuaaucucugaucuuuuuggaacaaacuguuuuacauuccuuucauuuuauuaugcauuagacguugagacagcgugauacuuacaacucacuaguauaguuguaacuuauuacaggaucauacuaaaauuucugucauauguauacugaagacauuuuaaaaaccagaauauguagucuacggauauuuuuuaucauaaaaaugaucuuuggcuaaacaccccauuuuacuaaaguccuccugccagguaguucccacugauggaaauguuuauggcaaauaauuuugccuucuaggcuguugcucuaacaaaauaaaccuuagacauaucacaccuaaaauaugcugcagauuuuauaauugauugguuacuuauuuaagaagcaaaacacagcaccuuuacccuuagucuccucacauaaauuucuuacuauacuuuucauaauguugcaugcauauuucaccuaccaaagcugugcuguuaaugccgugaaaguuuaacguuugcgauaaacugccguaauuuugauacaucugugauuuaggucauuaauuuagauaaacuagcucauuauuuccaucuuuggaaaaggaaaaaaaaaaaaacuucuuuaggcauuugccuaaguuucuuuaauuagacuuguaggcacucuucacuuaaauaccucaguucuucuuuucuuuugcaugcauuuuuccccuguuuggugcuauguuuauguauuaugcuugaaauuuuaauuuuuuuuuuuuugcacuguaacuauaauaccucuuaauuuaccuuuuuaaaagcugugggucagucuugcacucccaucaacauaccaguagagguuugcugcaauuugccccguuaauuaugcuugaaguuuaagaaagcugagcagaggugucucauauuucccagcacaugauucugaacuugaugcuucguggaaugcugcauuuauauguaagugacauuugaauacuguccuuccugcuuuaucugcaucauccacccacagagaaaugccucugugcgagugcaccgacagaaaacugucagcucugcuuucuaaggaacccugagugagggggguauuaagcuucuccaguguuuuuuguugucuccaaucuuaaacuuaaauugagaucuaaauuauuaaacgaguuuuugagcaaauuaggugacuuguuuuaaaaauauuuaauuccgauuuggaaccuuagaugucuauuugauuuuuuaaaaaaccuuaauguaagauaugaccaguuaaaacaaagcaauucuugaauuauauaacuguaaaagugugcaguuaacaaggcuggaugugaauuuuauucugagggugauuugugaucaaguuuaaucacaaaucucuuaauauuuauaaacuaccugaugccaggagcuuagggcuuugcauugugucuaauacauugaucccaguguuacgggauucucuugauuccuggcaccaaaaucagauuguuuucacaguuaugauucccagugggagaaaaaugccucaauauauuuguaaccuuaagaagaguauuuuuuuguuaauacuaagauguucaaacuuagacaugauuaggucauacauucucagggguucaaauuuccuucuaccauucaaauguuuuaucaacagcaaacuucagccguuucacuuuuuguuggagaaaaauaguagauuuuaauuugacucacaguuugaagcauucugugauccccugguuacugaguuaaaaaauaaaaaaguacgaguuagacauaugaaaugguuaugaacgcuuuugugcugcugauuuuuaaugcuguaaaguuuuccuguguuuagcuuguugaaauguuuugcaucugucaauuaaggaaaaaaaaaaucacucuauguugccccacuuuagagcccugugugccacccuguguuccugugauugcaaugugagaccgaauguaauauggaaaaccuaccaguggggugugguugugcccugagcacguguguaaaggacuggggaggcgugucuugaaaaagcaacugcagaaauuccuuaugaugauugugugcaaguuaguuaacaugaaccuucauuuguaaauuuuuuaaaauuucuuuuauaauaugcuuuccgcaguccuaacuaugcugcguuuuauaauagcuuuuucccuucuguucuguucauguagcacagauaagcauugcacuugguaccaugcuuuaccucauuucaagaaaauaugcuuaacagagaggaaaaaaaugugguuuggccuugcugcuguuuugauuuauggaauuugaaaaagauaauuauaaugccugcaaugugucauauacucgcacaacuuaaauaggucauuuuugucuguggcauuuuuacuguuugugaaaguaugaaacagauuuguuaacugaacucuuaauuauguuuuuaaaauguuuguuauauuucuuuucuuuuuucuuuuauauuacgugaagugaugaaauuuagaaugaccucuaacacuccuguaauugucuuuuaaaauacugauauuuuuauuuguuaauaauacuuugcccucagaaagauucugauacccugccuugacaacaugaaacuugaggcugcuuugguucaugaauccagguguucccccggcagucggcuucuucagucgcucccuggaggcaggugggcacugcagaggaucacuggaauccagaucgagcgcaguucaugcacaaggccccguugauuuaaaauauuggaucuugcucuguuagggugucuaaucccuuuacacaagauugaagccaccaaacugagaccuugauaccuuuuuuuaacugcaucugaaauuauguuaagagucuuuaacccauuugcauuaucugcagaagagaaacucaugucauguuuauuaccuauaugguuguuuuaauuacauuugaauaauuauauuuuuccaaccacugauuacuuuucaggaauuuaauuauuuccagauaaauuucuuuauuuuauauuguacaugaaaaguuuuaaagauauguuuaagaccaagacuauuaaaaugauuuuuaaaguuguuggagacgccaauagcaauaucuaggaaauuugcauugagaccauuguauuuuccacuagcagugaaaaugauuuuucacaacuaacuuguaaauauauuuuaaucauuacuucuuuuuuucuaguccauuuuuauuuggacaucaaccacagacaauuuaaauuuuauagaugcacuaagaauucacugcagcagcagguuacauagcaaaaaugcaaaggugaacaggaaguaaauuucuggcuuuucugcuguaaauagugaaggaaaauuacuaaaaucaaguaaaacuaaugcauauuauuugauugacaauaaaauauuuaccaucacaugcugcagcuguuuuuuaaggaacaugaugucauucauucauacaguaaucaugcugcagaaauuugcagucugcaccuuauggaucacaauuaccuuuaguuguuuuuuuuguaauaauuguagccaaguaaaucuccaauaaaguuaucgucuguucacuu

SEQ ID NO: 17138 - RNA, 3026 nt, Homo sapiens
ccuggugacccuaguggaaaagcucaccaguuggcacacacaacuuccaaucagcuuuuggaugccucacucuuaaaacaugaacagauccauaggaucaccauauauuugagaaaaauucacaacgugaaagauagagacugagaccaccaaaauaaagagaacucagagaaaaugagggcaacacagggagcagaaaagacuuccccucagaccacaaucauuaacguccacagagagacaaaaucugcauccacgcaucaagagcaggacacuguaaaacaaagacaggauaauaaccaaagguuuuauuaacuuggaaaauaaaaauucaauaaaacauucagauugggaagauaaaaaugaauaauucuuccugaaagcagaucagaaacauagacgaaaaauagaaaagauaaaaaauauuagagcaucagccuggguguaggggaggguccaacauugaaauaauaggugguccagaaagaaagaauguaaauaaucacaagaaaauuuaagaaauuucccaugaaggcccagcacaagguuuaacacccgggauacaacaccaucaugacaguucagaacaccaagaauaaagagaucuuaaauguuuccaggaaggguggauaaaaaaaccuaagucacauauaaagguacgggaaucagaauggcaucagaaaucucaaccagcacgcuugggaggggcuaggggaggguauuauuuuccaccugucauucuaugcucagccacauuucuguuaagggcagaauacagacaucuuaagucaugcaaaaaucucaaaauauuuacaaccauauuuacuucccauguucucuuccucaggaaguuauuaaagaaugugccacaccaaaaaaaaaaaaaaaguaaagagagagaauagcaaauuaauggggacauuuggaggagaaaggacauguaaccauaacacacugcugggcuugggagucaacaauccuuaagugcuccagguaaugucaacaccuaauagaaauguacuaaaugaugugaucuagcuauacuggaaaaccaaagcacgguaugguaagagugaaauccuccucuacugugacagcaagccaguagauguuucuaaauuaaaaaauaaaguguaagcacguuauguagaaaugcaaacauaagagaguugaaagugguuacuucuaagcagcgagacuuaggggacugcuaguucuuguuaaaagccuuauuguauuucuuuuaauuuaaaaaaaauuuacaagcaauggggugguuuguccugcagacuuccacauccauuuucuauauccagcuucuuccauagaagccuauacucaaaugagauuuuuuuuuccuuugcaaaauaucaguugacugccaaccugaaccaaaugacuuucaggcaucuugccaguagauguuuuaaacaauauuacaaguuguaauaggugagagaaguaucuugcagagguuuuucugaacaaggucuagacccauaaaaugaaaugauucacauuuggguuggcucuucccaggcucuucgagcaucuaauuuaggcaaggacugcauggugcccagaguuauaaacuaucacauaaucuuuauuaucuguaccuuugagcuuucauugaugccagggagcucauuaauuagcucauuuuccauggggcucuuggccuuccagauggaaucacuccaagcucccagcagcuuucugguuggaaggcugaaauucuuucaggaggggagacagacuauaaucagacugguuuagaggccagauuuuggcugucaucgacucagaugugcuauguaaauucuucuggccaugcuggaauucuguaaacuugaaacccacugcuugaaaugagcaaguccuuggcuagcaaagaaagaaacgugauuccuggaguaagagcgacgcugguaugucaaaugacaagcuguugcagcugucaaggguauuucagaaggaauuggggaugagcuugaaggugaguaagaauuccucaugggaaaaauacaagaacaaaacaaaugucgauaguuggucuaaacuuuuugguuuugcuugaauguggacauuuuaaucuagucauuuuaucuuuuucucaggacauuggugugcccaguggaaguuuccuacaaggggugacagcucuggacagggcaucaggugccugugugcucacugcaagucugccccuggucggcuauaugaucuuggucaagcugcucugucucucuggguccagcuagacaagaugcucacugaguccccuccugacucauuugugauuuuauaaggguugccugguacaugcuuucugaaggggagagcaaggggaggaggaaccaaugcagagacucaccacggaccugagucuuggcagggaggagagagcagagggagccuggggcugaggaagacugggggcaggggugcuagagaugccucucuucuuucacaaaccuccugugcuggccugcucccggagugcuguccagaaagccucuucaagaaacccauuacaagugaccacaaagaaugcccguuccaagacaugcauucugagggaggugugcaccaaagcuuuagugggcaggaagcuaccccaccacccagcuccagcacugcugggagcugauuccagcccagccacuccucauggcuuuuauauggcccugcugggcccuggcgaucugguuugaaaaucaugguucuaucucaauccaaucaauggaaaacugaauuucaaguguuaucuccccucaaacaaaaaacaaaacaaaaaaacaacaaaaaaaacagggugaaaaagagcacacaguggcucucaacacagcuuucaccuuccucccuggauucugccauuccuggaugugcuuacacagagcuggcugcucggauuuccccuagugaaugcaaccaguuaccggacugcgacaggugcauggaccccagcaccuucucucaaacacccacgcuuggaggaaaacguggcagcucucuccccagcu

SEQ ID NO: 17139 - RNA, 3026 nt, Homo sapiens
agcuggggagagagcugccacguuuuccuccaagcguggguguuugagagaaggugcugggguccaugcaccugucgcaguccgguaacugguugcauucacuaggggaaauccgagcagccagcucuguguaagcacauccaggaauggcagaauccagggaggaaggugaaagcuguguugagagccacugugugcucuuuuucacccuguuuuuuuuguuguuuuuuuguuuuguuuuuuguuugaggggagauaacacuugaaauucaguuuuccauugauuggauugagauagaaccaugauuuucaaaccagaucgccagggcccagcagggccauauaaaagccaugaggaguggcugggcuggaaucagcucccagcagugcuggagcuggguggugggguagcuuccugcccacuaaagcuuuggugcacaccucccucagaaugcaugucuuggaacgggcauucuuuguggucacuuguaauggguuucuugaagaggcuuucuggacagcacuccgggagcaggccagcacaggagguuugugaaagaagagaggcaucucuagcaccccugcccccagucuuccucagccccaggcucccucugcucucuccucccugccaagacucagguccguggugagucucugcauugguuccuccuccccuugcucuccccuucagaaagcauguaccaggcaacccuuauaaaaucacaaaugagucaggaggggacucagugagcaucuugucuagcuggacccagagagacagagcagcuugaccaagaucauauagccgaccaggggcagacuugcagugagcacacaggcaccugaugcccuguccagagcugucaccccuuguaggaaacuuccacugggcacaccaauguccugagaaaaagauaaaaugacuagauuaaaauguccacauucaagcaaaaccaaaaaguuuagaccaacuaucgacauuuguuuuguucuuguauuuuucccaugaggaauucuuacucaccuucaagcucauccccaauuccuucugaaauacccuugacagcugcaacagcuugucauuugacauaccagcgucgcucuuacuccaggaaucacguuucuuucuuugcuagccaaggacuugcucauuucaagcaguggguuucaaguuuacagaauuccagcauggccagaagaauuuacauagcacaucugagucgaugacagccaaaaucuggccucuaaaccagucugauuauagucugucuccccuccugaaagaauuucagccuuccaaccagaaagcugcugggagcuuggagugauuccaucuggaaggccaagagccccauggaaaaugagcuaauuaaugagcucccuggcaucaaugaaagcucaaagguacagauaauaaagauuaugugauaguuuauaacucugggcaccaugcaguccuugccuaaauuagaugcucgaagagccugggaagagccaacccaaaugugaaucauuucauuuuaugggucuagaccuuguucagaaaaaccucugcaagauacuucucucaccuauuacaacuuguaauauuguuuaaaacaucuacuggcaagaugccugaaagucauuugguucagguuggcagucaacugauauuuugcaaaggaaaaaaaaaucucauuugaguauaggcuucuauggaagaagcuggauauagaaaauggauguggaagucugcaggacaaaccaccccauugcuuguaaauuuuuuuuaaauuaaaagaaauacaauaaggcuuuuaacaagaacuagcaguccccuaagucucgcugcuuagaaguaaccacuuucaacucucuuauguuugcauuucuacauaacgugcuuacacuuuauuuuuuaauuuagaaacaucuacuggcuugcugucacaguagaggaggauuucacucuuaccauaccgugcuuugguuuuccaguauagcuagaucacaucauuuaguacauuucuauuagguguugacauuaccuggagcacuuaaggauuguugacucccaagcccagcaguguguuaugguuacauguccuuucuccuccaaauguccccauuaauuugcuauucucucucuuuacuuuuuuuuuuuuuuugguguggcacauucuuuaauaacuuccugaggaagagaacaugggaaguaaauaugguuguaaauauuuugagauuuuugcaugacuuaagaugucuguauucugcccuuaacagaaauguggcugagcauagaaugacagguggaaaauaauacccuccccuagccccucccaagcgugcugguugagauuucugaugccauucugauucccguaccuuuauaugugacuuagguuuuuuuauccacccuuccuggaaacauuuaagaucucuuuauucuugguguucugaacugucaugaugguguuguaucccggguguuaaaccuugugcugggccuucaugggaaauuucuuaaauuuucuugugauuauuuacauucuuucuuucuggaccaccuauuauuucaauguuggacccuccccuacacccaggcugaugcucuaauauuuuuuaucuuuucuauuuuucgucuauguuucugaucugcuuucaggaagaauuauucauuuuuaucuucccaaucugaauguuuuauugaauuuuuauuuuccaaguuaauaaaaccuuugguuauuauccugucuuuguuuuacaguguccugcucuugaugcguggaugcagauuuugucucucuguggacguuaaugauuguggucugaggggaagucuuuucugcucccuguguugcccucauuuucucugaguucucuuuauuuugguggucucagucucuaucuuucacguugugaauuuuucucaaauauauggugauccuauggaucuguucauguuuuaagagugaggcauccaaaagcugauuggaaguugugugugccaacuggugagcuuuuccacuagggucaccagg

SEQ ID NO: 17140 - RNA, 2324 nt, Homo sapiens
cgguuccggugucagcggcgguugaauugccauggcaaugcggugggcgcgcgcuugucguguuggucucuugggagguagcggggcuaggccgggcggguauccgccucucccagcuuaggugagcguccccgggcgccuccggagcgccgcggccgcaugcaguucgucguggcggggagccggagccugaccgggguuccagcgcucgggccguagccuuggcuccuggacuuucccuggcuccgccgccacgugggagcugaggcucuggggcuuccgccuccggcgcgcgauuauuucucuagaacaguuuucauuuuuaaaauuuguaaagcgcuuuugccugugugauuuccucuggguuuuuuuuuuuuuucuuccuuuuuguagagacggaauuggcggcgggggcggggggucgaugucucacuuuuuugcccaggcuggucucgaacuccuggcuucaagggauccuccugccucggccucuuaaagugcugggauuacaggcgugagccaccgcccccggccgccucugaguuuccagccucguuggcccuccagccuuuuaaccuguugggccuaggaucaggaaagguuuguugaauggggaacuaagaagugaauucguucguucgacaaacguuuccugagcagccgcugggugcuaggcgcagugccagcgcggaauguccagggagaccuggugcccaaagcuuggacccaucgugagaaaugagaagcagauacaaagcagugugggagugcagaggagacaaagcaagccucaucaggcccauugcuugcucugcucucccuuguacuuaccagugcuugacaauauacaguuauuuacuagcuugguuauugacuuccuacccagcacucaguuuuauucacugcuguauccucagugccuaggacgaugcuuggaacgugguaagugcuccuauuggcgggaagaauaaauccggaagagcaggaccaguggacuugcuacauaaucuguagucuuggagccgcacaggguuggugguacccucgagcacaccagacuugcagaaaaagcauacuccagaggaagcugaggcaugccugcucgagagccagcuguuccaugugcaauuuuccucugauaguuucuggucacuguugccacggugauaaugacugggcuaugucauuaucuauccgccaacaguaagagaagcuuugcagucgagauauuguuuagcagauggaguguuuucuguugaacacuaaguacugccacaaguuacuuuuuuuuuuuuaaacuuugaguauuuuuuuacaauguugcuggaggugaucuguuuaugcuuugagaguguucgaauuuaaaaucagaaaaucaugucagugagugagucuuucaaauaauccuucggcaugaaaccugagccuaguaaacuaugaaaguaaacucggcacauuacccgaaagucucaaugucauauuuucacccccaucaauauuauugaugauugcucauuuucuaaugugggaccugaaauuuaccaggugcuuaaagaaucuuuuuguuuuucagauucauugauuccagguaaaucagaggaacaagcaacaugaacagaaauauguagaaaaagcuauuaugcagaagcauaauuguuguuucagaaguccagcaucuggugcacuuaacaauagagaauauauuaaacucuuuccaaaauaaccuguuguuccuaccuguguuguaaguguuuuguuuguuuuuaaguaaauauuggugauuuguugccaaaaaccuaaacuguuuguugcugucaacuuaaauaacgaacagagagaggcucucuaaaagaaaauggcauuuauucaggaauagagcacugcaaugagaaaaugcaugcgauaguuaacuguguguauccugggagauagaggaagacaaaggucuuuaaaggaaaaaugaggaggguuacauaauuguuuugagauaauuauuuuugacuacaaggaucaguaacaaaggugacaccagucccagguuggacaggcaggugcucggcaggcauugcagaaguauuuuuuguguaagauugagauggccuuugugcaggauugugguuuuggaaucuucugugaucguuuuugcuaucaggcauuuaugcuugcgaacucuuuauggccuucccugugucuauuuugauuccaccuuucucauugcccacucuaaacuguaauucugcuuuuauguugacugagaucaggagaagaauuugcaaacuuauauccugagacagaacaguaaugaggaguaucguguuccuuac

SEQ ID NO: 17141 - RNA, 2291 nt, Homo sapiens
cuuuguuuccuggaauagugggacgcauggaauccaagcucugagguuucauuuauuguaagcacugggcucccugaccaaauuaggugucaaacucuaccugcagauugggaaauuggggcugaagaaagagccggcagccaauuuggcacacagaaauaguucuucuggaguuucuggggaccaccucccugucugcaacuacccauaauaacugguugggaaauucagagauauugcucccaauuucgccggaaaauguuggaaugcaacuguuauacacaggcugggaugcaaagugcuuuucucagaaaaguguggccuuuggacccugguuucuuaagacacagguuucuguuuccauggacuugcaggguuuuucaauaggaguuacuggcaucucaauaauaauaauaauuggaggaaaugucuugucacuaagccaacaaaaaccacucagacucugcuguuucccaaagccccucauggagggacucuguccuguagagcugcagggcugggguguggguguuccugggcaggccugauuccccuaaaucucugcugagucucuccucugcaucuuucuccccacauccauaccaugaggaagacagaaaggccagcuagggaggguauggguugguguuguggacgaggugguaggugauuccuauucuguagcagggaugggagggaagcagccuuuugguaggcaggaggaucuucugagaaguaggggcagaagguuccuugcaccauccaacuggggaaggggcacagcggugggcccugggaaccugcuaaccaggaugucuggguucuucccccagcucugcuucugaggcacccagcagaccugggcaauuugccuccucgucgauagagaccauggucgcugcuugcucugaccauguuucccggcacuugccuuacuucccuggacguugggguggauuuuggugaggucccagagaaccaggagacaggcugcuuaucuucuagaaaaucauguucacauucauggaaggccuuagguacuaguacuuagcuaugaccuuuggagacaaggacuccaucuuccugaagacguuaaaauguccuguguacugaaagcaauuggaggggccuggauuugaaccccagucugugucagaggucccaagucuuccaagaaaguggaaggcgccccgaggcagguuagagggccuacaaggcgggcaacuggacauggggaugggcuggggaggcgccaaagggcggcagggauuggggguauagugguuugaccacgacuuaacuaccuucagcugccaggccauccgccuguucccuggaagauauaaggagcugggaguggggaacggagcaaccugggcuuccaugaugaagaaagagacagcgcaggagcaaaauguccaggaaggagggagagagaccagaggaaggaggaggcgccucuuucacccgcguccccagguccccauguacgccacgugggugggagcgugucccacacacccgcgcgcccaaagccacauucgccacgcucccgccggggcgggcucaccgcgcgccucugggugccgagccuccacaggccacauagccgccaccugcugcugcauccccacugcggggacaggggcacucagugccucccuccgucccccccgccccgcgaaggccucccauccuccagggccaggcggaggccacgucuuucccgggcccccuccccaacgcggagagggaagcggagggaggagcuuggcccgcagccgccggcccuccccgcacuggagcucccccuccccucccuccccgccccucggcugccgcagcccggcucgcagcgcgcgucagcgggggcuccccggagcgagucgcuagguaacggggcuggcuccgcagacgcggggccggggaagcccgcgcgcgucaucagcagcggcgccgcggggcggggggcgcagagacccuccccaaucccggccugccaccaccuggcucgcgcgcagccccggcccagaaugccuuaaccugcgccgauugcugccgccgaggugccccuccccuguagggaccccgacgccgccagccccuuccuccuuucccgcaggugcgcacugcugugcuugcggccgggugggcgccccgccgcugcggucgcggucgccgcugguaagcugcgcucuggggcuuggggcaggaagcaguggggggcgcucgaagagcagggcagcuacggccaccguggccgccggaccggccaugugcuaaaguuucug

SEQ ID NO: 17142 - RNA, 2291 nt, Homo sapiens
cagaaacuuuagcacauggccgguccggcggccacgguggccguagcugcccugcucuucgagcgccccccacugcuuccugccccaagccccagagcgcagcuuaccagcggcgaccgcgaccgcagcggcggggcgcccacccggccgcaagcacagcagugcgcaccugcgggaaaggaggaaggggcuggcggcgucggggucccuacaggggaggggcaccucggcggcagcaaucggcgcagguuaaggcauucugggccggggcugcgcgcgagccaggugguggcaggccgggauuggggagggucucugcgccccccgccccgcggcgccgcugcugaugacgcgcgcgggcuuccccggccccgcgucugcggagccagccccguuaccuagcgacucgcuccggggagcccccgcugacgcgcgcugcgagccgggcugcggcagccgaggggcggggagggaggggagggggagcuccagugcggggagggccggcggcugcgggccaagcuccucccuccgcuucccucuccgcguuggggagggggcccgggaaagacguggccuccgccuggcccuggaggaugggaggccuucgcggggcgggggggacggagggaggcacugagugccccuguccccgcaguggggaugcagcagcagguggcggcuauguggccuguggaggcucggcacccagaggcgcgcggugagcccgccccggcgggagcguggcgaauguggcuuugggcgcgcgggugugugggacacgcucccacccacguggcguacauggggaccuggggacgcgggugaaagaggcgccuccuccuuccucuggucucucucccuccuuccuggacauuuugcuccugcgcugucucuuucuucaucauggaagcccagguugcuccguuccccacucccagcuccuuauaucuuccagggaacaggcggauggccuggcagcugaagguaguuaagucguggucaaaccacuauacccccaaucccugccgcccuuuggcgccuccccagcccauccccauguccaguugcccgccuuguaggcccucuaaccugccucggggcgccuuccacuuucuuggaagacuugggaccucugacacagacugggguucaaauccaggccccuccaauugcuuucaguacacaggacauuuuaacgucuucaggaagauggaguccuugucuccaaaggucauagcuaaguacuaguaccuaaggccuuccaugaaugugaacaugauuuucuagaagauaagcagccugucuccugguucucugggaccucaccaaaauccaccccaacguccagggaaguaaggcaagugccgggaaacauggucagagcaagcagcgaccauggucucuaucgacgaggaggcaaauugcccaggucugcugggugccucagaagcagagcugggggaagaacccagacauccugguuagcagguucccagggcccaccgcugugccccuuccccaguuggauggugcaaggaaccuucugccccuacuucucagaagauccuccugccuaccaaaaggcugcuucccucccaucccugcuacagaauaggaaucaccuaccaccucguccacaacaccaacccauacccucccuagcuggccuuucugucuuccucaugguauggauguggggagaaagaugcagaggagagacucagcagagauuuaggggaaucaggccugcccaggaacacccacaccccagcccugcagcucuacaggacagagucccuccaugaggggcuuugggaaacagcagagucugagugguuuuuguuggcuuagugacaagacauuuccuccaauuauuauuauuauugagaugccaguaacuccuauugaaaaacccugcaaguccauggaaacagaaaccugugucuuaagaaaccaggguccaaaggccacacuuuucugagaaaagcacuuugcaucccagccuguguauaacaguugcauuccaacauuuuccggcgaaauugggagcaauaucucugaauuucccaaccaguuauuauggguaguugcagacagggaggugguccccagaaacuccagaagaacuauuucugugugccaaauuggcugccggcucuuucuucagccccaauuucccaaucugcagguagaguuugacaccuaauuuggucagggagcccagugcuuacaauaaaugaaaccucagagcuuggauuccaugcgucccacuauuccaggaaacaaag

SEQ ID NO: 17143 - RNA, 21517 nt, Homo sapiens
cugacuuuauauucccaggaugcauucaucagggucucaguaaaaaaaagagggcacauuccaauuggguaauaggaagaggauguuaaugaagcguuucuuuacagugcuguaggcagcauauugggguucugcgaagagcaggcagcacccugggugccucagggcugguacggcaaagccucagcacccucccuaccuccuuccccccucgcgaucaggccccugauaaaagcagugaacucugcuccaggucuggccagcauaaaggcccccaagagaggagccaacaacaccccauccucccucucacccucccucaggcuccugcuggggcucccacuggccaaacccaaagagaagccggaaggcaaagagcuccgugguacccaucagggcucccaagcaggggccacagaggagaagccaggaggugaccuggagcaggacacagcagcucccugacagggauccucacccagggcacgccucuagagcagauggagaaaacaacucaguagacuucagacucccaaauucucccaguuccucaacccgccugcccucuggacuucgggagaaaguugagagggaaagcccucaacuuuguuuugaaaaugagagcaauguuuacagccacuagcaagcaauuaggauccagcugggcugauguggccagaucuggggacacccagccagguagaugcacaacagacccauaauggaggccagcgaggaaacgcuggacacgucccccaugacugagcugugaggaccugacuuaucugugcggcggucacugucguguagaaauggaagcuguacaugcaggcugaggcuucucagcuggacaguucagcccgagugagccccaagaggacaggggaggcuggucuucauucuuccccucugaaucaccagcaaaugauagaccgucaauaauuuguuaaaugcuuuuuaaaaugaaugcuuuaagccgggugcaguggcucacaucuguaaucccagcacuuugggaggccgaggcggguggauuguuugaggucaggaguucgagaccaaccuggccaacauggcaaaaccucaucucuaccaaaaauacaaaaauuagccaggcaugguggcaggcaccugugaucccagcuacucaggaggcugagacaggagaaucgcuugaacccgggaggcagagguugcagugagccaagauuacgccauuguacuccagccugggugacagagagagacuccgucucaaaaaaaaaaaaaaaaaaaaaaaaaaauuacgcuucaaacacaugaucucucaccacuguugaauuuucuuucuaugagcccaggagggccucucagagaggaaagcuccuaggucuuccuuucccucugcaaacucccugccuugaaggaucagaaggacugugcugcucguugcauccuuugcaaguuccaaacccugaucccagcugugcuuagggguuccugcaaaccuuuuccagguguuaauuaccucccacuucauuuccuguuuaccaacucagcuuuuuguuuuaguguguuugaauucccugaacugaccguugucugaucuccaccucccaacugaauuaggggagcugggcuucuggaaacccaggugccggguguugcagaguggcugaaagcugggauguggcagauccguggcuacauucaugcacacacacacacccacauacccacacaugcacacacacacacacaccugcacucacacacuugcacaugcauagaccacagcuuuccacacccuuccuagacaggggucacuugguguccuggagagagugugaagucuggaagggaaagaggggggauuaagccccaccucuagccaugggacugagacaagucacccccacccaucugcgccuuguuuccuccucugugaggcaagcacagagcccaugccucccucccuggaugggagugaugugaaacuugaagagggguagagacaagggucgucaauggaagccccuugggcaaaaaggcccuuucaacuaggggcacagaggaggcccugggcugagaacuugacagcaccuuguauugguaaccagccggagggacuggaaauacucagaugugucugucucccuuauuagguucaaagucccucgagacccugucuccaucacagugcuccaguccagaccccuccucugagcuccagacccugcuggacccaacagccauccccauccccaccugccuggaauucuccaaagaaccuccccuuuaacaguuccagccuuuaacaguuccagucuaaacacaugaccuuucuccucuaaaucagccccccaucucugccuuugcaggagauggaagccaugacaccugccucgccccuguccucaccccauccauguccaaucaagcacuaggcaugucagguuuacccucuaaacuccucuggaauccagucucucagucuccaucaucccaggucgaagcuaaugggcuaacugguccuugcuuccacucuacccccacugcaguccugacuuccugagcagcagccagggccuaauccauauucacaccaagcgccuuccugacugagauauccuccugcaccaucaucccuccacccuguuuaguucugcucacccucaguguucucaucaauaauccacucgcccucacaggcgcguuugggaccccauguucuaugcucucacaggaccuuuugcuugauuuuucacuguacucaggucaguuugcaguuauuaagugacugagcaaugucuggcuucuccaguagacugucagcuccuagccauuguaucccuagcaccgcugugugggagcacuucacaaacguccauugagucagggacucagcagucuccauuucuccucccugcuggagaaugcguguauuuugcaauccccagccccugugccaucuaaccaucuuuucuucucuguucagcccagguguggccucacucacaucccacucugaguccaaauguucucucccuggaagauaucaauguuucugucuguucgugaggacuccgugcccaccacggccucuuucaggugagucaaagggauuccucaguucacuaguuaggggaggugggcagacacccuggagaacucccuggaaagcucaacucucaugccccggacaacaguugaaggaaccagugauguuaagcccaaagacaaaaccucucagguguccaagucccuguaggccuguugggagcagagggaauguucugcggaacuagaggaagaggggcucagggagaagaagggcacauuccugguugucauaugugaucuaucccagaugaacuuggaagugaagggaagagaguuaaacauuaaaguaaauacccaguggaucagacagcaaugugccagauugccuuggagacaaaauaucuccaacacauggcugacauuuggugggagaucagaacacccuaaagagagaauuuaaggggagggggaggaggaccugagccagaguagaagcagaggauagggagaucuguucuuggggacagcauuugcaagaaacaaggcugagggguccacuccaaccucuccacccugcugcaggugcugccuaugaugaagaugagcagauggccaucucagcuggggccacagugcacuggaccuauaguuuccaauuccgcacucagcaggcaucuuucugaugauccgauggcuucucagagccagggaugggccaggauccauccccuuggcuacugucuugcugagaaauuaauaagcagcaucuggugcuauacuuuggucucuagugaguuagcucaugaaagaugacagacucuccaagccagggguaugcaggaaauggguuuucuguagcuacagaaaugggguugaggguuggaccaaggggacuacccaggggaagucuuaccuucagaggacucuggaaaggaggcugcaaguuuucaugggucaagaauucagagcccaguagagacagcuuaucucuguuccaagaugucuggggccuugguuggaagauucaaaggcuaggaaaccaggagccaccaaaagcguaacuggggccagaggauccacuuucaagguggcaaguugguuccccccauguggcugcuugaguauccucacauggcggcucacauccuuccaaguaagcaaugcaaaaggccaagaaagaugcugcaaagcauguuaugaccuagccucagaaaucacacaccaucccugccaccauuaguaagaaguccagcccacguccaggagaagaggaagcagauuccuccuuuugaaaugaagaauaucaaguaauucggggggcauaugaaagccaccacacaccacagggaucuuuuuagagcauacuucuuauaccaucacuguaguuccuuaagacucaggggcaaagccucacuuccuuagcacccagugaagaccacgcuuacucccucacucaaccucuugcuacuucccaccucuccuguccaacaucuagugucacuuuccagaacauaccaacagcuuccccaguucugugccucugcucaggcuguucccccugccugguccacuuguccuccuucuugucccgucaaaaugcuucuuauccuucaagacccagcucuagagucaccuccaaccccuuacccaccagcccccucuccaagucugugucccacaaccccccugcucccuccagggcacccuccacccucugggccacaguugucaggagucaggcagggcaggggccggguggugucuucuuuguguucuugcacucagggcagagcucagcacagagcagacgcucaaaaaacauuuaaaggauagaagcauugauuugugggucccccagucuggcuccaggaugccagccagcugcuccuagaagcaaacggacuuuuccugggaaaucccagaggugaugaucaguaucucucccgugacucguaguucagcucuuccuccaugagccugacuaucaguggaccuuccagaaagagccccuuuuccuucucucacccacagcacagggcacugggaaaaugcccaaugaguccugcccucuggguugugcuuuggacuuuucagugugucuucgcauccacucuucagcuugaauguugcaacagccaugaaaaaagaaaugcaaagcgauucaggaugagagcaauacccuacuccaaagaaggcaaaauagaagcucagagaggucaagcauuuugcccaagaccacacagcuaggaguggaacucauggcuguccaagccccacgccucugcugaagguagagaugaauuacagcaacaagucuagaaaggugccugcccuauggucugugagucuugccuaagaaugaaagaggagccaguggguuaaagaugaggucaccaacaaacggugguguuggaguuuaccacugguuauuuuaauggguuugcaagaauuguuaauuacuaauguuuauugagccuagugcagugcuuggggcauuuugcacauugucucugaucccuaucacaacccugagagguaguuuuuuuaacucccauuuuacaggugaggucauugugguucaaggacguuaaguaacuuccccagcgucacacggcuuauaaguaaggcagccaggaugugaacccaguaggacuaucuggcugcaaaguccccacccucccucgccaucuguauccuccaaucaucuucagugcuuugcugauagaagguacggaaauacgaugccacagacuguccaggaagacagaaacuaggcagaugggcuggccauggucuccaagccagacuggaaucuccaggucuggaaugauaucauuuuucucuuuuaauaaauuaacucacccaccacacggcuuugagaggcucaaaggugaccaacucccuugggagggccccgguugauaaggaaggaaugugaauccucccaucacggaagcuucaaggaggucaaggguccaacacuugagauuguuagugcuguugguggauacuggccaaggaaauaucccaguggagccucgagaugaagaacaugaggcccccguuuagauccaaggaucagagggggcucuguaagacccaggggagucaggugcacuggagcgcgggcugcagaaaacagccugagcuccaccucggcuucuccuugcccuggcugguuguccuuaaccccugucuccuucuggaccaguuuuuguccuucccuugugacccugagggguaacagccucuuuuccacuuucuuucagcgccgacaugcucaaugucaccuugcaagggcccacucuuaacgggaccuuugcccagagcaaaugcccccaaguggaguggcugggcuggcucaacaccauccagccccccuuccucugggugcuguucgugcuggccacccuagagaacaucuuuguccucagcgucuucugccugcacaagagcagcugcacgguggcagagaucuaccuggggaaccuggccgcagcagaccugauccuggccugcgggcugcccuucugggccaucaccaucuccaacaacuucgacuggcucuuuggggagacgcucugccgcguggugaaugccauuaucuccaugaaccuguacagcagcaucuguuuccugaugcuggugagcaucgaccgcuaccuggcccuggugaaaaccauguccaugggccggaugcgcggcgugcgcugggccaagcucuacagcuuggugaucuggggguguacgcugcuccugagcucacccaugcugguguuccggaccaugaaggaguacagcgaugagggccacaacgucaccgcuugugucaucagcuacccaucccucaucugggaaguguucaccaacaugcuccugaaugucgugggcuuccugcugccccugagugucaucaccuucugcacgaugcagaucaugcaggugcugcggaacaacgagaugcagaaguucaaggagauccagacagagaggagggccacggugcuaguccugguugugcugcugcuauucaucaucugcuggcugcccuuccagaucagcaccuuccuggauacgcugcaucgccucggcauccucuccagcugccaggacgagcgcaucaucgauguaaucacacagaucgccuccuucauggccuacagcaacagcugccucaacccacugguguacgugaucgugggcaagcgcuuccgaaagaagucuugggagguguaccagggagugugccagaaagggggcugcaggucagaacccauucagauggagaacuccaugggcacacugcggaccuccaucuccguggaacgccagauucacaaacugcaggacugggcagggagcagacagugagcaaacgccagcagggcugcugugaauuuguguaaggauugagggacaguugcuuuucagcaugggcccaggaaugccaaggagacaucuaugcacgaccuugggaaaugaguugaugucuccgguaaaacaccggagacuaauuccugcccugcccaauuuugcagggagcauggcugugaggauggggugaacucacgcacagccaaggacuccaaaaucacaacagcauuacuguucuuauuugcugccacaccugagccagccugcuccuucccaggaguggaggaggccugggggcagggagaggagugacugagcuucccucccguguguucuccgucccugccccagcaagacaacuuagaucuccaggagaacugccauccagcuuuggugcaauggcugagugcacaagugaguuguugcccuggguuucuuuaaucuauucagcuagaacuuugaaggacaauuucuugcauuaauaaagguuaagcccugaggggucccugauaacaaccuggagaccaggauuuuauggcuccccucacugauggacaaggaggucugugccaaagaagaauccaauaagcacauauugagcacuugcuguauaugcaguauugagcacuguaggcaagagggaagaaagagaaggagccaucuccaucuugaaggaacucaaagacucaagugggaacgacugggcacugccaccaccagaaagcuguucgacgagacggucgagcagggugcugugggugauauggacagcagaagggggagaccaagguuccagcucaaccaauaacuauugcacaaccaucugucccugccucaguucccucuucuguaacaugaagucguugugaggguuaaaggcaguaacagguauaaaguacuuagaaaagcaaagggugcuacguacaugugaggcaucauuacgcagacguaacugggauauguuuacuauaaggaaaagacacugaggucuagaaauagcuccguggagcagaaucaguauugggagccgguggcggugugaagcaccagugucuggcacacaguaggugcucauuggcucccuuccaccugucauucccaccacccugaggccccaaccgccacacacacaggagcauuuggagagaaggccaugucuucaaagucugauuugugaugaggcagaggaagauauuucuaaucggucuugcccagaggaucacagugcugagaccccccaccaccagccgguaccugggaagggggagagugcaggccugcucagggacuguuccugucucagcaaccaagggauuguuccugucaaucaaugguuuauuggaagguggcccaguaugagcccuagaagagugugaaaaggaauggcaaugguguucaccaucggcagugccagggcagcacucauucacuugauaaaugaauauuuauuagcugguuggagagcuagaaccuggagagcuagaaccuggagaacuagaaccuggagggcuagaacuggagaggcuagaaccaagaagggcuagaaccuggaggggcuagaaccuagagaagcuaaaaccugagcuagaagcuggaggacuagaaccuggagggcuggaaucuggagagcuagaaccuggagggcuagaaccuggagggcuagaaucuggagagcuagaaccuggagggcuagaaucuggagagcuagaaccuggagggcuagaaccuggagagcuagaaccuagaagggcuagaaccuggagggcuggaaucuggagagcuagaaccuggagggcuagaaccuggagggcuagaaccuagaagggcuagaaccuggagggcuggaaucuggagagcuagaaccuggagggcuagaaccuggagggcuagaaccuagaagggcuagaaccuggagggcuagaaccuggcagguuagaaccuagaagggcuagaaccuggagagccagaaccuggagggcuagaaccuggaagggcuagaaccuguagagcuagaacauggagagcuagaacccggcaggcuagaaccuggcaagcuagaaccuggagggaaugaaccuggagggcuagaaccuggagaaugagaaaaauuuacauggcaaagagcccauaaauccugaccaauccaacucugaauuuuaaagcaaaagcgucaaaaaaaagauucccuccuuacccccaacccacucuuuuuucccaccacccacucuccucugccucaguaaguaucuggaggaagaaaacaggugaaagaagaaguaaaaaccauuuaguauuaguauuagaaugaagucaaacugugccacacauggugaaugaaaaaaaaaaaaagaggcuguguuuugucacacagggcagucauucagcaccagagcacgugauggucugagacucucuuaggagcagagcucugccgcaauggccauguggggauccacaccuggucugaggggcaacugagucugcgggagaagagcggcccuaugcaugguguagaugcccugauaaagaacaucuguccugugaaagacucaaugagcuguuauguuguaaacaggaagcauuucacauccaaacgagaaaaucauguaaacaugugucuuuucuguagagcauaauaaauggaugagguuuuugcauagcucuagcauuuguuacaacucccgaaacccccgaguuuggucccugggguaccgccuugcacacucagaagccuuugggaaggggugcuauucauuucugcucaaucuguuaacaggcuucuggcauguagaucaguggucuccaagcuuuugugauuguauauuccuauaggaaaaaaagaauugauuaugcauacccaguauguauacuuauuaaucuguaugaagauguacauucuaaaauauaaucaaccaguagaaauuuaagaaagaagauguaaaaaaaaaaaauauuaacagugcuugaauauuuccuuccaucuuacauuucugcagggauaacucauuaccaaguucccacuacaugaaugugagacccucaugaggccuagaaucauaggcgcagcagcgauucaaucauuuauucaugcaauauagacuuacugagugccuaccacuugacuucccuucaaaucaggaguaucuucuacaauauccugaugaaaagccacuuguuucauacucccagugauggggaauucauuauccaugccacuuugggaucccuucauuauucauguauucauuccuucacucauuuauuaaacaaaacuugccuagucugucuccauaaaugccccuccuccauccaugcauccauccauccaugccaggaaccuggggcucaucgcucaacguacccucuccuucaucuguuccaucuggugggucagcaccucuuuuauuuuuuucuaacuuuuauuuugaguucagggguacacgugcagguuuguuacauagauaaacuugggucauggugguuuguuguacagauuauuucaucacccaagcauuaagccuacuacccauuaguuauuuuuccugcuccucucccuccucccaacccccacccuccacuagaccucagugucuguuguucccuucuuuguguccauguguucucaccauuuagcucccacuuacaaaugagaacaugugguauuugguuuucuguucuuggguuaguucgcuaagaauaauggccuccagcuccauccauguccccgcagaggacaugaucucauucuuuuuuauggcugcauaguguuccaugguuguauauguaccgcauuuucuuuauccagucuauaauugaugggcacuuacauugacuccaugccuuugccauugugaauagugcugcagugagcacucaugugcauguguauuuaugauagaaugauuuauauuccuuuggguauauacccaguaauaggaucagcaccucuuuuagauucuacucacuaaguguuuccuaaaucuauguuuccuucuauguccaaccaucgucugucaugggugccuccaauacuaacuacuaccaucucccaauucuuauucuucacucugcagccaacauggucuuuuaagaaugcaaauacauucauggggaggcuauaaacauagagaacuguguucaggagccaagacuuuaggauuagguagaccuggauuccacuugugguucagccuugggcucuuauuugcuguguagucuuggguaccucaguuauccuuucugagucaacauuuccuugucugcaaaauggggauaauaaugguaucuaccucauaaaauuguuaauaggauuaauguaugaaagcaucuagcacagugccugguacauaguuggcacugaacauguacuagcuuugaugaugaugaugaugaugaugaugaugaugaugguggugguguuggcagugagugugaugggggcauccuccaagggaaacccuuccauagugucccaccccucuugcgauaagguucuacagcuguaacauggcuugcaagacccuucaugaucuggucccugucuugucucuaugucucccucucucugcuccaggcucauucucuacccuccagccauuuggacacaagaaccuagacagaucccagaagauauuucauucugccuccagugcccacucuucccacccagacugcacccccucacuaagugcccugaacuuggaggaaguuguccacaagugcccaagggagcucacuccuccagggaauuuuguucacagaugccugcauuacucaagggagucugcaauccaggggaaaccacaugccuggaaaccugagcagggcucuuagcaggcaaaaaaagaaaaaaaaaaugcugggagagccuccccagcgaggcaacaggagcagccccucaacuccugacccucucuggcuccagcaagcuggcgcaaugagaagaaguccaggugggcucaggagaccaggcaaggggccuagcuccugagucuucccuggccacagaggggugagaauaggaugcagagaugcaaacuggacaccagaugaccucaugggaauucaugcuagugcuggagccucuugagcacagccuucaugacucagagggggagugucuccauuguguagaucccagccaugugcugcauuaucuccuuguuacccaauuccugacccuuauguagcucugauccuucaccaaggaugaggguggggagcagggaugagcaacagaggucaugauuuggcaacagcaauggcugaaaguuuaaucguuuguucaugagaguuuuauucugguuuuaguuuuuuauuuuguuuugcuggcugaggcaaaauagucccaggucaaagggaccccaucaaaauacuucacgcucacaaccacucugggaguuugcaugaucacugguucaugguauggaaacuggggcccagagagggaaguaacuuuccaaggccaugcaguucuuaaggagggugcucuggaaauucucucuguucuugggguguucaugccuuaacaaaccgaggauacaaauucugucacaggaaaaguccucgaagugccuucuugcaugacgagcuuaugacccagggcuugggcuauuucugccacaauaaaagcuuugcaucucauaggccuugugcauacuugcuuccugcagaucaccuucccagagcugguggauguaauucacaugccguagaguuuacccacuucagcuuuuacuuaauaaccaauucaugcaaccaucacuacugucuaauuccagaacacuuucaucaucccccaagaaaucgcauauucauuaacagucacgucccauucucccuuccucauggcuuugggcaaccacuaaucuuucugucucuagauuuaccuguugugaaagaagccaggcacauguuguaggaugcugucucuguagagccuauaacacaugccuuuugugucuagcuccuuuuaccuccuaacacugagcuagaauguuuaauuguugggggagaauuuuggggaccaguccauggguucccuaccaugccacuugugugaucucagcaagccacuuuacucaucuucccucccaccaccuuuggccuuaguuuucucgucugucaaguggagagauaauaagucaugacucuaacagguuucuggcauguagaucaguggucucgaaggacugccuuaugugauguugaugcuguccucuauaguuuacgaaggccccagcaccaacaguacaggggcuuggaggcagguuccugguucacaucuuaccucugccacuucccagcugugggaauuugaagaaggucagugaauuucucugagugucucuuuucucaucuauuaaaugaagauccaaguauugugaagauucagugagauaaagauguugugaugaguugaagaguaucccuccaccccaacucauguccacauggaacuucagaauaugaccuuauuugggaauagggucuuugcagaaguaguuaaauuaagaugagguuacacagguugagcauuccuaauccaaaaaucuggaaucacaaaugcccccaaauccacaacuuuuugagcacugacaugaugcucaaaggacauguuauuggaacauuuuagauuuuggauuucuggauuaaggauggucagcuaguauguauucugcaaauacuccaaaauccaaaaacauucaaaaugcaaaacacaaaaacuucuggucccaagcauuucuggauaagggauccccaaccuguacuggacuaaggugacccuuaaauccaauaacugguguccuuauaagaagaggagaaaaacacacagagacacagagagagauggaggcagagacuggagcgaugcuuccacaagccaagaaaugugaaggauugcccagaaucaccagaagggaggaagaagcaaggaguggcuucuccuucagacccuccaggaggaaccaacacugccagcaccuugauuuuggacuucuggccuccagaacugugagaggacaaauguucauuguuuaggccacuuagguuuugauacuuuguauggagcccugagcaaauggauacagguauuuuagucuuuuugagcacauacucaccauccaguugcccauuaagguaccugcaggccccuucucucaacaaugagagggcacacuggauguuuuucucaggucuuuuuaggguuagagauacuuguucgugcagauuuccuaagaaauaauaccaaaugccaucuuacuaaauuguagaggauuuuuuucaaauggaagauacugaggccuuucccauauugcgggccagcccaagcccccagagcgugaaucaugggccccgggugcugaguguaaaugcccauccuugcggaccuaggaccugggaucugcugauucuuucuuccuuccccagaaccaaaaggcaggccaauucaaagagucucagaccaggauucaaauaaauaaauaaauggccucagagcccagcucccagcuuccagacagcccagccaccaaccccacccaggugggaggcuacuuauagacaacccugaaagauggucaaagaugggguucugagacucucuggaugccucccuucaugcugagucacccuuugccguccacucagccggcgagcaaugagugucuguuuccucucuucaguucuggccaagacagagcacggugugugugggcccuccucauaaugacacuaccaucgucuugugcaacaguaaaaugauaaaaucaggaacaguuacuguggggugccuacuaaaggccaguugcaucaccacauuaucccaugugauuaccaaauucuacaacaugcuccacuuuacagacugaggcucuggaagguggaauugaaaaugguccagauucuccaauugcacacaaaaaauguguugcuuucuaccauaauuucccauuaaauugucucuuucacaaaaaaaaaaaagaagaagaagaagaggaagaagaaaaugguccagauucaccuucucagcagugacggagcuagggugucaacgcugcugaggcagcuccacaccguacaccugccugccuggacuuccaaaucagaccuuaaggaccagggacgggacuuguuuuugcagucagauuugcucacugucuuccugaccucccuaaguacaguagucccccccuuuauccaugguuucaauuaccuguggccaauauaggucugaaaauauuaaauggaaaauuccagaaaaaagcaauuaauacguuuuaaauuaugcaccagucugagcagugugaugaaaccucgccccguccugcuuugucccaccugggacaugaguugucccuuuguccaauguacccaugcuauauaagcuacccaccauuacuguauagcaaaaagcauaguguuauaagguuugguacuaucugcaguuucaggcauccacugggggucuuggaacguuuuccccaugccuaagggggaacugcuguacagagccucauuccuuucuguuuugaagaccacuggauccuguucuguuucuucauagaacucacaaucacgauccuguacagguuucucuguuagucugucucuaucccaagucuguagcccccaugagggcugggacagucaagaaugaccccaagucuucaagaaaaguuaugguuaucuucagcaauuucaguuccccuauacucagaguucugcagcucacagaagcaauuucaguuucccuggauccggaguuuugcauccccaucauggggaccaauaugauuuauaugaaagauaaaugcucacagcaucaacuuuauaauaugguaauccaauuccaucucuuuaaaacaucauaaaggaacuacugguuucuaaggaaaacaucuuauuccauacccccauucuuugcuguacacauggcuuaauuaggcaucuaggcugauugaaaaaugaugaaagagcuuuuccauauggcacuugcugcuagauuaagaaagaaggucauaauacugagaaaagaugcaucaacauguacauauucaucuuauccugggaacaucuauacagcacgauacugacauuucccacacaguuauuugauccucacagcaacucucagaagcaggcaggaccagagcauuccaggaccaccggcccugcucucuucuggaagcccugcaggugggcuccaccugccgugagcauuuaucuuuagaauagaucaugcaguuagagcuauaaaacuccaaguacagggaaauggaaauugcuuccaugagcugcaaaacuuuaugcaccugcucucucaaaacacccuuacucugggcuaaaacuaucauucaauucucuucccugaaccaaaccaagagcugcacagggccugcuggaggguaggggauaugggauauucauggauagcgugaguaagugggguguggggcuugaaccugggcuuucugaccccaaguuccaagugagccuuccacaaaggcuuaugaacaugugugcguuauaauacaaaugcugguccccccaccugcgaugguuuucucagcuugcuugccuuccaaacuccuauucagcccugaaaaccuaguuuaaauaauccccugccaugaauucuuccccaacucugcauaauagucgagguucucuagagaaacauaaccaacagaaaauagauaaauauagauagauuuguuauaaggaauugguuuaugcaauuauggaggcugagaagucccaccaucugcugucugcaagcuggagacccaggaggaccagugauguaguuccagugggauugugaaggccagagacccaggauggccagcgagaaggugggagaagacagaugucccagcuugaaaacagccaggcggagagaaccaauucucccuugcugcuccuuuugguuguauucaggccuccgacagguuggaugccacccaccaugucagggaagacaaucugccuuacucagucuaccaauucaaacauuaaucauucaaauuaaccuaggaagguuaaacucgcucacggcccccccagaaaccauguuuaaccaaauaucugggcaccccauggcccagucagcaugacacauaaauuacccaucccacuccaccucgagcagaacucauuuuuuucaaaccucacacucagacacagccucagaacuucauugccacucugcuuucuacaacauguugucacuggaugucagcuugucccuguccucagccaucccaagagcuccuuaagugggcacggagugggcuguguucgucuaugcacccccugugcccacacagggccuggcccccacaagggguuuggcacauguuuguugacauaagacaagcuauugcuauuauauacuuauuuguaauacauaguuaugaauacacucagcaaauauuugagcacgugcuacuuaucagcccuguuguacaaguugggaagaugaaccuaaucaaaagagauaaauccguugccugguggagcagguggcaauagggcugugaagagcaguggagcaggccaagaggaggagagguuauuucaggaaaggucucucugacaagggaggauuggugaggaccagaaggaccugggggagcaagcauggggcucucgaugggaaggugcuccauguaggggaacggacagugcaaaggcccugaggugggagaggaggugguacauucaaaacagagaggaaaggcugggcauaguggggagugccuguaaucccagcauuuugggaggccgaggugggaggauggcuugggcccccaggaauuugagaccagccuaggcgacauagugagaccuugugucaaaaaacaaaaaacacagcucgaggaagccagggcagccaggcaccaugagacgagugcucugggaggcggcugggucugugcaugugcccugggagacagcuggguuugcgcgugugcucugggaggcagcugggucugcgcaugugcucugggagacagcugggucuacgcaugugcucugggggacagcugggucugcgcaugugcaaccuugccgccguaaggucucuguuuuccugggccugagacagcagcagaggaguucgagaagagacaugagacggccuggcuucggcuuuaggagacagagaaaugcagcugauuuuccugguacaagccccuucugagagcaugugcacuccugggauucucgaggcucccuaaagaggaaggucucgugauccccugcucugccugggcgagaaggcuuucaucucccaaagcagggccacacaagggcggggaggaaccccuggcccaguggagcuuuaucugcuaagugggcaccuucccaccccagagccagcacccaggacccuucacuucugggcuggcugccaggccauggcagcaccuggagcugccugaaugcccaggacgugcucauguccacccugucauccuguagaucuccaaguguuugugcuuugcuaaauguauauuugggauuuucugcuuaccuccccccuuacacuuagacaccgucuguucaccccauccauuccccgcuuccuaugugcuagacacgcaugcucuucuaggguggcauuugccuggcaccagcugggugcuccauauguguuuuuaaaauaaaggggaaagcacucaggccccgugcuuagagaaaagcagaggauuacaccaggacuugagugauggaugaacacugaacagugcgaggaggaggaggucauuuucagcaaaugcucacaagcaggaugcauucagagcccaugagucacucgcucagcauggaggguggcucuggguguuacagcaagaccguuggggagcucuugaauuccaagggguugggucguuguccuguggcaugacaaaauccagguguuuccagaauauuaauccagcagaaggauagacugaaggaaaggaaucagaaagccaggagauugguuuacaguccuuuguugcagacuuguauguacguugcaugaguuucuaaacccugugaugggaagaaaggugugaccgccaacagccuuggucgggggugaaaggacacgagcuggaccacagugagggugcugcauuucauccuggcaagaauucugcccagcuguggcuuucuguccuccgucuacaauugggagaauacuggagacaucagaugucguguaaggacuaagaacgaacccuggagaggcucagcaucugggugcuauuuguagaggucugcugggugacauguacuagagucuuucauuuugaagaaccugcuggauaugacuagaaaaguaaaggagaaaaaaacuccaggacugauggaugagagaacugaaaaguggcccuugaugucacagugggcacugggacugcauguccccaggggcugcaaacuccagagcucaccuucccuugaauacacauccaguauggcccaagcccacgcauacuacagggaguccagccugccuggagugcccccucacuaguauuuaggacaccccagggaagguuggccuguccucuauuuccagaggcaggccuuuauccucugugaccaccucuucacccaaguacccaggggacuucaucaagcacagcacacaucagacuguaagguuuaaccaaaccuuauagaggcugugggaauuacaaacaacuaaauucagaaaaggcaagcauuggccgggcacggugucucacgccuguaaucccagcacuuugggaggccaagguggguggaucaccugaggucgggaguuugagaccagccuaaccaacauggagaaaccccgucucuacuaaaaauacaaaauuagcugggugugguggugugugccuguaaucccagcuacucgggaggcugaggcaggagaaucgcuugaacccaggaggcgaagguugcagugagccgagaucgcuccauugcacuccagccugagcaacaagagcgaaacucagucucaaaaaaaaaagaaaaaaggcaagcgaagccucagaagaggguccucagugccuacccacuucuuaguccccugcuaucuucugccacacuauagggaccugcuuuucuuucacagauuugggguccccucccccugcccucagccccacucccuuggccccagagacaguaggagacccucugcuccccugagcccgggccugucucgcauuucccguggagaugagcaacaaggggaaacgugggucuucuuaaagaacuuuccuuuccgcccuccaccaccuuggcaaggcagccagaugcaucuccgaaguccagcucacucaggccagcucucuucacagacugucuuccagcaagaggcaaagcagagaugagaccugcacgugcucuuuguggcagagcuggccuuauacgcacuccugggugaauaaacagggagacaucuccuaagaacaaacgcuucucagaaacaguauagucuaaacucauacugaagggagaauaagccagccacgggcuggagagacccccgccuacauuacuaaguaacaggaaaggcuaagauuuggagccuuccuccgguucagaucuaucccgggaguaauggaagaugcuugccuguugacaauuuuuuuuuauuaaaaaucccacccaggaggucucuccugauaggaggggaccauccuauccucuaaggcaaauuccagcuucuucccugaaauguacauccgcuacugagccucagaaugcuauuuguuccaccuacuuccacaguuuuaaggucuucagcaacaggagaagacagcaggaaaacuugaagugcaguuggcucccgcugagaugucacuagcagaaaaagggaacacaagcaaaaggcaagauucuaaagacagaggugacaccuucugcuccaaacauuuggagggucaccuuuccagaagucagacucgaaguccugaauucuggcaugaaugaguucuccuacguguaggggguggccuggaaagaucuuaauuuguaaguugacagguaaggggccuucaguuggagaaucuugucaccugauucucaaagccaaaaauaucuu

SEQ ID NO: 17144 - RNA, 1323 nt, Homo sapiens
agacccuuaauuugguaacauucaucaaguccagggauuagguaccccccaaucuacgggaguaaucauuuagccuaucacaauagcauuuauuaugucacaaagaauugauaagaaagccaagcuucuugguucaaugcuguuuuaauuccgccagaaaaguuggaagauuucuuuccuaugggaugaagauauuggagcaagacuuuuaggggugcauuguuuauaaaguucccagaccuugguccugaagagccggcccacaaagacauaaauuacuggauucagggagcuguuagugaaggcaaagaaguuggccaauugcaggcccaggucaaugaaguccucccaaaagcagccucggacugcuugcaccuggaauaagaauuccaggaaggcaaagaagugguaaggggcccagcagaccaggaaggcaaccacgagcgugaggaucagcgcuguggucuugcuauccuugcggcccccgcaccuuguccugcugaccuccucccgcguucgcagggaggccaggaugugguaguugaagaagacgaucgcagccagugguaggaggaaacccagaauauuuaacuccacaauccuugcaaagugccaggccucaugggggaggagcaggaugcaggcggugauguucagaucugggacggcuuggauggaucgcagcaggaauguggggaugcucaagaggccccccacaacccagaugagcacgcaggugacccgggccugccuccgccgcugcugccuccggcuggccauagggugcaccagcacgcgguagcgguccuggcugauggccaccaccaggaagaugcugaugaacaaauuggccuugaugaccccguugaugacacggcagaggagggcuccgaaaggccaguuaaacugguuccagauauucucugcccagaagggcaagcccaagacaaacaccagaucagaggcugccagguuggccagguagauuucugccacguucaguugccgccggggcaggaggaagaccaacaggacaaaaagguucccuaggaggccgaagaaacagauggagaugauaaauguuggcagcacucugugcagcaggucccaggcuucuggagcauugucacaggccguagcauuuugagggaagagcuggcucugguuggaggauuggagcucuagagggggccaggaugaugccaugcacagugaccugaaaugaacagaagguagaauaaaacaggaaguggcagacuacagccuaugagccaaaccaaccugucaccuguuuuuggacaauaaaguuuuauuggcacagag

SEQ ID NO: 17145 - RNA, 82129 nt, Homo sapiens
gggucucgugaacgcgccaggagcgucccuacagccgggaacgcgccucgcggaugacaacaaauucgucgcgcggcggcaguggcgguggcugccucagccccugccgccuccucucgcgcucucuugcacucucuccgagccgguugggacccuccucggaaguccccuggccuggggccaggaggaccccucugcgucuugccuccgccaggcccagcgcgagcggugcggcgccggcgauggggucucccugagggacucccggcaccaaauagggauggaggggccgccccaggcuuaggccccgccgcggccuggagccggagucgcuaccccgaggccggagccgucgcaacccgcagccgcagucagcccagcugccagcagucacuaugccuuggccguuuucggaguccaucaagaagagggccugccgguaccuccugcagagguaccugggccacuuucugcaggagaagcugagccuggagcagcucagccuggaccuguaccaaggcaccgggucccucgcccagguccccuuggacaaauggguaagagcugccggcggcgagccgggcggggcucgcuccccucuuuagggcgcuuugaaccagugccauccaagauuggugacagucagucccuccuugggaauuguuuggacccgagugugacacggcucagagaaauguguuagaguguuguuuaaucuguuucuaacaaguuugcucuccuaaaucacguguuccggaaacuuuaacagauguaauggaaucuacacugugggaauaauugagucagugcuucgggggucugugaagcaggcucaauagguccgugggaggaggugaccagaacugucccucgggaugugaggggccgcaggguuuuguggcaaacaaacccugccuugugggaugacauucuggaaggauuaaggaugaagaggaccuuuggaugucagaaucccuaguuauuuguuuuggguuggcugcuugcgcaccauguuugccuuguuugucaucgugcagcguuugccaucuggaagaaaguuaggugaaggccucuugugccgguuugccugcuuuugcuugauuauauguuuacaagauagguuuguguauccagccugugaauggucgucuggcccuaguagugcuguugaguuaugccucuuugcuccacgugacagaucguaaaagcagguguugcaaaagcgcugaaguugcaauuuucagacauuuuaaaaccugccuucuacuugucaucuagaggcugugaauucacucauugcuauacaggugcuucaucugaauuucgacucaccacaugcagucguaccugcauuuguguguucaaugcauagcauuuuacuuaaaguauauucacuuuuggguuugacaggaauagagugacuucuacccuuugcccaacccuuacuuccuuagccacagaaaaucuuaaauuauggaaauaccuuauuaugacccuuaagcgaauuugugcuagagacuauaaaucaguauauaauuuuaucaguauguaccugacauaaacuagggagaggacacaagauaguggaaagagcccugguuugagagcaguaagacccagucgcucaccaggaggugagaguccuaccccuggagagacucuccagaccgccacaauuagccgagugauaauggacuuagcaauucaccugaguucaguaaacacuaauggagcacacacuucaucucugugucguccgucuuaugguauuguauuccuguaauucuuccaaaagauagggauucugaaggauauuuuugaauucaacaacccaugauucuauacuuuugauacaguuaugaauagguuaucuugaaaaaagaggguucaggauuuauuaaugccuuuuguggguggaagggcuuuguaugcauuauccuuuaaugacuuuaacccuauaaggugggcauuaauauuuccauuuuacagauggaguuaagcaguuugccccaucacacaucuagcaaguauuacaucacauggccuaagaucaaaagaaaggcaguuaauguuuauugaguauguauuuaugucaggcauuguacuaggcacuuucauuugugagguuuuauuuaguccuuaugggaaaucagagguagugauauuugaauuuuauaguuugaguucagaaucauuggcaaaaugauuuauuacuaaacuuaaucugaggaugauguuuuguucuugaugggcggguuuuguaaacuaaaaugauaaugucaaagcauccaguaaacauuugcuguugcugauuuauuuucaugugcuguguugaugguuaggauaaaucuuagugugacccuuagauacagcuguucagaguucugauuccaaauucaguuuauuuucacacuugauuuuuuuuuuuuuuuuuuuuugguagaggauucauucucuugcuuuguugccaaagcuggucuugaacuccugguuucaagugguccucccacuucugccucccaagugcucagauuacaggcaugagccauaggacccagccagauacuugauuuuaaugacuuacaugacugaaaaaaagguaccuucggagauucacagauccuaauggaaaaacugaugcuaauugaagaauugcuguacuccuacuguuucaauucuaaaugaucaauuaugcaaagaauuuuguugaacucagcaaugacauuccuuucauuccugaucucaauuaguuuuucuauuauggcuaauugacauugcauauauacacacaauuagguuuaaaauucaguuuuucaagcucuuuguucagaagacuuagauugguuggaauagucuuuucauguuuuuaaacauuuuguaaacuauauagauaaugacuuaaaaaauaagcaauguuuuuaauagacauuguuuucagcaacaaaaucauggaacaauggaaacauuuccaaauacaguuuuucaaauguucuccucauaguacaaguagucuuugaaaagugguugcuuucuuacucauuauuaaagugcuaucuuuauuuugaaaagacagauuaaguauguuuuguuuuuuggaaaauaucugcuagguagcauguacuacugauagucauugucauaaauacauaaauagucaguggagaauucuucucuguguaaaaggaaaaugcuuaucuuuaaauccaacccuuaaacacuuggccauaggagaaaccaggaaaccagaagguaauugccauucacuuucucuuuacaaagauucuacuguuuaaaggucugguuuuauucuauagaauguauguggaaauguuucagugugcagaaguggaaggaacauccaacugagggcaccacucuuaauccuucucuguuguggaacuacuaguuuucucuuuguaccaguuugauauguggcuugaaggaaggugccagugcccauuuguauauuaaauauaaguacaacuuuucaaucuaaauuuggaaaauuuaauauagaaugucucauuuuccucucacauccuuaugaaucaucugauaauacuuuaggauauaugcauccaguuuuggagauuacuaccuuaaacguggcaugaaguggagggagaaauagaggcaagggguuugggauuguuccaucauuggaauagacugucuaaaaauuucauaaacuccuugucccuagaagugguugaaauggcaaaauguugaaaggaggaaauucuauuuggggugggaaguuggauuuaaugacucauuccuuuuuaacucuaugacugugccuuuauuuuugauuuuuaaauggaauuucuuucauuaaucgauucaguacauuuauugagcucuuagcaugugccacugugaggggcugggggauauagcagugaacuaaacaaagacccuuuucuuacaggagcucaagaagauacacauuaacaauuuauuacacugaggccuuuuauuuuauuuuuuuuuugagacagggucucacucugucacccagacuggagugcaguggcgugaucuaggcuuacugcagccucaaccugcuaggcucaagcgauccuccuaccucuccuccccucccugcaguagcugggacuacaggugcaugccaccacaccuggcuacuuuuuguauuuuuuguagagacgggauuucgccauguugcccaggcuggucuugaacuccuggacucaagcagucugcccaugucggccucccaaagugcugggauuacagacgugagccaccacgccuggccacugaggccuuuuaacuucaguuuaagaauguuucgauugcugcuuauauucucuugguguuuaauaaaauuaucuucaguucaagaaacauugauuacugauuauuugucaaaggucaccuggagacuagaguguuaccuucacuuuuucuguuuauaugcgugaaacucauugaugauaauugaaagcaaaauacccuuaaacagaagaauaaaaagcucuaaaggacucuaugguggggcauuuauuugcugaguaguucaggugucuccacuuuuaguuuaagaguuauuuucucguuagcauaguggugacuaaaaaaaaaaaaauacuugauaggacuggugaggaaacacuucauaggacugguguggaaaauguugcuugagccaaguagguugagaauuuuuacuacucauauacuauaguagccuuggauuuucccagaaugacugaauuucaagguaccuuaugcuacaagauauaugggauuuugcucaagugguuauaagacugggcauaaauauaaccuauuuaaacaucuuauacuuagggaaauuauuuuguagcuuaguggugcaauguaaauucuggaacuguugacucuccaaaacuguuaacauuuaucaguuuuuuucuuuuuuuccuuuucuuucuuuagagacagucucuguuaccuaggcuggaguacaguggugugaucagcucacugcagccucaaacucauggguucaagcgauccuccaauccagccuccugaguagguggggacuacugauguacaccaccacacccaguuaauuucuuuuaauuuuuguagagaccggauuucacuauguugcccaggcugaucuugaccuccugggcucaagugauccucccaccucagccccccccaguuucuggaauuacaggcaugagccaccguaccaggccccuuuaauauuacucuucacugcuguaauaaaccuuuuuguauuuagagguuuaacuuuauuucaacuucucugccacaaaauugggacgaaaacuugguguuuacugagaagagaguuccaucaagucccguuucucucauaguugucuaagguugacaguuugcagaagcuaagucauugccuccauauguuuuaaacacuguuagguuuuuaauaguucauuuuuacuauacaauuaauauaugcucauuacaaaaaauucaaacaguaaagaaauauaugagguaugaaguaauagagcuuaaucccaucucuuccagagauaacaauaugguacaaaaguuucaaacuuuuaguuguggaaauacuuaauacaugaagcaagcaguucuacuuaccuuuugaagucuuuuaugaugggccauuuuuuuaauggaaugugucaaacauucuuaaaaaaaaaaaacuaugaaaaaaucugaaaaacacaaguagagggaagaaccuugaugaccguaacuugugguaccuaguugauggugaaauaggaaauucuagagaaggagcagguuuucuccacugucuggaguugggagugggaggaggagauugagauuggacagagaauaaguuuuacuauauugauuuuugagggggcuuuagaaugugggggcuuuagauccagguagagaagcucaggaggcacugggaauauacguauaggaagauugcaguuguaaagauaugggaguuaucagaguaucaauagugaauaacaguggcaggagauggaacugcacaaagugcguggguaguaaguagaucagcuugagaaacaaaaaaggccgaagaugaaacuuagaugaacuccaacauuuuaaauuguaaaggaucagaaaaaagauugagagagugaaguguuacagaagucaagggaaguuagaauuucaaaaaaggugagugguccuaggaacuagguagagaugagaauucaauaaagaugaggacuaaauauuguuuauugcauuugucauuuuaauggugguuacaagcaguuucagaggagcugaggguuagaaggucgcuuguaguuugcaguuugagcagauaacuaccuugacagagaaaaugggguugauggcuagggggaacauggagcaagguuagggguuuuaguuuacuuuugaaaauaauaaugaucauuuauuaaauaccuuccaucucuauauacuguacugugugggugcuuuuacauacauuauuuuacucuaaauuggguacuaacuuucuguuuacugugagguuaaauaacuuacucaagcuuaguauuaaacagugcagcaagguuugaaaccugucuuucugacuuuauauuuuuuuuuuguacaccacacugccccagauucaagaaacuugagcuucucagacauaacagcacuggguucaccugggaauuugcuaacauucaggcuucuggccccuuccauacagauuuuggcucuagaaauucaagaaucugcauuuuuaauaaacauccuaggagauucugauacaugugauccuugacugcauuuuuaaaaauacuugcacuaaaggaauggagaguuuuuccauugcguuuuaaaagcuuguucuaugagccagcccccaaaccaguacuacguuaaaaaaaauuaugauauguuaacacaugauuuugcuuagccuccugcaaaaucuuccaugugaaaauacauuucucuuuuuuguggguuuccgcagugauuaauugaagaccuuuugcaaguuacuuaguuuuucugauccucaauugccauauuuguaaaguaggcacaaaaauaccuaauucggaggguuauuaugaagauuuaaugcagguguaaauguagguauaaaauaguacacucuaguguccuguuuguaguaggugcugaugaaauguuaaucuaaauuagcucaugcacuuuuuuuuuuuuuuuugagccgcauucuugcucugucacccagguuggagugcaguggcgugaucucagcucacugcaagcuccgccucccggguuuaugccauucuucugccucagccucccgaguagcugggacuacaggcucccaccccgacgccuggcaaauuuuuuuguaucuuuaguagagacgggguuucaccauguuagccaggauggucuccauccccugaucuuguguucccccgccucugccucucaaagugcugggauuacaggugugagccaccgcccucagccagcucaugcgcguuuuuaugcucugucuuaucucgauuugaauucugaugccuugguuuaaacuaauaaagauguauucuuugccuaguuaaucuauggaauuacguauuaagaagaaauauauaauuuaauguuugcuuuuuuuucauauugucaagcacaccuugaguuccuuuauagagcucaucauuguacuagguagguacugugaaagauaaagaccaauggcccgcauuuaaaaaguguuugcuuaguaccaggaacuauuaauauguugguaguuuuacauauauuaccucauuaauggucacaguaacucuguggaguuacuauuucuauuuuauggaccaggaaauugagacuuggaaauuaaggauuuguucagagccacccagcuagcuaguaaguaaccugaacauaugcuguuuuaaaggagugggcuucucacaccugcaacuaucugaucuuugacaaaccugacacaaacaagcaaugcggaaaggauucccugauggugcugggagaacuggcuagcccuaugcagaaaauugaaacuggaccccuuccuuacaccauauacaaaaaucagcucaagaugaauuaaagacuuaauuauaaaaccccaagcuauaaaaacccuaaaagaaaaucuaggcaguaccauucaggacauaggcaugggcaaagauuucaugaugaagaagcaaaaagcaauugcaacaaaagcaaaaacugagaaaugguuaucuaauuaaagagcuucugcacagcaaaagaaacugucaucagaaugaacagacagccuacagaaugggagaaaauuuuugcaagcuauccgucugacaaaggucuaaaauucagcaucuguaaggaacuuaacaaauuuacaagaaaaaaacaaccccauuaaaaagugggcaaaggaugugaacagacacuucugaaaagacaacauacaugugaccaacaaauguggaaaaaaaagcucaacaucacugucauuagagaaaugcaaaucaaaaccacaaugagauaccaucucgcaccacucaaaauggcuauuauuaaaaaguaaaacaacaacaauaacaacaaaaacaaaacacacgggcuggugagauuguggagaaaaaggaaugcuuuuacacuguugaugggaguguaaauuaguuuaaccauuauggaagacaguguggcgauuccucagagaccuagaggcagaaauaccauuugaccuagcaaccucauuacuggguauauacccaaaggaauauaaauuguucuauuauaaagauauaugcacgcuuauguucauugcaguacuguugacaauagcaaagacacggaaucaacccaaaugcccaucagugauagacuggauaaagaaaguauacauacacacaguggacuacuaugcagccauaaaaaggaaugagaucauguccuuugcaggcacguggauggagcuggaagccguuauccuuggcagacugaugcaggaacagaaaaccaaauacugcauguucucaagugggagcugaaugaugagaacacauggacacauggugggaacaacacccacuguggccugucagagggugaggagugagagcaucaggaagaauagcuaauggauacugggcuuaauacuaagugaugggaugaucugugcagcaaaccaccaugggacacauuuacguauguaacaaaccuggauguacuacacauguaucccugaacuuaaaaguuggaaaaaauaaaugaaggaguggucuuuaaccauguuugcucaauuaucucugaaauuuuuuuuaaaaaacuacauauuccuuguauguuuaaaauugacuuacuuuuuauuauaauuuuaaauaguuguagagaauaacuuguuuaaauauugauauuaaaauauaacuuuuuucauccagugggauuuaaaaaucguacacauuauccguuaaaaaaugcuugaacaaucucuucauuaaaguuggaaauuuaacaucgugucuuuuuccauugaacuccuguguccauuuuacuuugcaagauuccauuguaauuuauauaguuuaugcuugucuuuuauugaucaugcugccauuucucuacaauaaaaacauauaaauugaaauuguuuauauuaaauuuuuucuguuggcauuaggcuuucuuuugcauuaagcaaauauuuucuaguguaacauuuuaauuccuuuaaugauuuauauauauauauauauaaaauaugaaauuuuuuugagacagauucucacuguuucgcccuggcuggaaugcaguggcacaaucucggcucucugcaaccucagccucccagguuccagcgauucucguaccucagccucccgaguagcugagacuacaggcccaugucaccaugccuggcuaauuuuuuggguuuuuaguagagacaggguuuuaccaugcugccuaggcuggucuugaacuccugagcucaggcaaucugcccaccuuggccucucaaagugcuaggauuacaggugggagccaccaugcccagcccaguauguauuuuuaaauuguuucuuagugguugcucuagggcuuacuauauucauuuuaucaguacagucauguguugcuuaacgacagggauauguucugagaaaugggucauuaggcaguuuuguugugugaacgucauaguguacuugccuaaacccagugguauagccuacuguauaccuaggcuauaggguacagccuauugcuccuaggcuauacaccugcacagcauguuacugaauacuguaggcaacugugacacaaugguauuuguguaucuaaacauagaaaagguauguacaaauauggcauaaaauauaaaaaauaaaaauuuuaaaaagauaaaaauugauauggcuguauggggcacuuaccaugaauggagcuugcaggacuagaaauuccucugagugagucagugagugaaugugaaggccuaggacaucacuguccacuacuguagacuuuauaaacacuguacacuucggcuagaauaaacacuguacacuucggcuagacuauauuaauaaagacaucuuuuuuuuuucaauaauaaguuaaccugagguuacaguaacuuuauaaacuuuaaaaaaauuuuugaacuuuuuguuucuuuuguaauaacauuuagcuuaaacacacauuguacagcuaugcaaaaauacuuuuucuuuauauucuuaugcuauaagcauuuuuuuguauuuuuaauuuuuuuuuuuaauuuuuaaacuuuuuugucaaaaacuaagacgcaaaaaaacacagccuaggccuacacaggguaaggaucaucaaugucaccaccuucuaccuccacaucuuguuccacuggaaggucuucaggaacaguaacaugcauggagcuguccuuuccuaugauaacaaugccuucuucuggguaccuccugaaagaacugccugagccuguuuuacaguuaacuuuuuuuuuuuuaaaguaggaguauacucuaaaauaaugauuaaauuguauaguauagguauuaaaacagaagccgguagcauaguuguuuauuaucacccucgaguauuauguacuguguauaacuguuugugcuagacuuaugacuggcagagcaagagguuuauuuacaccagcaucaccacagacaugugaguaauguguugugcuacauugccuuaugauggcugcgaugucacuaaggugauaggaauuuuucagcuccauuauaaucuuacaggaccacuauccuauacauggucugucauugaccagauguccuucugugaugcauaacuuuauuuccuucagauaaucauggggcuuuaaguguuacuuuucuucuggauuguguuguaauuacaauuauuguuaaguguauaguugaucaaaacaguauaaauuuaugcauuuugauaagcauaaaaauuuuuuuuucuuuuuuuuuuuuuugagacaaggucuugcugugucacccaggcuugggugcagugggugaucacagcucaaccgcagccuugaccuccugggaucaagcgauuauccccaccuuagcccgccaaggagcugggacuacaggcacgggcuaccaugccaucuaauuuuuuuuuuuuuuuuugagacggagucuugcucugccgcccaggcuggagugcaguggcgcgauuucggcucacgguaacuuccgccucccggguucaagugauucuccuaccucagccucccgaguagcugggauuaaaggcgugggccaccaugccuggcuaauucuuguacuuuuaguagagacaggguuucaccauguuggccaggcuggucucaaacuccugaccucaggcaaucugccugccucagccucccaaagugcugagauuacaggcuugagccacugcgccuggccaauuuuuguauuuuuuguagagacgaguuucaccaugucucccaggauggucucaaauuccuggacucaagcaauccuucugccucagucuccaaaauugcugggacuacuggcaugagccacuguacccagcaaacauaaaaacuuuuacuggaaauaaauuucuuaaugauagagguugguugugauccccuccucccuaauuuguuagugcauccauaggugaauauacuuauagcuggaauucagcagggcucggcacacauuuuauucuaaauuaaaauguagauacaagcuugagaaauacugauguuauaaaucaguagaugagaauugagagauuuugcaggagcaacaucacugaguucuuugaauuucugagugucaugccaaaaaaaguauaagaugggaaaagauagaaaauguacugcuggcccugucuggagguuuuuauaccuuagacaguacauaagggagaauuucugaagagaggaagaauauggcuauuuuggcuaaaugggagaaggaagauuguacaaggaacuaugggacaggagacccagcaugaugccaccacugucuguagucuucucaguccauuuuaggaaagaauauguuuggaugcuuauaccuuaaaaccauccaugcccauguacuacugggaaagucuuuaggauuaugcaaaugucagcaugaagaaagccuuuuaaaguagugaucuccaaaaauaaaacgagccgaucaagucucacuauucaacacuaggguacagacaaagaauuauacuacccuaugcaauauagcaugcaggaagcacuuuacauauaagcuggcguuuaauaaauauguuauuuuaauuugaaaaguaaauugucuuuuaaaaaucgcauuuacguucuuucugucugucuccuguuguagucugguuugcuccaccaugccacugaaauugcaguuaaugggaucacuaguacuuuaaauauuacugauuucaguagacauuuaaaaaucuuugacuucuuguuagcuuuuguugagcuugaccacucuucucugucauguuguucuuccaugauuuucugggacaugaaccucuuucaauuuuccuucuaugucucuguuugcuuuuuucuaguuucuucugcaggcuccucuuucauaacccuuuucuuaaauauuggugucuaugaguucugucuuaagccaccucucauuuuacacuguauaaguucccaaacauuucucuccucgugcuguggcuucaguuacccauuuguuuauuauuuuauuauuuuuuugagacagggucuuacuaaguugcucagacuggaguauaggggcacagucuuggcucacuauaaccucugccucccgggcuuaagcauuccucccaccucggcuucucaaguagcugggauuacggguaugugccacuacaccugguuaauuuuugaauuucuuguagagucaggguuuugauguguugcccaggcuggucucaaacugcucagcucaagauccucccgccuuggcuucccaguguuggaguuaaaggcgugagucaccauaccugaccuacccucuguguuuguaauguuaaucuguaucucccacccagauggcucuccugagcucuagcuggaggaagcuccagcuuccuccuuagcaccucuaccuagaugucuccuuaaauguguacuuuggaagugaacuucucaucuucccucuaaccugcuucccuguguuucuguaucucaguaaaugacaccucuaucuaagcaauugcccaagccagccuccuaagugucauucauaauucuuucuuucuuuuaccccucaugaugccaauuaaucauucuacuuccuaaauauguuacaaaaauuuauccacuugugacuguccucaguguugcuaucugugccaaaccagccucucuagcuucuauuacucauaacagccuuccugcuggcaucuucccuucaugcuguacauggcaacugaaggggcccacucaaaguuugaaucucaucauggcguccuugcuuaaagcccuucaguggcuucacaucacccuuaagauaaauuucagacgcuuuaacaugcauuacaaggcucuuuggauccuacuccucuuuaucuacauagccuugucucugggucuucgcccuggcacacugaagccuaaagcaacuuuucuuuuucaaauacugcgauguaucaaauaugccugcauguauuucuuugacuucugcuuucuuugaauccuuccacaugcuuuguuuuugccuggaccauuuugccugauuaacuccuucuggucuucuggucccagcuuaaaauagcacuccuucaagugggcugccuugaaucugcagguuagguucuauuauguguucaaauagcacaguguguuuccucuguauauaaucaucacacuuuaauuacuugucucuuucaugguauacuaucuuguaagcuuagugaggaccgagaucaucuuuaucuuggucucugcuuucuuuuuaauuuuuaacuuuuaauuuuuguggguacauaguagguauauauauuaaugggguacgugagauauuugacacaggcauacaaugccuaauaauuacaucaggguaaaagggguaugcaucaccucaagcauuuauccuuuguguuacauauaauucaguugugcucuuuuagauauuuaaaaauguacaauaaauuauugacuguagccaccuuguuguacuauuaauuacuagaucuuacucauuuuuuuuuuuuuuugagauggaguccccugucgcccaggcuggagugcaguggcucacugcagccuccgccuccuggguccaagugauucuuuuguuucagccucccaagcagcugggauuacaggcacguccuaccacgccuggcuaauuuuuguaauuuuaguagagacgggauuucaccauguuggccaggcuggucucgaacugcugaccucgagagaucugcccgucucagccucccaaagugccgggauuauaggugugagccaccaugccuggcccuugggcuuauucauuuuaacuauauuuuuguacccauuaaccaucccugcuacccuacuaccauucccacccucugguaaccauccuucugcuaucaccaugaguucaauuguuuuaauuuuuagcuuccauagauaagugagaacaugcaaaguuuguuuuucugugccuggcuuauuucauauaacauaaugaccucuaguuccauucauguuguugcaaaugacaggaucuuauucauuuucauggcugaauaguacuccauuguguauauguaccacauuuucuuuauccauucaucuguuaauggacacuuagguugcuuccaaaucuuggcuauugugaauauugcugcaguaaacaugggagcguggauaucucuuccauaaacugauuuccuuuuuugggggcuauaccuaacagugggauugccgaaucauauaguaguucuauguuuaguuuuuuugaggaaccuccaaauuguucuccauaguggguguaauaauuuacaauuccaccaacaguguaugaggguugccuuugcuccacauccucuccagcauuuguuaauugccugucuucuggauagaagccauuuuaacuguagugagaugauaucucauuguaguuuucauuuguguuucuccgauggucagugauguugagcaccuuuucacaugccuguuugccauuuuaugucuucuuuugaggaaugucuauucaaaucauuugcccauuucuuaguaggauuauuagauuuuuuuccuguagaguuguuugagcuccuuauauguucugauuaguaauccugggucagauagauaguuugcaaauauuuucugccauucugcggguuaucccuucacuuuguuaauuguguccuuugcugugcagaagcauuuguccacuuuugcuuugauugccuguacuuguggaagucucugcuuucuuuauaccuagugccuaacaugugugggcauauuugacaccuuugaauaaguucacaacuuuguguucuuguucuugugauucauaaugaaccuguuuuuucuccuuagugucucaaugagaucuuggagucagcagaugcacccuuagaagucacugaaggauucauucagucaauuucccugucaguuccauggggcucuuuacugcaggauaauugugcacuggaagugagaggauuagaaauggucuuccggccuagaccucgcccagguugguguguuguauguuucuguuuuauguguuuuuauucuucagagacugggaaaguaaccugauuaccuuaaauuuaguauuuuugcuuuguauuugugaaauuuucaguugauaauacauuacgacuuggcucuuuguagaaugugcauguuuacaaauuuagaguuguuucuuuccccgauuuuucacagaaacuuuaguauacagauuguuugguuuauuuaauuauuuguuaucaguuaucuaaaaugagacuuggguuuuaaagauucaaaaaguauugugccagaaagcaaagaagaaugcucaaagauuguuggaaaaauguuaaagggacacaggauugagugucagggggcuucccuuggccauauuugggaaaauuugaguauuacaaagaaugaugacaauaaugguuuauaacacaugaaauaaaaaaucucuaggaccauacugauacagauaaaucaguauguaagguggacagggagaaggaaugcucuucuuuauagcagaauagcuacuuauaaauagagaaaaaaaugauagaauuagauagaauugacaaucuaggugacagguauguugguaugcaaugacagaauuauaaucccaaguacugcccaaaacaugaaaguuuaaauuauauuuaguagaauuaaagugaaacucuguauuuugaaaaccgauuaugcaugcauggaaaucgucuuuaguaaucuggcauuuaauuuacaagaauauucuaucuuuuaacuaugaugaguggauauaauauuuuucuaugggaaggcaaacuuucaaauauuuuucucuuuaaagcauuccauuagaaagacuuuuaaauuccauuuuggaaggcaguaauucuugcaaucucugucacuuugcuuugaauaauguagggagguguggggagaauuuucucaugagggaagaucuggaaaugauuuuucacaucucauauguuuccuccuccaaggaugcucuuuuauuuuaucuacauauauacuaauuuccaaagccuguaucaucuacuacuucugccacauuuccuguuaauuuucucagcuagaaggaaauaauuaacuaaagaagaauuaaccucuucuuuuagcuuucauaauguuuucuguugacauucaauaguugucuacuaaucguaucuuauuucuuuaacuauauaguagguucucugagggcagaauuuacuauuauuuuuucuacuuucaacagcaggguuaguaaacuauaaccugcaggccaaauugguccugucgucuguuuuuguuaauaaaguuuuauuggaacacagccaugcuuauuuguuuauuuacuuuaauggcuguuuugugcuauaauaugagaguugagaaguugugauacagaccauauggcccacaaaauauaaaauauuuacugucugacccuuuacagaaaaaaguaugucaaccccugcuuauaauauuuagaacaguuccaugcaucuguaggauauccauuaaguauuuguugaaugaauacaugaauugauauuugguaaaauauaacauguugugagagcacauucucuggacuuuuuucugugaucuuuuuuuccuucuugguuauuauaaggugauuuuaaaucucaagaguacuuucuagaauauuguuuaccuggguaacaucaugauguuaaaaaucucuuaaaagauuaagaauuugucuauuugaaauguauuauuuuaagaacuggcauuguuguaacucuuaagaaauuauuuaggauuaauuuauauuuuccacagcaacugguucugagccuauguauuggucaaguuuuaugaccagcaguaugcaauuggcaaaagaaugucuuagccagaaacuaacagaugaacaaggagaaggaucccagccuuuugaaggacuugaaaaguuugcugaaaccauugaaacagguuugguguuacugagaauuuucaaaaauuuagauuugauuuaguaguuuuguaccuucauguaauaagcuuuguauaaggcaaauccauuggaauggauuuuuaaaagaauuacuguucccacuucagaacuuuagaauugagguauuuuaaauauuccauuuaauugcauguuguuuuuuuuuuuguaccuuaguuucuccauuuauuaugcuugcauagugaauggauuagaauauaacagauaguguuagucguugucccaagcaucuguugagauguaacaugguuaagugcucaguaagacaaaauauuuauuacaaaacucaggauuuaaggauuuuaauggaaagaaauucagcuucuuuauuuuguaaacaaaaguucuuaucaaacuaguacuuauuuauuucuuuggagguuuuuauuuagcauauauguggucucuuacguugacaauuacuuguuuacuuuaguacuaagaagaguaaaagucacuuuuauagauacuguuuugagaauugaacaugugccagaaaauuccaaaacuggaacugcacuugaaauucgaauagaaagguaagaauucuuaugucugaaaauaaaugacccuauuguaacucugauauuacauuuucagggagguuuuggagauuagagcuaaugauaugaaaauauugcauaauuucagaguaaagugcugcucuucaaguuauuugcuaauuuuauuauucuaauucccuuauugaaaacuugaaagugccaguugggguauaauuauauauaauaccauguugaauuuaaagcaaguuauucuguuuuaguuaauaucagaucagaauaauaagcauuugagugccacugaauuuaaggcuuuccugugggaaaguuucaguuuuuucauauuaacaaugcaauauuuaggcauauuucauuaacgugaaagacauuuuuguuuugcugugcuuaaucuaagugcugcuuuagugagaaaggcuaaggccacuguuuugaggauccucuacggauuauuuuaagguuaauaugugcaauauuuacuuaaaaaaauauaaguacguugcuuuuaguuuuuugcauaugcccacuugaagcucuuauacauagcuguaaagcaagguuaauuuacauacauacaccuaagcauugauuugaggcaguaacuggucacccguguguuaaugcuguaugaacugccaacagaaaugagcaggaugaagcguguacacugcaugagcaccagagacacuucguacauggaucuacugggggucucuacugaauuuuaagcagcuguguuaagauuucugucuuucacaaaacaccuauuaguaaaacaguuauuguuagcagaucuuuggaauaaggguccauugccuuaaauaguagauuuaaaaaaaucuaaaauuucaugcauuuagaaccaccuuauguguuuuguuuaaacugaaaauuagucacauauaggaauucaagaaacgucauuugugacuuggagccaaaugcugucacacuguuaccaagagauguuuugugggggaguacaggaauuguuuuccuuaaaacuaacuuaagggaguuauuaauuuuuuucucucaauuuaagccucauaaaguuaccuuuuuggaguuaagaccucuucaugaaaauauuuaugguaguaaagcauggugagacugaccauauuauaggcauauucuaagaagugcuaacacuugaaaaaaccccuuaacuuaaaaaagcuaugugcguuucuuauuguaaauagguuuuccuaggagauuuuauuuauuuauuuauuauuauuauuauacuuuaaguuuuaggguacaugugcacaaugugcagguuaguuacauauguauacaugugccaugcuggugcgcugcaccccuaggagcuuuuuguaaaugcuuuuuaaaaaaauuucagaacuguguacugugaugaaacugcugacgaauccucaggaauuaaugugcaucaacccacugcuuuugcucacaaguuacuucagcucucuggagugucucucuucugggaugaguuuucugcaucagccaaaucuuccccaguguguucaacugcaccagugguaagaaaaaacaaaaacccuaaaaccauaaucauagauuuuuuaaaagguuuaaaugggggcuauuaaauuuugcuaggauguauaauaugucuuaaugaaucucugucuugagauuuaaugcaaauauucaguaaugguaauauauguuucagagauuugaaaauacuaauauuuauauuccuaccagugugcuguguauuaguuugaaagagaaauguuggguacuguaucuugggggaaaaugguguagaaguugaguaucucuuauucaaaaugcugggacuguguuucagauuuuugaauauuuuuauagacauaaugagguaucuuggggaugagacccaaguguaaauacaaaacucauaaaacucauuuauguuuguuuuuuuuuuuuuuuuggagagagucucuugucgcccaggcuggugugcaguggcgcaaucucgacucacugcaaccuccaccucgcagguucaagggauucuccugccucagccuccugaguagcugggauuacaggcacaugcuaccaugcccggcuaauuuuuguauuuuuaguagagacgggguuucgcaacguuggccaggcuggucucgaacuccugaccucaggcgauccaccugccucagccucccaaagugcugagauuacaggcgugagccaccacgucuggcccauuuauguuucauauaugccuuauacacauagccugaagguaauuuuauacaauauuuucaauaauuuugugcaugaaacaaauauuugacugcagcccaucacgugaggucagguguauuuuccugaccuugugggagugucauguuggcacucaaaaaaguuuuggauuuuggagcauuuuggauuuuggguuuuugguuuagagauguuuagccuauauuaacgucuaauuuuuuuuuuuuuuacaaucaaaacagaggaaauuaagcagugugcaaauuuaccuuacauagugacuguauugaugaaauuuuauucuacaaaucaucucuuuaaaaagcuuuauaauuaaggaacucuguuaaaucccuuccaagaggagaguccuuuuauaagucagucacuguauaauuugccuuuuuuguuauuuuacaaaucagauuuucuuaauuauacagugcccauuagguuuucuuacugcuguaacuugaacagauacugugcuuuuuuucaugaaguccuuuuucaugacuugcuuuuauuaccaguggacugugcuaacauuuuaguggacuguguuucauuuuagcuauacgauacugguuuguccauuguaacaucauacaguuuuacaugucaaauauuuuauucuucuuaaguugacauuuauauuuuacauuucauuuuauuuauaugaaaguauuuuaaauaauuauuuuugucacuuuauuguaggaaacugagccaaagcucucaccuagcuggaaccccaaaauuauuuaugagccacacccacagcuaacuagaaauuuaccagagauagcaccuucugacccagugcagauuggacgguuaauugguagguuggaguugagucucacguugaaacagaaugaagugcuuccuggagcuaaggucaguguuuguuucacuuucuguaguaaaaccaaaauaaaaguacaaguauucuuuauucuaugcagugauucacugauugauuacugcagauuauccuguaacuaguguacugcugucaccgaguuagcauuuuuacucucaguugaugcuucuauccuaggucacaaaauuuaugugaggacugccuuugcccuacuguugcagcucaaguuuuauaaagaguugccuucuacacucacucucccguauuccgacaauucgaaacugacaaaccucucuuuuugguauuaaacaugguuucauuaguucagauaacuaggaauuuauuuaaaaaauucuuucuauuuucauaaaauuaaguuuaaaggaaaagagauuuggcaagcaagaaaucuguagaagauguuuuuauaauuauauguauguaaaaauaucuacccaucuauuuugaacagaaugaccauuuuuauauaguuguauaauauuugugaaaagagauagacuuuuuccauugucucauagcuuuaaaauuuuuugacauaaaauaaaccuauauaauauaucaucuuucauucuuuuuuuuuuuuuuuuucgagauggggucucccucuguugcccaggcaggggugcaggggugcagugacaagaucuuggcucacugcagccucgacuuccugggcucaagcaacccucccgccucagccucgcaaguagcuggggcuacaggcacaugccaccaugccuggcuaauuuuuguauuauguuuuuuguagagacagggucucacuauguugcccaggcuggucuugaacuccugggcugaagcaguccuucuugcucagccucccaaaguguugggauuauaggcaugagccaccucaccaggacccuuuacuauuuuuaaguguaaguuaagugauaaucaguauauuuauauucuuuuucccuucauuuccccacuguucccagccucugguaaccaucagucuacucuucgugaguaggggaaucuucaugagauccccuuuuuuagcuccugccuaugagugagaacaugcguuaucuuuuugugcuuggcuuaugucacuuaacauaauggcuucuaguuccauucauguuguuacaaaugacaggacuucauuauuuuuuaugguugaauaauauuccauuguucauauauaccacauuuucuuuauccauucaucuguugauggauauguaggaugaguccauauuuugguccauauauggguccauauauaggaugaguccauauauauaaauacacacacacacacacacacacacaaagaugugugugugaauauauauacgugugugugaauauauaucauauaugauauauauauucauauauaucauauaugauauauauauucauauauaucauauauucuauauagcauauauucauauauaucauaucacauauagcauauauucauauauaucauauauauucacuaugugaauagugugcuguaaacauggcagugcagcuaucucuuugguauauugcuuuccuuucuuguggguauauaccuuauguggaauuguugaaucauauggaaguucuauuuuuaguuuuuguuguugucccuuuguuuucuuuuuucaaaaauuucaguuguuuuugggauacaggugguuuuugguuacguagaugaguucuuuagugguaaauucugagauuuuaguguacuugucaccugagcaguguacgguauacucaguauguugucuuuuauccuucaccuccuuccuaaccuccccuccuccugagucccuacaguccauuauauaccucuguauguuuugcauucucauagcuuagcucccacuuauaagugagaacauaugguauuugguuuuccauuccuaaguuccuuaacuuagaauaauggccuccaguuccauccaaguugcugcaaaagacauuauuuuguuccuuuuuauggcugagugguauuucacuguguguaaauauauauacauauauuuguauaugguguauauauaugugguguauauguguaugugguguguauguauaccacauaaauauacaccauauauauauacacgcaccacauacauauauacacauguguguauauacaccacauacauauauauguguguauauauauguuuguguauauauguguauauauguguguguauauauguauacacacacacacacacacacacacacacacacacuguggaauugcugggucgaaugguagaucuacuuuuaguuuuuuaaggaauuuccauacugcuuuccauaauaguuguacaaguuuacauuccuaccagcaguguaaaaguguuccuuuuuuacgauguccaucccaacaucuauuguuuuuugacuuuuuaauuauggccauucuugcaggaguaaggugguaucucauuguguuuuuaauuugcauuuuccugaugauuagugauguugaacacuuuuucaugguuguuggcuguuuaaauaucuucuuugagaaauauauaaucaugucccuugcucacuuucugaugggauuauuuuuuucuugccgauuuguuugaacuccuuguagauucuggauauuaguccuuugcuggaugcauaguuuacaaauauuuucuccuacucuguggguuguccauuuacucugcugguuauuucuuuugcugagcagaagcuuuuuaauuuaaucaggucccauuuauuuuuguuuuuguugcauucacugaggucuuagucaugaauucuuugccuaagccaauguccagaagaguuuuuccaauguuuucuuauagaauuuuuaugguuucaagucuuauauuuacaucuuugguccaucuugaguugauucuuguauagggugagagaugaggauccagguucuuucuuccacauguggcuugccaguuuucccagcaucauuuauugaauaggggguguuuuaaccaauuuaugguuuugcauuugaugaaauucagcaucccuuuaugauaaaaacucucaacaaaauaggcacagaagggacuuaccucaaaguguaauaaaagacauauauaacaaacuuacaaccaacaucauacugaauggggaaaaguugaaagcauucccccugagaacuggaacaagacaaggaugcccacuuucaccacuucuauucaacauaguacuggaaguccuagccagggcaaucaggcaagagaaagaaauaaaggacauccaaauuggaaaagaggaagucuaacuauagcuguucaccuaugcuaugucauauaccuagacaacccugaagacucaucaaaaaggcuccuagaucugaucaaugaauucaguaaacuccuagguuacaaaaucagcguacacgaaucaguagcagugcuauacaccaacagugaccaagcuaagaaucaaaucaagagcucaaucccuuuuacaauagcugcaaauaaaauaaaauaaaauaaaauacaauaccuaggcauauacuuaaccaaggagcugaaucucucuacaaguggaaaacugcaaaacacugcugaaagaauagauggcacaaacaaauggaaacacaucccauacucauggauggaaauaaugcauuuugugaaaaugaccauacugcccacaacaauccacauauucaaugcaauucccaucaaaauaccgucauuuuucacagaacuagaaaaaacaacccuaaaauucauauggaaccagagaagagcccaccacagccaaaacaauacuaaacaaaaaacagaucugggguuaucacauuacuggacuuuaaauuauacuacaaggcuguaguuagcaaaacaguaugguacugguauaaaaauaggcacuuaguccaauggaacagaauagagaacccagaaauaaaaccaaaugcauacaacuaacugaucuuugacaaagcauacaaaaacauauuuuuuaguuuucugaggaaccuucauacuguucucuguagugguuguacuaaucugcauucccaccaaaagcauaugaggguucuccuucucauagcuuugacacuguauaaagacacuguauaaauacaacuauauuugccucuuagggaaucauauugaucagucuuauggagaaccaggaaacuugcauuuacuuaguuaaaaauguauuugucaagcauuauuuucacaccuugaaaacaaauuuucuacauaaucucuauaaaacguaguuuuaauuaagaagauacccggauuuauucauuuguuuauuuacugaucucccuaguuguagauguucaagugacuaccacaugccagccacuuaccugucccaguuuuucggacagaugcaaagaugaaucagauacaaucuuugccuugguaaaagauacaguaagggguauggaaauugcuguggggacacagaagagggagccacuaaguacaugucaauauacauaaaaugauuuuucagaggauugaagaaucuccggaaaucccuccuuggauuggaaccucugacuagaguuggaggaggaggaaaguagaaugaagacacuccuauuacugauuacucaggccccuucuguuuacugcucuguccuucuucagauggugcaaaauccuuuuacaaugucaaaaggcccuuuacaaguaacauguugggauuguuagcagaacagguagucaaaagauuauguaaacucuacagggaauccucugcugugguaacauccuugggaaacuauacuaauaauauguuuaugucucuggggaaugcauuugccaugucuguaaggaggaagcauagcaauaacuuuuauaguucuguuuugguuaauuauauguaguccucaacauuuguaugcuuuuauauuuauguaaacccaaacuuuuguacaugauguguugauuuguacaaaugucuuuuauaauaaaacauuauguauacauuuguacaaauguauaaauauauguuacuuuuagaguucuguauauuagugacaaaugaacauguggaaaaacugcguaguggcauugugugccagccaauauuuaauauuuagaaguacuacccuugccuauagaguaauuuuuguguaaugacuugaguauuugaguauaauuuguuuuuauuuaaugcaaaugaugcuaaauggaaaaagacaaguucuggauuuuaguauugagaaacauagaucucauaaaauauaguguagauaaagauggcauuaauuaggggugcugaaaaugucagaucuuuaaucucuuucugauguacauuagccuuaacucuuucaacuguggauucaaaauguuaugaaagauuucauguuuuuuuuuuuuuuuuaaguucucugaauaguauucccuugaguaguguguaagucuguguuucauguauucaguuuuagccuauguuuuuaggaaugcauuuuauugaaaauuggagacugcccguauugaauuuagagauguuuuguuucaguuaccauguuacauugaguugaaauuuguuuuuuaguuauguucuuuuauauuuucaaaagaaaguaguaaguacuuuguucuuuuuaugccaaacuuagaauguacaaauaaugaaauauuucuaugaaaauuuuaauuucaaugaauuagaaaugaaacucuugauuggccauucuaaugaaagucagagauugugcuuucaguacaacaauugugaaauuauaaaacaauuuuuaaauuuggcauguaguuagaaacacauuuucucucuccucucagccuuagguuggcucauggcuugggaugucaguagucaggaaggugccccguaaaauaaguugucugugggcagaacaagggagccaugccguggaaggagugagggcuuuuccuccaggucagccuaggugaaaauccagcucuggaucugcuacaugggccuugugcaauucacugaaucuuugugaacucauuucuucaccuauaaaacaggaacauuaauaagaauuagaggaaauauauauaaaagcacuuagcaugguaccccaaugcuaaaaauaaaagugauaauaaugauuuauuuuacuggauuucuuaggucaucgaaauuucucaaucauuauguaguuuauuugauuuuuuguuuguuuuguuuuagaaucagaaggaaucccuuuuucuccugggaagaagucauuuucuagauauaaauguuuuguuaauucuauuauuuuucaguugcaaaaugacauaaaaauaauaggagucaguguuaagaggaggcgaaugaaaaguaaggcagggauauucugcuuuuuagaauguaauauagagaauaaaguaauugcuuuugucagaguauucaggaaucaucaagagagugggauggagcuuuuauuucuagauggaaaagugggcaaagaguuggaaaagagaaaggaaguccaccuaagcaccaucuucuguccacguuucuguaguggcguccccuugcaugcagagcgggcuuuguggaccacaguagguacugggaaggcacaguguuggaggagaagguccuuacaugcucugcuagaguaugauugguaguguacuuaagaaagccaacuuuauuuguucuugaugugaaucagacuuuaaggauuaugauuucagucuuuugaaagucaaugaauacugugcuauugcuaccuuaauauucauccuuggagacuaugucuuaaguccuccucaaauacuuuuaaguacucagaagacuugaagagacaaaaaguauaacauuggacucgucagcauggaauuucucaggaggguuuuuccuuuuagaacaacaguuugguggccuuuaagucuuuucauuuagauggugugaauuaguagagagagucucagaugaaggacuccaagacuaaagacucaguauucaucucaguucauuaaaauauacugacguuuauggugauaagguuauaaagaauacuccucaugaauaguuuuuuuuuuucccuuaaguuggauguugauggacagauagacucuauucaucuacuccugucaccaagacaggugcacuugcuuuuggauauguuggcagcuauugcuggaccaggcaaguauaauucuguuauuauauauacuuguuacuuuuuuaaauuuuaaaaaacuuuaaaauauguaauguauguacauguaggaaagucuauuauuuuugaauaucugaauugaaagaagcaaauaagaauguuaaguaguaaaauuugauuggguguuuugaauguguuaccaugggacauauucacuucagauuaugugugucacauucuuaacuuuucuaaaauuguucugacuucuuugguuggggauaguacuucauacaaucgagaaaguauaauucuugaacacaguaagugguacacauuuuaaaauauuuucaauggcuucuaucuaucagcgauaagauuuugggauuccuggcuaguugcuuaaagcuguugcuuagagcucugacucacuaaauagcagugguuuugcacugugguguuaaguugccauuguuguuccauaaauggguuuugggaaagaaaugcuuaauuaacuccaaauuuaauuacuguuuugguuuccuuuuguaugcuuauagaaaauucuagcaaaauaggguuagcuaauaaagauaggaaaaaucgacccaugcagcaggaagacgaguaucgaauucagauggaauuaaaccgguauuauuugagaaaagauucccucucuguggguguaucuucagagcaaagcuuuuaugagacagaaacagcucguacaccuucuagccgugguaagcaacucaaacuguugacaccagaaucauauauuauaaucauagauaaaauuacacuuaauuuuggcugcugugaacagaaguuuaggaaugaaagaacaaaaagauccacauuguaagaaauccacaacuuuuaauuuacgauuaaucuaaucacaacauuacaguaaugcaccagcacauaggugcuauaguauauuuuuuugauuuugauuguguaguuuuguuuucuaaaugauuuagucuaaggaaaaccaauuuauaaaaauguaaauuuaugugaaaguuaaauuagguaguuauauauuuugucaaauuauuaugugcucauguaaugauuucuagauuaagaaacuacugaacuacuaaaguuuaauaaggaaacuuuccuuuauugaucuuuccaucaguuauauguaaauaaugaucucuacccagcuuacuuuacauuuauagguguuucacaauguauaaaugcuaauaacauaaauaauauggaucaauuuaaguauggaauguuggacaaaauaagaaaucaaacccuacucaaaaaauuuuggccauaauaaacuucauuugcaugagaguaaaacaauuccgaaagaaggaacugaaauguaaauggaauuccaaauaauguuuuuggcucugaauaaaagaaauaacuguauccagaugaaacuagagguugcaauauauuuauacuauuuuaauaucugauuuuaauuccuaaacuggcauaucacauuaaaaauauaccagguaauacuacauuuauauauuuaaaacaaaagaaaacauguucaucaguaggguagcuucauuuuuuauuaauuuauauugaguuuuuacuaugccauuaauauuuuggacucauaaauuacaccacuguaaguaacauaaaauuuggggcaucgcuguaucucauauaaucugaaggaagaggauuguauuaacguauauuaacuuacuuaaaagacuugaauuggugggauuauaauacaagugacauaguuuaauucucucuagaagaagaaguauucuucuccauggcugauauggacaugucucauagucucucuucucuuccaccccuuggggaccccccaaacauggaccuugaguuaucauuaacuaguacauauacaaauaccccagcaggaucuccauuaagugcuacugugguaaaguauuacuuaauuuuucuucuagacugaaaaguugcuucuaaaauucuacacuucauucaugugcuuaaaaaaaaucuuuuauagcuucagcccacuuggggagaguuccuugaucaucauaaagaacagccaguaagagggucaacauuuccauccaaccuaguucacccaacaccuuuacagaagacauguaaguaaaaauaagacauuuguuguuaguuuccgcuggaauuuuuaaaaugccauucuacuggugcuuuucuuucuuuuuuuuuuuuuucuggucuuggccauuuacaaaguucagaaagcaaaaugaaccauuguuaaacaauucacugugaaguguuuuagaauaguugcucauuuauuguauucuuuguguauuuaaauacuuaaauauuuuuaguuaaaaguacacuguaaguuucauauuauuauugcaguucaggacccucagucaaucaugugauuuuuguuucacuauuuacauuuuccuuggaagagaaccucagguuucuuuucugcaaaauuuaauugauauagacccaaggcuuaaaggaaaauuuggugagcaguuuuugguuaaucuugaguuuuccaguauguuuuuauuaauauaaaagcuugguuuguacauuuacuguugucacguacucuuguacuuuaguacaaaaaucuuggauguaagaugcagcaagauagcaguugauuuuacuuaaauuaauuguuuaauaucauucaaacuguuguaugaucaucuguuuuuuaaagcuaauaaaugaguaaauguuuuauaauuuuaauaguuuuaugugucaaauuuuauguauauaauuuuaauacuuguauuuuagcucucccaucuagaucuguuucaguggaugaaucaaggccugaacuuauuuuuagacuagcugugggaacuuuuucaaucucugugcuucacauugauccuuuaucuccaccugaaacgucacagaaccuuaauccauugacaccuauggcaguagcuuucuuuacuuguauagaaaagauugauccagcaagauuuucaacagaagauuuuaagucuuuccgagcaguguuugcagaagcuugcucacacgaucaccuuagguaaacucucacauauguauuaaugauccuuuaaacuuccacauaugcuaaugauccuugaaaaagaaccacauguggacuuuuguaucugccuaucugcauuuguuuuucuaauucacauuuuauuuguaaaugaauggaaugagugaaguuuucuugcagugcugcaaagguguuuagaaucuuucauucagguuauuuggcaugcagaauaacagaucuagauaauaggaguuuucaaagugaucucuuuaguucccugcccagcucuugucaaguuucuuuaaccacauuuugccuucaucccuauugacaccacugcagucgugaaaacaguucuuauugucacuggcauuagcagagaugacaguggugaugaaaaauaaaauaauacuauuggaacugauccauaugccacuggccauggggugggaaacauuaccaaggcugauccugaaacuuggaugcuacguuucaacuucugcuuaagaaaaaucaaagcuauccaaauagccagugagugauccuuucauggguugagucuuaacagaugaggagauaauugaauuuguaauauaguugguuuuuuuguuuuguuuuguuuuuuguuuugagacagagucucacuccaucguccaggcuggagugcaguggcgcaaucuuggcucacugcaaccucugccucucagguucaagcuauucugcagccucagccuccugaguagcugagauuacaggcaugugccaccaugcccagcuaguuuuuguaucuuuaguagagaugggguuucaccauguuggccaggcuggucucgaacuccugcccuccagugauccaccugccucggucucccaaagugcugggauuacaggcgugagccaccacgcccagccuuuaguauuguuaacaugcaaacucuguuuuacaauuuuaaugugaaagugaucuauaaauuguugaaugacaucuuauacggugguuuaaacauaucauauauuaguauuuuuagaaaauacuuugggcguuuauuuaaucuuuuuaacuuuuuuaaaguaugaaaauugauaugaaaaguaguuuuacaccuaauacaagaaaaacucuacagguuaggauuauaguauuuauacucaaacuguaaaaacauuuuguuuucuuccaccccccuuuuuuuuucuuguauuuuuaagagagaugggguuucaccauacuggccaggcuggucucgaaguccugaccucaggugauccgcccaccuuguccuccucaagugcugggauuacaggcaugagccacugugccuggacuuuuuuuuuuuuuuuucccauuuuugacaaaguuucaaacaucugccaguaggaaaauagaacaaaagcggcagaaaauauagguagaccucauuugggcuucaccgacuaaaguuuuugaaauauugcauaauguuuuuagauaauuuuaagagacuauuucauauauuuuacagaucugaaagauuuugccuuugcaauguaaauuuuuaaauguggaagacgaagggcaguguugggaaauaaacagauccuggaaaauuucccaucaacagaacugauuuuuuaucuuaaggaaagggaaauuugaagcaaucuuucugguuaauuuccuuaggaguauuaauuauugauaacuugaacuugucagacuagguggauaauuguuacauuuuaacacuaauaaucuuaaauggugcauuuuuuauaauagauuuauagguacuggcauuaaaguauccuaugaacaaagacaaagaucagcuucccgauauuuuaguacugauauguccauugggcaaauggaauuuuuggagugccuauuuccaacugauuuucauucuguuccuccucacuauacagagguaaauauugaauacuuuuucuuuaagauuauuuuuuaaaucuaccuugcuuuuuaaugauuguaugaggcaaugauuuucuuuaaaaauguauagaaagccauaggaggaauauugucauuuucuuuuugcacuuguguucuauagaaauauauuuaagaaugucacucaacaucguuauaaggaucuguuagaauuuuaaauuagaguugacuuguuuaggagugacagguggguuaugagagaaaugacuucauuucacucauguucaaagcacucuucauuucagaagaauuugauuauugaacaaauaauuaucgaaugccugcugugugcuaagcauuguuuaagacaaguuaaaugucuuguguucauucaccauuuuucugauauuuuuccuaauguaaaagugugaccuaaagaaacuuuagaaaacugucaaaguuauguucauugcuguuacuuugacccuuuauaguguuuuauuucaaaaacacuuucuuggaaaugaauuuauuugaauccucgccuacauuuuacagaugagauaucacaugaguuaacuaacuugucuaagguucacauugcuaguaagugacaaaaaugaaacuuaaaaccagauuucugacuucagaaagccuuucucauuauuguaugggcaccucuguaaauucuugugauuaauacauuuaauuuaucuucaucuuuacuuuuaagcuuuuaacguuccauuccaaagaagaaacugguucccauuccccugugugucuucagcuucauuauaagcauucugagaauagagggccccagguaagagaucuuuuucuauaauugccaccuguaaauuuuaaucugauauauauuuugucacaauuauaagguuuuaacccaauuauauaguaguuuuuagugauuguauuaaugccuuuucuuuuuuuuuuuuaaaaggguaaucaagcaagacuuaguucaguuccucacaaggcagaauugcaaauuaaauuaaauccaguguguugugagcuggauaucaguauuguggacagguuaaauuccuugcuucaaccacagaaacuugccacaguagagaugauggcaucccacauguauacuucauauaauaaacauauuagucugguaaguauucaaaagcugcaaauacuaaucauaauuaugguuagcuaauaggguuauugagauaauuucugaacuuaaguauuuuuaauagauuaaacaguauaauuaaaauagcauuauuuguaauaauaaaaaaaggagacaucuuuuaugucuugauaguagacuagcuaaauaaguuuuugagacacacugaaugaaauguuauguggucauuuaaaaugaugguuauggccaggcguggcggcucacaccuguaaucccaacacuuuaggaggcugaggugggaggaucacuugaggccaguucgagacaagccuggccaacauggcgaaacucugucucuacuaaaaauacaaaaauuaacugggcaugguggcacacaccuguaaucucagcuacucaggaggcugaggcaugagaauagcuugaacccaggaggcggagguugcaguuagaucgcaucacugcacuucagcuugggugacagagcgagacucugucucaagaaaaagaaaaagaaaaugaugguuaugaagaugguauaacaacaugaagaaggcucaucaaggauuaaaugaaaaaguagaauauauugcuuuacauaaacuugucacaccuguguaaauaaaauugauguauagaaaaagaauggcgagaaauaugccagucaguagcauuguuuauauuacaguggaauuagguuuccuuuacuuuucaugucuaucagaguuuuuauaagcugugauuauaacgacuuuauaaaauuuuaucuauuuauacauuugauaaguuacuugaacuaccuaaaacaugaagcccaaacaauaugggauauacuuuugaaaauaaucuauugaacaucacauuauaucacuuuuacuugcaucuggugccuggggucuuuucuaagcaaauuaaaucagucaaguuugcaagaagucuguuaggaauuuuggggccagaggaccaggaucagauggagacaaccuuaguuaaaaagaaaaggaaaaagauauuuuauuuuucuacuucuuugcuuuucucuuaguauugaguauucacaucaaauuagcauuguuuauuauuauuauuauuauuauuauuauuauuauugagacagacaucuguugcccagaccgcagugcugucauacgguaucagcucacuucagucuugacccccuuggcuuaagcgauccuucuaccucagccccccaaauaguuggggcuacaugcaugugccaccacacccgguuaaguuuuuauauuuugucucccuauguuucccaggcugggcauucuuuguuauuguuaucaauugcuaguuauuuuaguuucugugggguagucuguauauuagcuguaacuauauaugcaauuggaugaugguuuaaucuguuggguuauuuuugccugagaguggugguuaaauauuagcaaaucaaauggggagaguuagaauagauuuguuaaaaauccaagucuggaugggugugguggcuugcacccauagucccagcaacucaggaggcugaagcaggaggauugcuugagcccaggaguuugagaccagccugggugauacagcaagaccuguuucgaaaaaaacaaacacaaaaauuguaagucuagcauaugcagggaguuuucaaaucauggagguuagaaauugauugaagaaacugaggaguguuacaacguagaguggaauaaagcuuuuuuaguuucaauauauuuuagagaaaaaauagaaauagauuucuauuugaaugggauguucuuugacccuuuuauuguaagauggcuuuggguaaaauggugcauauaucuuggucucauagaaccauuugaugagaucauacccuuggauuggauaggagcucagagugcgucauuuagugaauauuuauuuagaaccugugaugugccagccucuggguuuuaucuuagaaguacaaaguugagucagcgauuguauuuggcauaauucaucugauuucacauugaguauuuaaaaucauauauugguagaaaagucuuucaaacugaauguuggacacuacagugauuuuuaaccguauugaauuuguugguaggcuaauuuacaccguauucuuuauaaauuuauaguaagauaaauauuaauauauagugccuuugucuucacuuuggcucaguuuuuaauuuaauuuuuuauuucagaguuuaacuuuugccaauaguuuucacuuuugcuaauaguuguugcauuauaaaauuuuuuuacacuaaauuaauaugguagugguuaauuugaauugacuuuuaaugcauuauaccaaauggggagauagugauuauacauauuguaauguugaauacuguguaauuuauguucauuuacuuuaauauuuuggcauauuuuugauguuuuguguuuuagcacaaggcuuucacugaaguguuucuagaugauucacauaguccugcaaauugucggauaucaguacaaguugccacaccagcauuaaaccuuucuguucgcuucccaauaccugaucuucgaucugaucaagaaagaggaccaugguuuaagaagucacuucagaaggagauccuuuauuuagccuucacagaucuagaauuuaagacugaauuuauaggaggaucaaccccagaacaaauuaaauuggaacuuaccuuuagagaacuaauugguaagauugaaugugccuguaaaagaaccauccuagauaacaaacaacugcuacugaaacuuaacaucacaaaaguaucugacagcccugcaauauaguacaauuaaagaacauuauguuaaaaucaacagcaacaaugucuuucuaguauuguaugcaaauaugugauauagguaauuuuuuaaaaacuaaggaugaugauucauucacuuuguuaaaauuccuguuuacugcaggagaguguaguacuuuagccuacauuuuuauuaccaccucucguuuauuuauuguaggacugauaauagaacuuguuaagugccacuguauguuaaauauuaugcuaagcacuugauacacauuuucuuguuuuuuuagucaucauaaucaccauauguuuauuuuuccaguuauuuuuauaauuuaauagaugagaccaucuguggaccuagaaggaaguaucuaccaagaucauguuguagucaauggcagaaucaagauuugaacccaagucugacaguggagcuugagcuuucaaccauuacacuaacuaaucgcuagugacuuuuauuuguaaaacucguuuugauuuuuucugcauuacuuuguuuuugucaguuaaugaagggaauuuauaaaaacuuuaaagugaaccaagucuaugaagaccuggaaaaccuuuuauccugugguuccuagaccaccugccucugccacgacacccucucuccgcaaccacacucccaccccucaugagaauaguuugcaaaaguuccccuucuuuucucucucgguuuuacguaucuuaagagguauuuaaaauugauuguugucaauuaugacuucaugaaagggccuucagguguugugagaucaucccuuaucuccaguggugagaaacucauuauucuggaggaaagccauuuuucauuuguaaaauggauugaaaaaacacguauagaauuuuuguuguuguuguuuuuguuuuucagacagagucuugcuuuguugcccaggcuggagugcaguggcaugaucuuggcucacugcaaucuucaucuccuggcuucaagcgauucucgugccucaguuggaugucaccacacccagcuaauuuuuguauuuuuuaguagagacggguuuuuuccauguuggagaggcuggucucuuaacuccugaccucaggugauccgccugccucagccucccaaaugcugggauuacaggugugagucaccgcgcccagcccguguagaauuauuuugaacagagguguuucuuacaguguuugguacaaaauacauauuuaagaaauguaguuauuuuucuagugguagauuauauagacuuuaugaagaaauaaucacuaauagcacuuaguaagugguaagugcuugcucuauuuacuaugucauuauguacuuuaugcaguguaccuugguacuuaagaauuugaguuugaacacaaaacagaaucuuuaauuuauuggcucauucugucuaccacacgugcacaugaaaccagaacaacugaaaaaugcuguagaacuuaagguugcauuauguuccugauugagaggaucuuugcuccuccaucucuucuuuuaguacuugagaagaagcacauuucaguaaaucagucuuuuuuuuuaggaucguuccaggaagagaaaggagauccaucuauuaaguuuuuccaugugucuaguggaguagauggagauacaacaucgucagaugacuuugacuggccacggugaguaagcaaaugcauagguuuaauaggauuuuccuuuuaaaaauaaaauauucuuuuaaaccaacauuuugucuauuaaauauaagcuaaacauguccauccuugauucuuuugugguucauaagcgugaugauuggguguucacaugaaugugugagaugugucacccucaaaccuuguugugcuauuuuucugccugccuugcuuuacuccuccucuccacugucuauuagaccgauuagauucuuaggacagauguugcucauacacaccugguaauaagcaugaguuuagagcacaaguuucauaaggacuggaucuacuucgguuaaauaauucagaagcacaauuuauauuaggauauguaucaauuaggaaaaaagccugugaucauuuacaaaccaaauaacaccacuaccuagggaauaagaguugcaguugcagcacagcuauucucuuugaggguuccaugccuccuuauaacaauggguggaugugguaaucaaaggagaaugaaaagucugugcuagagauguucuguagaagcuuaggaaagggauuacucuggaguaaaaagcucauuaguuuuuguagucauaggcugcauuaacucagugaucuuuagguuuugugguuauaaaacagaaacagcaccagcccuuuauuauugaaauuacuagaugaaaacauaacuuuguuguuagaguuuugaaacuguuuccuaaucagcuucucccuuuucccuuugaacaacugauauaauaugagguugauauaacaugagguuucuuagguagacaaguaauuuauuauagcagaacagacuauaugugagaagauuugguuuaaugauaacuagaauccuuagguaaaguuugcugacuuuuaaugaaauuuaaaaauaaccuuuuugcccccuucaguuacccaaguauaaaauguuuaugucuuucuguuacuuacuuguuucaguuccacacuuguaaguuuacaacauguucauaaguggguuaccuuagacauaauuagacuuuguagagaaguuuaauucuaucauuaagauuuaaccagugguguguguauuaauuugcacaaaaguuaaaguuuugcuguuuacacuuagaucuuggucuuuuuaaaauugucuuugcuaucagaauuguacugaaaauaaauccaccagccaugcauuccauuuuggagagaauugcagcugaagaagaagaggagaaugauggucacuaccaggaggaagaggaaggaggugcucauuccuugaaagauguuugugaucuaagaagaccagccccaucuccuuuuucuucucguagaguaauguuugaaaaugaacagguaaaagugugagcaagcuacaaaggaauaauacuauuauucucugucauagagcaaugcuuuugauuuuuuauuuuuaaaaaaaugccuuguguacuguuuuugcuaggucuuaaacuucaaaauugaauaauaccuauuuuuucuugguguauauuuucucuaguuaaauguuucaugcuuauuuauuucucacauaccaaguccuauggauaggcuaagaagaugcuacuacuauuuuaaacauggaugccuuuuuuuuugcacugaacuauuauguuuuagauggugaugccaggagacccuguagaaaugacagaauuucaggauaaagcaaucagcaauucucacuaugugcuggaacuuacguuaccaaauauuuauguaacacuaccuaauaagagcuuuuaugagaagcuuuauaauaggugaguuuauacacauuuaguugaaucuuuggaaucagauuuucuaauugccucccugauuuuccucuucccccuuuccuuuccuugccugaauauuauaugccaucucuguguacuuugugugguguugauggugacuauugccguuaugaugugcuauugucauagcagaguuuccuaacuagcguggugccgggugugugagauauuuauuuccucagcccugagguuggcugauugcccucugucagcuuacugcagguuaccgaucaaauacaauuuuuuucuuuaugugcagugacgugaagaguuaagagaugcuaauacagcuagccaaugcuggaguagaaucagaaccccauucauuguacaagaagcaucuuuucuucagcauucaaaaagauaucuuguuggaauucaaaauucugugaacguguacaaaauuuaaauuuauuauauuuagauaccccucaauauuuaugccaggcagguauuuugauacuaauggaauucuaggucauagacucugaaggccuugagcaguuuaucuagccucuguaagacucagcauccucuucuguaaaauggagaugauccuggcucccaccuauaaggguuguuuggaggauuaaaugauauaacacuuggagaguucugagaauaguguauggcauaucguaagaacuuagugguugucuguuauaauuccuacccacugaagggauuucuccguagcauaccugaaagauugucauguggguuucuagaaaaagaaguccuuaguguuugucaucacuagcuuccuacauguagacaaguuauucuaguuuccauuaaucuucagaaacuucagacuguuguuucugcuguagguuuacuugguaucagauaccacucgguauuuauuccuuaaauguuaguaauaaacccuggguuuucucacugggugcuauugacuuuugcucuuagaaucagaaaauuaaguuccaggauucuucuaggguucacauuacuucaguggucuugaaaaugagauucagagaacaguccacucugguauaggaagaaaauguuaucacuuacguuuaacuuuaaaaauaaucuuuuaaaauuuauauuuuuauauuuguuuuauaauauacauuauaaauagcaccuaauguauauucaauucacauuagagagguuucaaauugguuuuaaauguugggguuuguuuauauaugaucuacaguuucaaaaugacugaucucuaggcuccuccuuuuauuucauaguucagggguguccgcaaagagcugauguaugugcaaggcugagauugagggaaaugaaaugacucuuucaaggccuagcccagagaucaaaaacacuugaccuauuuuuuucucauucugcauugacugagcagauugcuuuugauuaaaucagggcaucaagaacaguaauacauaccuuaaacauucacuuuauaaauguauauuuauuuaccacuucauuucuaaauacaggacaaggccuuuucuuugaauaugagccacugauuggaauucuauguugucuuuuuuucccccuuuccuuuuuuuuaauccugcauguggcaucugacuauuuugucuuuuuuuugcauaaaguguacccagaaggcauugucuaccguuuuuaguuccaguuucuuuaaagugaagugaaaaaaauuuuuucagagauauguaagaggagaaucuuuguagguuuuuaagauuuuuuuuuaccccagucugcauuaauuaaaacgguacaguuuuuauuuaaacuauacuuaaaaguaacaaauacaagcagauuugaagccagacacaguuggucuuuggcgaguauaugaaauauauaacuccacugauaggaacaguucucagcucuacuagagagauguccaccaacagcaggcaguuagcauauugggggcuuccguuguuguggcacuuggggguaauuggguagcugacugcuuaagucagggaguauguauuagaaucguguauuagaguauguaucuguuaaucuggauaguugguuuaauggauugcuuaagagaguuucuauucuauuaaauaccuuccacuaaccacuuuuuggucucucaggccccuagaauugcauaaauacugaagcgcucccucacuuucugggaucauauaaaucucauaucuaacuuccucaggguuugcauccuuugccccuuauccggcuuuguauuuucaaauuaauacuguuuaaauaauuuucaaacauucucagagaagauuugcuuuacaguacgaagaacuccccgugcccuaaccaucugagaguaaguugcugaccugagucccuucaauguuuaguacuugaaugcauauuucccacauacaaggacauucuacauuaacugguaauucagcucucagaagcaggaagcuaaacuggauacguacuaccauauaauccucauaccccauucaaguuuuacuuaauaugucaauacuauccuuuuauuuuucauuuuuuuuucugagcaggaguuauaaccaacucugccuuuauauauuuaaaauguugauuuacuccuuuagugccuuggucaacaggcuguuuuuagcaguaugguuuuagguacaggagaauguuuucugugucgaaaauuguuuaaaauagaauauaaaaaagaauucuaauugcuuucauuaaauauguacugagcaucuauuuuguuucagccucauagacacagagucauggugauauguccuuauguaucuuaagcauuguuuucuuucuugauauuucuugauacuacaagcaccauccaauauucgauaguacuaaugguaucaagacuguguuuagaccaaaauauaaauaaggagaacauaauaggugaguggauuauaaucuccugagagucacaauccucaguccugguguacaccuucuaggacuucagaagcucaagaauuguccuggcaguggcuucucacagaagggggcagggcugccucaccacgcggcgccuugaccgguauucacaccaggcuuuacgaugagucuggguuuuggcagcacuuccaugugaaucauucacuguccucaccaacuguccgugccuguuaugugacagccacugugcuaggcacauguagagaugaucgacacaagucccucucuugggcggcuugcagucuaaaaaggggaaacgagaaaauucaggagggugcuguaggugcugugauuuaagugggucugugugaagcauaugcuguggguccagaucuuacgauggguuuacuagaagacguggugaaguuugaguuuucuugaaaacuucgaggauggaugaggggaggaggcuaggacaggggcaucugagcagugacagguaguucuuugaaaaaguaggauguggugacagccuagguaugacauaugccuucccauugguugccaguauugauugggcuagucucgcuagucauaaggguuuuucucuccuuauuuuuugcuccauaugcauucuucaucucaugaagucuucccagugaagcugugcuuucuguugcugaugagagaaaaaucagguauuucuagggaaagaacugaauugaucccacagauaaauacuugccuuaaaaaaagaacugaauugggagcuggauguaaucuacauaaucuggacuuucauccccauuuuuccacuaauuagccaugugacuuugggaaggucacauaaccuuuaugagacaguuucuucagguguaaagugagaauaaugauucugcccuggacaccccacaggacugaggggagggucagugagaugaugcaggaucaguuccaguuuacaaagugcucucauauaggugagccguccuccuuuucuguucuuuguggguuuuuauuuuucaugagcuucuguuucuaagguauauuuugaaauguaauaugaauuuguaauuugauguauauaacauagguaaaauuaggcaaguaucuauuuagguaucuaauugugcagauucuuuugucacugcccugcauuauagccauaucaguuauuuuuucauugaaagaaugcaguuguuauuuuuguuguuuuuccaaauucuuguaggaucuaauuuccauuuugccguuuaaaaaauuauuguucauacgaucuuuuaaaaggauuuuuuuuuaaguuugccuucuguugaacuaggaguuaaguacuuauuuuucaacuuuugucuuuauaggaucuuuaaugacuugcuacugugggaaccaacagcuccuucaccaguggagacauucgagaauauuuccuauggcauugggcuuucaguagccagucagcucauuaauacuuucaacaaagauaguuuuagugcauuuaaaucugcaguucacuaugguaauauauuuuuaauuuguuuugauuuaaaaugccuaguuuaucaauuaacaaaguacuaaccuuugaauuguggauuuaaaaaucuuuauguuucauuguaacuauauuuugcaauuucuuuuaguaauuuauaagaauauuuccuuauuucuaucuguauauugagaauaucauuaucacuuaaauauguucucuuuagaaugauagugugcacauuguuugaaguucaaagcuaaagagaaaaacaguauguauuucuguguucacaccauauucuuuguaaaacuaagcagguuauauaaaauauuuucaugaucauuuuuauguugcuguuuuaauaugcuaucagaauguaauuguauguuuauuucucauagaugaggaaaguggaucugaggaggagacuuugcaguauuuuuccacuguugaucccaacuaucguucucgcaggaaaaaaaaauuagacucucagaacaagaacucucagaguuuucucucaguucuucugaauauuaaucauggauuaauagcaguguucacagaugugaaggugagguuuacaaauccgaaguguuuuuucaaauguaucuuacuuuaaauaaaucugcuaggauacauaucuagugauugaaguauuugauauuuugaaguuguuucagggacugaugaagaccaguguccuggggcaaaccaugaugauagcaacuuuggggauuuagcuuucguugcagaucaaacuuuguggggcucucccuuuggaaaacaggugcuaauucugcuucuggggugacaacaaaguacagagauucaucugauagaagagguuccacauagcauuuaaguuauccaguuuuauuuuauaccaugauauugaauaguucaaggauuagacugcuuugcugcaguaugggagauuuuccuaagcugaaucaacaaagagcaucucaaggaacaugcuuacuuuucugcauuuaaguaauaacuucuguguuuuucugaucuuuuuacuagcaagauaauggagaucuguuggaaaacaagcauggugaauucugguuagaguucaauagugguucauuauuuugugugacaaaauaugaagguuuugaugacaagcacuacauuugccuucauucuagcaguuucagucuguaccauaaagguaggacaaacacgugucuugguuucuucucuuuagacauguuuaaauuucuuguuuaacaaagaaaaucuauugagaacagaacuuugguauuagaaauuauuuucuguggagggcucucauucugcugucaaaguaauauuuacaaauuagaagucaacuucagguucuuuuuuugcaauagcuuuguugagguauaauucacacaccauacucauuuaaaguguaccuuucagugguuuuuaguauuucacaagaguuaugcaaccgucaccauagucaauuuuaaaacauguuuauuaccccaugaagaaauuucauacacuuuagugauaaacuuucaccccuuccgcucucuccuucccguaaacacacuaaccuacacucuguuucuauggauuugcauauucagaaguuucuuauaaauggaaucauacaauauuuggccuuuuugacuggcuucuuucauuugacacgcuuucaaaguucauccaaguuguaucuguacuucauuccuuuuuauugccaaauaauauuccacuguaaagauagaucacaucuuauguauccauucaucagucgaugggacuauauguucuuuauucuucuuuaaggaauauuuccuuuugguuccagauauagaaccuaccauuuuuugagcaguuaccugaguuuaccuuguuucauagacaugagauguuugugauaguuuucuauuuaauuuuccuagcauuucagaaucuuuuguuucuuuaagcuguguacggucagucacacuaacauuagcaaagaggaguggauuauuaaugccaugcugguuuuugucaucaugccuccuuaaguuauauucaguggaaguacguggauuuuuguuuugagucauguaaguugauuagcuaauuucaaguaaucauuuuguuacuauuuuuaccucaauguggaucucuaggcauagugaauggagugauucucccgacagaaacacgacuucccagcucaacccgcccacacugguuggaaccuacuauuuauuccucugaagaagauggccucaguaaaacuucuucagauggaguuggaggagacaguuugaauaugcugucuguugccguuaaaauauugucugauaaaucagaguccaauacaaagguuuguguuuuguacuuuuaugccacuguugauuugauucuagcuaaaaauaauuacauaaaaggcaacauauuuauuuucuuggaaaaacuuuugaguuauaggauuacauaggugguaaaugucauucuuugucuuguucuguauaggaauuucucauugccguaggacugaaaggagccacucuccagcauagaaugcuuccuucugggcuuagcuggcaugagcagguaagagagcuguuauauauguauuaauuuauuuaaaaauuuguguugacaucuaauacacauacugaaaaguuuguaagucauaaauguucagcucagugaauuaucauuaagugaauacuacggugucaccaccuuuuagguuaagaaauagaacaguauuggccgggcacgguggcucaugccuguaaucccagcacuuugggaagccaaggcagguggaucaccugaggucaggaguucgagcccagcuuggucaaucccgucucuacuaaaaauacaaaaauuagcugggcgugguggaaugcaccuguaaucccagcuacuggagaggcugaggcaggagaaucgcuugaacccgggaggcggagguugcagugagcugagaucgugccacugcacuccagucuggcgacaagagcgaagcucugucucaaaaaacaaaacaaaacaaaacaaaacaaaacaaaacaaaacaaaacaguauuaucaccucagaauguaauugguuuuuuaccuuaaagugugguccucaaaaccucucaaugacagaguuaucuuauaugucauuaaaggaagggaagggacucuguaucccaggacuuguagaaugucuggcguagaggagcagugaaugguguguugaauugcuuuuauaaucagaaguucuuuaagugcaauauuuccauauaauucccuaggccaauaauaugauguugcuuuaaagcauuuuaucaggauuucucucauuaauuuccaguucaacaacuuuuuaugguaauaaaauacaauugguuauuuuucagaggagacuuugaguaagaaguuagcuuuuccuuaugugagaaugaaaacuagugcacuaugauugcuucucauguuucuuauaaaggagaacuucuuaauugugcugggaaaauaauacauuauuuaaaaacuugaguguuuucaaaauucuuuucucaugaaagcauuuaggaaacaugagaauaucugucugacuuucuaucugguaggaguagagaagugguuagggugaauaaccagcuggaagggagacauuuagcagaaccuccuuauuuguuuggauuagaaauaugaaagaauagauguuggugagagggacugguuuuuagacugagcuagguauacauuaaggaaaaagagcuuccuucaacaaugacuuauaugaaaaaccaaucgccccugcacacaaugaguuauauaagaagccagauugauaguuuuaagcagucuuuagcaaaauuuauuuuuucugagaauuguuccaagccaaaaaauaugaaauuauauuaugcauacauuguuauuaauuucauaaggugugauuuucuaagauuucuguagcauuggaguuguuggauaggcuucugcauuucaaauucuaauuuugcaaauacuuuuaaaaaauuuauuuuuauuauauauaaggugaauaacaugucuugauaugcauaguaaaaugccuauuguagucaaacgaacacauccaucaguauccauuaccuucuuuucugaugcaaguacuuuuugaaacuaauuccuucaaaaugaugauuuuuuuccuuuuaccguuaugauuuuccaauuaaaugauuuuuucugugagauauucugguuuacauugguauuaaggauauuauaugaaaccuuuuuuuucuucuaaagcagggcguuuuaauuuuuugugauuauagauuuuauacuucuugaauauugcugaugaaccuguuuugggauauaauccuccaacuucauuuacaacuuuucauguucaucuuuggagcugugcacuugauuauagguaaguucacaaauggaacaaaauaaaguuuuauuuaaaaugcuacuaaauuuugaaaaaaauacauaauucaguagaguuaagguucaaauuguuguuguuguuguuguuuuuaauagaguuucuggagccguaucaaacugauguucuuuuguuucucuuuggcauuagaccccuuuauuugccaauccgaucucuucuuaccguggaaacauucaguguuuccaguagcguugcauuggauaaaucuuccucuacucucagguaccuguguaaacuucauuguauacuaaacaaagcuguucgaaacauaccaauugauauuuaccuaaaccauuuuauuaaagucucaauuuuuuguuaaacguucuuuuacuaauaguuauaaccuuuuacccaaauuacccaauuuuucucaggugacauguuucaucuacccauuuauuauugcauuucauuuuuagggaagaaauuaauucuggagauucuuuaaaaaguuugcauuuuaaaacauaugguaaacuucccaugcuaccugauacacuuuauacuuuuuauuuaauuuuuuuauuuuuuagagacagggucuugcucuguguggcccaggcuggaaugcaguggcaugaucacagcuuauuacagcuuucaacuccugagcccaagugaucuuuugcccucacccuacugaguagcuaggacuauagacgugugccucuaucccuggcugauuaaaaaaaaaguuuuguuuuuguagagaaggggucuugcuguguugcccaggcuaguugagaacuccuggccucaggugguccuccugccuuguccucccaaacggcugggauuacaggugugagccacuacaucuggcccacucuaucuuuauacuauaguuuaaaccuugugaauuugggcaucucuuuaaaaacugccaaaaauuuagaauuaauuugaguagaugauuuaaucuaauucuuuacaccauuuaaauauuccuagcauucauaaacaguuuuuaaaaaauguuagaugacaguuauaaguuagaaacugcuuaugauuucaacaauguucauaccagaaagaaugaugcaauuaagcauauagugauuaugggguaugauacucaaagcuuaguuuuucagauguugguuuuaucuuucuugccucagaauaaucuuggaugaagcugcuuuacaucuaucugacaaaugcaauacugucacuauaaaucugaguagagguaagaguuaaaaaacaaauggaguagauaaauucugcuuuauuuuugugcguaaauaauuuuaaagcauuuuaacucugggauaaugcuagugaacuaagaaucuuauuaaagauccuuaaagauuaaagggucuuuaaguauauagugaucaugugguauauauucacagcuucauuuuucagauacugguuuuucaguuugaaauuguaauguucuuauaaugcuaguuaaguacaucaaauuacuauauauacuacaaauuuuuauuuaagauaauuuuuguuucuaacaaaaaauaaagugaauuuuaggacuucuaugggaugaaacuauuuucauugcauuauaauuauuuguagugcucucugcaaugaauuuuaaaggaaugcuaguuguauuggguguugguuggauacacauuuuugaaagcuguacugaagagauuuucuuaauuuuaaaaauuuuagauuauguucgugugauggauauggggcuuuuggaguuaaccauaacugcagugaagucugauucugauggagagcaagugaguuauuaaaauaaaugaaaauuuuaaguucuauuuuuuaagagauuaaaaaaauugaguuuaacauuuuuccguguaccuaauuuuggucagaaauagaguaaguauauuaaaaauggauuuauuuaaauacuuuuuuuauguagcgagacagauuaucaugaaucuuauuuaauguaaaucuaugcaaaaaaagaaacuuuugucucauuuggaaaacauuuucaucccuuuuucugugucuuguccagacugagccccgcuuugaguuacacuguuccagcgauguuguccauaucagaacgugcucagacucuugugcugcguuaaugaaucucauucaguacauugcaagcuauggugacuugcagacaccuaacaaggcagauaugaagccuggagccuuucaaagaaggucuaagguacagucagcaaugugauuccuccagucccugccaugucgugacauguuuacauuauugaggucuucaugacagucauaagguagaaaagaaacuuugaaagucauucaucuguucuuuaccuucagaauaauggggucugaaacggugguuucaugggccuuuuuggaaaaccauucugcuguuuugauauucuuuguuuccauuaaucuuccuagcaaacaucauacuuuuuuuuuucuagacuuguuauuuucaucuguccuaagggaagaaagaaaacauuuaucaugcaaaagcuuguucuaugcaaguuguauguaaaaaugcuaugaaaagauagauggcagguguuaguauuguuaccagaagacuuacuuauaucaucauauuuucccuauuuuuuuaucucuaagacaauccaguuuucaguguacuuugucauauaugacuuccuuuuccuuucaugaugaccuggugagauagagagguuaaaaauuaauaagacccagagaauuuagaugauugcucuaaagaguagcagaaacagcaacaaacccagauauuuugguguccaguucaaugcacuuuucugccccaagugucaccuuucuaacuucucuuauguccaaauugaagaauguccaguuuguuuagcauuuuuucuuuuucauuguuauucuuuguggucucucuuaugaacagaaaucucaguccccuuagguucuagagccucuguuauguacucuaguaaaggccugacuggcaucguguuuguugucuuuuguucaggauuauuuuacacuuuauuuguguuaauuucuguuugugacuccuuguuccugcuguauucucacgauaaggugauuuaugacaccccgccuacuauuuauucccuuuuaaaaaacauucuucuuauuuuaaauuaucccuuucagcuuggaacuugcuauuuuagagucaugcucacauauaaaaagcacgaucuggguuuaaugaaucuacaguucaccaaccauuggugaaguauuugguuaaguauuuggugcuggaacugagcucugaaucaccguuuaguauauuuccccugcugugugugcccccuacuguuguuagguguccaagaaaugaggccucguccuacaggggcuuuaugucaaagggaugaaagucauugcaaccaucagaguugaggagaucaaacuuauuuaguuaucccuucuuucccagcuuuauugcaguuuguucaacuucccuguuuucaaaugcauugccucuucaagaucccaguucacugugcuugcuuugagguggugacacauuuauugcucuuugccaguauuuguuagggugauaauacuaaaaacuugaaauauaacagcugcugggcauagaaaaaugaguagguuucuauuucugauguuuuuguacaauguaauguauuuuugggauaaaauaaauguaaguaguuugguuuuuaagagcauuuucaguuauuuuuaauuagguuuuuuggcuauagguagauuccaguggucgaucauccucacgugguccaguacuuccugaagcagaucaacaaauguuacgagaucugaugagugaugcuauggaggagaucgacaugcaacaaggcaccucgucaguaaaaccacaggcuaaugguaagaccaggacucuucucagggagcacugauguuaauguuggggcuuacuuuauuuguguucucguaaauuuaauaagucacuuauuaaagacgcauaugaguuuuuauggauaucuguuaaucauucagcuugugucuacucagugucuaguaaauagguaacucuggccaggcuggugucgggaaugcagagugaguagaagacagugcuuauguuuucugguagcuuguagccuaguaaaacaaaugggcacaaaacuggugccaguacuuagacugauugauaaaugauguaagaaaauacuucaacugugguauauccucuacuguuuggaaaggauugggauaauuuuauuagacuuuaguaaaguaagauggcuuggcuuuuuaaaagugguugggauuuagguauguaaagagggaggagaagguaaucuuggcaaggucauuaacaucaacagagcacagacaaaggcaugcaugagccucaguuauuuagccaugacauucggguucuuacugaaacaaaaguucucuuauugaaaagaauuagauaauaaaguuggguaagcaaagagggacccaggugauucaagauccuugaaagccaaagggaagcagguaaacauuuuaaagccucuauuucaacaguauuuucuucuaauugaauggucauagcuauaucuauauauugggaaaucuuaauuaaaaauuauuucauggaguuguaaaagucuaguguuaacuguugcugucuugcuaauuuaggauaaauuagaacuaaggaagcaaacuggggcuuuuaguguucuauguacuacauuauuuguaauaaauguuagcagcuaggcugggcacaguggcucaugccuguaaucuagcacuuugggaagcugaggcagguggaucacuugaacucaggaguuugagaccagccucggcaacauggugaaaccccaucucuccaauuaaaaaaaaaaaaaaaaaaagcuagaugugggauguguuggcaggcgccuauagucccagauacuugggaggcuuagguggggugggaggaucaccugagcccaggagacggagguugcagugagccaagauugugccacugcacuccagcccggguaauagagcgagauucugucucaaaaaaaaaaaaaaaaaaaauauauauauauauauauauauauauguguguauauauauauauauauauauguauauauauauuuauguauuuauauauauauguauauauauauuuauguauuuauauauauuuauauauguguguguguguauauguauauaugcagcuaccuuaauuacaugggaaagaauauuuagugauuauuuacuggguggcuucaauauacaagauucuguacuaggcccuggguaccuguaaggaugaguaauucugagguacugcuguagaagaaucuaaaaucuaaucugugagucucuuaaagccaguaugucucuugauucagcuuaguguucucagccucaucacaguguuugguuuuaaugaaugaaugggaaaagaaugagugacucuuaauauguaauguaaacauauuaaaauauauguugacaugcagauuuuggugcacauguaaucuuuugcgauagcuaccuaagauuagguauccaguuuggguaucccaggccccaggaagaggucuucuuuucauacuugaaucacugccuccucugccaccuaaugcuugcucaacagcuauucuucccuccccuuccccuucccucccccuacauuuaggcucugcuaaauguaaccaguuuccccucacauuguaauauuguccaagaaguuucuuccagagcuccgccuauaggacagaauugucaaaggugaaauucuggguaaagcaaaacuccacucaacacuaaccagcaacugcugagcuuccccaacgccaacuaacugggaggaaacugucuuugugacauugccauuucgaauuuaucauuugucuuuuuauuaguuguuguuuuuuguuuguuuguuuguuuuuuugacagguucuuggucugucacgcaggcuggagugcaguggugugaugucagcucacugcaaccuccaccucccggcuucaaacaauucuccuaccucggccucccagguagcugggacucaggugugugccaccaugcccagcugauuuuuguauuuuuaguagagacaggguuucaucauguuggccaggcuggucuguaacuccugaccucaggugauccacccaucucggccuucuaaagugcugggauuacaggcaugagccaccaugccuggccuauuagugguuuuugauguauuucugacucuugcugagguguuuuggugcauguuacuuagcucucuuuaagccucagauucauagacuuauuuuaggaaauaaaugagauauugcagguaaaagcacacaacauauaucugacacaugguuaaaaugcuuguuguuguugauauuucaaagugugccaaaauguuguaaucuuuuuaucuagguguuuuggaugaaaaaucucaaauucaggagccauguuguucagaccucuuccuguuuccugacgagagugggaauguaucccaggaguccggccccaccuaugccucauucucucaccauuucaucagugaugcaaugacaggugugcccacugagaaugaugacuuuugcauucuuuuugcaccaaaagcagccaugcagguaauaaauuaauaacauuauugaagccuugaaugguguuacaaaugaauugaccaaaggguaccuggagaaaauucuguugauuuuguaaauucuuuauaguucagaguuacuuuuuuuuuuuuaauauacuauugacaguuggugaaugguuacuguacuauuucugugacacaucuaaagacucagagaagaaugcuauuugcaaaauuuccaacauagauuauugaacuccagauuuuuuauauaguaagaugacuauucaaggaucgugaaauuaaauggcagaaggaucugcuggacagaauugcuaguccaagaaucgggaaagauaagaugugguuugugugaaggcugaugguugggguguguuuguguguauguauagauauaaguguguguguguauguguauuuggaaacuuuccaggaauuguccaguaggugaccguauuuguuuacaaaguucugagaaccuucugguuaaauuuuuaaaaauccaaacaaucaaacucaggauaaaccuauuauuaaaaacaugguaauaucauccauauguugaaauuuguuaacuuuugguuugcaguauugacuuuaaacaaaaaaaaauacccacacacuaaauuugugcuuuuuuauuaucaaacaaguagugaaagccgaauuguaaaccauaaaaaauccuuauggagugguuuacguagaacaaagagaguuuauuuuaugguuaauaaagcagaauaucuuuguggugacuaaugucgguaaccaucaccuuauuuuauauacuggaauuauuaaaaagaauguagaagcaagaaugccccuugagaugugcagcauaaucaguuguuucuaauuagaaaagagaguauguguuaccuguuuguuuauuuuaggagaaggaagaagaaccaguuauaaaaaucaugguugaugaugcaauugugauaagagacaauuauuucagucugcccguuaauaagaccgauacgagcaaagcccccuuacacuuucccauuccugugauucgcuauguggugaaggaggucucucuugucuggcaucuuuauggaggaaaggauuuuggaauagucccucccacuucuccggcuaaaaguuauauguaaguuaauuucuauauaaguuuauuugggaggccaauauauucuuuucuuagaaaaauagaauuuuccauuuccccuuuagagagaaaaaagaaaaauaggauuuaucauuuuaagaauuauuaauaaaguaguauuaaaaacuguaauuuaaauguuacucucacaguuuuccaauugugaacuuauuuguauuauuuguauuuuuacuaaaauguugacucucaucauuuucauucagcagaaauuuucagguaucuaccauguaccuauuucacaaaaaugaguagguccugugagucaugugagugacagagggcagugaaacgcaggaagugugucaggagguggggucgggcaugcccuguccccagcauucagcagggcacugagcagagagccuguggucauugagcgccugugagacgagugcagugugccggucgcugggagaaucagguggacagaaucccuguagggggcagacuuccuuauugagguggggcauggcauggaggcugcguggagcaguaacauuugacacuauaguucagcagcuuuuucuacuuaaaagcgacuuuaaaacacguccaacuuuacuauaauuauuuuguguauuaguugggauuccuaggacuuguguucugacuauaaaggguuuccaaaguaacaagaagcuuauaaggaggucucauuucuaaguguauccugugauacggaucccagcaucauaauuagcuuuuccuguaguuuugaguauuuagcaagcaggugauuacucuaauggcaauaaugaaacgcguguuucagugucuacagaguaaagaagauacgguuuugguuucuaguaauuuguggcagcguucugauagcucuguacucuuacuuugucuuucaucuuaucauuuuccuuaaugucauucauugacuuucuuugaauauuccuuuaacaaaaggguuuuuuuuuuuuuugcucauuuuuaguaguccccacaguucgccuucucacacacccacgagacauggacguaauacaguaugugggggaaaaggaaggaaccaugacuuuuuaauggaaauacagcuaagcaagguaagauggcauuugaaggaaaaauccacuuaaguaggauauuggcgggggguucuuuuguuaucccccaccacguagucuugagccuuaagucccaacccuuuggauuggaaaagugcaaggaucuuguauaaaacucuuaccucuuuuucauucucaaauguucuaagaagacugagguguuuuucuuuuauuuuuguuugucugggcuaccgcuagagcggugguucucacaguugagcaagcccagaauccccuggagggcuuauuaaaacacagguuucugggcuccaccccagaguuucugauucaggaagucugagguagggucagacugaggagaugcugcccuagagcaucugucugggaaagccuguguuuggacagugcaucuggcagguccuuugugagacuagagaccaguagggccagacuacugauggcaucacacgcauuuaauucuaccagcuugucugagauuguaccaagugucauauuuuaggauaguuagcauggcaauauuguagugaugacaauucccuguauuuaaucauaucugugccuccuuuuggaacuugaacccugccucugcugauucauuuuaaagcaauuucauagguaugcaagauaauaauuuuaugucuuauuccuauugagaauuuuccuuggaaauaagggauuuuaccaaggucaaauagaaauauuagucaagcuucucuguguaugguaggguccacauagucccccuuauccacagacauacaugguaauagccucaguggaugccugaaacugcaaauaguacugaacuuuauguauacuguguuuuuccuauacauacauaccuaugauaaaguuuaauuucuaaguuaggcauaguaagagauuaacaauaaugaauaauaaaauagaauaauuauaacacuauacuaaaauaaaaguuauauggaagguauuucucuugguuucaaaauacugaaauauuuuuggaccucaguugaccauggguaacugaaacuguggaaagcaaaaccuuggacaagcagggagcacuguagauuaauaaaugagugaacaagugaaggaaugucauguuguugaguuuuuugaagguggaauuguaagcugagguagaauucagaggaaaaaugagugauauuuugcauuuuaaagagaaaauacaauuuaauaaaaggaauguaaagaacuguuccgcguucuuccuccuuacccguuaaggugaaguuucagcaugaagucuacccgccaugcaaaccugauugugauuccagccucucagaacacccagucucccggcagguguucauuguucaggaucuugagauucgagaucguuuggcaacaucacaaaugaauaaauuuuuauaccuguauugcaguaaagaaaugccucgaaaagcucacuccaacaugguaagaguuaaccucaucguuguguuauguuaguuuuggaaacguguuuuuauuauaucuaacuucaggagaguuaaaguagggaaaauuacuagauaucuuuucucauuuuaaugugaaaagucccuuuugaauguauugcuuaaaguuuuauguuuaaaaaauuauuuugcaugucacuucuaggguccauuaacucuaauugcuaauaaauugauaucugaggaaaaguagaagucccuagugaucaguacaaaauagguaguauugcugaagguguuccagauuucuaacacucuuuacauuuuaguaagguagaaaugauucuuucaggacuuuggaggucccucacagaauuugauuuuggcauauggaccuaugguuagcuucaggguuucaguaaacuguuacuaaguacaacauuauccauuugcaauuuuuccucuaaagagagucuacaucuuuaagcaguuuuuuuuuuccccccaacagugucucacucugugacccaggcuggagugcagauuguaguucacugcagccgugaccuccugcgcucaaacuagccucccauucaaccuccugaguagcugggacuacuggcagugcaccaccgugccuggcuaauuuuuuguuuuuuguggaguugggguuuuccuauauugcacaggcuggucuggaacuccugaacucaaguaauccucccaccuuagccucccaaaguguugagauuacuggcaugagccaccgugcccagccuuuaaucagauuauugaugggggcaugugacccaaaaauguuugauucagacuuuuaaggaaagaggguaaacaauuccucuuuuucucauaugguauaggaauaggaauuuuucuuuuuuuuucuuauuuuuaaagagaagaaggucaucauauuauuggggaaaaauguuauucucuuucuugccuuguaguugacagugaaagccuuacacguguguccagaaucuggcagguccccacaggagugcugcuugagagugucgcugaugccgcuccgccucaauauugaccagguuuguagcaugagcgugauuccugccguuacaguuagauuagacugcauguucagaauaaagaaauuguaauguuuaucauuauugaacuuuuauggcgguuacauauauaaagcaaacuucugauaaagaauagggcaaauucauuagauguuuggaaucugaacuauggcugagucaacaucauuagauguuauuccccagucuccuacucauggugugauguagaccuuaauaccugcuucuuguucucuaauccucaaguacucuacucccaguucagauaugcauacauuuucagagaguauuagaggauucccugaugaauugaaugcugcucugucuucauugcagcaucuggaagagaauucuuucugugcugggcaaaaugacaaaugaguaaauugguauacauaaagaggucagaaacaacagagauuuagacuuucccuaaaaaaaacuggaguugggcacagugaaauccacuuucccguauucuagcaggcaucccaucaaauucuucugggcuuugcuuugacccagcgaucuguuuaaaacauagcuggugccucuuccagaaacuuuuuaccaagauguaugaaaauaggaugcgcagccaagguauaguaauagaauggcgagaagcauggguuuggagucagaccuggguuccagucuuaguucuguagcuuuuacuaguuguauggcuucggguaaguuacugaacaucuccaagccuuaguuccuucacugauaaaaugggagaaauaguaauauguguaucauaaugcuuuuuaaaaugaagauuaaauaaaucagugugugaaaaacauuaacugggugccugacacacuagguuagggaucaguaauguuaacuguuguuauuuaauaauaacauaacauaugauaauugcagaacauaaauggaguuuuuaacuaaucugcugugaaauaacaaaaccuucuugacagaaauuguguugauaugagcucagguuuggaaguagaguauuuauuugugggguggacguuauuaauuugcuuaaauaguacugguugaauaauguucauuaguuguuuaaauaaaacuugaauaacuaaaagcugguaacaaauauuucaagacugagcuuaaauaauauuuauaaacaaaaaauaggcgcugucuuagagaaaauguacugugaaguacagaagcuuagcauagcucuacauuaaugcuuauagccucugaccuagguuagacuugccaaucaguacuuuaaguuuauguuuuaucauuaugaaaagaagauauuuugauauccauacuuuaacuaaauuuauccauauauugauuggccuaguggaaauacaaugaaauauuugugggaaaauugaucuguggcgaucaccagugugaacaagacuuugaguaagauacaucuuucuggcaugacuuuacgaaacuuagcaagcccaauuuucuuucuuuuuuucuucccccgccacagugucucacucugucacccaggcuggaguguagaucauggcucacugcagccuugaccuccugggcucaaacuauccucccgccucagacuccugaacagcugggauuauaggcgcauaccaccauguccagcuaauuuucuauuuuuauuuuuuuguagagacguggucccauuauguugcccagacuggucuugaacuccugggcucaaguaauccucccaccuuggccucccaaagugcugggaugauaggcauaagccacugugcccacccuaauuuucuuuaauagacuuuuaaauuuaauauugaacacaauuucuuauuuagaacuauaaagcauuaugauuuuaaaguggagaguuauuaaucuuagaaccaucagggaaauaaauuuuaugacuaccuugaggaagaaugagaaauaauucauuaagacauaaaagcuaggaaaacaaagccacaccacaaauauguaagcguuaaugagguauaucaccugacacaaaaauucuuuucaguucgccucuuuuaagauugcuauaccauauuuugggauaguaaauggucgucugaguagaaaaucaaauauuuuuguuuauuuuuucuugugaaaacaaaucaguuggugaaugauaaugcuuugaguauuauuuuucuaaccgagcacauccccacuuauucuucuuaauugaaucauguuaaguaugaaagcaacacauuauucuuucauguuuuugaaaaagcugcauugccauugaagguaagugcaacugcuuccaaagcucaguguucccuuagggcaggcaguaagcauugcagauggaaugaguuccaucugguggauaaguggaugauggaggucauacagcuaggcaguuugagauucaaaauaggaagggggccggauuuccugacucugcuagccuauuauccauuuuaguuuuguacugccuggaacucugccgggaaagcguaucaauucauucaagaccauuuggugaaugccugccuugucccaaguuuuauauuaggaugcuggggauacaaagaugaauaagacaucucuaucuucaaggaucucuuuauagaagacugacauaaaagagauaguuuuaaugugcuguggugaguacaagugauacagauaggcaugggaugguaugccugaccagaagauggcucuuaaccuagacugggaguuuggaagggugagggaugcucaggaaaggcuuucuggagguggugacauucaaggugggccuuaaggagugcaguggagcuaggcaggugaagauuuuuguaaagauaccaaaagccuuacucugauuguggacugggacugggagaccauucugcuaaggaagauaaguaagugcucaaccaggcucuauaggaugaacauggagcagcaccaguuugcacaauuguguuuuucaucauuauugcuucauugcuugaguaugacauuaaaaggaauucuuuuaacacuguaagucauagugcaguauuaauauccuuuaucauaggaucuucaaacuagacauuuuacagucaaaguuuagcauaaacaauuuuuuaaaguuuaaaaacauugauugcacugagguauaauuuacauacacuaaaaugcacagcuuuuaaguguucaauggagguuucacagauuuacacacuugaguagcuacuaccccaguugagauauagaacauuuuccuuaccgugaagacgucacucaugucccuuuguaguucaucuucaccaucccaaagugacuacugacugaucuuuuggucaccauagauuaguuuuuuccuguucugcaacuucauguaaauggaauuguacuuggcuuccuguacuuagcguuaagucuuugagauccaucuauguuguagcauguauccacagugauguuuauugcugaguaggauuuugcuguggauauaccacgguuuaucuguuuaccugcugguucacacugagguuguuccaugguuuuggcucuuaggaauaaagcuguuaggaaauuuauguagaagucuuuuuaugggcauacguuuucacuucucuugguugaauaaauacauauauaagaguagaauuucugggucauaagauaaguauauguugagcucucuuaagaagcugccaaacaauucuucacaguggcuguugcauugcauauucccaccaauagccaugagagcugcagcugcuucauagccuugccaaacuugguauugucguucuuaaaauuuuagcugggaugcuuuguguacacugugguuuuaaauuggauuucccugguaacaggugaugcugagcaucuuuuuaugugcuuauuagccauuuguguauuuucuuuugugugucugaagugucugugucuugcuaguuuuaaaauuggguuguuugggucgggugcggguuacucaugccuguaauccuaccacuuugggaggccaaggcaggaggauugcuugagccuagaaguucaagaucagccugggcaacauagugagaucuuguuucuacaaaaaauagaaaaaaaaauagccaggcaugguggugccugccuauauucccagcuauucaggaggcugaggugggaggaucgcuugaacucaggagguggaggcugcagugagccaugaucaugcuacuguacuccagucugggugacagagcgagacccccaucuguaaaauaaaauaaaauaaaauugaguuguuggucuuacugauuuguaaagaguuuagcauaaauaccaaaaucaaaaaauuuugagaacauuuuaaaaagcuagugauuaguggccgggugcgguggcucacgccuguaaucucagcacuuugggaggccgaggcggguggaucacgaggucagggguucgagacucagccugaccaacaugaugaaaccccgucucuacuaaaaauacaaaaauuagcugggcuugguggcgggugccuguaaucccagcuacucaggaggcugaggcaggagaauugcuugaacccgggaggcagagguugcagugagccgagaucgugccacugcacuccagccugggcaacagagcgagacucugucucaaaacaaaacaaaacaaaacaaaaaaagcuggugauuagcaucucuuuaucuguuguuuugugcauuuguggugaaaaaugaguagaaaccauuguaucuuuagucucccuuuuuuuuuuuuaaagaggaaauugauaccugaaaauuugcuguuuuuuugaagguaaucauggagucccaccauuuauggcauuaaaauaucaccaucuaguggccaaagaauagcauuuuauaugcuguuaaacuguaaacauguaauauuugguauaauaugaauuauauauauuaaauguguaugauggaaauaauacauaaaauacauacaugaauauauauguaaagcauaacaauauaaugaacaauucaugaacccacuaccccgcuucagaaucagaauauuuccacuacugacgaaaccaccugcuugugcugcaguccauugcuuagucucccauaugcauguuaccuaggauauccuucucauuugcaucauuuguacuucugagauaugugaucaguagacagagcuuuuggaauugucaaacuguuuuggcgugccacuaaauauuuugacccuucacauugcauuuuggcacaguauuaauguuuuauauuaguuuagguuuuuuguuguuggguuuuuuuuuuuuuuuugagacagugucucgcacugucgccugggcuggagugcaauggcgugaucucugcucacugcagccuccgccucccagguucaagugauucuccugccucagccuccugaguagcugggauuauaggcaccugccaccacgccuggcuaauuuuuuguguuuuuaguagagacgggauuucacuguguuggccaggcuggucuugaacuccugaccucaugaucugcccgccucagccucccaaaguguugggauuacagaugugagccacugcacccggccaguuuaggauuaugaaaggaaagaauaagaucaggcucaggcauauauacaaauauauccucgaagauauauuugucaguuugagugagauaggcaaaacgaagcugccuauaaugggcaaauauggcauguacguacaaagugaagacagagccaugcaguuuuuguuuguaauuauguaauuucaggagagaccauacugaauggauuauuuucauuauuuugaauaucauguucaaugaugaaauguauuaaggcaauauaauguaugaaaagcagaaguuaagucauuuggaacuuugaagacacuuaaaaguguccacauggugaaacccggucucuacugaaaauaccaaaaauuagcugggcaugguggcgggcgccuguagucccagccacuugggaggcugaggcaggagaauggcgugaacccaggaggcagagcuugcagugagccgagauugugccacugcacuccagccuggcgacagagcgagacuccgucucaaaaaaaaaaguguccagcacaugauuguugguaauaucaccacaaugcagaaugagagccagggccaagagugagagugcuccauuucuaagaaaacucaaauguacuuugauuuaguccuuuuuacuuuuguaaucuuuaacuucugucucucaguuuucauaccuauaaauuaauuuccucauaaaguuaugagaauuaaaagggaaguguguaucugugugugugugugugugugugugugguggggggaagaauaggaauaaugacuagcauggagaaagaauucaauaaauuguagcuauauuugaacaaugaguaaaauauaugaguuuaagauacuuuguuucauaguuuuagaaauaggugauucuuuucuuccuuaguuaaaauuacaucucuuaauuuuaggaugcuuuguucuuccugaaggauuucuucacaagucuuucugcagaaguagagcuucaaaugacuccagauccagaagguauuaaauauguauaguugaaaagacuauaccaaguacuuggauugauuuuaauuguuaugaggcuuuuuugagaauguacuuacaauauuuauucccacuuacauaaauguguucuguguuuauuuuuguugauucgcgaauacuguuuauauaaaaguaauaauuuaaaaggugaaagcaaauuuucucuguaacaagaaucguauuuugauuaaauaaaauguagaaaaacaaauuagaucaagauugauuuaaauguuugcuaagaagaagcauaucuaauuuuucaaacaugcacauuacauuuucaguuaaaaagucuccuggagcugaugucaccugcaguuugccaaggcauuugaguaccucaaaggagccaaaucugguuauuucuuucucugggccaaaacagccuucccaaaaugauagugccaauucaguggaagugguuaauggcauggaagagaagaacuucucugcugaagaagcaucuuuuagggaucagccuguguuuuuuagguaacuaauuuaguuuuaauaacaaaugaaguuauuuuagacuuuugaagauuguucugugauguaugugugcugguaaucaugagguuccgucagcuuuucuuugcacugccaaaucaucagcugguguauuuaucuguuugugguccccaucuaauugcaccccccuuauuugcacauaguaaccugguuccaaauucgucucucuuucaauucucuggcaggaauuuccuuuucuucuagcuucuuccuucuuuuucucuccucuguccccucuuuccagcacuguuaugguguguuuguaccagcccagcaggauaucauccuuuugcuuuuuuuccuuuauguaucucaaccuggcuaugccugucugucuuuucccuuguggggauuuucuaccuauuuucucugucugcccuucccagucguuaugugucuuuccugacccuucccucccugcucagugggcacuguuaagagacccagguccgcugugcugcugccgucggcugugacugcugcccaacggcucggccagcucgagcacagcacacugcaguuuccucauuuacagaccuguuuguucuucucaucuucuuucuuuuccaaaacuggaugguagggaugguggcuuggcccuaugggaaagagaagggacugaagaucagugcccccuuguuaugaggagcaguuacaucuucccugauuuucugugcugcuuucucauaugucccggguugcugauuucucucuuucucucuagguucugaaguuagacuuuaggcaugggccaaagucagcaguauuacuaauuggaaggguugucacguuuuaaauauuuugcauagugaugaaaauagguagaaaaaauggaauaugauaauuggaaagaucuuggaauagaugauuccuggugguucuaaaucuuuccaccgccaaagaaggaccuuuuaaaauuaauuuccuacauugauccuuuuauuuuuacaaaaacauguaucuuaagugauaauaugcauucuuauuuuauuagucacauuuauaaacugccaauuugguuuuuguaaacaugggccugaaagcaaagaauuuugccuuuuuuuuuuagcccagaggaaguaggguuacccauuuauuuacguuuaaaaaguacacaagcccuauacuuacuuagguaaauguuuauuuuuuccauuagacuauuuaaaauauugagaauagcuuauagauuuucauuuguacucucaaaggcuccuaaucagugccauagucuaaauuacacaccuuacaaaugaggaaaugaaugcccagagagauuaguugacuugcucaagaccacaguucguggccaaggcacaacuagaacacagauuuucuuaucucuaauccagaaaauccaguacaguuuuuaguaaugucaugagagcccccuuccuccaaacauuuauucauuuuacaaauauuuacugagcacuuaacuguaugccagguuuugaucuaggcacaaaugaacaaaguagagaaaauauuuaauugaguuuacaaauugagauuacaaauaauuaaaauaaaugguuuguccuauuaauaugugccauggagaaaaaaaaagugagaaaggagaguauuggagggcacuggcccgacagccaaguggagcugaguauucaggggaugggcgugaccuggggucugaggcuucugguagugauugguguaaauauagcaucuccauuuuguuguaggcgcaguggacuuuggugagauggcuuaggauguaaccaccaacauuaauucugugggaaaacuguguuucaaguuccaaacauuguuugcagccaacuuuuggaagccagaucauuuuguuagauguguaccaucaguguacaaccagcccucuauaucuggaauucuacaucugagauucaaccaaaauauuaauuaaaaaaggcaauaaaaauaauacaaauuaaaaauacaaaaaugauuugcacagcauuuacauuguauuaauacuauaaguaaucuagaaaugauuuagaguauaugaaaggauauguguggcauauaugcaaauacuaucccauuuuauauaagggacuugaacaucaagggguuugguauccauaaaggcccuggaagcaauccacuucagaaaccaagggacaacuguauaauuauaauuucauucucacaccguucccuauauuuguuugucgauaauucuguuuacuuagaaucauuaguuucaaggauucucacaaaauuuaacaauguagguggcauuuuaacaauuucugaagacugagcagcagagaguucaagugacuugcccacaguugcaugucauagaugaaccugggguucaugccaggauugcuggcucuguuuuaccagacagucaaaauaauuccuuaggccuucucuuuauauuucuuggucaugacuaucugguuuaaucuugaagguugcuuuuauuaauuuauucuuugaaugaauugugaauauauauaagaauaaauuuuuguaaguguacauuauuucauaaacugagaaaagguuuuuauuacauuuuauguuaguauuauuuuuauuuuccuacacuauauagacguaacuaagaaaagcuuucugugagaaaugcaaauauaauaauauaugagaugauuaacaucuguuuaauuguuauauuaggaaaagauagagcuaaaagacauucucuuuuauuuaguucuuaagauauuuauaugauuuauuuugugguuuuguuuuuauucuccaauugaacaaauuaauuuauaucuaauuucaccuauuaguaauuguaaauguaaauaacucccuccuuccuuuaucuucagagaauuuagauucacgucagaaguucccauucgacuugauuaucauggcaaacauguaucaauggaucagguugggaaacucuacaaauauacuccacaaaauuaucauauguuucucuaaugagcucguuuuuauuuuuaacuuugcuuugucauaguuuauauauauguuugaaaugaagugcaagguuuuuaaauuuaauuguuuuuaauguaaauauuuacuuaaguaccaugaguaaaauuugguauaaauugggucauauguauuguaagauauauauuuuuacuguaaauauuuuaaguguuuuaguaucaauaaugacuacugcuuugacuuucaaaauaacaauuauuuuagauguugagucucuuaauuuacaguaagguuaauuuggccuuuuuuaauuuugaaggguacgcuagcugggauuuugauuggucuggcucaguuaaacugcucugaacuaaagcucaagaggcuuuccuaucgacauggguaagugaauuuauuauaugaagcuuuaagugaaguuaucaaaguuaguguacaacaaauuuaaaaacugaguuuucuuagcaugcauacacaauuuuacaguauuuuauuuagagagcucauuuuuagaggacucuuaagauuuaggcacugauuucuauucugagggauuagaaguaguuugaaaagaguaguauuuggaaaaaacaguuauaguuuaggauauuuuaaauaauuuucuaagguuguaaauuagcuuauucagugaaaagauuggaaguucuuaguagcaauuacuggcaauuuagaaacuuuggguuaaucuuaugccaaagccuuaagauguucaagaaauaagaacauuggaaaaacacacuaauacguauuaccugagucuuguagaaauuauuaacauuagaauuggauuuuauauauauguguguguguauguauguauauguauauuuagagaaauucagguugugaguuaaaaggaugauuuguguuucuuuuugauuugaaaaauguuaccuguuuuugaagcaccuguaauauuugcccuuauaauuuguagaauuuguuuuaaguaaaaaaaaacccucaaacuaaucugugucuauaaauguauuucuccuuuugacauacuaauaaucauuugcucuaguuuacuaggcguugacaaauuauucucauaugcaaucacugaguggcuuaaugacauuaagaagaaccagcuaccaggaauccugggagguguuggaccuaugcauucacuaguacaauuaggugaguuuucuucuuuuuuaaucaaaagauaaguuauuuuuucagaugaguaauucuuaucccuuugagaacuuaugugaggaccauuagucuagaaaacucacauauguacucauauacacaaaacuuugccuccaguuuuaggaguuaaaaaccccaggguuagaaugauagaaaagucugaacuguggcacugauguugauuuuguguugacuguuguaguacaaggccuaaaggacuuggucuggcucccaauagagcaguaccggaaggauggccgcauugucagaggguuucagagaggcgcugcuuccuuugguaccucgacagcgauggcugcucuagaacucacaaacagaaugguucaaaccauacagguaucuuuuuagacugccuuagucuauccaaaaagagccauugugaaaugguuggguccuuuuguuuuuaaaacgauacugugaagauauacaaaauguugugaguagauacuuuauucguagugauuuaaugucaugcuuguuuuauugcuuaaauguuuaguguuaaauaauuagaauaaagcaguggaauacagugucagauuuguuugccuauuucagguaaauuguaaacauuaaguuagcagaggauugauuucaccauauuuguaugaaaggaucguagcuaaauuugaagaaggcguuguagauuaaacagaaguauuaaagaucauucuaguaaguauuaagcuccauagacugauguggaaauguugaguguucucagugaacagaggaggggcuaaaaauuuagcucaauccagguguuaguuauuaauuuauacuuuuauguucucguuauaaaagucaucaauucuugugguaaagaauucagauacgcagaagugucuucauuaggguuugugaguuccucugcucuuccucacucccuguaggaagugcucugcugguccguaacucuucagacuuucuucuaauucauuucuuccuuuugacaaaaugauccaggcagcugcagagacugcuuaugauauggugucuccugguacccuuucuaucgagcccaagaagaccaaaagguuuccucaucaccgguuagcccaccagccaguagaccugagggaagguguggccaaggccuacaguguugugaaagagguaacugaauacuuggguggacacaucagaacccuucugugcgcuuucccaacuuucaccuaaagagcauuuaauggcuuaaauguauucuguagaaaucccugggagcagaauggcaacugccacuaauaacaugugcccauaucugugugaggugauggaaaagggccagucugggaccaauaggcugacaggaauacuagugauugcguggguggauggauucucucucuucaccugcagaagcacucagggagugauagaaacaaaugccgugugaucgcugucuagguuuaacacauuuauacucugcccugcuuaccucagauuugcuuaagaacuagaacuuuucagaugaaucucccacccugauccuauucccaugccuucacuaugcugaacguggaacauauuuuuuuguacauguuuuuauauaguuuuauuauguauguauuuuuauuuaguauguauuuauaagcaaaacauacuaguguuaauguuuuaaaaguuuccguaaaugguguuaugugucucauucugcaacuuauuucaagauagauccauguuaaucuuaauccauguaggucuaauuuccacaguuuuaugguauuucacuguaugaauauaucauaauuuauuuauuuuccuguugguggacauucaguuuccauuuuuccccugaaacaccacuauggggagugcucauuuaacucucuuuuuguucauauguacaagaaauucuuuagggucaacuggggaguaaccguuggaaucucgacauguauuaagcauugcugaauugcucucugacacgguugugccagugaacccuguuuuuuuuuuuuuuucuggguguugucagcgucauucccuggcauacucuuuuugacauucuuuuuaauaugacauaagggaguuugaggucauuugacuuaugauuuguguuuuaggauuucaugaaagauauuuuucucagucauauucuaacaacagucagacgugccuaggauggucuuuuacuugagaaaaguagccucuguggucccaaacggcaggaaguccacgaagguagggccccaagaaauguauuaguggauaaauaaagguaagaccaauggucagcuuugaaaaaaagauuuacuggggagaauaaagagauaauuaccagucagauuugcuccuacagaugucaggauugagccagcuaucaauaggcuaaaauuagaucugugaaacagacacugggguuaguaagggcagugggcaguaagauguaauagcaguuugauuuaacaacuugugaagugguugccuaauuuaaucuauauuaauuuuaaaauaaaugugugcuuacuuugugccaaauauaugguaaucaccauuagagauaggcgauauuucuaauuuacagaugaggaaacggguucugccagacaguggccuuccccaaguaccacagagaaaagggaguggagccaggauuggaacuggguauuuggguuuaaaguuuaguucucuuucucuaagcugucacuaggaagaaugagggaagggagggugagauuaguaaguguggauugagaugguaggaugugcuuguuuggacuugcucuggauucucuauuaaaguuaaaaaaaaaaaaguuccuaaguggugcuugguauuucuuuuccauuuuagaugucaguaagucaaagaugaagagaaaaugccuugugugugucauagauaggcucaucuuuuagaucagaaguuggcagacuaggcugcaggguagacuagccaugccucuuuuguaugggccuuugagcuauuaauaaugguauuuacaauuuuaaaggauuguaaaacaaaacaaaacaaaaaauaaauaacagagaccauggcccacaaauaccuucuguguggcccuuacauaaaaaguaugucaaccccuacuuacauaguucuauuuggugguagucaggcacuuacgagggugguaguaggaauuauuuauugaacacuuacugucuuccaaacucugucaagcucuugagaugaauuauuuaauucuaacaaucaccguaggaggaaggcagcauuuuaguucccucuuuaaaugacuuaucuaaggucacacagcuaaauaauagggcugagacuggaauuuacuucuguuguccgcaaacguagugguggucggccucguacucuacucaucuacuccuguuuaucgcaggugggauagggaggagagcugguggagaggggagggagauggugcagggaaauguacaaguuguaaacauuguugugcucaugguuucucuuauuggcuguuauccucuagauaguuuuuaaaguaguacuuauuauuucuuugaguuuuucuggacacguuuuuuuuuuuuuuuuuuuugagacggagucucgcucuguugcccaggcuggagugcaguggcaugaucucggcucucugcaagcucugccuccugguucacgccauucuccugccucagccucccaaguagcugggacuacaggcgccugccaccacgcccggcuaguuuuguguauuuuuaguagagacgggguuucacuguguuagccaggauggucuugaucuccugaccucgugauccgccugccucggccuccuaaagugcugagauuacaggugugagccaccgcgcccggccuucuggacaucuuuuuuauugcucugugguauuacguuuuugccagauauacuggguagauaggacgcucuuguuaacuugccaaaaugauggcuagauucuggguuaguucaagguccuugauuucccuggagaacucaaaguuccuuuaugcuguccccaucacugaagcugucacaauaauauaauaauauaauaauaauaauggaauguugcuuugaguucccuagggauuucugaguuagauaaaugguaaagauucagaagucaugugaaguuuuaccacauugguuugaccuacauguuuguauauucagcuucaaagcucagaagucauuacuagcauagagacugaauaaaugaaaaagaaagcuuagcaaucaucauuauuuuauuauguugugagaaagauggaaaaugcuacuaaaguuuuguugagaauuauuaaacauguuccugcuuuuuguucucagaauucucuaauccaauaaaauguucuauugagcuuuuuaucuuaauugaauuuuccauuuuuuuccuaauacauagccaguaauuuaaaacaaauuaaguaauuucccagagcuuaguagaauuagguugaaucaaagggaacuaucaccauauuucuuuagugaauauauucaagaagcuuuguuugccaaguuugauuuaacuggagugauuaauaguaccagcaaagcccguauuucugucuucccaaugcgaaauuuuaguuuaccuacauuuuccacgcacuagugucacaacaaaauacuaagucauaauugccucuuucccuuauaguuagaauucugucauuaaaaauaauaauccugguuuaucuaaaagcauggcauuuuuuuuugucugguuacaaacauaauguuaccugcuuuaaaaguguguacugcaggauagcuuagagaguuuuccgaccagaguuuguucacugcccuccucucuccuaccucccuccucuacgcagggaaucacagacacggcucagaccauuuaugaaacugcggcucgagaacacgagagcagaggggugacuggugccgugggcgagguucugcgccagauuccuccggcaguggugaaaccucugauuguugccacagaagcaacgucaaacgugcuggguggcaugagaaaccaaauuaggccagauguccggcaagacgagucacagaaauggcgccacggggaugacugauggcuuggaacugacagugugaagauaaggagaguggaaccaggagcucagaguccugacagcagcuucagaggaagcucguuuaauuuuauugugcucaucucaggaacaaaagcauuuuuuaguuaaauaauuuaacaucaaaacaacaugcaaccaaaaacuucugacauuuauaguugauacuugccuauagaaauguuugguggcuggugucaaagguccuuaaagcauuugcugccaaguuaguggaaggcucacuuuuguuaagaugacuguaauucuccuuguuaccgacgagagaucauuggaagcugccuucuaacacuuuguguagcucuguggaguuggauuuucuuaagguuuaaaaagaaucacagcuucggaacuuuuaacugaaaaugagagacagaagccacaggggaagcaaagcaaauaggauuuucaauauaaauaucaguguggaaaaauaaccuauucuguugaauuuaguguucaugcacuugagaacaacauuauuuccauuuacuccgaaaauccuucuguggggguuugagaaagugaauguugcagacauguucuguuguguugcacuuuauccuguguuuauguguauguguuuuuagauuaauucaaguugugugcuauauuucuuguauaauuuacaaaguuacacaaaauauaaagagcaguaaacuugucugaaaguuuuuggcaaaggaagguaacuucaauguaauagcuuccuuuaagaguacaggaaaaugcauucuguaaugaaguggggcccauguaauuguuuauauuuucaguuuuaagcagguauagugcaggcuuguuaggaauguguggaagggaagauuggaagugauuuuuccucuuuuaaaaguaaacaaaauucuucaaauaugcccuaguuaacuauuucagcauaccauuuuuacuugguuaacaguguacauuuugauaaccuaucaggaaugaauaaaguauuuuuauuuaaaggugauauuguuuuaugcuuccaugaauauuuugcuuuucuuagagcauauucauagaugcaguacugugauuuaccacaagauaauugggaacacuuucucaaaaucgauuuugguuaauaucagguaaaucauuaccuaggaguaagagggaaauuguugucaauuccugacuuuagauugauccagcagaaagaaaagguggaacuuuguauauauccacuguugaaaguugcaugaccugacuuccuguuuucuaaaguugggggaauauuauugaacuucaauuucagaacugcauuucaauuuggggcuuggaaaauguaguuaaaucaauuucguucucuaaauuuucuaagcaggaaagcaauguaaaccaaaaaucaaaauguuuagaauuuauaaaaaugggguuauauagcuuuuaauuuuaguuuccuuuuuacugccaaaaaacuuaaaaagacaacagcguaaccaccuguuuaagcaccgugggaccaucucuuauucggguagagccugguccuggcgacacacuaacaggaaggcgugcuguguuaccgggaaggcgccucuggcuguggggugcguucugaccaccccgcucagaugccagcauuuuccauuugcccuuaaggaaacuugcuauguguguuaacccaguuaugauuagucaaacuggaaaacacuugaucaaacuuaaaauuguaaaaucugucuaacuuuuaaauauacuuuccacaguuguacuuaaguucaauuaacuacaguauagagaaaaauaauuauucucuucuuugcacccggaguugcaaacaaauuaaguuuacaaaucucauuuaaacauauaucuuuguaauguaaucuccgcgguucuuucuuuguucuacccuccugcaccuguugucgauguaaucauuuugggaacagaaacguugugucucaaaaagauucguugucaguucagccaagauguucuuuaccugagauucuggaaagauguuuaucuauaucggaacacuucuacauuauuaaauguccuuaagcuuuuucuuuuuuacaagugucuuuucagacuuugguguugugaugacacaguagaaagagcguggcuagaauccgugguuugccacaucugcagcuuaccaaacggaugacuuguccaggacaucugaucccuguaagccucagcaucccuccugguaaauggaggguuuuuuacgacaaagcccaaagggagguuuuggaugauuaggcugugugugcgugugagaaugaucacauguggcgucaugcuuuguacagagccucagaccacugggccucguccagugagaguccucucuggcgacaucacacgcggagcagccaggggccaccuuagaucucagaucucucagagcaauacuuuucugaacugccacugugccugggugguuggguuggugucaugcuucugacuagaguagaucgcgcauguccaccagugauacguugaguccuuacaguuccccccauggagucccauaagcagcuccaucgagaucugucagcaaguugcaggaccccacaauguucugacauguuaagacccccuuacaugacgaguagagaggcagcugaggccacaaccgugucuuccucuugaauggagcuaacucggaaccccccguuuucucuuccuuucugcccaccacugaacauugccuuuuagauaacucaguguuucuucuagaugucauagcaauagacuuucacuuucaugaaguuuggguacgauuuggauucucgcuuaaguacauauauuuaucaauauuuuuauaaggcaaaguucacuuaaaaaaucuuuccaaguagcagugugccuaagauggcaaaauacuaaaaacugguguuuccugcuccuguugugugucacuuuucaagccgauugaaauauuucuggcuuuuagggcauuacuuuuuaacuaucuccuuuaaaaacgauguucuguagguuuagugucuuuguucauuuccaaaagaguccagacaacugugucugccccugcagaggcuguuuguccaaaggcagcaugccgcuuccaccggaaugcagacagcaggggagcggaauucuaaagcagcgacuuaaaaugaggaauccccaauugcacuaaaugguuucaggauugacuaaucauugucuuaacauuaacucagauuuucaauguguaaagagcugugugacuuggcgucugagagaucccucugcuuugcuuugcuucagaguccucgcacccgcauccucagaacuguggggcauggugggcucuaacgagcacuccccuucuguuuuccuucauuacuuuugaccuccuuaagacuucagagagaauguccgucaaguucuuuucuccaucaaguucuuuaaguuccuugaaaggaagggacugugcaaacacaaagcaauauucuuuuguaucugcaaaugcaucagcuggacauaccaauugguaucaaauagaauaaaaucaaauauaaauguuugagucuuagguuaaaaaggaagguuauuuguauaguuuauagauaaugaaggaaaaauuucuuuuucauugcaggaaaucuuguuuacuggaagauagagucacucuuuucauauaagacaaauagugcuuuaaugccaacuucuuuuuaucucaacauuucaggaucaugcuaggcacacugcccccuugaauagacauuauaugcacaguugcaagucagccaauguuuuuauucagaaguauuuccccccauuauagugccugcauaucagagauacaaaaagcauccaacacacuaccguaauaggcuucuuuggggaugagaaauuugagucucaacaacucagaguuugagaugucagcuuuuuugguaaacguagguguuagagguauauuuugcuuuccuacaacaauuguuggcccuugauuucaagcauguugcuucauaggaagcaccagagugccaucugcugcauuucaagagauuguaaaugucaucucagcuggcucaguuauaucucuaaugucccggguagcagcaccucccucuaaaaauauguuuacuucacuguuucacuuguauuuuguguauacgaaauggcagcuuccgauuucuaguuggauuugucuugcauuguuuguauaacuugcuggucacccagggcuauuugcuuuuucauugagaaauuugguaggggugucuaguucagcuuuuauguugauccauccugacuuauuuuagacauugaauuuaucucaccacaaguaaaagaacauguguauugacugucuuugcuaaguuuccuaauuuuuccuaauuauggcaauuauggaugugaauaagaauacugaugcuguacaaauauuuuuguggaaauguaccuuguuaaugugacuauuuaaauaauaugaaaauaagaauacucuugaagaaaaaauuaaaauauuuacucuuuggauuuugcuuuaaacac

SEQ ID NO: 17146 - RNA, 64923 nt, Homo sapiens
caccgcccggggccucccugagcguucccuuccaccaucugacacccacugcuaagugugagaggacccaggggguaauugccgggccgcaggcggccuuaggaacuccgcuucccgugaggcuucgcggcggacggcgcuggugcgcaggcgcacgcacggcgugcgugguggcgucagcaguucuagaacguugcugugguagcgcucgggcgccauguuaggacgaaggggaaggaggagaagcgcuuaaagcggcgggagcggugcgggagagggguuggacccagggcugaggcaggccccccccucccucccgccucaguggaucaugcccagggcggcagcggcggcgguugcgggggggaagugacugggcggugccggcgccggagacgaugccguuguaaguaauuuguauucuguuuucuuucgcucgccggcugggccuuggggggcguccgggaaggggaagagguaggcggagaggguggcacgcgagcccgacccuccccgcugguaggaggcaggcaggacuggggaccuuccuguuuccucgcucgcucgccgccgcacuuccccccgugugcuggguucccgcgucccccgacccuuccuggcugggucagcugccgucgggccgggggccuuccccuuccggaauugcuggcggaaccucuaacucgcccggccacuccagcuucuccgccccguccacaaagaaaaucaaaacaacccgaaaacaaaacauugccuggugguggggaaccacgacccugcugcacgcgggaucagcacuugggguucgggcucgcucucggcgccccucgggcccauucgauguugcuuuucuguuccuggucugucucaguuugcucacucucuuccucccauuuccagaugccugucuugugcgccggaguuagccccuuuccacugaccuugucugaauguaggagcacgaguuaaaagcccagcuuugagcguugaguccgccugccuccaccuccgccucccuagcauucacaggcggucggagaagggggcacuucacagggugcccuccuccaaaacgacuuauguauugcuuucccuguuuuguuuugaugggguaaccagguuucauucuguuuccuucuuucucuaucucuggugauacuuuuuuuuuccugguuguaaggcuugaagcuagucucuuuaugcuuucuaaugccacugcgccuuuuucuuuucuugguggguuuuuaaaaaguuuuuuucuccccucccccuuucugauaaugagauauaauuuggcagcucauugccaguagauuacggauuuuuuuuuuccugcaaauauacagcauuguagaggccuaaauagugagacugcauuucuuccauuuuugaauauugaagcguaagagugccucuuugagaccagggaccgaguuuucuucaucuuaguagccucaaaacgcaacauguaauugacacucaaaguuuugguuaaauucaggauaaagauuuuugugguuucuagacaucgaauguaguaacucaggucuauuuuuuuuuuguaaguaaggauaauuucuuuagcacauaaucaccgauuguaguuuuacaauuauauaugugugugaauguguuucuuuacaggugagacucuaacuuuggcacagaccuuaaugacuucuaucgcaauuuauguauuuuaaaaggauuuuccauggcucccacccacccccuuagguuauuaagaagucuaucacauuacuucugugaugaaaacguuuguuagacuuaacuaacuauacaggucuaaaaucuuggaaucugcaugguuucuguuuauugauuuuucccuuucauagaauaagagacccuaggagaacugagucuaagcaagauuguugugguguuucucaguucaauaggagauaaauguuugcagugaugucgugaugacugcguuauuaaguuaacauuuugcugucuuugaaaagggacuucuuuuucugauaaucauaccagcauuaaaaaugauagauguaaaccuuaaaaggcuucaaugaagaaauaacauuaaguaauuugugucuuauuucuaggaauuaaaaguacuuuuauaccuacuuucccccaacauucuuugaagagggaagguauacauuucugugaaagaccuuagguauuucaaauucuucgcgaguuaguucaaguguguaaaauggaagacggggccaggcgcggugguucacgccuguaaucccagcacuuugggaggcccaggcagguaaaucgcuugaggccaggaguuugagaucagccugggcaacauggcgaaacuucaucucaacaaaaaacacaaguuagcugggcgugguggcucaugccuguaaucccagcuacuugggagguugaggugggaggacugcuugagcccaggaggcugaggcugcagugagccuugaucaugccacugcguuccagccugggugacagagcgagacucaaaaaguaaguauacgauaauuacuguaguaaacaauagagagaccaaagaaugccuaguuaaagaaaaauagggcuucuuccucauuaaguugcuuuguuuuucauguacugcugucacacugucauaaauguuguuuuuuugauguguuggauugugauuucccggcuauauuguguuuggcuuucauuuuugguauaccuguccuaauguuaaauuuggaugggugaguggcauuggggcauggacccuaggugaguugucggaaugaauuuaaaucaaaauuaucgaaauuuaggauauuacagaacauuuugaucaaguguccauauuuugucuaaauuucauauguagcuacaaacauacuuuuggaaagauuauagucugauuuaagagucaugguggugaagcuucugaaaguuuugauagucuuuggauccauuaaacaguuucucaccuagucauuauugacauuuaugccagauucauuccuugcaggugccuguccuguguauuguaguuuaacagcagccuuagcuuccaccuacuggauuccgggagcuccaccccuccauuuccccaguaaugacaaucaaaaaugucuccagauauuaccagaugugcccuggggugcaaaaucugguugagaaccacggcauuaacgaaaagugugaugcccuuauggaaacuagauguauuucugcccuacucuguguuggucagauauuuuuggcaucagcucaguucugaguaucacacauaugauaaaaaggugugaaggagaguaaccaguaucaguagcauuuaugccacaugcauagaauguugucaaaguuaccaaaaagaguuacugcaagguuuaggcgagacaauagcaaaaauguuuucgggggcugcacaaaaaagagggaauuguaguaguuuuacaucgccauaacaagcagaacugguaccugcugguggauggucugugcuucccagagcgggaucuguggaugcuuggggagggggaccacugagaucuuucagaggguacauaauguucaaacuauuuucauguuauugagauguuuugucuuucaacauuuguacuuaacggugcaaaagcagugguggaaaaugcuguauccaucauaggaacaaucaaggcagagaaccgguauuguauauagucauuuccuuccuuccuuccuugcuugauuccuuccuuccuugcuuccuuccguucuugacggagucuugcucugucgccgggcuggaaugcaguggagcgaucucggcucacugcaaccuccaccucccggguucaagcgauucuccugccucagccuuccaaguaucugggacuacagguguacgccaccacgcucagcuaauuuuuguauuuuuaguagagacgagguuucaccauguuggccaggauggucucgauuuccugaccucgugauccccccccaccucggccucccaaagugcugggauuacaggcaugagccacggcgcccggcugucauuuuauuucuugaagacugcacacucauaguuuaaaaagcuuuugaugaaacaguaaaaggagguuaauuuuauuaaaucuugacacuuuguuuauuuaauguacugugaccacggaaaguacuugugaagcuguauacuggggaguagaauggugguuuugaggagcacuuguauguugauuugugagcuaaacugguguucucauggagcuccauuuuuaucugaaagaacaagugaugaacuguggauauucauauuugaguauuuaggagacuuaaaugagaauaaagcaagucugucacuccaagguaaacaacugacuauuccuggccagugaaaaauuggagcuuucaagcaaaauauagaauuuuagaaagcuugcuuuuccaucaugagcuugacgguuuuucccaauacuuaaaagauguuucugcugacauuggugguaauauuaaugcauauaguuuuaaugcuguauaaugugugcuuaaaaaaagaauguuuuuuaauauuugguagaccuguauaauucagugaacccauauuuuccaaaugaccauuugugauguaauaaaaucauaugugcauucaaggguacauucagagugcaagguaaaccagauuuuaaugcaacagaguaccaagggcuuauuaauaggguuuuaacuuucauauuguaacuaaucuuugcaaaacugccacuuguggaguucugguguaguaucaaagaagacuacucauauuaauugaaaauacuaaauacuccucuuuuccaguuauaauguugcucccagcacuaugggaggccgaggugggaggauuauuugagcuuacaaguucaagaccagccugggugacauagccaucuccacaaaacaaaaagaaacaguuauaauguugguuugaugccagguuuucuucauaugcuucaacuagaacaauuuauugcaacagauugaaugcagaagcagcuaugagaauccagccaucuuugguuuagccagaauuaaagagauuuacagaaaugcaaaagcaugccauucuuacuaaauuuuuuguuuuggaaaauaguuuuuuuuuuuuuuuuuuuuuuuuugagacggagucucguucugucgcccaggcgggagugcuguggcgcgaucuccgcucacugcaagcuccgucuuccggguucacgccauucuccugccucagccucccgaguagcugggacuacaggcgcccgccacugcgcccggcuaauuuuuuguauuuuuaguagagacgggguuucaccguggucucgaucuccugaccucgugauccgccugccucggccucccaaagugcugggauuacaggcgugagccaccgcgccuggccgaaaauaguuuuuuaaagcuauguuaacauguaaugaguuucuuguuauuuaaaugaauaaauacuuuaaaaguucuucaguuauaauuuccaauguaguggauauugguaagcauaaugcauguaagaaagagcucuuuggagugcucaauacauuuuaagaguuuuacaacucguaaagggguccugagaccaaaauguuugaaaacuugagaaauccugcuugagaacagcugccccaagaugaaguagacuuuucaguggugguaugagcuguccaugcagcaccucugguguuuuuuuguuuuucguuuuucuugagauggagucuugcucuguugcccaggcuggaguguaguggugcuagcucggcucacugcaaccccugcaucccagguucaagugauucuccugccucagccuaccgaguagcugagauuauaggcccgugccaccacguccagcuaauuuuuguauuuuuaguagagacagaguuucccuguauuggccagguuggucucgaacuccugaccucaggugaucugccugccuuggccucccaaagugcugggauuacaggcccaccacgccuggccucuggugguuuucugaacacugucuggugguuuucugaacacugcaccucagcccaccccaaccgucugugauuuaaauaaaauuuuuuuguuguugucagugaaaaacaauauaguagauaaccuuuaggaaagauaacagaacugugggagauuuugauucucagauuuuaaaauuuggaguuuuuguagugaauugcugcucaguaaauguugauuaugguuuugagaugugguguucugccuuaaacauguuuucaguccauauuuuuugguagagaaguuggaaggcaagguauuggaguugaguaaauuuaugagccuacucaguuccuaucccugauuguuuuccucaccuucuuaaggcagaagccaguucuggcuugauaacaacuuugaaaauguuuuggcucaucagaacauucuauucuuggguaacuaagucaacuuuagguuaacauuacaauuaaauuucaucuucaguuuuaucuaggcaaguuuauaaagcuagcuucuuucagguaaaaugagaccauuuggcuucuuagcuaguucucauuuugggagggugugugugucucuuuuauucuguauguucaggguucuaauuaccuagcagcuuuuaaauaauuggacaaugccaguuuaugauuuacaaagcagcaacauuauaggagguaauugguuccccuaaaaguugguuaaaguugaggcucaaaagaauaccugaccaaggucauaaagguacuaaauuguagauuggggcuuaaaucagcucuggauucuguguugcauugucauuccaguacacuauaccaucuccuguggacacuguagggaaccaugugugguuagcucaguuggagucuuuauuuauuuuugagacaggaacucacuguugcccaggcuggaaugcaguggugugaucaugggucacugcaggcuugaccucccaggcucaagggauccucccaccucagccucccaaguaucugggacuacaggcacgcaccaccauacguggccaauuuuuguauuuuuuacugugacaggguuuugccacguugcccaggcugcucucaaacucccgggcucaagcaaucccaccuuggccucccaaauugccgagauuacagguggcucaugccaccaugccuggccaguuggaaucucuguauaguuucaaguagaauuaauuuucaagcucaauuuuuuuuguguguauaacauguaaaucucaaaguauuuacauaauaaaaauguauacaaaaguauauaaacaaaaguaacauauaguguauacuuguaguauacacagaauguaacauacuauagaaccugagaucuugugcauugcuuaaugauuggauauauucuguaaaaauguguuauuuuucagauuuuauugugggaacaguguacuuaacacaaaccuaaaugguauagccugcuaugcaccuaggccuaugcaccaaugauauggccuguugcuccuaggcuauaaaccuguggcagcauguuacuguaccgaauacuguaggcacuuguaacacauuaggaagcauuuguguaucuaaauguauguaaacacaaaaggaauaguaaaaauacgguauuaugcuguuaugggaccacuguuauauguguggucugucauugacugaagaauucuguuaacguggcacacgacuacuuucaguggcuuuauuugcauauauauucuuauuuaaagccaugcacagauuugccacuuagacgccgcuuuguuguggccaguaccuuuugugggaguugcuuuuuuuuuuuuuuuuuuuuaaucuuuggauuguauguaggccugcugaacuguauagcaaucucauuuguggaaaccuaaggauuugggaaagaaaaaauaaaggcauucuguuagauuucuuucuuccucuuuuguuacagaauuauuuuucaaauuuuuauucccucuauauuuuguccagaaauuggauucuuggauuuuacggcaguuuuuauaauuuugagguugaucaagaauaguguuugucauuuugaucauuagaaacauuuaaauuacauuuccugaaauuagugucuguaauacuaugacuuacuauaaucuugacuauuuucugauacauuuucacacucuuucguacuuuuucagguccuguuucauacuuuauuaaauuuacauuucuuucauuuucaaguuguacuuggcaaguugauguagcaguguacaauuuggcuuuuuuuuuuuuuuuuaaguuucuccuagccauaugagagagagggacacaacacacacgcgcgcgugcgcuugugcgcaaaggggcaguuggaaguacccuuuggaagugaggaaaaauaacuuggccauuguaguaauugaacagcaaguacccuuucucugcauaagcaaccuugaauuuucaguuuggccuugggcuuuaucauacauacuuuauuccccuugagcauaaacaaacuauuaacaucaucuuugagccucugcugcugcuuuacuaaauauuggcuggauggcccaccugcaguacguuuuuaagaauauagugggaucuaaauauuuuuaguaccacuuacacagaacaccuuacggugggccaguuaaccaucguuuuaauuucuuagcaaauagauuauuuuggcgauaaucuugccuguaagcuacuaucaugccguauaccuugugaaaaaggagauuguauuauuuuggcuaauaauuaauauuuaaugcacauugagauacuuuagagagaucccuuguaucuuuucuguucauguccuuugaaugagcacauuaagguuaagaccuuuaaacagcaaauucuacugugaugaauuguuacuuuaaauaaguuaacuguaguuuaucugauugguuucaaagaagaauauuuagcaaguuuggcuuucaguuuuaacucuaucaugcaaauaauaaaguguuuucuguuaaguaguagcuauaaauuggggcaguugacucuguuaauaucaugggccacaacuuguuccaaaugccuaauaucacuagguggggauuaaucaguagugccugaugaguuuuguauaaauugagacacaggcgggcugugguggcucaugcccguaaucccagcacuuugggaggucaaggugggaggauugcuugagcccaggcguucgacaccagccugggcaacauagugagauccugacucuauuaaaaaaaauuaaauugagaugcaaaguacuuaaacauuaacuauuuaaggaaaacaccaauggaaauaugauguucuguccuuuuguguguuagucgucugccuagauuacgccucuccuuuccgaucauuuacuguguacaccuucuggcauagucaugauuuuaucuuuguuucuuuaaugguuuuuuucccaaacuucuacuuugcacuuguuguuuaaggaucugaaucccagacuaaauuugagauugucauugaaaacagagacuaccuuaagcaucuuuguauuucugauuuuauuuagcauugucuuuuaugcauauuuaggaauuugguacauuucaaccucauaaauacuguacuuucugacaaaagguagaugagaaaaaagugcuuuuaggaaaauugaguugauguuuaauaacuuggccgcccuagcagcuuccuggagcaauaaauaaagcaauauuugcuuuggauuuacuauuucuagccacagaguauugcacuaaaaagcuauuuuaaaaaucuuuguuuauuucacaaaauaguguuuuaauuagcauaaacugaguuuuuagcuaauaaccaaaagcuaauuauuguuuuaauuugaagauuuguuuggugccccuugcugccauuauaggggguuauuuuagccuccuugcuauaacuauucuaauuuaauggugaacgguagaauuaguugacuuucaacuuuugcaagauuauuaauauuuacuuuaaauaauuuaacauguugaaacaaguuuauaaaauauaagguaaaauuuuacggucucaauucugcuugauuguguuucuaugaauguguuauggacauaauauacaaauaguuaaaaaaaaaacugggugucaugguccaugccuguaaucugagcuauaagggaggaucgccugagcucaagaguuuagaucagccugggcaacagagcaagacaccaucucuaaaauuaaaaaaauauauaucuuuaucuauaugacuacauauuguaaaugaugugcagaggugccucaguauagagaugauuauuauaggcuaugauaucagcuaucuggguucauauucugguccaguaaacuuagucaagccuucuuucuuaguuuaauaguaagaguuguuagaaaaaauugggaauaauguaaagugcuugacuuaauacguggguuauguugaaauuucaguagauggcagcuaugaucguaauuauauucugcaacuuuuuuuucuccugauacacaugcugcuaaacauacuaucucauugcuuuauuuuggcauaguuuuaaguuguaagcauguacuguaauuaacaaguucuuuacugauggauauuuaggugguuuccaguuuuacuucauugcauacucugcucagugaacaaccuugauuaccuuucuguguuaguucugugagaaagguucaaauuccagaaccuaugagaucaagagaguuaauuuacaaaugaaugaacuaaguaccaaagaagcucccuuuuuaggggauagcccugggauagacacugcucauuucaagcuuauuucuguugugcuggaauucgggucccuauuuuggucugucuuccagucuuugcacccauacucuagcaguggcuggaaauguauauauuuuuuauuguuuguuuuuugcuuuuuuuggggauggagucccgcuuguugcucaggcuggacugcaguggugugaucacagaucacuacagccucagcuuccugggcucaagagauccucuugccucagccuucugaguagcugggacuacacuacaggugcaugccacuacagcuggcuaauuuuuaaacuuuuuguacagauggggccuuucuauguugcccaggcuggucucaaacuccugggcucaagggaucuuccuaccucagccucccaaagugacgggauuacaggucugagccgcugcaccaggccuggggauuuagcuuuuuauguaauuuauauuuuaaaaaugugugauuaaagagaauaugucuuccaauuucauggcuuucaguuugaaccuucuguccuaguauuuuuguaauaaauagaucgcuggagauaaaguugcuagacaaacuuuuaaaauugguaugugcauuuuuaauuuugauaaauaucauauugccuuuuaaaaugauguaacaaguuugcuuucaucgugaugaauaagggcucguuuuuuuuacaccauggccaacauuggagguuuuuugucuuucauucuuaccacauauauuaaauuuuguuuuucauuaaucagguugucuuaauuugcuucccugauaugcagugaaacuuuuuuaaaaauugauugaagaauucuuuauguauucagacuguugcuguuuuggcauaagcugcauguauuuucuccuuuuaucauuugcuuuaacuuuccuuaugugcuauauuguuauuauauaaaaguuggaauauuuugauguaaguaaaccuguuuuuauggcuuuugcguuccgugucuugcuugacuaaggcucugaaaauguuuuuuauuuucuuucagugccuuuaugcuuuuuaaauauuucugaaauagcaucuggguuuuagauuuuacuauggacagucaaagccauuugaguauuucauaguugucuucacugauuuaaaaugguuaucaguauauguccaaagaugaucaugcuuugccuauuugaauguaugaccauuaaacuccaguuaacaaaucauaggaacuugcacuauuugcauuagguaucuuuuuuuuuuuuuuuugagacugaguccuguucuguugcccaggcuggagugcugggaucucggcucacugcaaguuccaccucccggguucacgccauucuccugccucagccucacaaguagcuaugacuacaggcaacugccaccacgcccggcuaauuuuuuuuuuuuuguuauguuuaguagagacgggguuucacugugucagccaggguggucucgaucuccugacgucgugauccgcccgccuuggccucccaaagugcugggauugcaggcgugugccaccacgcccagccuauuugcauuagauuucuaacuacuguaccaaggugguucuugauaguugagauuguauauauuaguuaagucgaaugucuaaccuuuugaaacaaauaucccgccaaaauaaauagccaacagucaacaaaaaugucacuauucuuucuaaguuccuaaauauuuauccuaauuagagucaucuugacagcccugcauggggaaaggaaagaccuguuucucagcuuuggucuaaaaacuuucguauuuggaaacugcucuuuaguguuauguguuguaguuguaaaauuccuaguuuguuauccaaaguaaugaagagauacaauaaauucuaagguaaaucugcagagaugcaacuuaccaagaauaauauaacuaguggcagaauugaaaccagaguaauacgacgaguagcagaagugaaaucaggccugcuuucucccuuuuuuaucagauuguuuuugaguugagaccagacuuuguagucuguccugaaugcuguuaccagaagucacaguuuuuuuaguauacaguuauauuuuaggaagacauacuuaguaguaauaugcaugguggaaccaugugacaaaggaguggaaggaaaggaguugggaccaagauugccaagaaucagaacuagaauaguugaaaacgaauuguuauauagaauguuaaaauuaaaacaauuaaaaggcauguauucuaugugaacuuugccuugaugaaaauaauuuaaauauuauaaagaaaacuccucguauucuaaggagagaagaguucugaaaauucuuuauacauuaccuugaaccuguaagaaaagguguguuuguaggggaggaguguuuggcugucuuuuugugguuuugagagggggcagaauucauauauguacuauuagauguagguauguauuuauguguaacucugauccagaaaggaugaagacuuuuaagaaugcuuuagucauaauauuaaaaacuggcaagauguuugcauuagauguggaugaaaaggaagaauaaggauagauacacaauggagcaaaauauuaggcuacuaaaaauaguucuuaaggaaauacaguaacuuuuguauuuuuauagaguagagagcuugcuagauggcugccaguugcacucuaagaauucaggcaguacccugaagguaaauauuaauuauguuggugagacgaaaauggaccaguugcucaagcaaagcacaguguucuucauauuaaaaaccaggaagacauuuuaaggaaucacaaauacugcagcuauaugucugguuuguauuuuuccuuuuuguguuacguaaauuguagaaguuuauuuuucaaaguagaauagugucugaagaaaauuaaauacugguaaaaauguuucuagaaugggcagaugucuagugcauucaagaaugggaggaggaacuuugcauucuugggauugguagcugucugguguaugguuccaggagagugucagugcauauguaaggcagaagaauccuuaaucuuuggagguuuauguuccaaauugcccaauauuggaguauauaguuuuguuagaaggagaacagcaacaaaaagauuccuuaaauuguuuuaucacucuacuuaauuucuaauguuaaauggaaaaucuucacuuccauuuaaaguguuacaauauuuaauguuucuacuuuggacguuugaaacaucugggagccuggaauucuuagucuagcuccuuaagcucaugcugagccauuuuuauuggagacacaaguaucuuguaaauuucagaguaugcauuuguuucuuuuuauuugguaggucuauguuaacguaguuuuuccuuuucuuucuuucuuuccuucccuuuccuuccccucccucccucauucucucccucucuuucuuccuuccucccucccucccucccuccugggcuccuaucucaaacuccugggcucaagccauccuccugccucagccuccugaguagcuaggacuacgggcaugugccaccaagcccagcuaauuuuuauuuuucauagagaugggugucuugcuguguugcccaggcuggucucaaauuccugaccucaagugauuuuccccugcugugccucccuaagcauugggauuauaugcaugagccauggugccuggcucauauauauucuuucuugaauuagauggaacacaugugguuuuaucuugacagaaaguaauacugaggcuagaugaugugccuacauuuggaauaaaguaaauaaaaauuuccagcuugcgucugauuuauuuccccaucaaaauguuaguguaaucaauauuuuuucaaauuaggcugaacaagucuugugcgcguuuagaaaucagggccuguauucuaauguucuagugagaaaguuaaaguagacaggagcuuuccaagcauuguuuauugugacaaugaaagccuaaagauuugaguaagaaaaaaaugggaagauuuaggaaucuuacaguggauacucuuuguuuuuuuaaugauccaaacugaacugguaaugaauuuaauuccuugagaauggaaaagaaugcagagaaacauauuacucgcacaaaacaaaaauagaaguuuauugcuugaagcuacaaaaguauaauuucagcuuauacuugacuuaaaagcucuccuugcuugaaccagaucuagccuagacaaaauaaaguuuuuacacuuuuucuggcuuuacuugcguuaaagucauuuauaaaagcauucauaaucccaggauaauugugaaggacuguaguuuauucagaaaaacucaugaagcaaugaauaacacaagauaauacaauuacguuaggauaugugguaagcguacuuuguauugugcacuugaaaauuuaagaguagaucucagguugcgugcucuuauggcagaaaaccagagggguacacagggaaacuuuuggagguaauggaugcguuuauuaccuugauuaugcuaauggaacuacaaguguaugcauauguccaaacucaccaaauuauauacauuaauuacguucaguaguuuugguaugucagugauaucucaauaaaacugggggaaaaaaaaaccugugugugaugaacaagacauuaugaauucaguuacauuucauguguauauuuuaaccuuaggagaugcuacauaugauuggaaaacagaacauuuuuauuuugucuucagcaaaugcuuuuuuuuuuuuuuuuuuuuccugagauggaguuuugcucuguugcccaggcuggagugcaguggcacgaucuuggcuuaccgcaaccuccacuuccuggguuagagcgaugcuccugccucagccuacugaguagcugagauuauagcaugccaccacaccuggcuaauuuuuguauuuuuauuagaaauggguuuacgccuucuuggcugggcuggucuuugaacuccuggccucaaaucaucugcccuccucggccccccaaaauuugcugggauuacaagugugagacaccaugcuugggccagucuucagcaaaugcuuaaugcugauggggauuaacauagcuuuugaguagcuaugcaacuuagauuaaaggggcaggaggaaacgaucuaaugugaauuaauuucugcaagagauaaaucugauucauauuuauucaguaaauguuauuauaaaaucugaauuaaaauuaagacaguauguaacuagaccaggcaacaguaaauagaugacacgcaguccagcagcuaauuaguaacacgcaguaugggcuucuuggcauucuuagaucuuucuugauaucacaagacaaauuacagaacagucuagccguuggaguauagaccagaacccaguggauuuguucaguaaauguaucauaagccuuacuugcauagcauucuuagauuuagcacuuuauugcuuuuugcuuuuuuuuuuuugagacggagucucgcucugucccccaggcuggagugcaguggugcgaucucagcucacugcaagcuccgccucccagguucacgccauucuccugccucagccucuccgaguagcugggacuacaggcgcccgccacuacgcccagcuaauuuuuuguauuuuuaguagagacgggguuucacuguggucucgaucuccugaccucgugauccgcccaccucggccucccaaagugcugggauuacaagcgugagccaccgcgccuggccuuuauugcauauguagauuaucacacuuuaacuuaaaguagaaauuguauuuagaacuugguaaaaaaaaguagcugugguugggcaugguggcccaugccuguaaucccagcacuuugggaggccaaagggagcggaucacuugagcucaggaguucgagagcagccuggccaacauggugaaacccugucucuacuaaaaauauaaaaauuagccgggugugguggcaugcaccuguagucccagcuacucgggaggcugaggcaggagaaucgguggaaccuggaagguagagguugcagugagcugagaucguaccacuguacuccagccugggugacagagcgagacuccaucucaaaaaauaagagguagcuguguguguguguaaaauacacuuuuuuuuuuuuugguagagacaggguuucagcauguuauccaggcuggccucaacuccugggcucaagccauucucccacuucagccuccugaagugcugggauuacaggggugagcccacaccuggccuauaaacacuuaauuucuuaaggaauggaauuugggagaaauaaccgauccagauuuugggucuuuccuuauuguguacuugguuuuguauguuauucaacuguuaguuuaaaauuauuauguugacuucuuaauuuaaugaaaaaauauuuaugaaaaaagauugagucagauuuauuuccuaagcauuuaaagcaugcuaugccuuuuuacaaauuuggaacuuaucuuaaaauggauaaaauagcuguguguguguaaaauaaaccuuuuagacuagcaucauuaucgaaguguaaaucucuuaaaaagaucauuaacaagcuuaagguauauucacccuaagggaaagaacuauauucaguucuuucccuucaaauuuuguuuaaguuuuugcuauuugcuucauuaucuaugaacuucguucauuguaagccagaugccagguuucauuuggggaaugucuuauauugguaaaguagcauuucuguagcguguuuaucaauguuuaagaaacagauuuuggcuucuuuucaagaggugaaauuucucagaaguuuacuauauucugaauuaguguuuucucuagcaauguauuuggucuggauucuaacuuagauguuuaaguagugacaguuaaaauccuuggggcaggauuuucucuuuggucacuugcuuuuggucacuuuuugucaaaaauuuuggggguauugcagggaaccaaucauguuuagaaauguguguuacuaaauuaguuuuucuggucuuacugauuuguuucaaauuguagaauucuuuuggcaguaauuguauccaauuuuguuuauaguccaguuacaacacagggaucacaacaaacacaaccgccacagaagcacuauggcauuacuucuccuaucagcuuagcagcccccaaggagacugacugcguacuuacacagaaacuaauugagacauugaaacccuuugggguuuuugaagaggaagaggaacugcagcgcagguaaauagauauucuauauuuuuuuaacucggaaacuuuuauuaauguugacauaaacuaauuuugaggcauucucuacuuacuuagaagaccaggguuauuugcccagaucuauauaucuguuuuggagaagagggauacuuaagagagaaaacuuuuuguuuuugagacggagucuugcucguuacccaggcuggagugcaauggugugaucuuggcucaccacagccuccgccuccuggguucaagcgauucuccugccucagccucucgaguagcugggauuauagguacccgccaccacgcccggcuaauuuuuuguauuuuuaguagaggugggguuucaccauguugggcaggcuggucucgaacuccugagccuuggucucccaaaguguugggauuacaggcgugagccaccguaccuggcugaaaacuuuuauuuucuacauagaguucucuucccuuaauuuugauguuauuuauuuuuuuuucugaagaauuaauuuugauuuuuuaugcuuuugguuauuauaguacugaauugucuggagaaaaaggaaugccuuacucaguguaacagugccuguauauauauauagaaagagagagagagagaaagcgagagagagagcgagcgagcgugcacuaacuacaauauacugugcuucugauugcuuaaaaacucauaauuuaggaagaacgccuauuuaaaacuuuaagaaauuuaaucaguaaugaucuggaauacuugauugauaauuguuuuaucaacaggauuuuaauuuugggaaaacuaaauaaccugguaaaagaguggauacgagaaaucagugaaagcaagguaaggcaacuuuuuuguauaugaaauaauuucauauauagccaacugaacacagcaagugucuuauauaaccuguucuuauuugaguggauuuggagucuuuaauguggagucaauuuuagacuauugauaacagauuuuacauuauuuuucuaguuaauuuggaagcaggaaaaacugaacugaguuaagcgauuuuuaaaaauaaguauaguacucuuuguuuggaacauuugaaaacugaaacucaguaauuguaaaguacuuacacucuucacagaaauaauggauguuucucuaaaaaggugcuuuaaacauauuugagacucuucuuaccuuuuaagaaauucugccacaguuaguuuuuaaaaaagauuuucagguauuauucaaacugaauauuuauuuauuuauuuauuuuuuauuuauuuuuuuugagacagggucucgcucugucauucaggcggaguguagugacaccauuauagugcacuguaaccugaaauuccugaguucaagcaguccuccuggccucagccucccaaguagcuaggacuauaggcaugucccuucacaccuggcuaaugguauauguggagucuugcuguguugcccagacugaucucaaacuccuagccucaagcaguccucucaucuuggccucccaaagugcuaguguuccaggcgugagccgcugcccggccuauuuaguuuucuguaauaacauucuuuggguuuccuuuuuucuuucuuuauugagacagagucucacucugucacccaggcuagagugcaguggugccacugcaaccaccaccucccggguucaagugauucucaugccucagccuccugaguagcuggaauugcaggcgggcgccaccaugcccaacuauuguuuuuauuuuuaguagagaugggguuucuccauguuggccacgcuggucuugagcuccugaccucaagugauccaccuuccuuggccucccaaagugcuugggauuauaggcaugagccacugcaucuagccucuuucuuucuuucuuuuuuuuuuuuuuuuuuuuuuuuugagacagucuugcucaguugcccaggcugaaguacaguggcaccaucuugguucgcugcaaccugugccuccugcggccaacugauucuccugccucagccccucaaguagcugggauuacaggugugugccaccauacccagcuaauuuuguauuuuaguagagaugggcuuuugccacguugaccagcuggucucaaacuuuuggucucaagugaucugcccaccucggccuuucaaagugcugggauuacaggcgugagguacuguucuguccucuuuuuuuuuuugagacagggucucccucuugcccagacuggagugcaguggcaugaucuuagcuaacuguauccuccaccucccgggcucaggcaauccucccaccccagccuccugaguagcugggacuauauaggugggcaccaccaagccuggcuaauuuuuuguagcgauggcuuuucaccauguugccuaggcuagucucgaacuccugggcuuaagauaucugcuugccuuggcuucccaaagugccaggauuacaggggugagccacugccccagccccuuugaguuucuaacacuucauuaugaauacucauacauacaacucauaaauacauggcugggcuucuucugguagagaaaauguauuuguagaguuguguguggaguucauuugacccauuuaaaaaaauaacauaaauagugguaauuuuuccaggguaguacaaaauccguguuuaaucuauaauauaacugaaagguugaaaagagaaccaaggguaaaggaaaaauuucauagagcagggagacagggugucaacuuaaaaguuguagucuuuugguuuuaaugaaauuuauaguacuguuuacuuaugcaguguauauguauauuucaaaauacaaauuaaacuucagcaaauguaguauucuaaauuauggacuuuacguaccauguguuucuuacugauuuuaguuucugauagaaaauaagauuuuuuuuuugguuuguuugacaucuaauacucuucacuuaaaaaugaaaaaaagauuuugcaagugaaaauguuuuuccaugaccugaauuaagaaaucuuaauuucuggguuacaaugaugauaauaaguauaaacauacuaauaucuaaaaauguaguuuauaauauacuagucacuagucaccagccagguauuuaaauaaaaauuaaaauuaaacauucagauucuugacuacacuagcaacauuucaggugcucaacaaaagugauaacagugacagaauauuuacauccuugcagaaaguaccauuggagaguauucuucaaaagauuguuaugucuuaauagagaagucuguggaccaguguuuuaagauaguuucuccuucaccuccuuuguaggcuacuugugcacacgucuugcuggcuaauuuuaaauaaccaggucagcguugccauugagguuuuaaaauaucuaaacauaggaagacaaaggcuuugcuuacuuuuaagaaauacaacauuacagccaggcgcaguggcuuacgccuguaauccaacacuuugggaggccaaggugggcuuaucacgaggucaagaguucgagacaagccugacuaacauggugaaacccugucucuacuaaaaauacaaaaauuagcugggcgugguagugcgcgccuguaaucccagcuacucaggaggcugaggcaggauaauggcuugaaccgaggaggcagagguugcaguaagccgagauugcgcccguugcacugcagccugggugacagagcgagacucugucucagaaaaaaaaaaaaaaaaauuacacacauaacuugucuauuagugucuauagugaugguuaaauaugcucuuaaaaaacaggagucucugacuguuuagaacuuggcuuuaggguuuuuuuggaguaugaaauaacacuucauuuuauguccuuuuucuuuuuuuugagaggaagggggguggucuuuuacauguuuugguacugaauagauauuuuauuauacugaggaguuagguaaaaggaaauauugacuaaacacuucauaaaauuguuuuuguuuggacagaccuugucauucuuacgagcagggccauugaauacuaaaccguaaagcuugggacuuuacacuagugccagggccaggaaggcaguuuuugaaugcuuucucccucuuccugaugaugcuacucuuucugaguaagaaaagaaaauuuaguuguuucuaaauuacuucacuaaagccuuuuggaaaucuaaaaaacuaagcaauuauuuaccaauauuggcuuuuucuucucugcucugcugucccuuuccccuucccguuccccuuccccuucccuucuuccccucuuccccuuccccuucucuuuuuuugagacagggucugacugucgcccaggcuagagugcaguggcgugaucauggcucacguagccuugaccuguaggacucaagcaauccucccaccuuagccaccugauuagcugggacuauaugugcaugccaccaugcccagcuaauuuuuaaaacauuuuuuguagagacgggguuucacauguugccgaagcuggucucaaucugggcucaagcaauuggcccgucucacccucccaaaguguugggauuauaggcgugagccacuguguguggcuacuauuggcuuucaagucacuuuugauaugauaaaaaaaauacucuaauauguugugggauauuugguaaaaaucguugaauauaaucuuuuucuuuaaagcaaucagaauauguuuuuauuauacucuaaauuggugauucauuuuauauacagcaucuuugucaugaauaaaguccccgauucuaacgugcuccugugggauuacaugaucuucucaaucacagucuucuuuauaguaguuucuagaaauagggcaagaaucuaacaauaaagaauaaaccucuuuaaaaguugaaaaugguuugaauuucaaauaugauugaucugaggggcugguauuuuuuaagaacuuuuauagacuuugaauacccuuuauauaaauuuacacuguaaucuuucuuggauccacucccucaccccaguauaguaucauuugaauaguuucccuugugcuccacuggcaaaauaaccauuuuuuguuucaacagaaucuuccacaaucuguaauugaaaauguuggaggaaaaauuuuuacauuuggaucuuacagauuaggagugcauacaaaagguaaguauuauuucauuuuucuuagaaagggacccuuuaguucuuaaaaauuaugacauacccgucucaguuacuuguguaucauauagcuuaggcuugcauggaagagagagugcuuugaggagucuaaauuuuucaguaagaaagauguaaaauaaugcugacuucuauaucgccacuguccaaaaguauuauuaagauuaaaugaaauuagcuuaguguggugacucauaucuguaauccuagaacuuugggaggccgaggcagguggauugcuugagcccagggaggucaaggcugcagugagcugugauugcauugcuacacuucagccugggugacagaacaagaccccgucucaagaaaaaguaaauaaauaaauuaaaaacucagaguuucaguagagguagccacauuuuaucuguucaguagccacauauggcuagucguuacugcauuggaaaguacagauacagaguaguuuuucuguuggagagcucuuuuguacagugcugcuaucuacauauauaucauuuucccucaccagaagaauaucacucuggaaauagaacaaaaaugaauucuagcuuuuaagaaaacucauggaugccccccgcuaauaccuuuauagacaaauuauaaaauauagcuaagcaaaagcaaaccccaaaaauguguauucauagccaaugauaaucaguuaauaguuuauacuuguaguuauuuccucuaugcaaauaaauacacaauaaaaauguuaccucggcaaagaacauuuauugagcuucuuuucuuucacugaguacugagaucuucauuaucuuauuuaguucuuccaguacuguuauucucacauaacaaacaggagccugagacuaaaagaggcaauaaagcuugaacaguuuuucucaaccuucuaguggcagaguagguacaacucaggcaucccgaggcuguacugucuuugggucuugcucuguugcacaggcuggaugcaguggcacagucuuggcuuacugcaccuuccaccuccugggcucaauugauuuucaggccucagccaccugaguagcugggacuacaggcacacgccaccaugccuggcuaauuuuuuaauuuuauuuugguagagacaggguuuucccguguuguccagcuggucucgaacuccugggcucaagccauccacuugccucggccucccagagugcugggauuacaggcaugagccaccacgcccagcugaggcuguauucuuuaaccaugaacuguaucugccgagauaguguugucuguuuucuaguauccuuuccucucuccaucucccaucacucugucccauuaguacauuacuuuugauauauccugugugcuguacaccguucuuccuguucuaauaaauagcuuucagagucauaccucagcaucuugucuuuuaggaaaaugacuguugaccugauuccacauuaaucucucccuuuuaugaccccaauugauuuuaauucuccuuuuuaaaauucugccuauguacuuagugcuggccucuuaucaagcacugaauuaaugacaaauauuuuaccauugucuacuucuuuggauucuucugcuugaaguuuauuuuguaggucccauuuaggggccugguagagaaccuauaagcaccaaauacguaguacauagaggaaaacuauuuuuguuuuaccaaugaacauggcuaugacuaaugacaucaagauguuggguguauguuugaauaauucccucuccaccaugaaaguacuugcugagccaucuuucuuugggcucccaguuuacuugggccacuauaaauagaggaugcugcaggaucaaaauauaccacaucaauuaaaaucauguuuguccuccauugacugguaauuuuaaguaagggguggaacauuuuuagaagcucaccaguauguuaaacagauucucaacaucaaauacuaccaugauaggaugcaaaauaauuuucuuguaauauuaauuagugguugaugggcuuaauuuuuuuuaggugcugauauugaugcguuguguguugcaccaagacauguugaucgaagugacuuuuucaccucauucuaugauaaguugaaauuacaggaagaaguaaaagauuuaagagugcguaaauguucggggugaaaugggaugaguuaugaacauucauuuagucaguugagugaauuuuaugauauagccaucauuuauugaguucuugcaauuugccaaaccuuucuaaacacuuggcauauguguuuguguuuuauucuuuacagcaagccuaaaauuauaaacucauuuacagauuaggaaauugaggcaaacaaaauaaauaugaaauaaucuggccacaaucauacaucugaugagugggugaaguaaaauauuugaaccuugauuucugaucugucugaucgaacagcccagucuuaaagcuagcuauuuuugugucagguguuuugcuaaaguacuaaaacuaguagaggcuuaaaauguaguuucagagacccugaacuuguuuacuuuccuuauaggcuguugaagaggcauucguaccaguuauuaaacucuguuuugaugggauagagguaagguauaguucaaauugacaguucuugcuaugugcugucacuaauuuugauugauauagguuaaaaacuugguuuaaaguuuauaauuagugaguugguugugauauuaauaacaauuaaggcuuuuaaauggaagugacugccuauucuuguagaauauaccauuuuaaaucuuuuuaaaaauaccaagugaaauuuggagcuaaaacagaaguaaugaaaccuuaagauugaaaugcuauuacaaaaaaguuuuuuugguagcuuuuccauaugccaguuuugugugcuuuuagucucauuaaggcaguagcauaauguguuuuugcaaguaaugcuuugcuuugacuucauuuaaaaauugggagaaaagugugagugcugaaauaucuuccgauaggggaggauuuauggacucaaauucuugagaugauguucauuucuccuugcugcuuucgguguguguaauuaaagugaugagaauaaaguugacagugaagcaacuuuaguaauucauuacuuuugcuguacagaaugguacuggaaagucacagauaauaaagugaagauuguaacauuuuggaaacuguaagagaaauaauuuauugaagcugggcacagugaugugcaccuaucaggaagcugcuacaggaggaucucuugagcccaggagcuuaaaucuagccuggcaauguagcgagacuuaaucucuuuaaaaaauaaaaaagauaauucacuguuguacuauuuugcaaaaaaauggcugcaucuaagguugcugcauaagacgcucaacucuguauuuuaugaaaagucaagugacugaccuuaauaaguagacauaaaauguuaaauuugguaaaggauuaucaaguucauguaguuuugauuuacugucaguguuuuaaguaaacguaaaaauaaucuguaauauaaaguauaaguugaggccucauuuuccuaaaaagaauauuacugacaaagaggacuuuuuuuuggaaggagaccugaccuaacuuuguaaacuuuacaggaucaagauggaaaguuagauggcuacuuaaaacauuuaauguguuaauuuucuauuauacaugcuauauuaaaaaauaauauuuuaggaacauaauauuuuaggaaauuuaguaaucauuuucacauuucaauauuuuuugaaguaauuccauccuuuaaaaaaugugucaguauuauuacugaguugcuuuuucaguuaccuaguuuuaugagccuauaaucuuuauuucuguccaaauugggggagacuuugaaaucuguucuuuuucauugaacaguuuauccuagaccacaaguacuuauuuguguaacaguacaauuuuuuuucuguagguauguuuaaaugauauuuuaaaaugugcuccuaaaauacugcuuuuuaaaaagugaucuaguagccaggcacgguggcucaugccuguaaucccagcacuuugggaggccaagguagguggaucacgaggucaggagaucaagaccguccuggccaacacguugaaacccugucuguacuaaaaauagaaaaaauuagccaggcaugguggcgugugccuguagucccagcuacuuaggagacugaggcaggagaaucacuugaacccgggaaguggagguugcagugauccaagauccugccacugcacuccagccugggcgacagagcaagacucugucuaaaacaaaaaaacaaacaaacaaaaaaaaagugaucuuauaaaaggcuuguuuacagcgacauccacauuuuuggaaccaugaaaucauacccucagggauaacuaccaaagcugugcuguuucuuugcacucucaccuuuccuuuagaaaagaaacaauuuugucagcggaauucuaugucuucaaaauuagccuuaacugugguuguuuuaggcuguacuuuccccaguguuuuuguuuuacuuaaaacucaguuggaaaaacauacuguaguauuacagacauaaaaguucucagauauaauggaaucucuuuauugagaauuauuuuuggcuaaauguaaggauguuugccuuauauuugaguacuauuaaguucucauguauaaugagaucuccccuuauugagagguauuuuuggcugaauauaaggcuauuugccuaaauuuggguacuuuuuaguauguaaucaauuuauaauucauauagaugaagagcuaaacaguuaacuuuaauucagcauauguauuuacuagacuuacuauauccaguagaugcauuuaacaaacuuaauacaucaaacuugauaauugugauuaaacugacaaccagguauuuguacauuuccauuucuguuuuaaaaauauugccauguuuguuuguuuuuuuuuuucuuuuuuuuuuuucugaggcagggucuuacuuuacccaggcuagaggcaguguugcaaucacaguucacuguagccucaaccuccugggcucaagggauccuccuaccucagcccccccaaguaggugggacuacaggcgcuugucaccaugccuggcuaauuuuuaauuuuuuuuguagagauggagucucacuauguuguccaggcugaucucgaagacagccucaagcagucuuccugccuuggcucccaaagugcugggacuaccggcgggagccacuacccccagccuauauugccauguuuuaaaauuaucuaauuaaaauaccuaugauacgaaauaauauaguuuggacuuuuggagggacauugucguguucauagauaaugaaaggauccuggcuuuaaggaaaauuagguuuuuguuuugcuguuuugagucaggguuuuacuccugucacccaggcuggagugcgguggcaugguuuugacuuaccgcaaccuccgccuuccaggcucaaaugauuuuucugccucagccucccacaggugcaugggagguccauagcugagaccacaggugugugccacuacaccuggcuaauuuuuuuguaguuuuuguuuuugagacggaguguugcucugucacccaggcuguagugcaguggugcggucucggcucacugcaguucugccuccuggguucacaccauucuccugccucagccuccccaguaacugggacuacaggugcccaccaccaugcccggcuaauuuuuuuguauuuuuaauagagacgggguucaccguguuagccaggauggucucgaucuccugaccucgugauccgccugcccaggccucccaaagugcugggauuacaggugcgagccacugugccagaccuguauuuuuuuuauagagacaggguuucgccauguugcccaggcuggucuugcucaaguguuccaccugccucagccucccagagugcugggauuuuuuguuuguuuguuuuuucauagaaaugccuuaaaaguaguuugacagauauggaauguuguuuuguuuguguuucagauugauauuuuguuugcaagauuagcacugcagacaauuccugaagauuuggaucuacgagaugacagucugcuaaaaaauuuagauauaagauguauaagaagucuuaacgguaugagaaagccuacuuccuuuuguguacuucaguuuuugucagauauuaguuguuuuuacacaaguuuuguauugaagcuuuuuauagcuauauuguuaacacaguagugaguuaaauaaaaugaacuuugccuaauaaacuacagaagaguauguaguaguuuauuucacucuacaguauuuuauacacuguauuucuucugucauuaaugguauacucaggacacuuaaaaagaccaucugacuuuuguacucuguugcuagugauuuagguuucauggccuaacccaaauuaauuuugauccuguuauucuuuaguaaugcuuucagcauugcugagaucagaaggacuacuuugguacaauuuuauauuagcauagcuuguuacugugcucuugaagagcaguucuuggaaacuuuaguggauuaagucuuccgcaguauaugugggaaguuuuaauugugaaucugaaguucaaauuggggcagguuacaguuuacuuugguuucuuuggucagugcuuacaauaggagauaaaugcuuuagauuuuuucccccucuuuauugaauuagcuuuacugguucuaccaaauaaaaauuuauguuuacuuuuaacuucaaucucagaaaauuuggaagcauuaccauuaaacuuuugaugauuuaauguuguuuuuuuuuguuuuguuuuguuuuguguguguguguguguguguguuuuuuuuuaccccuauuaauuagguugcaggguaaccgaugaaauuuuacaucuaguaccaaacauugacaacuucagguuaacucugagagcuaucaaacuaugggccaaacgugaguucagaauuuguuggcuagcuuauuaaaaauguucaaacuuuuguucaacacuaacuuaucuuuuugcuuuucccuuaucaacaggccacaacaucuauuccaauauauuagguuuccucggugguguuuccugggcuaugcuaguagcaagaacuugccagcuuuauccaaaugcaauagcaucaacucuuguacauaaauuuuucuugguauuuucuaaaugguauguguuuagauuauauuaaaauaaaauugauuguagacacugaaguuuagucuuauuucuaugacauuucucagcuugguuucagauucaaauuuuaguucaugauguagucauguaggcagccuuggagaucacauuguguauaaaauggcaaacugaaacuauuuuuuuucccuaguuuggccaggauaguaaggcagauucuauuuguacuuccuugcauaaacuuacccucugaauaaacucugaauuuuagcagcuaagauccaauuuauugauagguugggaaaucaguuacuauacuuuuggauaaaacuuguacacacuaccucuuucacucuuuuaauucucuaucuauaggccauuaguuucuugugauuguuuuuuuuuucuuuuugcuuucagcauuuauuuggccuaauauuaaagauacgaauuuucauaagaagcuuuuaaagaauaaauuaacauuaagugcuucgggacaaaaaaggaauuugagauuagucauuaacccagauuuuuuuaaguuucuucguuucauuuccacauaugucaacuaugauuuaagaaaaaguagaauaaaagauuacugccauuuuauauuaauugccuuggcccaaaaggugaggguucuugguuuuuaaucaaauuaagauaaaucguccauuccuguucuuaugaacuccugcuccucccucugcaaaagagauguucuuuucuaguaauuuuauaaaaauuaguuauuugagacaauuuagagcuguguucaacuggaggaaaaauaaaaaaaauuuagaaccaugccacacuuuucaguacacauucuggcuguuuugggauuuaguagcacuuauaaucaggugugauaagauuaaagaaugucagaauuucuuuuuuuuuuuuuuuuuuuuuuguuugagacggagucucacucugucacccaggcuggagugcaguggcacgaucuuggcucacugcaagcucugccuccuggauucaugcuauucuccugccuuagucuccugaguagcugggacuacaagcgccugccaccacgccuggcuaauuuuuguauuuuuaguagagacgagguuucacuguguuagccaggauggucucgaucuccugaccucauaauccgcccgccucggccucccauagugcugggauuacaggcgugagccaccgcguccggcugucagaauuucuuuuaaugcuacacauauauaagcaaauaauguuuuuaagaagcuaaccuugauguuaagaguggcagguguucuccaguuuuuaccucuuucauaugggaccaaaguagcuaguuuauggaacacauaugaaaaugugguuaugccaccaaguuuuacuacuacacuugucuuaccacuuuuaagucaugaauucuauaauuauucauaccccuuugccugugaucagaaguaacuuuuaaaauuaucacuugacuuuggauggaacuaguauaaaggcaggaauuuugucuuucaguggagauuuauucuguucaagguugaaguggacacaucauuaucuugggaugguacuucuuuauuuaaauaguccuuuaaaguucuuugaguggcagagaacguuuuugguuucagucugagaaggcuaccaaaugguuuaaguucauuucauaguuaggagaaaaagauuuugaguagucuaaugucgucagaaaggauuaaaacguuguauguaccaagaaggcagaaugaagaaggaucacguucacaaaugcuguauguuuaacaaaauacguuuagaugguaauauccaauagucuuaucaagugcuacaaucuuuuuaaacagggaauggccaaauccagugcuauugaaacagccugaagaaugcaaucuuaauuugccuguaugggacccaaggguuaguguauuauuuuuuccccuaccaauucacacugugcaauaacaaguaaaaaucaucugcauaaacuccagggagacuuccagccuuuuacuuaugaauggucauguccguauuacacuuucuuuuagauaaccucaacuauaauuguccucaacuauaauugaugugagaagcauaauuauguacccuguaaaccacauuuaauuguacauaguuuuuaauacagauuuuacuaacauuuuaauuuauucuauauagaacuaccuuguaagucaaaguugugugggcauuugugcuuuaaaaaaaauaaaaggauacuaaaaaucccuguauuuuuuauuuuaucuaaguauuaugcuaaaguuggguuguuauaggaaagcuguuacuuaauguuuacauguggcauauaacuucuaagcauuuucacuuuaauuaccaugauguaauuguaaaaaaaauugguuuagauauuuuagagauuauaaaaacaugguugggcuaaagaagaccuuccauucuguuucuugggaaguuacaacauuuaccgcuuacucauuuuaaauguuaacaacaugcacuuuauaaacugauaaaagaaauuuagguuugaauaagauuuccuaaguuuaugaaauccuuuuuuucuaaauuauuacaauaucaaaaauuuuaaauucuguugaauuacaucaagcuaugcauuuucagguuuuccgaaccucaaggcauuuacuuuuagaggaugugaauuuacaacuuacuuuguggaaaugugccacuuacugauauacagauuuaaaauuaacaguauaucauuucauuaucuccuaacauaucaacauggauaauguaguuucaccgcguguuaauaagcuugaacuccuuaauaguuucaggguauauuaagaacuuaaguuucuaucuuguugaaaauuagcuuacaaaacauuguagcaugacaugucucuaaagguaauuguaugugcauccccauuucuguuguugaauaaagaaaaacuaaacaucaauagauucccaagcagaacuuuuuuguuguuguucagcaggcacacuuucuaguaagguugccaaaauccaaauugaagcagaucauuaguuuagaugaaaucuuugauucuauaaaaaauuccuauaaaaacaaugucucucuacaugguuuuucuuucucaacuccagcuaugaaugaaauaaaaaauagaaucauugguucaguuuaacaagggguaaaaagcccaaguaucuguugcauauguacuugaagaaacugauuggcuguuguuguauguagguaaaccccagugauagguaccaucuuaugccuauaauuacaccagcauacccacaacagaacuccacguacaauguguccguuucaacacggauggucaugguugaggaguuuaaacaagguaaguguuuauccuuaugcucugauuuauacaggaaggauuuacguaccauuguagacccaguagucagcugugcaacuuaaauugaagaaggauucacugaaguggauuuugguguucauuuauuuauuacaguauauauuugagaacugacuucaaaaaauuaauuccuuuuaggcaauuuguuuuuuauaacaaguuggaagauuaaccaacaguuaaaaccaguaagcugguuuaguugcauacuauugccuuguaaaauuauaaaugauaacaguuugucuacacugguugaaaugagagauguuuagcaggcuguauacuccugggaaagaacuuugagcaggaauggggccaaaccacccaauuacauuccauuauuuuggaggaaccuuuuaacuuuugaacccuaguuguacuguuaauuugaagguauagcuacuaccaaauagucuuugagagaaauaacuggaacagauugguuugacugaaaacaguaaaggaaauagaaucaguugucugacuacuagcuuuaaauuuagacguuuaaaauuccugaauauuuuacacuuuaguuucaucuuuagucuaaagaggcccaucaagggaagaugccucuaucccuuuagaaacaacagggaaacuugguuuuagaaaggcaagaaacaaaguauauuggaaaguuuuccuucucggguaacuggaguguuuaagaaagaaggucauucuaugagcauggcauuuuagaauaauuguacuuuaccagaaaccugguucucaaaaaaucuuccagcuuuuuaaaaaaaaaauguguauauauauaagaguaugcucuaaaaucauaagcuaaaacuauauauguuaaaauucugguuuuaggauuauagugagugcauguaguaugauuaagauuauuuaaaauucuagauuguagacugaaguaugcaaacauuuuaauauguuuuuaauuuaggucuugcuaucacagaugaaauuuugcugaguaaggcagagugguccaaacuuuuugaagcuccaaacuucuuucaaaaguacaaguauguauuuuaaggcaugucggacauguugcucucuuaaguaaugguuuaaugguagcacauuaugacauuucuucuugcuggacuaauguuauuggaagaauuuucuuuccugucacaaggacauacuguuuuagugaacuccuuaguuuuuuuugguugagguaaugaaugugaagccccuuugauuuuucugcccgaucuaacugaacuccugcuacauuuguagcaacauaaguucuguaggcauacaucagucaugacaaaaacaguacaucuguauacaguggcaaguggaugcacccugaaaaaucuguaguuaauaauucucugcuaagaaacaguauuuuuaucuaauucuggaaacucauuaauugcuaggaaucuuuaaaacaaagacaaagcuaauaaaaugucaauauauagccaauuaaauguuuucaauaguuacagcacauuauuggccugccauuuucccccaauguuauagccccuucaaauauuucuacagcuagcuuucaugaaucuaaguggguguuaaucauuuuaauuaaugguuuaaauauaaugguuuaauaccuuaguacagguuaaaagcuucauuaauuguguuaguuuugaugaaaaauguaaguuauaaucuuauuuaaaaaacagacaaaccacagacuugcacuuuuauuugcccugggcugaaaaugugccaaagucccacuuaaaauuuuuuuuuuaaugcuugaagcuuuucugaccauuugaucuuguguuggauuguguuuuguaauaaucuaagcaagauugcuuuaugcucuuccccaauuaaaaacaagaaugaugaccuucaugaugucucuguguuuuguuucuguaucuuuugcaugagaaagcaauaacggagccaguaauuguguucucgaagcacuacguugucaguaaaaauuaaaauagcauaaucauuaaauacucuuauuuuacuacgaauccccccauaaauugugauuucuguuugacagauaauuuuucuuuguuuuuauuuuaaccaguguagaggaaguaccuuggaacauuuaaacuaauaaacauguauguagauacuuuuaaaacuaugauauaaaagagacacaguuacauguaaggagaagaauaaaggaauugguuuuacaggaaagugcuaguaccccuuaauuccuggaaucaaugaugaaacuagauucaaacuuuguucuauucacuuucguauaggacugugacggggcuucuuucacuuuaagaaagauuaauguuuacacugaacaaaccuuaauaaugucauuuuauuugaacaaauucacaucauuagaacuuuggugcuuuuucuaaagcuugcuuaauguuucuuuuaaaaguuuuaaacuaugcuucaguccuugcuggauaguaccuguaaguucuuugacugguuaaaagauauauuacuaaucuucacugaaguuuuugugaaauaaucaaauuuuuuuagguuguaaaaaaagcagcaacaaauagaggaaauuacaucaggaaaauuugcauuucagcugagugucuugugaaaacuuuuaaaauaugacaaugggcuaguuuuauccauaccaaauucuauuuauauuuuuaauuguucuccagaaauuugccucuuuaagauaaagugaugacuaucauuaggcuuuuggagguguucacagauuugaauuuuuaaagacauccucauauaaaauacuccaaagauugacuguacaaccaaauggaaauguuuagucuucccaugagucacaaguugauucaaucuuauuugaggcauaucaugaaauacugucaguugauauguguaggauuuuaaaucaugugaaauauaccugacauucuuggaaggagccagaaccauggagaaaaaucucguuuguuuuaaaaugcaaacuaaucaucuuccagaaagacuuaucaguguuccucaagaaaaagggguaacauuguuuugugaaauuuuuggaguucuaagaaaacaguuuuuuaaaugccgcuucugagauaauucaaguuaacauguaacuagcaguaaaucauuaacauuaggaaaugugaauacuuacuucaguuguuagauuucacuaggaauaaaggaaaaguauuaggaaaaccaauguauucucuaaggugcaagaugauuuuauaauuucauguguguauacaguaaccuuaaauuuguuaaaaaaguuaaaaacaggaaacuaaaucuuggucuugaauuacguaaacauagaauugcaaacauuuuugacuaagauaugccagcuuuuuauuguacaucugaguuaugaucuucccaggugagaugaaauggucuucaagagauucacuuagagaauuuguuuugcaaauagcaguuagguaauaaaguaacuaaauuaaguguuuuuagggcacuuugcauaaauucuaauuauuuugggauacauuuuuauaguuaaauuuauuuuuaacuauguuuuuaacuauuuuuauuggaaacuauauauuuuuaaauuuggggaaaagguaauggcaauugcaucaagacuucaaagucucgcauggaggcacuugcgcaucauaaacaugacaguuuuaaacauggcacuuguaaaauaggggaccaugauuuuucguacaucaacaaaaugucuaauuuagauguacacuagguuucuguggucugauugggaccuuaagaauugaguaccaauccugguuuuaaaaauuaaaaauagagauauuuagagaaugcaguuggaauuuuguuuuguaaaugaauuccuaaugacucaaaauauuugcggguuuuuuuuuauuaaacuuaacuauugcauuuuauaucucaacucaaauuuguuuaaauguggcugaguaaaggacauuuaaccucagcauaaauacuuguuagaauuacuuaauauuucuaccuauaugugaaugugugcauuuguguguaagauauauacagaguagguacucuuucccuuuuggauuucaguaagaaguuauguugaacucuaggauucaaaacuuugaauugccagcaaaaccguguccaaauggauuguauguuuucccuuuauaaauaaagaacauuguauaucauuuaagguuuuguugaagacuaaggugguuauuaagaauuuccauuuuaauaauguguuguaagagugauuuagagacugcgggaguuuugucccugcccuuagauggacccagacagcuuuguguuuuuguguacaugccugauuucuauacuucauugucuccuguuacaagucacuguacuuucgugagagagcucuuucugcauguucuuuaccuuuuuuuuuuuuuuuaaccaguuagccauuuuuaauguuuuagggaccuagaaaucagguuacugagcuuguuaggauuuuguuugauuuaagagcauuuggaacuccgaguauggguuuuucuacacauaaaauacaugauuuuuuaaugcuuuuauaugacuuuuguugauuuauuugggccaucugugcuugcucauguauuugacauauuccaaauaaugcugagcaaauuaaacugguaaaggaaguauugguuuguaggaguuuggacugcauauucacauaucccuauauaccuuguuuuuuauauaucuaucucuguuaccuugaguuuauagacuucaaguuaacuccauugaacuuuacaauaccucugccaguaaaauguguacuauuaucccauuuuacagaugauguacacaagacuuagaauugccuaggauuacauagcugugaagaauuaaaaccauuuuucuuuuuuuuguuuugagacggagucucgcucuguugcccaggcuggaaugcaguggugcgaugaucucggcucacugcaagcuccgccuccuggguucaugccauucuccugccucagccuccugaauagcugggacuauaggugcucaccaccaugcccggcuaauuuuuuguauuuuuaguagagacggaguuucacuguguuagccaggauggucucaucuccugaccuugugauccgcccgccucggccucacagagugcugggauuacaggcgugagccaccacacccggcugaaaccauguuucaaauacauuuuuuuaaaauaaguuugguaguuuuucucugggucuaggucagauuuuugcucuugguuagaaacuauacuuauaaaauguguuagaaaguauuaggaagguuuuagacuuuucaaagaguaaaauaauuuuaaaauugugguuauacugcuacuuuugaaacuagugucaguacuagaugaugucaguuugcuuuuugggguagagauucuggugugaaauuuggcccccagcacuucuaaaauggguacuguagaagaguauauuggauugaacuuuuuuagucguaggaaacugaaucauuguaguuacauuuuaguuguaaauaguuuguuuuaaaaagacuucauuauuuauuugaucaugaugcuauuuucugaagugaaaacuuggcuuuugucuaauaugaaugggauugaguuuuggauaaaaaucagauuucuuuguugcugucauguuagugauuuuuuuuuucuuuuuugauuauagaaauguauacucuuaaaauugggaaaaaaaucacagggccuaacugcaguauucaguuuaauuuucacuacuauuucauuugaauuuaaaagcaugauguguuugauacuguuuuugaaguuacuguuguaguauguguauuuagugauaaguuuuugugucuaaagcaaugguguuuugauucuauugaaacauuuuuguuauaaguagauuauauuuuagugaacagcucuuuaauuuuauaggcagagcacucaaucggugucauugagcaaaauuauuaaugcuuauuuaugcuucuugaauuaagcugcuuuuugguaauuauucauaaagucacugccuuuuucagaagaauuaaacucacuaguaguuagaaacauggaauuuagcauauaugauuuuaugugcauauugagauuguagucccccuugcuaaauugauguggaucuauaacuguaaggaagcuuauuacuuuaugguuuaauauccagcacaaagcguguaaauaaaauaaauagcauguugucuuuaucuucaaaggcauuauauuguacuucuagcaagugcaccaacagaaaaacaacgccuggaauggugaguauaagaauagacuuuacagaaaaagcaaacuucaaaaugaaucacauagccacugaacacaguaggagaugggaggaaguccuuaaaacuucuaguuugguuugauuuguucacaaauggagcuuuacuguguguaguggaaguacagaaaucaggagauccauaugcaacuuauuuuuuuguuugcuuuauggagauccgugcauaauuucuuaauuguauauuuaaagugcacuuauagcuuguuuuucuuaaaauuuuuguguggauaacuuuuguaaccuugcuggugugaauggaguguuucuuggcucuuuuuuccccguuguuuggcaauuuuggguagaacauaaggcuucugguuuuaucugugggaguucagcuaguugaaaugcccugguaugugcauuuuauuuauuuauuuuuaaguuaaccaaaacuuuuuguuaauacuaagugacauuuguucagggugggcuugguggaaucaaaaauccgaauccugguuggaagcuuggagaagaaugaauuuauuacacuggcucaugugaauccccagucauuuccagcacccaaagaaaaucccgacaaguaagcccuuuucuaauuuaauuucuucuucccauuuccaauuuuuauucauagaagcuuuuacaggcauuuuuuauaacuaguauaacuauucuguugacuacauauggcuuauagacaauuuagaacuuauaauuuaguuuuuccugaucagaaacauugaagagaaagacuguuucgugagaaaaaucagcacacauuuuuuuucugauaauauucuuccaaugaugaggugccuguuagcuagaguuuacauucuacaguucugcuuuaauacugucuuuaccauuccuucuuaauauuuuuucuucuccuguuuuguacaauaguugucagaauagcugguauaccauacaucagucuuugcuuuuuaucuuaauuuuuuguuaugaacuuauaaaaaucugauuuaugcgugauucuggacuguugagaagauaacauaagaaaaagcagagucaguuuaccuuuuuaggggucuuuuauuuauguagguuaguuguugauuugauuguuugcuguucguaugagacuagacucuauacuuuguugcauuggagaauuggagaguacuaguaaugagcuuauuuuaaaaaauaaagcagcauuaaaacaagugaaaggaucauuaaauuuguguuauacaguauucuuauugauuauauagauuuuuuuauuuuguaauuauauaagaguuuuuuuacauuuugugguaauucuaaucuuaauuauaacaagaccguuugauguuccauucaguagauaaacuguuaaauguucaaaaguagcuaaaucacuaauuacuccuguuaugcuucuguucauguggccuuuuaaauugaauuuuugaaguuuaagaaauaucuauuaaguucuaguuaaauuucuguauuuagaaaaauccuuuuuuucccagauuuuucuaaaaagauuauucuuuuuccuucauuaguuuaaagauaauuuuucuuugauuucaguggcuuugguucuuuagaaucaucauuaaggacauugacuaucaaugcacaguuaguaagaguauauuucuccuggaucucuguuuauguuguaguaggaauauagaggacaggugugggugaggacuuugcguuuucauggagcuugggcuuagaacuuuuaguuugcucauacauuuguauuguaaguuuuuccaugucucugauugucagccacacugauagcuacauuuucaugaaauccagauaaacuaugguaaugcucuucuuugcagggaagaauuucgcacgaugugggugauuggguuaguguuuaaaaaaacagaaaacucugaaaaccucaguguugaucucaccuaugauauucagucuuucacagauacagguaugucuuuacuuggauaaucaaaacacuucaguucuugcauauuucaaauugucuugaugcauaccauagugauauuuacaauaauuguugaaauuacuugcgaauauugaacuaucaucagaauaaugguuuuguauuagucuaauacagauugaguauuccuuauccacaaugcuugggaccagaaguguuuaggauuuuuucagauuuuggaauauuuacauuacacuuaccaguugagcaucccuagucugaaaauaugaaauuugaaauacuucagugagcauuuccuuuaaguaucauguuggcacucacaaauuuuugcauuuuguagcaguuucagugucagauuuuuggauuagggauacucaaccuguguauacacgauuuuucucuauuguggugaccuuaaaguuaaguagaaccauuccaaacuugacuugcgcauaauuucuugagaaaugggaaacaacuugaauauaugguugucuagacugaaucugugucuaacugccuucaucaucuugaaccugagaaauugaugaagcagaacuugugaugaccuggagaaauuuuccgacuauggggauucaaauguuaaugcauaggugggaaauaggcugauuauauguagauuucagauugaccuguacccuaagaugaaagguaguucauuuuaaccaaagaccaaaugguggauguaguugagagaaugagucuauauguagcugcacaacuuuuaaugggaauggcaaauacuacgcauagggacaaccgcauuucuucuuuaaggacuaauccuuuucucucgcagauacuguccuucucuccccauuuaaaacaaauguaguaaguggcauuuuuauucccuuugaggaguuuucacuugagaacauacagacuuaaaauuaagaaauguuuuaccuaauuacaggagagaaaaaaguuagugccaguuuguuaaaaagucaguaucguacacuaacugugauauaaaggagaaauaaaaggaaaaggauauguauuucaauaugucagugcucagauacagugacacuagaagauaacuuaagagucaagugauugcacuuuauguagaaucgcgagcagugugacaucuauaaauucugacugauacaaguguugucuguagggauucagcuaucaccagcagcguuagcauuggugaccugguaaaagugaaaguugcaaauaaaaagugaucugauuuugauaugcuuggugguaguuguauuccuggaaauuucaaauuaaaauacucuauuuuuuguuuguuuuuucucguuuuuuauuuuaaauacuccauuuuuuaaauuuaaaauugaagugaauucuuguuuaaauaauugccaaguagguuuuuuugucuuuaggaauguaggaaggacaugguauaauucuguguuggguagaacuguccacauugaaagauauauaguguuucuaggcauaauaccuuuuaaucaauacaauaacaaaaauaccucugcagauuuuuagaaugucguauguagggugauacuccaccugcugaacaccacagaaguauuuuuuccugaaguaaaaauucugauguuaacucauuuaugaacuaauaagucacggauacuuaccuggauuagaaauuuguucuguacauugcauucaaguuaagauguuuaucaaagauugcacuaaugaaccaucaagauuuucaaggauguuuuagguauuuugggaaggaaauauuuaguuguccuguauauugaaacacuuuaauccaauacuuuaugggauuuuuaaagaaaauagguuucacauauucagcacacaaauguucacucccaaccccuaccaguuucuuuucaaguuauuuugguuguucaaccuagagacauuggaaucagucuuugacuccuguuuuuuccauauuugauguuaauccacuauaaaaucuuuuugccucuucuuucagaauacauugagguuucugcuacuuaguacuguucccacugcuuucacccuaaguccuagccacuauagugcuguuggaucacugucauugccaaaacuuucucuuuugcccuugcccccuucagcuguucuuaccuaguguccagaugauauuuuuaagccagaucauaucuugccuccuuaaaaccuuugaguauuugucucacucaaaauaaaaguccaagucuuuacugugguuugcaagccucugccugaucugccuuuuucauuaugucugugaccuuaccuccuguuauaaguucacaguccuuuaucuguaaguuuuggagccagaaggguaauaaaguuaguaaguaauauacccagugaggccuggagcagcauuugguacugaaagacaguaucauuucugcagggaaccauugguacucacauggagcaaaagguaaagaccauauagccauagccacaaauaguucagaacaggguuuguuacuagaugaauuuuguuuccuaucuuagaaaaacuuguguguugagaguuuuugggauuuuggaguugcacauaagggauuauggauuucuacuuuucaucuucuucauuggcauuuuucuuguuucucaaauguuccaggcauuuucugcugcuuagggcauuuuguucuugauguuugcuuucucuggaaugcuauuucaccagguacucucagcuuacauccucauguucauuuaaaucuucagucagaugucaacucaguuuccaggcugagcuuccuauccuacucccuacgugguuuuucucaguaauacuuaucaucaucugacacggacuauaguuuauguuuuauuuuuuuguguuuauucuauucucccuacuguaauguagacccuuugaggcuacguuggucuuuguucacugcuuaucuccagugucuaggacaauaugaaucaaguauagguguuucauaaauauguuuuguaugaccgacuuuuuuacuuuuuggggcccucuggaucuaaauaauuugaauuuauuuaauuguagcauuuucuuuuuguaccugugaccucuguuauuuaaauuauuacuauauuagaaaguaugucauuaguuaguuuuaucuugcagauucuuguaaagauaccuuuagguauaguuuaauaaguuugacuuauuuuacagcauguguuacauacuuggguaaaguuuuaaagaauaguacugguagcauaaaaggguauggguguaagaaacccuuuuccccucauuucugccauuucuuaaagaguuacucuuuagaguuacuacuuuaagagcuauuuaaaggguuacuacacuggaagaauuaauacauuuugugcuuuuauucagcucaucuugugguaaaaggaguuugcucaggcaaugaauuaugucagauuaggaauaggucuugaccgaucuacagauaugcaguauugauggaaaaaggaucccuacuuagaauaguuucucuggagugaguauaacugccuuuauuaaaauguuucuauuucuuguaacaauuuccuaauuguauaguuuauaggcaagcaauaaacagcaagauguuugagguggauaugaaaauugcugcaaugcauguaaaaagaaagcaacuccaucaacuacuaccuaaucaugugcuucagaaaaagaaaaagguaaauuuagaaaguacuuacaaaagcauuacuaacauaauguuuuaugcaucuggacuaucauuauuucagaauuuaggcucaguuaauaagucauuuuaaauagaugacagcuuuuuaaaaaucuguuucauggagcaguuucauuaugugaaaucugacucuaaucaguuuucuugcacacaguugcuuuagauuuuagaaggauuaguggugaugcuucauauccuuacuuuguauauacccguauucucuuuuaggacuuuuuauucuuauucacuuaaaaaucccacaccaguauuuaauuuucuuuccuuuaaaaaguaaacuaaauuaaauuaguaaggaaauaugugggucaaguaaauuaugugagacuuuuaaaaaaugaaagucgcuuuuuuuggugaauguaaaaaauauaacguauauuaaaaacuaaaaguugcugaguguaaaggaggucaugaacagaggucacugaguuaauauuuugcauuacauuguucuaguguuagugcuuccuuuugaauaacuuagagccauuuuuuccuuauuuggacuuuagugagcauauuggaauuuuaguggacagauacaaauuacguuuuuucuuuaagugauuucaaaaauagaugguuuauucuuauaauggaauacuucacaguaugcagcagugaaaauaaaugaacuacaacugcauauacuaauauguugaauaaaaaaggcacauguauguauguaucacuugauacuuccauauaaaguuuacaaguuuaaaaaccuaaaaaacaauguauuuaggagagaauaugaaauaaaaguauauguuacagaaugacaacuacugcauucaggaaaauggcugguugucugggauugggguugggaggaaaggaaugaaauuaauacacaaaagacuuuaauuuuauaauauuuuguuucuuaaaacaauauauuaugauacaaaagcauugaaguuaauuaaaggcaaggacucuggaguggacugccuuguucaaauucaggcucuacuguuuccuaccugugaaauuugagcaaguuacauggcaaacaucuuauucuugauuugucucaucccuaaaauuguggcaauauuuuuaccuauuuuauuagguauuucaugaggauuaaaugagccaauacauaaauacauguaaauggugguuuagacuagcuccuggcacauaauaaaugcucauauuggcuuuuguuaucaccaucauuguuauucacaacuuggagauagguagauagauggggaggggucuaaaaucaguuuuuaagguuuaaacaugauguuauucuaauuuuuuuuuuuuuuuuugagacggagucucacucuguugcccaggcuggagugccguggcacaauuucggcucacugcaagcuccgccuccuggguucacgccauucuccugccucagccucaugaguagcugggacuacaggugcccaccaccacacccagcuaauuuuuuguauuuuuaguagagacgggguuucaccguguuagccaggauggucucgaucuccuggccucgugauccgccugccucagccuuccaaagugcugggauuacaggugugagccacagcaccuggccaaaaauuuucuucuuaaccuaaugguuuacuaaaaauuuaguuaacuaaauaaaaauugacaaaaauguaccauucucaauguacuauuuauacacagacuguucagugcauguuuccacauauuuauuguaaaauuuuccaucaagcaguuuuauuuuaaaauuaaaguaucucagcuagagcuuagccucaggaaaacaaaacuaaaauaucaaguuaaacacuugcuuucuaauuguccuuuaguguuguauuauuaauagguuaaaucaauuguacuuaaauguaaauuuaucacauacagaaaauauaaacauuuuggacccgggaaugguggcucaugcuuguaaucccagugacuugugaggcugcaguaggaggauccuuugaggcugggaguucaagaccauccugggcaacacagcaagacuccgucucuaaaaaaaaauuuuuuugagaaugguggccugggccuuauaguccuagcuacuugagaggcugaggugggaagaucaugugugcccaauaguucaaggcugcagugaacuuaugauuaugccauugcacuucagucugagugacagaacgagacccugucucuuacaaaauaauaauuuuuuuaaaaaaguauacaaacguuuuauguuuucagaagugaaaguagauuauguucuuuagaacuuggcuauuucuuaugaauauuuaauucauaaucaaauagcuauuuaauaaacagcuauuuauaacagauaauuagauuucucagaaucauauauucagauuaccuuuuuaaacucuuaguauuuccaugacaauauugauauuuggaaccaucuuguguacauuuuaaguaaauuugaauauaagauguuuuauuauuucuuuaaauauagucaucuagaauauaaagagaaucauuaaugauuggaaauuuguuuuuugguccaaaaauucuaucagaugaaguaacuauaauuucacagcaaaccuacuuuuaacauuuuauuuauacacagacuguucagugccuguuaccacauacauauuuuuaaaagguuuuugauuaaacuugcuauuuugugaccugccuuuuuuuguguuaacauaucgugaccaucuauccaaauuacauuuuuagugguuguuuaauaucucuuuauauagcuacaguaugauuaaaucuacccuguauuugagaucauuuagauuauuucuaaguuugcauuaguaaaauagcacuuucuugcuuaauaacaagugucuaggagucaagaucuaugaauguuuuguuuggacucuuauaaauagcuuccuuuuauuaacugcuuuuugcaaagcacuguacgaguccuuuuuauauuuaauauuccaccaacccauggguauugucuuuaguagcagaaacugagggguugagaaccuugcccuggguuauguaguaugagcugugaauuggaccuaggucugacugcaaaguauguguguguguuucuuucuguaguauguucuuuguuuuauuuuauuaaaaauuaugauagaauauuuaugacuauuuggcuuugaggucucuugcuaccaaacuugaucuggauauagaagcaaacaaagcaaaguagcuuaaugcuguuuuguguuuagaccaaccagauaaacuuucacaguuuauccccaacaguggccuguuaacucacagcuguuuggccacuuagugaggcagguaggcagguaacuguagaacugaauauaauuuacuuacugaauaaauccucauaucuaguggagaguaagauugguagcauuguugaauagaagagauacucauuuauaauauuagguacuucuauuucacgacugacuucauaagcaaauggcauuacucucucuuccucuccuuucuaccaaaucucaucuuccccauuugaucaauuuucauucauguacauaagugauaugucuagugcuaaaucaaagauaagaauauuuuguuauuuggggaacuagaaagcagagaaugcaggcacauguauaaggaauguauuuuugucaacaguauaaauuauuuucauuaaaauguuucuguagguaagugaacacaggcuaaacauucuggaaaaaaaaauuaagcugaauguaauauuacaguaguaccaaauagcgaaaauuuaaacucuguuacuagaaagcaacuuuaauuccaugaaaccauccauaguuuuugguuuuucugcauuauuuguuuuggggugcuuugauuuuuaaggaggaccaacauuaggauuuguauauuauguuuaguuuucagaaaguuauuucugcuuuucuuuucacaggauaauuuacaguauuaagcaugccauuuaaaaaauucugaauugcaauuagagcacugaagucucuugcuuuugagagaggcucuuuuuauugacaaauaguaaggaguggcaauaaguuacacuuuuugaaauuaaaaaaauuuuauauuuauuguaggauaauuagaaaucuauauguaaacaaaaucacuucuagucccacuuuccagagucauuguagucccauguuuauuguugagacauuucuuucuuguguguguauauuuuuagaguucucugauuugagauucuuguguuuuuauauuauaguguuuuuaauuuguguuguaucuuacagucaguauguacauuuaauacggcauuucuuucucccuuuuucucccacauaagaacuauauuuaauguugaugccuucuuagaagaaaguacuugacucccaaaucguugccuuuuagagucagcauggcacaucuaacuuucguagauuuagugaucugugcuuuucaguaaaaaucauauauguuaaguaaaagguuuccauguuucaacauuuggaugaaauaaagauauauuugauaaaauguuuuauuguuugcagcauucaacagaaggugucaaauugacagcucucaaugacagcagccucgacuugucuauggacagugauaacagcaugucugugccuucaccuacuagugcuacgaagaccaguccauugaacaguucuggcagcucucagggguaaggaaaaagagggaaauagaaguggaggggcuguuugcuaaaucaaucagauacauucucuuuuugcuauuaaagucaucuauuuagaauguuauuuucauuccaucuacuaauuuuuuuuuaaauagcaauuuaauucccagguuuggggauaguacuuuuugguuuugucuugucauacuuaacauuuuauuuuugagacugauaaugucuucagucagaugugaaugaauguuagcacauaaccccuccaaauucauguauuuagauagcuacugcuacagugcacuguauggugugcugaugagaacagacaaaaggaacaaaaccaccuuucugucccagagcugcuuauaccuuuguaacagggaaugugucuaugauaguuagggaaaccuguuuuagaagagcuagauaucugucuaacauuuacagcaguuaaaauuuuaaaaauuuauuauuauuuugagaaauggggucuggcuguguuguuuaggcuggccuugaguuccuggauuuaagcgauccuccuacuucaaccuucugaguagcugagacuacaggcgcaugccacugcccuggguaugaagcagugaaaaauuuucagccaggugcagugacucacaccuguaaucccaacacuuggggaggcugaggugguaggaucacuugaggccaggaguucaagaccagccugggcaacguagugagacucccaucucuagaaaaaaguaaaagaauuagguguggugguaugcaccuguagucguggccacucaggaggcugaggugggaggauugcuugaaccugcaagguugagacuacagugagcugugaucccacugcuguaccccagccugggcaaccagagugagacccugucuuaaaaaaaaaaaaaaaaaaaaauuuugagucucgcucugucacccaggcuggaguacaauggcgcgaucucggcucacugcgacuuccgccucccagguucaagcgacucuccugccucagccuccggaguagcuuggauuaccgucaccugccaucaugcccagcugauuacuguauuuuuguggagacgggguuucaccauguuggccaggcuggucuugaauuccugaccucaggugaucugcccacccuggccuccccaaagugccaggauuccaggcaugagccaccacgcccggccuguauuacaauuuaaccaauggcagaagugcggguuggggaggauucccuggaugagugugaaauagaaaaugcugagguguuguggauguguuuuuuucuuucuuuuggacuucauguguauauguuuuuaggcaaaucaugcauaauccaaagacuucaggccugaauauguccuguaaguguuaucauuuuaaaaguuuuuuuuuaagugaagaaacuaacauuuuaauaagaauuuugggaucugugaaagucuguguccuuugagugugugcacaaauauaaaauguguacaacuguacuaaauaauuucacaaauuuaguuuugaaguuuaguuucuugaaguaauacuaaguaacuucuguaaauaaaacuucuggguuuuuagaauacgauuguauauuugcucaacaagcagugaguguuuauuauguacuaggcaccuugcuagccauuucaggcuuucuucagcaucugugguuguucucuggccaacuauccuuuucuuuuuagucauuuaauauuugugcccuugagggcucucucauuauucuuuugucuguuuauccccucuugauauugucccugagugguaacaccugcucuguugacuacauuuacauucauauaccaaugauauccauagcuuuaauaaguugacugcuccgugguucccuguggaugucauguaaguaccaaaaauaacaagucuucgaaguguugccuaccuccucauggugucaucauucaccaguuucagagugugggugauagcucugagagagagagagagaaagagagacagacacacacacacacagacacagauagagacagagagagaaaccagaggacuuuucugcuuuuguuuuucuuuuaggagguaauaaaaccgugaauuuauuuaaaugcuaauguguaggauuuacuugagacaggaaaauuggaugggagaguaaaggagugugaugauuugaguuucuugagaugacaggaguuagugagauuuagaacauagauugggcuuuuuuauauaauaaggaauaauuucuuuguauaggaaagaauagggguuaauuauagaaauaggugugucucuuuaauauuuauacuuagaauuugggguaauacuuggcuaguggcuuuugguugguuguuaaguaggaaggucauuugagauuggcaugagaaagagaaaaugagagagaaacuucgggggaguaaagaggguuuaaaauaaguuauuuuaaaaguaagauauugaaauaauccccuugucacuuaaaggucuuuaacugggccacuggaugggcuuuuaggguuuuauaaaacucuuauacuuuguauacagaaguuuauuucuguuuucuguuucucagaacauuugcucauucauaacuuuuuuuuuuuuuaauaauauagguuuuuuuuuuuuuuucuuguagagacgagggcucacuguguuguccgggcuaguuucagacuugagcucaagcaauccuuccaccucaccucccagagugcuaggguuacaggcgugagccaccaugccuggccucuuauuaauaacuuuuuaaaggauuuuuguucgaaaaaauccuucaguuaagucucuuagccaaaauuagcuaagaauagaucuuuuagaaccacucuggcgauauaguagccagccgccauaugugacaauuuaaauuuaauuaaaauuaaauaguuucucacuagucauauuuuaagugcagaguagcuauguuuuaauaguggcuaccauguccaguagcacagauauagaacauucugucaucucaggaaguaacauuagacagugcugcuuuagaagguuuguguacuauuuacuguuguuauacuuuauccaauaaagucaguugcuaaauuguauguauaggaaguaaaaccaaagaaucauuuacuuuacaaaauaauuucuauauauguuauagauuauuguaauuuuuuuuuuauuuuucuauuuuuaaauuuugagacaauuuuuaauuuuuuuuuuuuuagcagaaacaguccugcuccagcuguaacagcagcaucugugaccaacauacaggcuacugaaguuucugugccacaaguaaauuccagugaaagcucaggggguaaggagauuggguuugucagguuugagaauucuuacauuauauuugguuuagccuucauuuugaaaaguggguuuguuaaguaguugaaauucaguuuuuuaaaugccaguuuauuuuuugcauguaaaguuauucaugaaaucaaauucagagaaacaaaaacuuacaacuugauacugauuugguuauuuuaauuuguauauacucauauauuugcugcuuagguacaucgagugaaagcauuccucaaacugccacacaaccagccauuucuccaccaccaaagccuacggucuccagaguuguuucuucaacacgucugguaaacccaccaccuagaucuucaggaaaugcagcaacuucaggaaaugcagcaacaaaaauaccuacuccuauaguaggagucaagaggacauccucaccucauaaagaagagagucccaagaaaaccaaaacagaagagguauauauaugaaaaacauauuaguuagccauggcaacaccaacugccuauuuuuaaauccaguggaagaaaaguuuaugaaccaaaauagagaaggaucaaggaacaaagcuuuuagaaaauuuuaggugugucuguagugcuuuagugcuguaguuucucuucaccuuucccauucuucucaguaacuaccucugcuauaaagcuaugcccucucauuuaaacuucuuuaguguguguaguuagcagguauugucuacaacagaauuuaacaugaaauuacauguauucuuaacuuauuauucucuaaugacuaccuuuuauuuguacugauuuuuugaugguccuuuggacaguuuuuugcuucugugauccaaaaggaguuuuggaguuucucuacuguacuugguguuauaggaccaucaaauaccagagguucucagggacuucuuacugaaugauaagugcaugcagccagauuaguuuuugaaccuuaaaugguuagcucucuaacccuuaaagaaacuuucuagcaucauuugcauuuuuguuuuuuaacuccugggcacaggcgauccuucugccucccagguagcuagacccacaggugcaugccaccauuuccagcuuaauuuuuuguuuuuuguuuugagacaggggcuggcucuuuugcccagguuggagugcaguggagcaaucucagcucacugcaaccucugccucccgggcucaagcaauccucccaccucagccucccaaguagcugggacuacaggugcgcaccaccaugccugccuaauuuaaaaaaagauuuuuuuguaaagacagagucuugcuauguuauccaggcuugucuccagcuccugggcucaagcgauccuccugucuuggucucccaaaguguugaggucacaggaaccacuaugcuuugcaagcugguauuaaccuuuuauacuaccugguuuauaauuguuacagucuuaguuuugggaaaaccauuaaaacuguacauugauuucguaugagucuuaaaauagagguagucuuguuacacaauuuuauuucucccucgagucacuuucauguuguuuuccaaucagugaggcauuugcaauugccccagagaugacagucuaaaagcaccaauuucauuguguuuuuuuuuuuugcuaagaauguauuuaguaauuuacuuacuacaacacaauuucuuuagaguggaaaaaaaaccccucuagauuucucauggauucuauuauguuuugauuaagaauggugaaaaauuauuuuauuauuuuauuauuuagcuuauucucugaagacuuuuucuuucuuuuuuuuuuuuuuggaaauagcugcuauuaacuaaaaguaaucugaugaauuuugucacucuuaagaugguaaaugagaaugaaaaacggguauuguauaguacuuuaaaucccccagauuacuuacgaugccuaauacaauguaaaugcuguuuaaauuguuguuaugauguauuuuuuaauuugugucauuuuuauuguuguauuauuuuuuauuuuucuaaguauuuuugauccaugguugguugaauucgcagauauggauuccacagauauggagggcccacuguaaauaaucauaacuuagaagauguguucugaaaacucaucugugucuguguaauuaucucuuagggcagugauuuucaucauugguuguacaacagaauuaguuuuugggguuuuuuuuguuguuguuguuuuucaauaaagauuuuagggcuuucuccaaacugaaucagagaucuucuagaaguuaggccuggagauccuauuaagagcccugcugccacaugauuggguugugcagcagcuaaagaauauacucaauuuuugugucaauuacacauucagacuacugauacugguuugaaguugucacggcauuucagaacucaaauuucuuuugacauuaguaaaguguauuuaagcauaauucuaugcauuuaacauuugguuuucuuuauguuaaaaauggcacccuaagagcucuaaauaaguuuguacuagugcaguauuuugcaauuuuguuugcacuuaccuugguagaauaacacuuguguuucuugucugguuuagaaaagcaauaagaauauagaauuuuuaaacuuaaguauggaaaauuaaaaauacauauaaaagagucauuuuauguaccuguguacccaucacacagcuucuguuauaauuaacucucagccaaucuuuguaaucuuaauucuuucagccuuuuucauuuucucuugccauugaauuacuuaaaagcaaaauccaaacauguuucauuagaaucuuaaaaaucauaucuaagaaugaaagcauuaacaguaaaauuagccuacucacaaaaauuaacaauuuauuaauaucaucaaacaucuagucagugcucaaauggccccugauuguuucauugauuuuuuaaaaaauaggcuguuuguuuaaaucuggaagcagaaaaagaucccuguguugcaauuguuugauaucucuaaguguccuuuaaaauauagauucccuccuccaucccucccccacuuuucccuguaauuuuuuuuuuuuuuuugguguauguuuucucagucuggauuuugcuuacaguauuucuacggaguugauuaauagaacuauagcauuuuaagaagauaagggguauuagguuauuccaugggcuaaucucauuuccuaccagaagaacuugcuguuuaguggcuuuuccaguuacggaucuaguuacaguuagaggcaggauuagaacccaggccuaaaucucauggugcuuuagucaaaagaaauuugcugugguagaaguaauccugauuuugaagcccuucuuaauugggucuuuuauucucugcuaaugaguacuugguauuagaaauuuuagcaaagcagaaagaaauacuggccucacucaguaaugcacuaacguguauauagauaggaaaguuuuagauacucugagguaguuuaguucugcuuaauggucaucauauccuaagguuuuucaaauaaauauaaaugguaauguaaaauaaaaaucgaaaauguuugcucuauuuccuggauuauagcuaaauuaaccucucucucucucucucucucucucucucucuauauauauauauauacacacacacauauauauauguauauauauauauguguauauauguauauauuuaaaacuuucuguauggaaaauuucaaacaugucauaaguauaaugaacugucauguuugcaucaccuagcuucaacaguuaacaacucacagccagccuuguuuuaucuacauacccacaucacuuccuuccccauuguuuugaagcaaaccccaggcauaacaaccaaaaacauuucuuuguauaucuaaaaauaaggacuucuauaaaauauaaguaccguauauuugucacacaaauauuaauaauccauaguuuuacauaucagucaguauucagauuuggccaauugugacacauuacuauuuuuaaaguuugcauauuugcaggguacaaauaaaguccuuauuggaauugaucgauacuguauuaaaucucuucuaagcuauaagccugugguuuuucuaugccuguuuuaaaagucacauuuaaaauuaaauuuuaauucugcugagaaaauagugucaaaauaguuauuaagacccaagcaaggcauuucucaagucuuguauucuguaggauguuaguaggucguaccaagagcaaggauucucugguuaagcuugggaaaauuaaaguggaguucuuucuugauagaauuuauuagaaccuuuuaugugccacucugugugaaucucccagaaugggggugauacuaugccaaguuccuaaaguuguaugaucaggaacucuuuuuuuuuuuucuuuuccuuacaaaauauauuucuaugaacucuuagugguuuuggaaauguacuuuagguggugaucugcaguaacaguuuuccuaaugcucuuuuuaauuuuauuagcuacugaagccaaauuuaaucugauaaaaacauuuuaaaagagggaccaguuaucuauuuuaaggcuguaguugaucuuacagguuuaauuauuuuauaguuuuaaaguuuauaaaguaaagcauugauuggcaaauaaucuaaauuuuucauuuuagagaauaaagcuuuuuuuuuuaaaaacaggaugaaacaagugaagaugcuaacugucuugcuuugaguggacaugauaaaacagaagcaaagguauacuaauuuagccuuuagaauacauacacaauuaagaguacagaagauguaauagaaaugucucuaaaauauuguauuuuugugcuauagguuuuagauuuuuuuaguauuguuuauuacuguuaauuauguaaugcugaacacugaagggaauauugugaugagugaaacacauucugugccuuuaaaggagcuuauaauuaaguagacaagauaagucaugaauguaauuaauuacauuaucaaagaaaaaguaauugagggcugggggccacggggcaagaaaaguaagauguuauuucugacugcagaaauagcaguacaugucuucauugaagaaagaaguagcauuugaagugguccucaaaggauacauaggauuuuugauaguccgggcugagaucaugaucugucucuuuggguugagaauuuguuaugauuauagaagcaguuuuuggcguaagguuuuggcuagaaccugggguacauggggcuugaaugagguguagaugggguggaagaaauuuuuuuuuccccaaaauguaaaagacucauuuuuuuucccuagaaauugaaaucuauugaaggcuuuuaacuuucuuuccuuguggaaaaauuggaaauucucccccuucucccaaauuauccagauuucuaugauggauauuuuaacaaaacucucuuagguuuugugugugcccucauaaugcccuugcuuuauaauuuugauucacuuuguaaaccaagaaaaaaguauguguaucauuauguaaucuacaaaauuauuaauggcuucauagaaugcugucuuaaggcuaugauuauuuuuauccaaccaauuuccuauccauagcaauuauuuccauuuaaaaaagaaaguugugcuuuccugcuguaauauugguuacagcuaaauaccauaucugccauucauucauguuuauuuacuuagcauaaauuaauggaagaagaauuauugaggaaaauaguaugcuuuaucuuaaaguuugguauacaucaccaaguuguccuccaggaaggcugcaugucuuccauuccuacuucuuacaucuuauuuaccuuuuuuaauuucauaggagaaaacaauauuucguuuuuuuuuuuuuugguauaguuucauugaaauugaaguuuuuauauuuuucuuuucuucuuuguccuuuuuuugguuuuuuuugagauggagucuugcucugucgcccaggcuggagugcagugggacaaucucggcucacugcaaccucugccuccuagguucaagcaauucuucugccucagccucccgaguaguggggauuacaggcacccgccaccaugccuggcuaauuuuguauuuuuaguagagaugggguuucaccauguuggccaggcuggucuugaacuccugaugucaugaucuccccaccucggccucccaaagugcuaggauuacaggugugagccaccacgucuggccuauauuuuuauuuucauuuauuuguguagauauuauuuucuuuuguguacugcuuuuaaaaaguuuagagugauggcaugacauacuuuacccuguguuuucugaugaguagaaucagugcacugauuacuagagaggggugaagagaccauaaggagggagaaaucuuuuuuagacauauuuucuacuuuuaauuaaaggugugagguuauuuuauuuaguaguauugaauaaguuuuuuuuuuuuuuuuuccucccacaaagcuaagaacuguccuuggguuuaugcucuguuauugucugggcaacauuucaugaugugccuauguguguuuuuaauuauuguuugcuuaaaaugucccaaguuggagcugguuggaaagucaugagcuaguuugacccaugccuuauaagauuuaaguaggcaaauagaaauuuauuaauaucugaaauggugaaauaaccuacaacaucuacugacuagauguuuuuguaauguagucacaucuuucucuugaucccuccugucuuccaguuugucuucuuuauuagccaccaaacccaguuauguucuuuuauucuuuuuuaagucucuuuucccccuuccccauccucuuugucucacaggaacaacuugauacagagacaaguacaacucaaucagaaacuauucagacagcggcuucucuguuggccucucagguacuaagugcaaaaagcaaggagaauuuuguaaauguccuuaagauuagugugguauauugaauuaaagugagaguucauagaagacuauuaaaauuaaucuuucugaaaguaauuacuugcuagccuauaaacguauuuauuguaguuuuaaggcagggcccuggauuugacggaaccguucucugggacuguuucgauguuaacccauccccuuauauuaauauauuauuugauacugcaaaucauuuaaauucucacuagucauuuacacaggguucauauguagguuuuauuuguaggucaaaagugaaauuaaaacuaggaaugaacuaaaaaacauucuucguggauuucuuuugcaaaggcuaauauauuuuuauuuuaaaaauguauuucugccuuauuuuuccacuacugauuucaguuaguuauuuaauauagcccauagcucuucagaauuauguuuucauuuguccuagcaauucuacuugugacagacccucacauacagaauacaguaggcaucuggaaucuuuuuucauugauuugugaaccuucauuuuguugaauaauuuuuuucuugaauccuuucacaugaaugaacccuaacaucuagcucaaauucugacacaaaguagauauauucuuuaauagaugauaaaacugguuaaugucuacaaaguaacugagauaacaacugcugcuguacugauaugauacuauguacuaugaugauauuuugcugcuccugugcagcuccgaguuauuuuaacgugaucauuuaaacaugugcuuuugcuagauguuaacuuuuauugacucuaaagauauauaaauauuauguuuaguuucugaaauaccuuuuccauaaucuaauaaaacuuuagggggaguaacuaacaucaggaaguaugcuuaauauugauacguggacaaacuuguuuaucagucuuaaacuguccugugauugugauugcauguuuuuugguuugccacauacucucgggacuuauuuucauaguuuugucuuacugaauuuaucccuauaguaauuaguacccauggguauuugccuuuuagauauuuuuaugagugaguagaauuuucuuucuaaugaaaggauucauagagccauagagagaaaaaucacccaguuauguaagaagaaugauuauguugauuuaaaaaaaaauucauuccuaucuuugguaauguuaggggcguacuuauuucuggggaggugauaauauuguggcuauaccuaauaaagaguucuuauuguuuugagauaaaucuggaaauauuuauagaugaaaugauaagaucucuaggauuugcuucagaauaacacaaggugaauugaaagugggaggacaguggcuuugauuugauaauugaugaagcuggguaaugaauacauggggaugcauuauacagugcucucuacuuuguguauguuuggaauuuuccauaauaaaacuuuuaaagauccaucucuguauuuuuuuaguguuaaagaacgcuugugauuuaaucuaauuaauaugaaaauaaucuaccuaaaauuuaggaugauuaaauuauugcuuagcuguauauauuuguuuaauuuacagugucagaaaauaauaaauuuacugcugcuucuguauauaaaaugagcuuugaguauucucccacuugggggugcuccaauacuaguuaauauuacagcuauuaguguuguaauaagugaauacaguuuagcaguaacuuaagcauuauaugauaggugauucuuagaggaacaauuuuaaaaacuauuugaaauuacuuaggaguuuuuaaaauauuauuaaaauauaccuauuugaaaauuccuuuguugaacacauuauuuguugaacaaauaaugugauaggcauauuuacauuccauuuugacaacauuauagaguuuuuaaauuuguaauacuuuucuucuuagaagguuucuuaggaaguaaagcaauggaaaauacaucucauuguuaaauuauggugcuuugaacaauguuguguucuuugcuuucauucucagaaaacauccaguacagaccuuucugauaucccugcucucccugcaaauccuauuccuguuaucaagaauucaauaaaacugagauugaaucgguaaaaacaaccucagggguccauaaacaauaucugccaacucaaccuguugucuucaaaugcuaaaaaaggagaauggaggguacaagacuagacaugacugaaauggauuuggguuuuuuggugaccucccuuacugggcuaaucagcacuugaucggaaguccagguuaguaugugaagccaggaguacuauuauuauuguguuagcaacaguugcauuaacuauuucaaaaauuacugccuuuaaaaaaaacaaccucaagcuauauuuguauucauaauugacaucuggauuggguuuauguuugaugcauuguuuggaaaauuugcaauacaaacuggcauaagaauuacuuauucugaugaugcacuuuuauguauuuuucauuagaaaguagaacuaauuuuagauuuucagcuugauggauuuucaguuuuuccugaagaauuuucuuuaccauuagucuucaaauuggauacuguugugcagugguguacuguuauacuucagagaaaggguaagaguacaucuaguucaguuccuaugagguagcuguaacccuuaaaaaugaaacgucaacucuaggguacauuugacauugaaagaauaguuaggaaauaacuugguuuugauagggucaugauuaagaaaugauauauugguuuuauuuauggaauuguuuuauagugcauacaaaucagcgaucagccagcaaauauuuuucuuugagcuugugaaagcucuguguucuuuugccuucaaucuguugucuucaaaacaaacaaacaaaaaaagcuucuugcgccuuucccuccccuguuuucuuccuuuuucuuuuugcuuguaugcacaagguaggacuuacuucguaagaaacaaaaugccaguauuuucuuaagccaugaugugaaaccaaugacccugugaccacauggcacagaacacuaaauuuuggucccauggcugaaacuugagggugacuaaaaguaaugccugugaaacaugauaucuaucugggauggccauuugaucucuaaaaggaauuuuguacacuccacagaacuccuaucuauaguaaaauugauuuucaguuuuaaaugugggcaaaaaggcauuuucuccaagauuuuaaaacuaauucuuauuuuuaaaugguuuaccaaaauuugucaguacauuuuacguguagaagcauuuuaaaaaucauuucuagcaagcacuugacaucuagucagcucucuacuccuuuauuuuguuuuaucaaaagauuaagagcuccuuucuuugaauaaaauaauuucucauaauuaagcaguagaagaucuaucuucacaaaguaugagggaugccagauguugauaaacuuacucuuucugaaucuggacaaagucgacuuaacagauuuuucugaugagcauguuuuaugaauccuccauugugcuccauucuaucacaugugcauuuuucauguuaaacugcaauuacuuaaucucuuccccuauccuucuaaauuaauuuucugaaguuggaguguagucuuuucccccuuaggcuaugcauuaaucgaagcuuucuuuucaccaugacuuuauaaugucuaguaaacaauauuucuacuucccacaucuuugcuuuacacagucaccuugcccuuccuuccaccaccgaagaaaaaagauggucauacuaacaggugaaauguacaaggugucuguguguuuuguguagcuucagaguuagauugaaauuaccaggcacagauuuagucuugucauuuuguuuacacauuggggaaaacaauucaguuuauuaaacguuucauguaacugcacccaaguuuugccaagcuggaaacuuggaccuuuucuguguagugacuuuuuaauuauaguuuucauaaccuggagaucagacuguugcuuucgcaugauguauguagugucucaugacuggaguuugcuuuguuuuauaguaucuguacuccuuguauuuuucaagagcuauuuuguaaacagaugauguauuucuccauugaaaacacaauaaaaaaaaaacagcacaaucucac

SEQ ID NO: 17147 - RNA, 611 nt, Homo sapiens
agaaaagaaacauuuuaauuauuuaauagggcaugaaaaggaauuccaaaguauuucuacagaagcagucccaauggguauaauuuugguccccaaauuuuauucuuauucuuugaagaugauggccugaacuucuuauuucacuggauuaaaggaauugaaauucucaaggagaaguguuaggaggaugggcuaauuuagagaccagcaggggaggcuguaucccagcaaagggaggcauuuagggggagaugaggugucccaaagaagagauggaagaacugagaugcggaaaaaacacgucuugggacaacccuuggguccuuauaaauaaucaugauaauuugcaucucaguaguguuuuauaauuuauagucuacuuccuacauuucuucucaucuguuacucauuagagcccucuccagaaguuguuauuauuccuguuucacagacaaggaaaccgaggcucagaaaaaagauagguuaucuauguaguaagcccaaauucugcccuacucugcuccaggauguaggagacaucugugucacacuuggaguucuggccaugaguaccaucccuuccauagaggcaggcacccagaaaacugggg

SEQ ID NO: 17148 - RNA, 33714 nt, Homo sapiens
aagggauaguuucagaacugcuuuuauuuggauaacugacugaaggagucucauuuguaaccaagauggaauucacaguauguuguuacauucacacuuaaaaaauauaucucuauguacaggaauuugcaaagagauguaaacauacauuaauuuccaaguacauuucuccccuucucccuggaggaaaaaaaaaaagccauccaaugaggcaaccccuucaaaauaauuuuaauacaaaggaugcaaacaucuauaaaugaaaaaugugguucuucugccccuucugggugucaugggagagaaugucaccgaaugaaaaugacaacagcuuggcuucagauggaauuggacuauuuaaaauugaguuuccaggaaaaauaggcacugauuucuagaaggaaauuaacuccuuaccgaagcuauuuauugagccaauauggcugguuaacguccucacuaguauaaaguaacccagugcaggacucucagacauuagcugaaccaaguguacacagucagacugcaagggcacugaugaggcuacucugaaagcugguuguccccguccucuaggugugaggaccacucugauuuuaucccaggggcccgguccauucuucccauacugcaacugucgugcauuauacaagguacccugcugcuuacccacuucaacuacucugcaagucgauuagaaaaucuuguuaaaaaaacaaagagggaaaaaaggcucacguuaucucauccaggcugcccgccccagccccccaacuggaggcaugccgggugggggaaugggcgggggcacaggaggcuguccuccaggggggacggcaggagguggguagcuggcuggcggcaggcccaacccuggaggaggaugaggggggacugcguggguaggcgggaggcgugggggugggggugggaaguugggguuguaggugggugggggugggggguagccaggaguagggggugggauggcagguggggggaaggaggcugggggaggaggcacagguggcgggggcggguugggcggguagacaugggggugguagggcaggugugcaggugggccguaggcggggggcagggcaccguaggagggucccucggucuucaucauggacugcaggcucugguagcccucuccagacauguaggagcuggugguggacaucccggucauguagcuggaggggggugggggcgggggccgguguggcagcggcgguggcuggugcacaggggccgggugggccggagggggaaucuggacuuuggggaggucaguggcauccacagggcccggcggcucagccucaccuaaggcagcagcgaggggaggcuuccggucugcaggagagagacgcaucagugcccggccuccgccagcaaugguugcuuuuucagugccuccuggcccuucagggccaucuuuacagaggagcagggagcagcugcccgccuccucuguggcccaacgcaugggcccaugccccauguccugaugccaccagaugucuccccaccaucugucaagaaggcccuccacccugucugcgacgaccugggguuuucccucccucagcccugaccacaccaccuacaggcagucucggcagcacccgaagcccccuugugcccuggccccagcccccucuuccuagugcaaaacgugugggggcuccucuguuuuucugccuucagaaacugaccccaggggucagggccacacugaacuccugucugcagcaguggcauuuugcagaaaaccucagaguuagucaaaugaaugugauggcacuuaaaacaauucuguacaagucucugacauucccgguguacccaucgaagcagcaauucagguucuauucuacucaagagaggcuacaucaaaccccacugugugcucucagauagcagccuccuugagaggagugugugcaugugugugcgugugcgugcugcgugcgugcugcaugucugugcgugcugcgugugugugcgugcugcgugugcagcagggacaggcagcacuagguguugagcacgcccaagauacucgugcucagaaccagccucaggccccucccacagcgccucccaacccaugagcccucacgcccccuucugccaaagccuuauuuaacauguuuuggccugugaucccgggucaccgucagaccacuggaaaaugacaucgcaacaccccaccacagguagccaaacacacagaaugaguguccuuucccaaggcagcccaggagacagaccacaggagcaacauuucugguuccagagaacauagagaggacaaagccacgaagaugcuucugguuccccaggcacuuggguuaggcaaggcacagcacgacauccugguuggguagacguggccauuggcacacaacccguuugaucuugccaaagcgagcaugagcaggauuucaucaggucgguaacaggugugccacuggugugccacaucagcaccccgccagccuaccggguaggaaggucauaugugccuggccuuagauaacuggcuuuggcuccaggucagggccagaugcccugugguucuaggagcugacuaaaaaagaggugcagaaaagugcugacacccuucaaugccuccugugugucacuccacagccaccugggcccacaggccugcuccuccaccuugcagaaaucaacuuuuccaacacucgacccuguagccugaaucuucaagucaccagugugccugcccuugugcugugugacugagcuggaacagcaagugggggucucuccugggcaccccauucccucucuguacacuugcuccugaccaagucccacacacugccaccaaacugcucccuaaacaucacugcugaccugaaugccucuucccauggccuagggccucccaggaagcguacuucccucccuuccucacggcccagcuuuacugcgccucccaggcccugcucucuucagccauggccuccuggcaguguaucuggcacccaggucccacucaagucccaggccuacuccuggcuaucuguaaugggggagggagcagagcucugaggccuccacagcagcuacucagugcccuggagguagcagcaccccuguggcugccccaggcuccccagauaaaccacccaucuccucagugaaggcacagccccaggcucggaccaggggaacugcacuuggcgaggaggugcuccauaaaugcuucaugagcaaccacaggcauuuaaguaagguucauauugaauuggggguuuugggauuuggccccaaaguggaaaaugacgccucuguucucccaaagcacaaacacuaucaugauugaguaggaacagaaauguaaucuguggcacaucuguuacgggcacacagugcugucagccccagugugagccacgugcaccgaccaacagugaguguagcaggcuggaggagcugcugacagaggcuuggaagccuccggaguaucgaccaccuuuuggagagcaagcacaggucacucuggccuucucuagcgcaucaccuucugaaauggugccacagguaaagaaugccaucuacuuuacagcuuuucuccucuauugccagcgguaucagagaggcuuuccagcuuaccauguacuacuuguugagaacuuuucacucuuucauuuacucucuguacaauugcuuauucuucagaaugcacuaagacgacacacugccaauaggaagcagguguaggggcggccggagccuaguagccacaguaacccugccucuaucucagaaggcgggguuuggcuuucuuuccuaaaacugauucuaauacaauguguaguuuagcauuucuggaugugagaggucggaaaauauucagauauacuuaacaauuuacaacauucucaaaauaccuggucaaaaucagaacuuugagacacggucucccucucacccaggcuggaguacgguggugcaaucauagcucacugcagccuugacugcccagggcucaaaugaucuucccaucucagacuccuaaguaguugggacuacaggugugugcuaccacaccuggcuaauuuuuuagacagggucucacuuuguugcccaggcugaccucgaacuccuggggucaggugauucuccugccuccgccucccaaagugcugggaucaaaaacacaagccauugugcccagcccaagaacaauuuugcaaagauuccugccuguggcugacauugucaaucugggccccagucucccuuuucuaaguucccaggaccugcugcguccaacauucagaggcgaugugcacagcuggccaagcugcuucagcagaugcuuaccuggaggugggugggcuggaggcaacgguggaugaguggucucaauuuuggggauuuuaggugguggugguucuacaaagaaaaagcagauuagaaaaccacucauacuucuucacaugaauaagcaugucauaaagaaaaauguacuggcagagauuucuuugggagaaaaacaacagagaugaccaaggcuuuaagggaacuugaagaagguuucagcuaaaccauuaugcaugaauccuguuaacaaauuaaaugccaccucccuccaaaagaccugcgagcuucccacaggcagcccauuuuccaugucuaccuaaguuuccuugcugaccacuucacucaaguccuuccgaccaugugagaccagcagagcaacgucuucaugagcauguaugaccuaucuggaguccucccugguacagaggacacaaagaaggguccagaguagcaacaucaugucacugaguccccugaggguuccacaagagaaucucuaucuuuucauucuuagacauaguuuauucucucuuucccaaauacugacuuccaguuggcagcaugucagaagcagcacauuaacuggagucagcagagcucuggagguugacacacugauggcaggaagaaugugccgcucacaaaagcccagcagucaggaccccuugagguggaggaaacagcccacccuuccggggucaggcagcggcacgcagccagaauccacaaugacagcacuaggucuccaaggcagcccaagggaaguccaaucucauccguuuaagaaggcagcgugcacaucacaacugaaaaagaacccuauuuuucuguuugcaugcugaggcuuuuucuuccugaaauguacuuucuucuggcuuguacaccacucagaucugagucuccucugccaucacuggccucuuucucuggauuuccuccaucucaaauacaggcucaauuuaaguuccagggacuuccucucucuucacccucuuccucagaguccaaagccccucucuaaguggacaacuacaaaccuacauuucuagcguccaucuugccaccaaaaccauggcccaucccuagacccaccaaucagcaccucacacucuaccuuuugccucuguauccuauaacugcuauuacucucaccucagggacccaccuccugccuuuuuccacagcugguaauaguuagcuaaagccgucuacaucagggcuguccaacagcaauauaacugagagccacauaucuacaauuuuaaacuuuccaggagccauuuuauuuuuugagacagggucucgcucugucacccaggcuggaguguaguaauguaaucauggcucacugcagcuucaaccaaccaggcucaagugaucuugcugccugagucucccaaguagcugggaccauagguguggcgccaccacgccgagcugauuuuuaaguuuuguguagugauggggucacccuauguggcccagucuggccuggaacuccugggcucaaagcaugccuuggccucccaaagugcugggauuacaagugugccaggaaccacuuuaacaagaaaaaggagcacuccagccugcauuaacagagcaagacucuggaaauaaaaggaaaaaggauaaaauuuauuuaacccgauagaucgaaaauuuuauuucaacauguaaccaauauaaagcuuuacuaaugagaugucuuacguucuccuuucuuggaaaucucuguguauuuugcauugucagugcuucagaauuugacccagucacauuucgagugcuugcagcccucugcagccaguagccuucggcauggcacagugcagcugaguuccucuauaaagcuuccuccggaucugcccuuccugccccgcagccagcaugcugaggccaccauguuucccaugagugccagcaagauucuccccauuccuaaccacuugcccuauuuacugcugccaggggacuccuucucaaaugaauuuagacucugccauuccccugcuaaaucuccaauggcuucccuugccucugccaaacucacaguccuccagguaaacucugugaucugguccuaacccacauuuuagauccuaucagaagcuauugccuuucaauucaucacauuccagaaagacuccucuccauuuccccugauucucaauuccuuugcucacuugcguacuuccaacuuauugcuccauccucccccucugcucucgcugcucaaaugcaacucuuccuucaaggucauauauaguuuguuuccugccucugacagaccugcacgucaacucaauugcauuucauguggcauggaguguagcccguucuugugucuaacauuuaaugucggucaauuugaagcuaauuaaaaaauucaccuguaggcugggcacgguggcucaugccuguaaucgcagcacuuugggaggcuggggcgagcagaucaccugaggucgggaguuugacaccugccugaccaacauggagaaacccugucucuacuaaaaauacaaaauuagccaggccugguggugcaugccuguaaucccagcuacucgggaggcugaggcaggagaauugcuugaacccaggaggcggagguuguggugaguuaagauugcaccgcugcacuccagccugggcaacaagagugaaacucugucucaaaaaaaaaaaaaaaauucaccuguacugaacucaucauucccucaaauauacuggaaaaaaaaaaaaaguagcucuaucauaacuggaagauuucacagcaguuuaaugaauggaacuaagaaccgagaacaugguucuaagaaccaggaacuacuggaacuaagaaccaaguaacaaagaaagacaaaugagucaauagggucugugccuucaaagaguucaguaugauagguggacugacccugugacaaaacauuucuaacuuucuguuuuguaauuguuccaauuuugcucacuccuucuguuuauuuccaauauugacaugaacuaacuuuggguucuagacaugugacagcaccucaacccaaguguguuucaaagaggccuugccugcaagggcagcugggcugggccgggcuggugcuguccgggcagcacaccacccccuacugcccccccgcaucugcuguggcuuggugcuugggagaggacuccugcugcugugauggggguaaauagucucuaaaaauaaaauugcagcaacaguucuccuacagccauaauuauacuuuuauauauguuacugaguacauuuuuauugccaguaauguuuucuguacugauagcuucguaagagcacaauuuuagaaucuaugaucaggugaugaacagaaagacaaugcugauggaaaaguuuuguaugagcucuaaaguuaagauuuaaggccaauuuagaucugaaaagaaacaauguuggcuaagaauuuaaaguuuugcauauaaacacauaaaacuaaaaaaacaucagaacaggaaauuaccugcugcuuuguucucuucuuugggagaaacaaccuguuacaaaagaaaauacacaauuguuaacugggauccugaguaugaugagaaaaaaauggauuauccagguaccaccagaaucagcgacggcagucacugugaacagccucggacaaaaauuauuucuagccugaacuuucagggcaaaccacggcaccuaccagaucaucauuucugcucccuuccucuuuccauuuaccaaauaagacagaaugacuagcuuuccugaauggugaguucugaguaaacacuaaguuucaggaccacuugggugcaggaaacgguccacuguuuggggucaggcagcugcacagaagcagcaugcacaacgacacugcuaggacacggcaacgacaccgacaggcuucagaacccuggcagggaugaaacaggcagcagggcuggagccgggcagagagcccccuccugguucucagaggcagccuguccuuggagcaccuuuguuuucaggcuccccaccgacaagcagucggacugcgaguuucggcgaacacccccugcuuccgguguucccugugcucgcuuagaaaugggaacagugcucagguguugccgccaccuggaaagccugcucuacccagggccugcuuuagcccacucaccacggcucgcuuaaccugucggggagaacugggcugcggagaggguuucuugggcuguugggcuggcugcugcugcugggcugguugcuggggguccuucugcuggggcugggaugguucggagcuuugagacggcugugacugcuguacuugcggcacuugugguguaggcugaagagaugggggcuguugcagcugauggggggugugaugaggcaucuguuguuuuccuugugaguaaagauccaggauuugguggcagaugucuaaaugauagccaacaauuacauuuuacacaaauugguauuuuaaauaaaauuuuaccuggauaaagaaucaguuaugauaccccuacgaggaccuaagcaugaaucacauuuacaacucaccccaucuucguugugugcaacacugguguguauuuuuaguuuaccaaaaguauguguuuggacaaaguggaaacuauuagauaauuuaauuaaugaugcuucugaaauauugcucacauaugucuaucugggaaaauccauucuugggacucaggguacacauggaagaaucaucucaacauggaacacccucacgagaacgcuuagcaugccugguaccuuccaaaacgucgaccgggacaucuugaacaaacugcucccaccaucuccuauacauggguuuggagguccauucuuguauuucaaauuugcacaaacguccugcgagauacaucacugcuacugcuaugaucucugguucccacugcagugacaagguggugcagagacuaguucaacaagaaaaaaaaagguuagauaauaugaucuaauauuuaugauuaaaccagugcauggagaugccauaacuaaccauuaauuugcuuauucuccccuaaauuuaauuaaaguacuauaaauaaauaaacucaagucuuuacucuucuaaagguacccgacuaaguuacuuuaaccauaguuaguaauuucucuauuccuuaaagaaucagaagaauucuagcacauccaaaaauugcuacaccaaugaaaaugacuuauguuauuuaaacuguugaaauccuagccacucaacuguuucuucaaaugaaaucuuauggaggaagucaaauguaagagaagcuucacugacugcagugggauggggcuggcagcaacuccauucacaggcauucuguuucccaccacggccccucauuagaucccuggccucucaaaagaguguuaaggcucuaaaacuauaccaggaaguauauuuuugcaaaaccaaaugggcucuaaguaauuaguuuucaaaauucuccaguguauuguuuuggacuuauguuucagacuggugauaaaauuucagcaccucacaacaccaugacacggcagggcagaaggaaacccucugccgggaagcagaugaccuggacgucagccccagcuuugccauuaacuggcuccucaagccagggcaagucaguuucuucugacacaaaaugagggguuuagaugaaaugguccauaaagucucugccuauuuuaaaauacuguaauuaaucaacauuugaacauguauaccugucauuuacaaauguccaugccauuugaaccaacuuuugaauuuuguuuuuaucaccuagaaauggggacaaaaagguaaauuaauagcaauagaaaaauucacaggcagcaucaaguauuuauuaaaaaccuaccacguguucagcaccacucaaauacacagcaaagagcuuuugcgugggaaacaaggaugaaugauguggguccacauccuaccccuucuuccuccucaugaccuacgcugaaccaccauguauggaaaaccuggcuccaaggcuaaguuuauuaguccauuuaaaaaauucugccucauuuuccugccucucccaucacuuggcaacuggaugacagagccuguuuauacauaaaaggaaacagcauuagcagcugcaaugcugaauugacugagcaagccaugcccuugguauuucacacaucaaacuuuguuuuccgcuuuugagaagcguaauuugagugucaucaaauuauaaagacuugauuucagaaugaaaaaauucuucugaaaacuuucuucuuaccuuugaguugcuuugcauauuuuaguaggaacugguauggauguucuaccuguaaaucaaacuugauggucugcaguaagauucucuccagaaccauuacuuccuccuaaaaaucaaucacaaauguuaggacaguaauuacaauugcaggucucaagcagcauuacaaaagugagcuuuccugucuauuuauucucucuucaaguuauauuuuagcaacugccuuuccuuccuuucucucccacucagacuuuuaacaugcucagagacacugauaaauucugaaaagaucucaaacaggaagacaaagcagagguguaauguaaaaaaaaauacugaaaacaaaagauccuuaaaaauauuauuauuuucaauacauacaugagucucccuuuacaaaacagaucuuuacguuauugauaauuugacuaaauuguaauuucuuucaagaccucaaauuuuaaaaaugcaaucuuuuaggaauuuucauugaaaacauuuuaagcaagaaagaguuuaugauagccagccucaugaaaacucagagauaaauuguaccaguguguguguauguguguguauauauacucauguacacauauaguguauuacgugcaaaugggggcaaaucaauuuuguguuuaaaucuuucauuuauuugaaauaaaucaucccaacaacacuuacugaauaaaugaucauuuccaauuuuauuuaaaaugcuaccuaaaucaccuccuaaacuacguguguaugucugccuacacacacacuaucuuuucuguucacugaucugccugucuacuccuggaccaggaucaaagggauuugggugggauacaauagcuccaguauuacuucucuuuuucaaacaguuucuggguucugcaugucccccucacucaaauuuuaguaaccauuuuacuuaguaucauuacagaaaacauacaugcuauuaauauucucauuggaaacucagaggauuuauagaauaauuagggagaauggagauuuuuaaccauauugaaguuuccuuccaaaaauuuauuaauaucuuuucaguccuuuaguuguuuuaaaguccuuuccaccccacuaacgagguuuccacaagguuuaaccuuggauauuuuacuguugcuaucguuaauggaauguccucuuugaugauacucucuaacuaaugucuugaacucagccccuguacagccgacuguaccuacugcuuaaagacaacauaaaccacaaccaagacacugugugcggggaggacaauuugagagaauuccuuguuuggcaucaaagacagggcguuguagaggacuguaaaucucaucaacaggugcagagacccacaggucacuggcuuucauuuagaagcaugguauuauuuuauaggauacagagaugauucuauaauuauuauuccaaauuacauggcaagacuaagguuuuucaaucuuaguuucccaagcauuuucucaugaaaguuuuuuaaaaucuuagaaacuuucacacaguguaaaaaaaacugggcuggacaugguggcucaugccuguaaucccagcacuuugggaggccgaggcgggcagaucacuugaggucaggaguucaagaccagccuggccaacaugcugaaaccccaccucuaccaaaaauauaaaaauuagccaaucaugguggcaggcgccuguaguccccuacuugggaagcugaggcaggagaaucgcucgagccugggcggcagaggcugcagugagcugagacugugccacugcacuccagccugaguaacaagagugagacuccaucucaaaaaacaaaacaaaacaauuuuuuucuuugaaugucauugucaccaccugcuucccagaagcuucaacacuuccucuaaauuuagaaacaauucuuuuuaccaaguguaccaauuggcuugcaggcuguagcccacauacuguuacaggauagcccagggccugcccucccucugucuuccaaauauucaauuaauggggucauuauaggucuuugagcaaacaucauuccucaggaacgccuucccucagccccuauuuauccgggggacuugccugggucccuggguggaaugcuaucacagcaccuuaaaugaccuuuuacagcguacaccacaacucaucaucaaauaguuauauacucauuugauuaaaauuuauccugccacucaacugcagaguccaugagagcagagaccaugucuguucugccucgugccucaugucuagugcccaacacaaaggcugaaacgaauauuacagagaaaagccacacaauuaaaauaaagcuaauuaaggcaaaaaauguuccaugggacucaugaucuuauuuuuccuaaauacuuauacugccuccacuaaagaauugcccuccugucugcagaggaaaacaucuuccccaaugucuucacugcucccagcuccagguguuuuccuuuggccccgacuccgaccagggaagacugcgcgagauagagaggcagggggcagguugcaaagcccccucccccauucagaccuaauugguauggugaccccucuuuucccauuuucuggggcacaggagcuucagaacuucuacuuucacuguuccuggacuggggcuugguuuccugacuucaugguacaguggguaaaggcuaaaaguaaagggggcuucuccaaggcacccugggauggcacaaaccagcagcugccacgaguccaugcccugcuguggucccagaucugugugaugccuuauccuuaagcacagcuugccagccacaagguucaccugccccugugacgggggugugacugaaccacagcauguuccuacaaucagacuuaucacguuaggacacagggccccacuacucaguaaaaaucaaauacccaugcacauugaaaacauuaucugauggugaaauuauuucuauaaaacugcauuuuugguuauaguuaauaugaguuccuaauagguucaaauguuuauaaacagauuaauggauuuauaauuaaguucaaaagaguuacccacauuggcaauacuuagaaaauacuaguguuaaucacaaccacaauauguauaaaaguguucugggcccuuguuaacuccucaaagcaaugaggagaaugacuauacauuuuguauauacauacauaaugcuuggcagagaaaaagauaacuauugugagacaauacaagcuaguuaggaaaaacaacaccaugaauggggcugaacuucaucgcuuuagcuuuaacugugauuuagaaauuuccucagaccauuaguuugacauuuauuccacgaguacuugcugaaugccuacucuguccugccacugaaugaggcauuagacaaaacagauagucuuugcuuucaugcaucuuacagcugagaaggggagggaguuaugugugugauaauuugauaaaaaucaucuaauggauacuacuaucuaaaugcacaccacuaagugaaagagaccaaucugaaaaagcuacauccuauaugauuccaauucgaugacauucuggaaauggugaaacuauagagacaguaaaaauaucagugguugccagagguuagcggggagaaggagacaaacagguggagcacagagaauuuuuaaggcuaugaaaauagacuacaugauacuauaaugguggcuacauguuacuauacguauguccaaacccacagaauguacaacacugagaaugaacccuaauguaaaguuuggacucugggugaugugucaaugcaggcucaucagucauagcaaauguaccacuuuggucggggggaugcugaaaaugggggaagcugugcauguguugggugggggguauaugggaaaucucuguacuuuccacucauuuuugcugugaacauaaaacugcucuaaaaaaaaaaaaagcauuuuuuuuuuuucuugagguggagucuugcuuucucguccuggcuggagugcaguagcgcaaucuuggcucacugcaaccucugccucccaggcuuaagcaauucuccugccucagccucccaaguagaugggacuacaggugcgugccaccaugcccagcaaaaaauaauaaagguuuuuuuuuuuuaaaguaauauuaguuuauuuauuuuuuuuugagauggaguuuugcuccgucgcccaggcuggaggguaguggugccaucucggcucacugcaagcuccgccucccggguucaugccauucuccugccucaaccucccgaguagcugggacuacaggcacccaccaccacgcccgguuaauuuuuuguauuuuuaguagagacgggguuucaccauguuagccaggauggucucgaucuccugaccucgugauccgcccgccucagccucccaaagugcugggauuacaggcgugagccaccacgccuggccaguuuauucuuauauaguagagaugggguuucgcuauguuggcuaggcuggucuugaauuccugggcucaagcaaucugcccggcuuggccuaaaguauuuuugaaaaucuauuuaauugcaaacugugauaaauguuaugaaggauaauuaacagguguuacugagguugcaacaaggggaacuugaugcgaaugggaguggaggaacacugccaugggucccuaaaagugguauuuuaaaaacacaacaaaauauguacaauuauuugagcaccacuugcugacacuggcgugagcuguauggaaaagauaggauggcuggugugaccaguaucaagcucugggugcauaaaaaugcugcaaauguugauaccuuccaacauucuuuagaagcaaaagacacauggcauauguaggcauguguauguguacauacagcauacauacuuuuguuugacccagaagcuagcuggaguuguaacccugccaucaccacugcacuuaagaagcagaguccuaauggcaauuaagaggauuuuugcucauauccaugaaaugugccacugccccaaaguacuuagaauacugcugggcacauaaggaagcacugaguaaguguaggcuacacgaucuucccuccuuucuuacaaaagcaucaaguaacuucuacagaaggcccucuuaggaacucaagagacuggcagacacaagggcuacaggcacugucaacauguggaacuguacaauacuaccauaaggaaucaagaccagaaggcaggaaguuauuaucauucuuaccuuugggucaucuccaaacuggccaaauuguacaucauuuaauaaacuacgagcuguuuugaugauaucuuuacauuuuuuugguguuucuucuacuuucccagccagaaagaggcaacaggcuccugucaccuaaaagggaaacaaaaguucuugauuuuuguuaucaaaggucacacagaaauagauacaauaaauuuuggccuucguaauaaacuggucuuccucauuccccuaccuuucuuuuuaucauucacaaauacuccgauacucuagaagcuugaaggaaauuuuauacauauaaaucccccaaacucuagcuucauaaauuauuuaaaauuuaacuuucuuaaaaaaaaagucauguaaacaaagaaaaugccaaaaaggaaaagagucacauaaauaaauuuucuucucauauuccaaucugaaauuaacucccuaaacagcaagcuuugccguggaaaaagaaagagcacaacuaaacacagucccgcggaauccaucucagcagcacugcccaugcuuccuuuuccuucuagcacaguccuguggaauccaucucagcacugcccaugcuuccuuuucuuucugcuauggucugaauguuuauguccuaauucauagcuugagaccuaauucccaagguggcgguaugaagaagugaggccuuugggaaaugauucugaaugggauuacugcccuuauaaaagaggcccaaggggcuuguuccucccuuccaccauuugaggaugcggcaaggagcccuuuuaugaggaacaaacccuuaccagacacagaaucugccagcaccuugaucuuacaccucccagucucuacaacugugaagaguuaaguuucuguuguguguaaauuauugggucuaaggcauauuguuauagcagccugaauggaugaagaaacugucccuccaguugccucaaccuuagcucagucccuauaucacuggggucugaacugcucugucuucagcuucucuuugcccacuccaauccuuccuacaugccacucuccucacauaauccugaucacacuagaugucagacacucugccggggguacaaaacugauuccaacauggucuccuucuucaagaacuucacaaccagugaggaaggcauguauauaaaucuaacuaaaaucuuagcuaacaaaucaacacaaugacuuuaauguuaagucugucauuuucacgaaaccuuuuaauuacugcauuguucacccacugaagccaaauuucugaagucuggcauucgaggcuuaucguggucugacccagucuaccuauccacccagggucucaucauuuccuuccugccaaaucaagcuccuggcugggcugacaaugugucacaugguucccccugccucugcuuaugcuagcuucuguuggaccacugaccuagcccaucacggcauggcuaugcccuauguacguuuaaggcuuaccuuaaugcuggcaccuucuuccuagcacuuucccugcucucuccaagauguaaguugucuccuccuugaaugccacaacucuuuuaucaguaucuucugauggccucacuuuccaucacguguucugugcaugucauaccacuuauccuggacugaaagcuacucuaucucccacagagaguaagacacaaugcacgucuugaggaguaaccgaagaaugagugauauggcauagacaacuucuguuccauuuugcuuucuuggucuuuguugagucucaauuauaagcccaaauuuaugcugggaaagguaccacgggaguaaacuuucauacaaagcgcaauaugacuaugguccauauuggccuaagugaaaagauuugaacauggcuaauuggaauaaaaaaaguucaaacuugauuuuguuuauaugcaguauauaccauauaaaaauaaauacuuucuggaaaauaugagaaaaauagagcuuauaauuaguccaccaaacuguguggaaauaauaacauaugacagagaauuacaauaaaauucaaacacuuacauaucuugggaauugcuugaaggaaugaaacauauagaagcgaugaaaauaaauuauuccaguugccaggguaucauagugucuguuguucugguuaaggacucuaaccaauaacuuuuacagguuauacucuuaguuaaauguagaaaaacaaaaagacaaacaacaacaacaaaaucaaugguaaaguaaacaauauuaguggcaaaguaaugagaugggaaucucagggugucagaauucugguacaagaauuagcaagcugaaguuuuauacuuuuaacacccuuuagaaacacuucaacuaugaucuuuuuuuuuuugagacagcaucucugucacccaggcuagagugcaguggugugaucuuggcucacugcagcccagguuggucucgaacuccagauuucaagggaugcuccugucuaggccucccaaagugcugggauuacaggcaugagccacugugcccagccucaacugugauccuaaugggugccucauauccuccuggcuggccaccuccucaguggcuaagucuacaccuuuaaaaugacaaaucagaaagagaaaaacccccaccagaaacaacauucaaacagauauuuaagaacugcucugguacagagaaauuacuauauauuuugucuacagaaucuaauuauuucuugguggugaguggggagccuaucuguaacagauuccaaggagagucaggauacagccccaaacgugugcccacaucaaagaugaaccgagcgcccucucggcgguaccgggccucgguggcuggaucaaguccuucaaguugugaggguguaugagccaagucuuucuuaucccaguaccaacauggcuuugugugguccagguuugcugaaguuacugaagggcuugaauuuucuuuauucuccuucauuuauugaaguaggcuuguucuuuccaaaagguucucugaaaauguuagaauccuaugagaaagagaaaaacaaaguuggaaaggaauacuccauacuauaagcaaucuagaaucauagauuguaccugguuugggaucacuauuuccuauagaaaccacacugucaauugccaguuacaagcccgggcuaacuccagagccaauuuaacacaauacuguaagaugaccccaguacuaauauuaauaaaucucaaauuucaugguaguuuaaaaauaagacuauuuccucccucucucuugagauuaaaggguuaaccuuauuugacaaaguuuuggaagaaacgaaguauaucucacuuucuucugguuuuucuucacuagacauacagguccucuaacgcugguccagauuccauucuucagcaaaaccugggccugucuuaaucuugacaaagauuuauguucuaaaacuaaccaucucuuccauccagcaccccuuuucaguuuauuccauguaggcacuuucacuuagacaagucaugggauuggguuaauucacaucugcacaaaucacugaauucacugauguaaaccaaaugugcaucuugugauuuggggaguggguggauggaagugguccaugagagaaggagcuccuuuaaacuguucuugcuuuuucauccucuuccuuuucuuucacucagaauaaagacacucuccaaaagcuccaugcugagagaaagaaagaaagaaaaaaacaacaacaacgaaggaucucaucuagagaccacuguuagaaauaagucauuuguaaccuggaucagagacagcagauacuuucaaauaagguaucaaaaggguucugaaagagcuggcuggagccagguuagucugguuagcaagaaaacagcagcucuguggccagguucugggccagggcucccaccaguucaucuggaaaccuaaccuuuucuguguaucugccucauuucugguggggaaggugacaugguggggcugaauauucuccuccuugcaccugguagcucugaaggaaaucugaucuucccuccaagaggaagaauuaaguaccuggagaaaagcuugaacuaauaauuuacauuuuugugugugacugauuaaauugggcacuguucaaagggcgggggagaccaguuaauuaaaaccucagaaaauaugaccuguucauaaucagacaucacacugagauacaauucucaccuacuggauuggcaaaaaucccaaaguuugacaauuugcucuguuggcaaagcuauagagaagcaggugaucuuauaagcuucuggugggaguacaaaaugguccaacugucacagagaaguugacgauauccaacaaaauuacacaugcauuugcucuuugacccaggauucccacugcugggaaucgacucugaaaauauuguccuaacuaugaaaugucacaacuaugaaacaacaugugcacaagauuauucacuguaguguuauuuauaauggcaaaacuaugaacaacccaaacgcccaucaucaggggacuggcugaguaaaauaugacacaugcacacaauagcauaccccacagcuauuaaaaagaaugagaaacaucguuaaguacuggauggagaaauuuccagaucagcaagguauaggauaguguacacaguauguuagcaucuauguaagaaaggaggggaaaaaacagacaucucuuuuuuuuuuuuuuuuugagacggagucuugcucuguugcccaggcuggagugccaguggcaugaucucggcucacugcaagcuccaccuccuggguuuacgccauucuccugccucagccucccgaguagcugggacuacaggcgcccgccaccacgccuggcuaauuuuuuuguauuuuuaguagagaugggguuucgccguguuagccgggauggucuggagcuccugaccucgugauccgccugccucggccucccaaagugcuggaauuacaggugugagccaccgcgcccagccagacaucucuauuuuuuuaaaguaauucaaaaaauauuuaccaauaaggaauggggaaaaacaggauggaaaagacaggaauggaaacaagacuucucuauguauauaucuuuuuauacagcuuugccuuuuuaugaaagcuuuuauuuuaaacuaauuguacguuuacagaagagcuguaaagauagaugaguuuugucuauacccuucacuuagcuuccccaauguaaacaucuuccauaaccaugguucauuuauccaaaaaaagaaauuaacuuugguauaaccacuauuaacuacacaucauauuugggugcaggugauaucagaacaacuuacugcuguuaaccaugagcucuugguuaagauggagucuaccagguuucucacuguaaauuauuauuuuucccuuccuaucuucuauuccuuagaugcaagucacgagguccagcccacacucaaggguaaaggaauuaagcucuacuuucuggaggcagagauaucaaagaaauuguggacauauguuaaaaccacccacuaguaaguaaauauuuugggggaaauauuuuacaaugcaaaauacuauacaaaugucuauuucuccuucaaguuucaucuacuaauuuuagcauucaccugagacgauuacaacugugguguucuaauggugacuuucuauuuccuucacugcuucaacauuuauuauuuggaaucauuuuguuaauauuuguuucuucucucccauuuguuuauuuacuuuaguacagacaugaguauuuuauucuuuggguuauaauccaauacuaucauuauuuauuuuguugcucaaauuauuccaauguggccauuaggugcucuuucagcuugacucccugcagaguacuuuuauaacuuugauguuugaaucauguaaauauuuaacauacucauacacuuaacuaaaaauaaaaaagcaaauccuaaaacucaaaccaaaugggcaacaaaaucacacagaaacuuacuuccaaguaauuucugauauuguuacaugcuuagugagauauauucuaaggacaaaaauaacugaaaagaauuauuuauuuguuuauuuauuuacuuacuuacuuauuuuagagucagagucuuguucugucacccaggcuauaagugcaguggcaugauccuaguucacugcagcaucgaacuccuggccucaagcgauccucccgccuagccucccaaagugcuaggauuauggguaugagccacaguggcuggccccaacgaaauuuuaaaacuucauuaguguacuguuaguagugucauuaauguuguaauuuucaaacacauuuuuuuuugcauguuguggaauaaagcaaauauguaaaugcuaauguuguuaggaaccaagauuuucagugcaaagaaaacaaaugcacacaugcagaaaaccaaauguuaagaaacaaaucuguaauguuaaacuuuaacugaagauaucaaaauaaaucaugguuaaaaaaaaauauauauauauguaucccauuucuguccuuuucaaguaccaagaaggaaugacacuccuaauucugaaaucuuaacuuuuucaauaccaauacccucuaaaaggaagcagguuucuuuccagucugggguuggagccugccugggauguacucagacuaaucaaagcuuaucaaaagacauaggacugcugaaggaaugauuugcuagggaaaaaaaaaaaaaagacauaggagccaccaugaugggugcccacuggacuaauccaagguaauuugaauagcaaaaagaaaaauaacugugguugaucauaaaauagugaacauacaauccaaguguccauaauauuaauacauauagagaauaauacuuugcuagcacugauaacuacugauaauaaaaugcuacugauaauaaaugcgacuuugcuagcauggauauuaacuacuguaaaaaaaauacaguugauccuuaacaaaaugaucacacuugacaucacuaauagggugaaaaccugacauuacauggcuucugaugugaugcaaugugaaauaaauaucaccuaccuauguaguauucuugucccccaaaagcuuaaccuaaauuuaagcaaacuuuugaccgaacuuccaguuuacaauaaauacuggugguacaagaguaagugaaaaaagcacaacauggaaacuaucagucacauccagaaggugagacacucuacucaacaacugacccggucucuucaaaacaguguuaugaaaaaacauuuugagagacugucuuagauuuaaaaaggcuaaagagggcuacaacaaaaugcaaugugugaaccuugauuagauccugcuuuuuuuuuuuuuuuaaaaaaaagaaauuucaaacaauuuggaaaaauuuaaguauaaauuguauauuagaggguauuagggagggaauuacugucaguuaauuuucuuuggggguaauaaugauauugugauuacacaggagaaugacuuuauucuuagcagaugaaggcugaaguauuuuggguaaagugucaugaugucugcaaccuacuuucaaaugguucagcuaaaacacaaccacacaguaaacauggcaaaaaacgaacauguguccacagguaaauaaguugucauugcacuauucuuucauacaauaaaaaguuggggaaaaagucagaugagacugaauaggagaccaggaggacuccuuaucuucaucaaucccucgauagccaaggaauacuugcuuauguguggguacugcuuucauaaauuacaacacugugauuugaauuauagcauacaaaaagaaaagugaacuaauuauaaguguauggcugauuguuuuucacaaaguaaacacaccuguguuaacacuauucaguugagaaagagaacaguaccaacauuccagaagcucucuucguucuuuccuagugacuauccucccaaagauaacuauucugaccucuauuuccaucaauuuguuuugccuguuuuugaaggacugugcgaugacacaguaccacuuuuacauuugguuucuucugcucaauauuaaguucaugggauucauuccuguuguugcauaaagcaguauuuguucauucucacugccgcagagcagugguuuuuaaaccugggacaauuuugccccccaggggacauuuggcaaugucugaagacacuucugguuuuccuaacugggggguugccacuggcaucuaguguggguagaggccaggaauguugcugaauguccucagugcacagaacaaucccccaugacaagaaauuaucugguccaacaugucaauagugccaaagcugagaaagucugcuguacaguacaguuauauccuaugaaugcaacacacuuuaucuauacauucuacuguuugggcauguaaauguuucugguguuugauuauuaauaaguguuaaacauguacauauauucuuauagaacagaaggcaacuggacaguuggcugagggaaucaauaucuuagcacaucuuagcaauuuauucacaguugggaauugcuacuuuaauauacauacgccuaacaguuuuccauguacuuuuucauuuaaauauuuccugagcauuuacuaugagccaggccuuaauggcauggcagggcacaagauaaguaaggucuuugccccaggaagcuuacauucuagugggagagacaauaagaaagaaauauaugaauauuugucagggaaucuuaagugccacaaauaauaacgcauguaaggggagagaacauaaugagguaagggcuguuuagagguaugcagaaagaggaagaguuaggagauuauaguagcaguucaaguaaugccuaauacaccugucuccacacaauggcagcuggaacaaggggugugugugucauaauuggccaugaggcaaagaauggaaaaagaugauuucaaguuugacugacacagagggugauacuaaaaagacaaauggauaagacaagagaaaaagcugguuuugauaaggagggaggaaaagaauuuggcucuauaaauacuaagcuugaagaacuuuaagauccuuuuguggaaauaucuaucagacagauaaauaggccaguugaagucucuacagaacauaucuacuugggguucaucuacacagaggugauaacuauaaagucauguugacggauggagggauggagagugaagaaggaaggggucuggguacagaacucugugaacuuguaccaaguaggaagaaucaccaaaggcgagcguuugcccagugacaggaagguaaaacagacuugaaugcacuuaugauuuacccacuugcagacuaagaaucaccaaauuagagaaagggaaaaagacugguccaagaaguagggaaauuugcauccuuuguugcaaaacaaaccaugggaugucagcuuuaaaccagagaugguagucaacagugacaaaugcuaaagaaaaguuaaaggacaaggaacuaaggaaaguuuacuuuaauuggugauuaguuguuuauuagagacacugaaaauugugaugguuucaugacucugcaaauacuaaaaacgacugauuuguacaguuuaaauggguaauuuguacgguauaggauuauauuucaagaaaauacauauauacacauauaaauaaaauaacauuuuuagaagugcaauagggcagaagguguagaaacugcaaggggugguaaagaaugaacagacuaggaaauagguuauucuuuuuuauucauuuuuuaauuuuuugagacagagucucccucugucauccaggcuggaaugcaguggugcucacugcaaccucccgccuccaggguucaagugauucuccugccucagccuccugaguagcugggauuacaggcauaagccaccgugccuggcuggaaauagguuauucuuuugaggcaucuguucucaaagagaguaacagggaauaguagggaguagguuuuguuauuguuuugguuuuuauauauuuuucagcauaaaggagaaugaaaaaugucugcagccaguaaaaacaaaaaggaaucacuagaggagucagaacaagggaggcuaacuggucaagggauaauaaaaagcacagcaagaaaguuaaccuuagaaagaaagcucuuucuuccccugagaauggaaggaaaaguuugagaaagauauuuuuaaauaaucuuuuaagggggaggaaguaacuaaaaaaucucaagaguaccuccauauucucuaggaaguauaaugccaagauaucuguugaggggaaaggggcagaacggggaacaguguuaggaauaccccaguagggaugaaacuggaauggaaaagaaccucgguccacaagcggauaaaucguaaguauauucaauuguuuuaccuucuguaacuggccaaacuccuggucccuuuagguuccaaggcagaauauaaacaauucaugaaauguagugaaaauauuauggacauaaacagaauagagacaguccucaaaaucguagaacucccugaaaaaguuuuugccucaggucuauaaaccuguucccuauuacucuucaauuauuuuuucacaagacccuaaaguuguaaguuuucucauuaguagcuugugauuccucugaaaaugacugagauuuaugaacucugcaaaaugaaaauccauaaacaagcaaccugucaaggcauuuuagcagcaccuuucaggaaugugcuucauaaauaucauuuuacaucauaaaagacuaaauauauuuucaacauuuagaauuauggaaacaauaguaaaugucaccacucaauuaucucacccaauaucgaaauccccucuuaguaauauuuggccacuuaucaaugaaaccucauuaguuuacaaaacagccuauggcauugcuggguaucaauaacugguguucacauaauuccuguauuccuauauugauuuuuaucuguccuguucauccccuagaucugcuacacagauggcauaaaauaaugcaugaaugaaaucuaccuuuuagcgacucuuuaacuucuaccaggguccuuaaacuaagccuugaaaauacauuucccuuaucuauugauugucuuucaaacagguaaaagcaauuuuuacauucucuucucuaggguaaacaaaucuaaccauuuuucucaucaugauuuuucuuuuuuuuuaguguuucaaguccucccuaaauauuaggaaucaaaacagauaugaugugcauagcacaugggaggggggugguaacuaacaugcaguaacauguccauugugugucugcugcguugcagcaugucugcaagcuaguuuucuuauccucacaauuuaucacugagaaaauggagccagagacacgaaacaaccugacuaauucacagcuagcaagcagcaucacaacuagucuuacuuuauaccaagauacugccuucccucaaucuagacacugcuuuucuucuguuuaaguggaauguuacauccuagaaccacuuuugucaagccaggaaaacucagguuuuguaaauguaaucacaccaaguaaauuuauuuauuuuuuauuuuuuuugagacaaucucaccuaguaaauuuauaucuggccaguucuggccuauuauuauauuucagccuuuaagaaaucuuugauuucugagugucaucuaauuugcucauuaucacuacaugguuugagugcauuuauuaacuugagaaucacgcugcuuaucuauuuaaaguugguauuaagaaaguguuaauccgaguaagggcaagaccagaguccuguagcauaucuccaaagacaucuccccaggcuuacaucaacucauuaaucaacauuucggguuugguaauuugcauggauauaaauccaucuaaccacaccuuauccaaugcacauuuaacucuugugucuacacacaguauuagaaucuuguuggaagacuauguccuaaauaaacuuaaaugaacuuauguccaacaauccccaaucaccaccagucuaguaaacuguaacaaaaggaaauaugauuugugucaccuggcuuuuucuugagacagggucuugcuuugucgcccaggcuggagcgcagucacccgaucacggcucacugcagccuugaucucucagacucaagugauccuccugccucagucucccaaguagcuacuacaggcaugcaccuccacaucuggcuaauuuuuugauuuuuuuuuuguaguggugaggucucacuauguugcccaggauggucuugaacuccugagcuugugugauccuccagcuuuggccucccacaguacugguauuauaagcgugagccaccaccucuggccucaccuggccuuuucucacugaagcucugcuggcuucagggaaucagcucuccuuucccaaguacucauaaacuuguuggcucuuccaacaagauucuaaaacagauuauuaauagguuccuaguagccaagagccaucgaaugguucuaugugaaaacagacauuuaccagauucuagucuucuaucauuaacuguacuuuuaggauuuuucaaaaucuaagaauaacgauuuuauaaagucaucugcaaauacucugguauacaauuuaccugagcuuaaaaauaugaucacucuguaaucuccucaauuaccuugaauuuaauuccucuagauuuuuuuguccuuauccaauuuuaaagaaaacaagcagaaaacacuguccucccuuucagacacucagcagagucacugcuuucaaauauaauguccugaaaugaacuagcccauuuuauaggccacagcuaugaccaauuuuucuuuaugacauucaauuuuagaaacagcauuuaaaauuuaagaaccucauuaacaacucgaauaguuuuuauugcuuguuagugcaaacuacauuuucaaaauggaacaaauuuaaacaggauuugcccagaaaucaacuaauaugcuugaauaaugcaucacaauauaaucgaaaugagauaaaagagggaaaaaaacccuaaaagacaccagcgguggucacucugaauaagacaaucuuggauaauuauuauauucauagucaagauuauuuaacagguaagcauccuaagggcacuuuaauccaaaugucuaucaauacuacuaccacuaccaucauccauccauucuuucauucagcaauacagagggcuuauuaaacgucaggcaguguucuaggcgcugaaagcuccucgcuuucauucuagcaacaucauucauacaaaccuuuagcgggcaccuacaacugcaaggcauugugcuagguaucuguaaacagcgauuuagaucgagauacacaaacaucaccaaguuucucuuaaaaacacagaagaccacccuuaagaaaugcucuuagaaauaguuccuaaccucagaugacuuagcgaaagcuccguuuaacuggcagucuaaauuuagggagcauuaccgagccuaucuugggcagacaaucguuuaggagcugucacauaaccucuagacuuacgcuccaauuuucuaaagaacaauuucucucauaacaaaccaaaucaaccaccaggagcggguccguaaagacgaugucugggcaagaacgaaaucuaaucccggaagugccuuuuccucaucuuagccgcacccucguuacguggcucuccaaaacuccaaagucggaguacccuagacauggaacaaccuccaaaaaguuucaggccuagccaagguugggacuaauacgccgcgaaauaaucggggagauaugagaagucuguggcugugagacugugcgcgguuaacaccgcugccccuuuugcccaaccccuagaaaguuccccaacucugacugccccccagugcgagggccgcuaccaguucuagggugaguccggccucccugccccgccccggcgccucagacccucucuacacgcccgccccacaaccccgcgucgcccgcaaaguucaauguguaccggagguuagcggagggaggcagaauccggaaagagagacuccgccaguggauagcggcgguuggccauaaccuacuccgaccuccagauacgcgggaggugggcggcgcugcccucagucggugggucacucaccccucgcuucaggcaagccccucagcgacgucucuccuugccgacugcggccaucuuguauauggaaugucggggaccuacgucaucacgcugcguccugagacgccaccaagcgaccggaggggcggagagaguaggaugccugucaaccaaugggaagaaagcagagcucucaaaagaggaacgagccgccgcucuccuccccgcccgccccgcgggucaguggcugcugcuuacagagggaggagccagccacagggcccaucccgucggucccgccccucggggcgaaaaggcauucuggagcaaccgaaccugcuaacggaacuugggcgcguaggcggggcccgggucgagauucguccaaucaaagcucuggcgggggcgaacgcagccaguugcgacaucgugguuggcggcggcugagccggccgcucuugcccccgggagcugccagcccacuggcuggggaggaccccgaacggaacgccggcuggguggcggggcggggccgcgcccaugcguccgaagcgugggccaaugaacggcggcggcugcggcccgggggcgggguccggggcgggaggagaagcguugggccgcggucgcggggccgucucaggcugccgucccgccccucccguccggccgccgccgccgccaccgccgccaccgccuggggguugguugaggcggacggcgggguccgggccggaguacgucguucccgcugcgcuaggggaagcgggcaggugagugcuggcggcggucucugcgcccgcgcggcccgcgggggaaacucgcgccgcgucuccgagcucugcgaggccgucccucgcccuggccagcgccccucggccgaaguccggcccgcgcccccgccaggguccccgccggccgcuguggccccggggcuugaaggggcaggugugcgcucgggggccagggcgaggagggcccggcggggucggagggcgccggucggccucugcccgggcgcccugcggggcgagaggcgcgcgcucgccgcugcccuguccccucuggcgcccacgcucccgggccccgcgccacccggucucgagguggugccaggugcaggcagcgcucuccccgagcuugccccgcuguccccggcccucgcgccugcucucggguggggcccgggccccucgcgcuagucggcucggcucugcgcgcggccgggucgcgcucccauuuccuuccuuccucccgucaccccgcugcucggggaaggcugugcgguuuuauguuccucucugcgaguucucggugcccaccagggugcccggggaccagcccccgccuccucccgcgccguccaguuaggaagacggacguaggaaauaggucgucuuucuucccacgcgccccuggccgugcuccacacgcgcagugcccuacuagggagaggcaauucggugcuuuagaguuugucauuccggcguuaacucuuccuccucguggcuccagcccggcgaugcaacucuugucuuuucccggucuccacuugggaaaaggagcugacagugacgcgcgccccuggcugcggggcucaccccugcccggccgguguugggaggagggcauuucaguguugcaaaggcauucgcggguuaggaccacucggaccguguuauuuugcuuuucuaaauaaauaaggugauguuucaaaagcaaaaauacuuuuaaaguaugcugacaaaucaauuuugcuuuuaagaauccucgaagaguuaccccaucuucguagccugauuguggugcugaugaggccacuauaaaugcguuugucagaacucagaaccggacacugaaaagugugaauuuuaucuuauguaaaauauaccucucccucucccguuuuucuucuugaaaugaccuugccaguauuucaaaacugaacuaaccaguaauaaucucggagaaguguuuauuauuuuaagcgaauacauuuaacccaagaauauagcaaaauaaagcagucuuccucuccacuguuaaaauuugccaagacuugcuugaaccuugcuguauguacuguguuuauacgggcuaccaugcgugaaaguccagcaguacuggauuagucccaagggcugccgugauugauacuuuggugaaauuccaacaguuuaccgaggaguuuuucuucggccuaagaaaguaguuugcaaagccaaguucucaaacagcuacagaaccucuuuauugggaccccagacaaccuuggauuuuagccuucugcuaccccuuuccugucugcccuccaagugauuguaaguuaauaucugaaauggaacuguagucugaaggaguaaaaugguugcuucuccagugugcuaacaucucagugcuuuuuuuuccuggaauuggagugguguuggauuugaagauuagaacaucuuaugucuguauguacgguuauagcgaaagcuucucguaagagcacagugacugucaguaagaaagugauggcugcugcgcugcucuuccgugccguggacauuuaggccacauuuuaaaugauaauuaagcuuuugcuuuagaagccacuggauaaugagaaaaauauggaggugauauuuuuccuauuuaaagcuuaaccacuggacaacuguuuugguuuugagaguucugauaaacggucacaacagccuccuuggaacacaguacucuccugccuggaggagaaugacaggaugacggcgccggggaagguaugaccaucagcgacggaggcuugcuuggagugaauauuuaguagacaaucauugaauucaaugaaaaccaggugcauaguuugugcuguguagaguuguaguaaaaauaugagcaaaaauccuaccuccaagucaggguuacucugaaugcuuugugacuagaugucaguguaguuugaggcguaccaguuuucuucaauguuuuaauuacauagagucuuuuuucuuaucacaaauccgaaguaggguuuagaacuguaacuaguaauacuguaucuuucuuuuguguaguuggaugaauauccuucucugagagguuauuuaucuuuagagacugguuugccuguucccuggcugcugugccuugugcuucuguugaggguggagaggaagaguuucaaguguguuucuuucccuuggaccgaaguccugggaauggaguggugacuuuguucccucaaagagaacucggagucauuuauugcuauggcauuaaauguuuuuaacagaacggugaacuuaucuuuauucuuauguuacuuuggauguugcuuguggccaguuauaauauuugcuuucucaauuaccuacccuuauuuuugggcccuuuuuuuaucagugaaaaaucuuuugauuagccgugcaucuuuucucuccugcuauagucauagaaguguuuaucuggcuaacaguuuguuuugggucauauuuaaccagucgagaguauuagaauaaagagucuugcuuuuucaguuuucuauaguuuucacuucuguugccuuuacaaugguuuucugucauuggauuuccuuuuaucaucucauuuuucuauucauaaauuggagagguuaacuaauuugauaugcaaauagaauuaauuuacauaauauuuacucucaagguaaaaaauuucuaucaaaauauuaau

SEQ ID NO: 17149 - RNA, 1372 nt, Homo sapiens
ccugggcaggucacugcugcaccucacaauaucuuuaaaaugaagcugaguaugguggcuuaugccuguaaucccagcacuuugggaggccaaggugggcagaucacuugaggucaggaguucgagaccagccuggccaacauggcgaaacuccaucucuacaaaaauacaaaaauuaacugggcauguuggggagcuccuguaaucccagcuacucgggaggcugaggcaggagaagcacuugacucugggaggcagagguugcagugagccaagauugagccacugcaccccagccugggcaacagagcaagacuccgucucaaaaauauaauauaauauaauaugauaugauaugauaugauaugauaugauaugauaugauauaauauaauauaauauaauauaauaugauauaauaugauacauaaaauaaauaaaauaaaaccuuaaccaccccccuggguggccaugcagauuaaaugccacauacuaggggcucgguaaguguuugcaguuggauuucucgagggcuuccuuggcccucacuggcugcccagcccugggaaggguccaggugaggcuuggagcccgaaucaaggaagacucagaggcaggcagggacuugcccaguggucgcacagcccagcggugguugagguggggacauggaccacacucgcugaagcgagcucauaucuuaggugggaagcaguagacucugggaggaugaggagggggcccuggggagcuccagaaugcaacagagggugggcuggccaccuuuaggugggcucugcuggacucccaugcuguacaccucaagggcacgggaauggucuggccaagcgucugccucccucaccagccugggggcuccucaggaccagguccuuuggucucccuacccccaucacauagcagaguuccugcauccaugccacauuugucuauugagcacuugcuaugugccaggcucagcacggcagugaggugggcagguggauggaggaagggaagggucaguccugaugcuguccccuggcagguuucuugggaaacuucccaggacagccuggcuuuaagcaaccagcaguuagcaggagugaccacuaacacuucagcccaggcgucucugagagugaccucaugucuggagugagcuuagagacggcggcugaggcuggguuaugguuucacugacggggccuccuggagcaugcuggcgggaggaccaugcucucugcuagccaaggcagagucugcauuuggcaccuccugauuuccacacggggaggugguggaggugccuuauucauaggucucugucaguguggaggcacucaggccuucacaccugcuuuggggggau

SEQ ID NO: 17150 - RNA, 7791 nt, Homo sapiens
aaauggugccguauuugugcuucccggcuaggcugggguuccagauccuuaagcuuccccugguggagucaggcucagcagcgccucuccaugcugccgccgcacagcaggagggcuugcagcuucugcuguggcucucuggaauggugggaccccugauuccuggucccagcucugccauuguggccuugcacacucccuucuccuucuggaccucaguuucuccaucugucacgugacggugaggcugaugucccaggggccugggacccaggccagggugaggguaugcacucagccugugggugggaaagacaggggucccaggcaugccgccggccggcaugaucuguggccucucccgacucuccuuguuaucuccccuuguggcuucucuagguccucaaagagucgcugaggcuguacccaccagcauggggcaccuuucgccugcuggaagaggagaccuugauugauggggucagaguccccggcaacaccccgcucuugguggguggaggcccuggggguccuggggugggcugggcugcuugccccaaugguggugaauuugggacucaccaggggagccuguggcccuguucccaucauugcaacgggccucacuggcugcccuggucuuucucauggagucucaccauagcccugugagggcuuuuuccccuccucacacuguccagcagaagauuacagggggucauucuggaagggaggugccccauuuacagcugaggacacugagguucagagagguuaggucacuuuccuggggucacacagcuggugaaaagcagauauggaaauugcccaguuucacaguugacccaaacuuguccugguuccuucucuccucacguuuuacagcccuuucucucucggcuuucuccccagaccuccuuuauuuugugucucuuuguuugcuuacuuguucauuuauccauucauccaggcauuuacucauguaugauagccccuaaacccacccccaaaccaggaaacuaggauauagucacucccugcuccgcugacaaggaaucacuaaucugaauuguguguuugccauucccgugugugugugugugugugugugugugugugugugccugugugcauucacgcaguaauauauuguaggacuuguuuuuugacucaguauaaaguugguaagauuuguguagguuucuccacaaggccguaggacaaccaccaucgcugaucaguucucaggugacaggcauuugagagguguccaguuugucccuaucucgagcaccacagcaacgaugccauuucuguccgcauguccaggaacagugugcaagccagcuccucggacauuuacccagaagugagagggcuggguuguaggaccccugacuguucagcuuuacaaacgaacgccacauuguuuuccaaaguggcugcaccaacuuggaugcccaguaguggugagagagagcaccugcuguucuucaucaucuccagcacuuagcaugguccgauuuuguaucugcugccauccaaauauguguuuuuaaaaaaguauuucacuguggucuugauuuaugcuuuccugauuacuaacuaguaagcgugagcaucugacccugcuuucucugucucugagaugugggcucaguuucccuuuugggguaguguguuuuuucguauugcuauguagagcguuauuuuauuuuauuauuuuuuacggcauacauuuauuuacuauuauuuucauuauuuuguuuuuaaauagagucuugcucugucccccgggcuggagugcaguggcgccaucucggcucacugcaaccucugccucccggguucaagcgauucucgugccucggccucccgaguagcugggacuacaggugcacacccccacgccuggcuaauuuuuguauuuuuaguagagaugggguuucaccagguuggccaggcuauucucaaacuccugaccucaagugauccaccugccucggccucccaaauugcugggauuacaggcgugagccagcgcgcccagcccuagagcuuucuuuuaaaaacucacguguuaaucuuuugucugguauguuugucaucuuuguggcuugucuucauuaauguguuuuugaugaucugcaugucuuaauauuuuuaacaauuacuucuuuugcuuugucuuguuuaagaaauccuucucuauccugaguucaggacauucacuuacuuuguccucaguuuuacauuuuucuuuucaaaguugagcuuguaacuaccuggaauugauuuuguguguaguuucaagguagggaccuuucuguauugacuugccagggcuguuguaacaaagugccacagacuuuggcuuaaacaacagaaauuuauuuucucccaguccuggaggcuggaagucugagaucaagguguuggagguugguuucuucugagggcucacuccuuggugugcagacagccaccuucucccugugucuccacauggucuuccuucugugugucuguguccuaaucuccucuuauaaggacaccaaucagguuggauuagggcccauccuaaguaccucauuuuaaguuaauuaccucguuaaagaccuugucuccaaacacagccgcauucugagguacuggggauuaggacuccaacauaugaggauuuguggggggcaaaauucagcccaugacaggauccuuuuuauuuuuaccugugaggaaggaggagccccagucccugcucccagccccucuccucccaggguucugcccugccuccuccagcauccauccaagccucaucuguggccacucugccaucuguuuugccaagcuuucuuuuuuaaugcuccuguaccaauaccacugugccuuaacagccaucuccuuagauccccuuacagccagcaggggaagcccuguggcucacucucagccugggggugccacccugugggcuuugagugggcagacugggcuccaaccccaccucugcuccuggcuggcugggucaucuccaucaggccuucggcuuccucuuuguuagguggggggaguggugagcaucaguaggaugacguacaucaugugucuggcaacaauccccggcacaucuuaggugcccuaaacccagcccccacaccggauguucccacacacuugcuggagcucagcuccagggcucccugcacccucugcugcacugacccccagcacagagagccagggguggaacaggcuuaggaggagauuuugucccaguguuuggaggccaaggacacagagugagcgucagccccacucaggaggcaccacacgugcacguggaaggcugguggggucugcaguuccuccacucccaccccugcugaaguaggccuugaguugaagagaaacugaauauaacaguucucgggaucuagaggaaguuggccucacagagucagaucugaguuugaaucccgguuuggccauuuauuugccuggugacuucaggugagucacugagccucucucugggucucaguuuccucaucuguaaaauggggacaaugacggcuccccuacagggcugagcccagcacaggaugacgcaguacgcccagcuggcacagucaacuguccccgcucuuccucuuaagggauuuucuagggggccagugcaauggacaccaaccuagaugaggggugaagacauggggggaggagagugggacccacucugcucugaguagcccuguuggguggccucaguggcucaagaggugccaggggaacaaccugggaaccagagaugagcggacccuuugcccgcaguucagcaccuaugucauggggcggauggacacauacuuugaggacccgcugacuuucaaccccgaucgcuucggcccuggagcacccaaguaagucccuccuggagcugcccaugaguggggcuggcgggagaaggacagacacagcggccucuggucugagccagaggcacccacucagcccacauagccuuccagaucccugugaggugguuguggaggaaaucacagcucagagagguuaaguaacuugcccaaguggcagagcaggggucuggccccagcucagucugguucuaaagcucaugcucauaagcagcaccaaauacugggaagcugggugacuucaccuccccaagccuugagguuccugucugagaaaugggaccauccguggcugcaucugcaaguugcugugggggucaacgcguuaagguaccgaagccauggugggaagagcuggacuccacagccugccugaguguucagauccaggcucugcccagagcuggauguaaauuuaugaccuggagugaguuguuuugccccucugagccucaguuucuccaucugugaaauggggacaacagcaguuccuuccaggaggguaaaaggaggagaaaaagaaugcagauccagcccucggcagagucagcgguucaugcuuugcaugcaaagugcccagccccuggcucaaagucuguguucauccagaccuggguuaacuacugucuuccuuauguuguuccuguggggacgccuggggcugcuggccucgugauuccucucuuucccugcaggccacgguucaccuacuuccccuucucccugggccaccgcuccugcaucgggcagcaguuugcucagguaggaggggcagggcugugguucugcccaggaguagcugcaggggugggggcucauccugagccgggaagcaucuccgaaccccugcucuggggcugcugggcugugggcucgggacccagcggagccagacccagaggacuggcuguguuuugcacggaggagagcgcaaaacaggaggcuccccaggcucucacaggcucuccaggaggagagccggcugugacauuugcugcucauucacucacucauucugucuuugcuccuucauuccuuccucauuuugcccgcugggcccagauggaggugaagguggucauggcaaagcugcugcagaggcuggaguuccggcuggugcccgggcagcgcuucgggcugcaggagcaggccacacucaagccacuggaccccgugcugugcacccugcggccccgcggcuggcagcccgcacccccaccaccccccugcugagggggccuccaggcaggacgagacuccucgggcaagggccgugcccgcccaccucugcugcccacggccacccacccuucuccccugccccguccccugggccacccuucacgcuggcuuccagcgggcccucugccgaccgccugcuucacaccccucagcgcucccugucgccugcggacuccauggcccuuccuggacuggcccuugcccaacucccagccaccaccacugucccuaccacugagcccuugcacaggccacuugcucagacgagacacccuaacucuugcucacucccuaaagcccucuucaggggucaccuccuccaagaagcccuccuugccaccccccgccggcaggggccccuccucugugcucccucggucaccugugcuaccucuaacaccacacugaccacacuguaucgugaguguccguugacgugaccaauugcccugccaggcugucagcgccucaaggguagggucugcgugugauuugucucugagcccccugugcccacccagggcccggcacagagucgaugcucaauaaauguguguugacugcaugaaugaccuggaaccaggccaugcgcucucgccucagcuugcucgucugugaaaagggggagaugcggaggcuggcacagcuuuggaagccaccagcccgcagaugccccgcagaugcccugacaacgcugccuugggagagacugccccagguuaccagccuguucccugugcuguauucacggccaugccccuggguguugugugagguugggccugggugggugacuggcucugagagcuggauuugagaggucagagaggccccugggccucucuugggagcagcuugguggagcugagccccgugccugugggcaccugcugcccuccugaccuggcaggggggcagggcaggugagacugcaucccucgugguggugaugggagaagccgucccuuccucuccagggccguguccucugagcucauccaaggaagagguccugcccugaguuucuccuucggccauugggagcuugucuuugugcagagagaaaaagcgcccucauggcccggugcgguggcucacgccuguaauuccaucacuuugggaggccaaggugggaggaucacccgaggucaggaguucaagaccagccuggccaacauggcgaaacccugucccuacuuaaaaauacaaaaauuagccgggcaugaugguugggugccuguaauuccaguuacuuggagucugaagcaggagaaucgcuugaaccggggaggcagagguugcagugagcccagaucgcaccacugcacuccagccugggcgacagugagacuccgucuaaaaaaaaaaaaagaaaaagcugcccucuccccugccugggccaugugcccccugggaagacccccuccccaaacagggaaggcacagaugugugccggcccgugaugugcauuguuggccuccuucgguccuugccgcagucuugaaugauagcuccaagggauggucccaucaagcagauaaggaaacugagacucaggggcgggagugacaugcucaguacagguggggccugguguggcucugagaauggaggagacaagugucuggguucccagccugccccucuccccagcccaggugggcccugagaaugcacaccccggccucugggcagagggucgggccccgggaugccucgagaacugcagcguucuugcagagcgaggguccuccugcuccccuagcaccucgccugaccacgugggcaccuggccagcccaucaucaagcugcacccuccacccucuccauuuccagcucgcugucugaggggcccccaaacucaccacucacuuugagaaugguaugcccgggcucagccuccagccaccuggucaaacucaucccuggccagaagcagccccuucccacagccaccccaaaugcugcugucucccagcguccuguucccaagcccccagcugggcacuguuccccgaccugcucugcugugccccccacuccgcccucugcagcccuucucugagucucugagguucaccaguacccacacaccugcccacgcuucccacaguccaugcccucugccuccugcuguggcugggccuaguccccacaguacagcaccuccuucacaguccaucuaaaagggccacaggccaccaagccucaguacugcagcaaugcaacccagcauugucuggaggggccuggagggaucggcucccuccagagacuucaaguucccggcuugaccauccccugauuuggcaaauaucugucuguugcugagccugagccuucacaccaugauuucuucaaauccugccaggaaacaggagccaacuaugccccauuucacagauggggaaguccaggccagagccacagcugggccauaguggagucagcacuugaacccauggcccuuugcauccaguggccuuccacaggcucagcaugcccuaucccugcaggccugggcuugucuucugcacgccccaggaaucccagauggcugggaagugcagagccagaaccccccagccccacugucacugccggugggg

SEQ ID NO: 17151 - RNA, 43964 nt, Homo sapiens
auuaaaaagcuuaacauuaugcauuuauuauauuguauagagccauauuacacaugcuuggugcuucaaacugaguuaucaauguuuuucuggaugcaaagccaucugaugcuggaugcggaugccuuaaauacuauauuucugcaucuaugaccuaugagcuaaggaaaaaccaaggacaauuccagaaauggcaaagaacacuuaagaaaaagauguacaugagacgaaaugcuaaguccuugagccagggccuacagaaguuaccagaaagcgaauaaaaacauaauuuuucucaccaccuguugauaauagagccucacauguccggguauggacaauguagaaaaaagagguuguuccguuugguacugaugccuuucuccccuccgugaugugugcggacauugugcggcccccagagagagcagcagacagaacagagcacagcaaacugcccccuccucaacacaucccagugcuguuuuuuuuuuuuacagcaucugggugucucaugaaaagcggucaauuugaucaaacuugccaccuuguggaaaaucaaucagugugcuucagaugaaugugacgccaucacacgcacccuccucugacauccagaaugcuggcgggggacauggggcugggugccugcucggccaggacgaagcucuccaugugucaccucccaccuuacggcacccaguuugugggagguuugcuuugccugcugaccugaugcuaacgcucagcuuaaacgcuccauuccagauuuuacaaggggacugggugauaacgugucaaguacaugcugcccauacuucccaucaagccucaguacagucccagcuuaaagauccucucuggcaccacacugaucccuugggccuggggguggaugccaggaagccucuuggccacaaaucugcccucuugugggucagaggccagcccucucuugccugacgugacuugucugaagggccugcacuuaaaccaucuucaggcaaccagggcaucugagcauaaccugagcaguaacaacauaaaucaagggucaguaauuugggguggaugagaccuagccagccauccagucagaugcugccgugcagguaagcaugauucugaaggcgugggguaccuuuuguccuguaaagucagagagaaggcuaagaagugcauggccagaaccccaagaaagugcagcuuggaguuuuggcuuccuuccccaccgcuuggguuaaaaguucggguggaaugcacuugccaggaccugcugggccugaacucugaagugcugcgcucacauuacugucaguguauccaggacaaagggcccggagccagacaggugcccccuacagccgaggguccaaggcaacccugugacucagagcuggcuucagcaagccagcagagcagcugggaggaagccucauggcauggcuguggcaucaagugggugucugugagcagcuuggcucucaccacuguuuugaccucugggauccuuacucuugcugggggucagaugucaagaaaauagaaggauuauuaaagaauaauuaaauaauuaaagaucaacaacaugaauuucccaagccaggcugauuuccaggucacagaagucagagacccuggaagugaucaacucucuuugccuauagucggggguggggggagguggguagaauugucagguuuccuuuuuuuuuuuuuuuuuuuuuuuuuugggagacggagucuugcucugucacccaggcuggagugcaguggugcgaucucggcucacugcaagcuccgccucccggguucacgccguucuccugccucagccucccgaaauuaucaggcuuccaauuccaaaacuucuuuuuagggggccagguuuuccugugccacaaacucuggucugagaccagucugggacacgucuccacaguaaguuuugcaaggcagagugcaaacggacguggggcaguccuccaauguacgcacucucaaaacacugcucaggcgggcuucccccgacuggaagugacucucaucuacuugugaagacaugaacuugaacucugcuuggaaacacggacagguauugcgcacacuauccugugaaagggucuuauuuagcaaaauaagugacauuuagaacuuuuacaugaaaaccaaauaggaaaaaaaaaaucccgauuuuccucaaauccucaggccuugaaucuaggcaaagcacacaaacaccauaugaaaccaacagcaugaguucagggucaucuuggaaaauaaaugucacucuggggugacaguucuuuauacaaauaguaugcucccccucucaacuccacuaccaaaaagggggaaauaauaagaaauucaaaaauagaaaacaacaucuuguuaaguguaaacuuauccucuggaguuuuuauauuacauaugcuagaaacaugcauuuauuucugcucagauguacgaaaauaugucuaucaguauuacuuauaaaucagauuaauccucaagacaauggacucacuguuagaauaccauuucaaaccuuaguaaauuacaucguuagcaaaauuauaaauucuaaccacaagcagaauggguugaaguuacacccaaugagaacuaccucuacucuuuauauuguugcucauuuguuaguuuucuauuguugcaaagucagugcuauguuaacaaggaacuuguuuucuuggaaccccagauuaaacuccuuacagaaguuaacucugcagacugagaagacgugaacagagagagucaaggggagugaugacuauuucagagacaggaaaggacagaagagaugaccaaaggcacccccaagggaucaaggcacagaggaagagggacuucauccacacaggagccuggcuccugcaggccauggcauggcucucggggcugccagcagggcuccccauagcauaggugugcucugcggugggcccuugggcaggguccugaggacagugccagggccaggcuccagugcagcacaauguugggcaaaggacuccuaacacagccacgcuggggcuacucaacccgacaguggggagggaaggugugggugcucacaaggcaggcauccauagaagacgcugcccagguccaagucaaagaacuacacguucucauccgagcccucggcacugaagaccuccaccaugggcugaccucucuccugacugccagauacagcaaagccuggcuuacccagaaaacagcuggggucuucugcuuaacucaguuccaucaaacuacccaagggguaacagauucuggaugaauuuuuuaaagggucucaaguuaaauguuucauucaugauucacaaaaggcacuucaaaauuccacagagccacagggucacuguuaguaggucaccaauccuccuguacaggaccgauggagaagcucuaagacaaugggcuauguguuucaccugauggggucccuggccauuuguaaauaaaucucggauauuagcuaguuugucauuuaucuugcagucaagcauacacaaaacagaaagacacacaguauguuugcacuuugaauaaaugagauuuugcuguaucauggcaguuuauaaaguauucucaagucuguuauuugaccuaagauccaacauuauaaucguacauuuaagagguuacaaugugagagguacucauugagcagaauuuucuaauaaucuaaucaccuugccgauuugcacccaguguccauuuagaaacaugaaauuaagcuacuggcacucaauugccacauugcuagcauuuaauaaggacuccacuagauggaggaacaagggcucucaaaccaaauaaccaacgaccacaagcauuuccugucagacaagccaagguccugcuggagcugccucugaaggcagccggcugauggacaggccuggucuucccucugugugccccacugccagguggcaccuuacccugcgcaggcgcucagccugcgcggugguacagaugcuucacucacacuugccgggggcuaaaaucacagccuaugaccaaccuggccugggguguucugagguaguuccugaacucgggaugccuguuaccuacucucuuucagaagucaggacauguaggaaguauuaaaauauccaugcaucgcuuucaucaauaaucacuguaauugagugcaaaauaaaggaaacuugaguugcuuuauuuagcuuccaauuucugggaggcucaagaauuauaaguauucuggacaacaaaagaaaauaagacugugcuuacagaucuuguucugccauauucuugcuuuaggauugcuauuuuauuguugcccuuucuguuacaugggauguacacaucagguguuaaaagguacaauacauucuacaacugagcaccacuuucuguaacugaacaggcaaagaaauuacacugaacaucagcaucuggcaguauuuuuuuggaaaaaaaaagugacuaaaauggguuuaaauugauuaacacuauuaaaucacaucuaauauuugauacuacaugauucaauacagcuauacgauacaauuauacaaaauguguuaacaucaaagaauacaaccaaaauuaagauagcaaacaaaaccuauauaacuuuuuuuuuuuuacaggaaaauacuuuugaaguaugcauguaacugcccauucuuuuaaagaaaaucuacugcaagcaaaguuaucaaccuccagaaaaaucacacguagcauuacuaagcauauccccaaaaaaguguacaauaugcacacuuggaaaauacaaaauuaaaaaaauuguaagcaacaggugagcuucauauuuauaagaaugugaaaagaagucccauuuuuagcacuguuguauaaagaauugucuuuugaugcgaaguucaugaauuguccuccuguugggaccacacuuuacaaaaacacuguguuuuugaaacgagauuacagagcaagauagagcaucuuagcaaugucaucuuaguaaaguuuuuuuuuuuuaauuuuuacuacuuuaucaaaacaugucccuuagguguguaggauucauuuuuaaaauucuuccuagaaauaauauacaaaggagaggcauauuuauucccaaucacacuucuggaagaugcuucccguggucgagaagggucuucucucuucuuuucacugguuguuuuuggccuuagcauguguuaagaugugagauuucagguuaguugacugagcaaacuucuuauuacaaccaucgaaggggcacacauagggccugucuccgguauggauucgcacaugugugcgcaaauugaaguccagugaaaagcguuucccacagccuucgaacgugcacugucaaggaaagaccagagaucaacccacucagcaacucugaccagacccugggagucaggagcucacugcuuugcuagagaacagccuauuuauuuuaccaaacacuuuucauuccugcccugggugaacuuuguggauauagucuagaaucagcaggcagguuggacaaccccgaaaacccaaggagagcccucacgaacuguuuaaaacacuuggcaaaauggcaagucuuccuaaaugcaggcuagaguccuagugcugcuguaaacauuuccaacaguaaaauacaaaugauuaaggguucuggugucaguugucaaaaaagaaccacguuagauuuacuagcugcacugcuaguucuuucacuuauuuaugggcuaaaguauuaccuauacuuacacucuagaaacuuuaucaguuaguaauuauacuauuaacuaccaaaaauaaauuacuucaauccuguaaugaaugaaguagaaauugaguuuuagguaugcucuucaauccuguucuccuccugccauaaaguguacuccaucaacaccaauacauugcguacccaguaccacagaguauagacaaggauguccagagccccggcaacccuucuaagcgacuccccaggagaaguuuuguuucucaccaaggaguaauaagacccugagucucugggcuggcgccuccugccucaucaccacaccaccuacacuugcaguguucagacaggcaaggcaguguggggaagagagggaacuggcucuaccugaaagggcuucucuccaguaugaaccaguuggugucguuuuaguuuugaacucucaacaaaagcuuugccacauucugcacagacguggacucugggaccgugggugugcagauguuuucucauggccgaguuaucccugaacaucuuugugcagcccuuaaaacagagaaagcagcuuagaaguucacauugcaaacuguuagaaaggauucaaccauuuaacagccuuuacugacauauuaaaacaaaaccaccuccccaaccccccauuuuaauuuuacuuaguauuacgguagaacauuaauaucauuuaagacaaaaagcagacagcugaaaaagucaucauucaaugcaaacccuaguuuuacagaugaggaaacugaggcuuagagaugucuuuaaguagacuugcccaaggucacacuacuaguaguagccaaacugggaauagaacccaacacccuggcuuccagcucuaccacagccaccucacccgacuaugucccccaaaaugaaguaacagaagcacugcuaagcaaauggaguuaaaaugacgguaguccaccacuaccuuugguggccccauauucugugcugcaacaauggacugucauucuccaucgccuacuguucccucuucucucuuugccucuuuccccuucuugacagagaaagaagcaagagggucuccaaggaauggcaacuacagaagaaauuuauuuugugagacacuaggaaaaggaagaagcaggcaaauugauaccagugcagggcgggaaaggcagauggauguguggcgcucgagaagcauguccucaacaauuucuucugcaguuguugcccaguaauggagugaauggggaaaugauaagacagcaugacagaaggacagcacaagucacuagacagcucacaggcagaagggagagggaagccccaguuuuuccgccuuuaccccuagguugaauuuccauuuagaaaauggaaauuuaaaaaauuuaacugguacacaauguauacaugcauugaaacaucacacgguaccccauaaauauguacaaguauuauguguccauuauaaagaaaacuucagagaagcuaaagggauggcauaggcacuuccagccuaacuguuuucaaaugcuuguuauuucggcccuaauggagauacguuuacauuucaaaucgccacaucaagaacgcugacaaagaacaggaaggacuugcuagugcacagucauuacagggaagagaccgugaaacuaaauguagccugcuccgauuguucauuuuuaacauucuuuauuccacucaaucucuccuacuuuguucucuguaccuaugugauacuugauuuuucuguuagucucauauccaauuaaguuugaaaauagcccccaacaaauaucucaaaaguacuuuucagguuauccuuuuauuuuaaagacuaacuacauuugaaaacaauuaagugccucucuaaucacacacaauuauuaagucuuuauuuggcuuauuuuagcaacauccaaaauaauuuucaaauuucaguuacaagccuacauucccauaaaggucaauaggugagacacaacccaggaucuuaagacggacuuguuaauauaauccaaaaagaaaugaaacgcuaacaguagagucaacacacaguaaucaagcaacggcucccugcagucaucccauuuaacaguauuuaaaaaguugccuuuacuaaauaacaaaacuucaucucuuggauuuagaaaccgaagauucuaauuccuugcuucauuuaaauuaucacaagcagaaacaaaagugcaaauuucuuauaacucucuaaaacuucaucaacaguuuaaugaacacucucccucuagcauuacuuacuuuaugagggcaagcuauuguucuuggagcaucaucuucuuuaauuuuucuuggcuucauucuuaucaaaagaaaaagagagacagacagauuuguaggaguggguagacucaacuggcauaaaucauauagucccuaaaaugcuuuccuuauagguacccaaacuaaaauuaugauacauuuccaugaagcagaaaggaugagacaacuugcauucacuaaguaccaaugacugugaagcacucuucccaucuuacagauaaggaugcucaggcuagaaacaucgaguugccgccuacagucucauagcuaauaagcuggugcagcuuagaauggcacuaugaucugugugauucacauaccuguucuuaacuccaaacccuuuaaaaaaacacaaaaaaucaacucagacaaucagaugaaucuccuugugagaggcaagggaagauuuccaaaggcagcugcugcgaugaugaaggugccuuaugaaaaagaagcggugaacacaggaguguccuaaaauauccaucucuauacacgaaauggguccaauuaguacugacacgaaugaucuuuaaaauauaucauuuuaaaggguacagaagaguccuuuuaaaucaagauuuauagauauuaaauaucaaauaucucuggaaggacacacgacaaaccauuagcaccaguuacuuuggggagagagcuccuagggccugguggacagaugggaacaccacauacucucauacuguuacccuacuucuggaugggggcuuggaaguucucauuuguaccaagaguccugguaaugugguaaccgucuggcagagccccaggugaaauuacuguccagagagccuccugguuugguaacuuaccuaccugcuucuccacugaaucaagcuuuggacuuuugucaaaacuuucucuccaaauauucccuauagaucugugugugguaggggggugagaaauuaagcguuccuaaaaaaacuagagaauaaauuuaaaucucggaaacagauuuucuuuuugucccuaguuuuaccccucucacaccccuccaugaugguucauauuuaauaaauaaauaaaucagccggguguggugggucacgccuguaaucccagcacuuugggaggccaaacugggaggauugcuugagcccaggaguucaagaccagccugggaaacacagugagacucugucucuacaaaaaauaaaaaaauuaagccugggcaacauggacaaaacccugucucuaucaaaaacaaaugaacaaacaaacaaaaaaucccccaaaaucagccaggcaugguggugugugucgauagucccaaccacucgggaagccgaaggcaguaagaucacuugagcccagaaggucaaggcugcaguaagccaugacugugucacugcauuccagccuaagugacagaacgaaacucuguauuggauuuaaaaaaauaaauaaaauaauaauuuaaaaaaccauagcugggcguaguggcucacaccuguaaucccagcacuuugggaggccgagguagauggaucacuugaggccaggaguuugacacuauguuggccaacauggugaaaccccaucucuacuaaaaauacaaaaauuagccgggugugguggcagaugccuguaaucccagcuacuuaggaggaggcugagggaggagaauugcuucagccagagaggcggagguugccgugagccgggaucgugccacugcacuccagccuaggcggcaagaaggaaauaccgucucaaaaaaaaaaaaacaaaaaaaaaacaacaaaaaacuagcugggggccacuacucugagugaaguaacucaggaauggaaaaucaaacgcgguauguccucacuuauaagugggaacuaagcuaugaggauacaagugauauaauggacuuuggggacuuaguagggaaagaauggugugggauaaaagacuacauaccggauacaguguacacugcucuggcgaggggugcacucggaccucagaauucaucaauauagaauucauccauguaaccaaaaaccacuuauacaccaaaagcuauugaaauuuuuuaaaaagucaaagucgaaaaaaaaaaagcccaccuaagugaauccuuaaaagcaagagcuaauuuaccaccacucuuuuguuacaaaaaaaauacuccuuaaaaaaaaauuaauucugugaucuuuuaaguuugugaaggcccuaacaauguccuucuucacuuauaaucugggaaaaggaugaccugaucuguaaccugaacacaugaaaucauugguuaaacuuuccagcccuaggaguauaugaggaacaacagaucugguaacuaucacuuaucuccauggaguugguccgauacuauacauauuuguuauuuuaaauucuacgagaacauuuucucuuuuccuuuucuuucuuuuuuuuuuuuuugagacagagucucacucugucacccaggcuggagugcaguggcgcuaucucggcucacugcaagcuccgccucccagguucaugccauucuccugucucagccuccugaguagcugggacuacaggcgcccgccaccaugcccggcuaauuuuuuuguauuuuuguagagaugggguuucaccauguuagccaggauggucuugaucuccugaccucgugauccgcccacccacgagaacauuuucaauucaguguccucccccuucccaacccuguagauauucguccuuucucguaaauggauuauagauugagcaucccuaacauccaaaauccaaaaucugaaacuaucugagugcuaacaugaugcacucgugugauagggucacagugaaaacuuuguuucguguacaaaauuauuuaaaauacuguauaacagccugggcaagaaagcaacaccccgucucuaaaaaaaauaaaaaguuagccaggcgugguggcacaugccuacagucccagcuacuugggaggcugaggagguagaauccuuucagcccaggaauuugaggcugcgauccaacuucggugacagaacgagaccuuguuucaaaaaaaaaaaaguacagaauugccuucaggcuauguguauaagguguaaugaaacacaaaugaauuucaaauuucguauuuaaacccgaguccuagccuuaagauaacucauuaugcauaugcaaaaccccaaaauccaaagugcuacuguuccuaagcauuuugaauaaaggaugcucaaccuguaauaccaguuagcaaguuuuuuuaagugccuguuguaaacaggacucugaacuagccuuucuuaucuuaaauacaaauaaauccuggaguucuggccugaguucacaaaaucagguagaacaaaaguuuggugccacugcgccaccuugagguuacaucaguuuggaaaauaacagugauugauaugaaaggucucuauuccacucaaacauuauuuauuuuuaauuuaauuuaauuaauuuauuuauuuuuugaggcagagucucgcucugucgcccaggcuggagugcaguggcgcaaucucagcucacugcaagcucugccucccagguucaugccauucuccugccucagccucccgaguaguugggacuacagguguccgccacuaugcccggcuaauauuuuguauuuuuagcagagacgggguuucuuaccguguuagccaggauggucucgaucuccugaccucgugauccgccugccuuggccucccaaagugcggggauuacaggcgugagccaccgcgcccagccuauuuuuuuuuuuuaaguuuuaauguucccaauuaagagugaacacuuauucuuugaaaauucuacugaaacauuguuuuauuuuguuuuuguagagaugugguuucaccauguugcccagacuauucucaacuccugagcucaagcaauccaccugccuaggacuccuuggaaacauucuguguugagugugaagauggcuacaugacuguuuguccaaauucacagaauaguacauacauaccuaaaagggggguagacuuuaccauaugcaaauuaaaucuuaguaaacauggcuuaguaagguccucucucauacauuuucuuuucuuuucuuuuuugagauggaguuucacucuuuugcccaggcuggagugaagugguuugaucuuggcucacugcaaccuccgccuccuggguucaagcgauucuccugccucagccuccugaguagcugggauuacaggcgcgugccaccaugccuggcuauuuuuuuuuuuuuuuuuuguauuuuuaguagagacgggguuucaccauguuggucaggcuggucuggaacucuugaccucaggugauccaccuaccucggccucccaaagugcuaggauuacaggcaugagccacggcacccggccucccauacauuuugcuagaguuauuccuaguaacuuaauuuuuuuuuuuuuuuuuuuuuuuuuuuugagacagagucuugcucugucgcccaggcuggagugcaguggugcaaucuuggcucacugcaagcuccgccucccagguucaggccauucuccugccucagccuccugaguagcugggacuacaggcgccugccaccacaccaggcuaauuuuuuuguauuuuuaguagagacgggguuuuaccgugcuagccaggauggucucgaucuccugaccucgugauccaccugccucagccucgcaaagugcugggauuacaggcaugagccaccgcgccuggccacuuaauuuuuuaaaagauauuuuaucauggaaauuuucaaauacgcccccaaaguaaagagaacagucucagguaccauuuacccaacucuugguuuguuauuauaagugguauuauuuuuucuuaaaaugucauuuucaaaaugugugcuaguauuuagaaauauauuuaauuuuagaaugagaguuuaaaaugcauuuggacaaauacccuuggacuuaaggaguaaguggaagauuuaaaugcagccacucuuaagcuccuuggcaaaucauccuccuucacacagaguggcaaaugcagcaguauacguugguacuuuuaagauuuuauuugaaugccaacaaugaaaaaagucauuuuucaaaaauauacuuagguuaaaacaguguuucauuuugcgaguaaacaguaaaaaucauauacuaccacugagaacaucuucucacccuccucaacuauucagaaguaacuaagauuuaagucuuccauucaccaacggacacuuuugaacccagagaguccuuuugaaccuggagacaaugaugacaacagcauagacauuaugaaugaggcaguaugggaugugugacuuggaggugacuucuacuagcugcaugaccuugagcaaacuguaacuucucggccucgguuucuuauucuguaaaaagguauaaugcuaccuacuuaagagcuguauguuaagcaccugggaaaugauagcucuuauuaccauuggcuaugugugaaaugggucuagcuaaaaaugaguucauucuuaaccacccuucgauaaaggacugagaaacuggagaaagcauggcacuaggaggaacacaccccucaacgcaguacauguuauauggaggagucagacacccaacaacucaaguuuccugucaaauagagagggagaauacacucccaaugacaugacugcccgauuuauaauagcucauucuggcauaugugggaagaacguuguaaagauuguggacuucagaacccaaacuucuggcacaguaucagcagagcauuguguaaaccgaaguucuaaccaacagaucugcaaauaucccagaaagggagaugaaacauuuuuggacaagugacucuuuaaugaaaauaagccucuuccauacaaaacaagguuagcugacuuccagaccagaaccauccucugaucugugcuauugggacagaaguuccugcguaauacggcugucauuugcaagcaugauucaccucccuucuuugugaaaagauaauauugccuuagacaaauaaaguuuguucaaugaauuaucucuuaaauauuaauauucaugugaugauacugaagaguugugagguauuuucaucuccauuaucacauuucaucuauacauuaauauugugaaagucucaggguaaguagugaacagcaacaaaaauacccauuugggauuggccuaaccauucuaaucuuucuagaccaaagguuuucaaaggucuaacuuuauuuagugaaacacauacaaagguggucacuuuacaggaaacagaacucacuggaccacucacugaccacuuuucaaaauguuuacugaacagacauuucgggaaaaaaagucauccauagacuguccaccuucccaaugucagacuuuccaauuaaagucauuauggcuuauauuuugcccaugugcguauguaacugauuuacuaggcagucuaggcugagugcagcaugagccugaaauacucuuuggacaguuucaaguccaguccagcaccccaucaccccagugcacagaggagacagaaaagcagcuuacauucuaccuuaagccaacagcugcggcucuaaugccacugugagugcugggggcgaagacuggaggccagcaggacaaguucuaugggccguaauuagcgaagauguggucuggcccccaagaguuuaaaacucuuggugccucuguaucuucugcucucagagucccgggcaucaauuccugagccuccagaaaaucccacucaacuguuacacacauccucaaaacgugaagaucuaacaaaacagggcaccuaggugcaaacaguucucaccaacaccacuguccaauuacagauauuuguucagaugaacaugagcuucaagagcuacuauguuagaggccgggcgcaguggcucacgccuguaaucccagcacuuugggaggccgagguggguggaucacgaggucgagagaucgagaccaucuuggccaacauggugaaacccugucucuacuaaaaauacaaaaauuagccgggcguaguggcgggcaccuguagucccagcuacucggaaggcugaggcagaagaauugcuugaacccaggaggcagaggcugcagugagcugagaucauaccacugcacuccagccuggcgacagagcaagacuccauuuaaaaaaaaaaaagcuacuauguagaauguggaugagagggagcccaacccuugacccaccucacagggcccaaacucuguaacuuuacuuuuuacacugucaaggcgagcaagauuucauucuuuucuauacacaaaugaaaucuuuuaacaggcuaauaaaagaaaugcuauuuacauucauauugugauuaugcaaauauuauuuacuguggggcucaacagugugcuaggaucacacuuaaugcucuacaaguauacaacauaggagcugcaaggagaaaaucuucccagagucaggucaaagaagcucucucuuucaauacugucaaaauuaggccccauuuuucaggcuacagcuuucuuugcccuacucccucaccccuuuucauggaguuuccgauugccuuuucuuuuucuuuuucagaagacccuuuuccauaccaccaagcuucuuacucacucuacccacuacugaaugaaacugacuuuuccuuaagaaauucuuacagccagccaacuuucuauucuaaauggaauacauuuuccagccugcuacacagcuguccucuugguugucgugcacuaggaaaucuuccuucugauguucauccucauuucgcuguauuauaucuucaaauuaccuccucagaaagggugcaugcaacaugaauccuugggucucuaaaauugucaucucuugaccuuguaucugacuugauagcuuugcuggaucaauaacucuauguuuacaguaauuucuccucucaaagcauuguuuuauugucucuaauuauccccugcuacugaagaaaagucucauucaggucuaucauucuuuccacuugauggccuaucuuacugaaacuuuuggguucuucagcccugguguuuuggauggcuaucugguacccgggugccagucucuguggguggucccuuucuuaaggaguauggucuaagguagccauguuaccuucccaacaguaacaugugucccuggauuuucugcucagaagacuggggacaaacuuuuagaucagcugcuccaaugcuccaaggagggugagcagugccaagggucaccaacaccuaauggcuuuacugcucaccacccauagauucccucucucuucaaaaccuuuccuucagcccuccgccccuccacugcaacuccuucacaauguauaauccaaagagguuuuauuccucucucucguaccuccugagucuccuucuauuugucugaaugaugcuuuuacucugccacugggaccucuuacccucugacaugguuucgcugcguccucacccaaaucucaacuugaauucuaucucccaggauucccacauguuguaggugggacccggggggagguaacugaaucauggggaccaaucuuucccauguuauucucaugauaguaagucucacgagaucugagauggguuuaucagggguuuccacuuuugcuucuaccucauuuuucucuugccgccaccaaguaagaaaugccuuuugccuccugccaugauucugaggccuccccagccauguggacacgggagaaucacaauuguaauuuaaaguuucaaaaggccaggcacgguggcucacaccuguaaucccagcccuuugggaggccgaggcggguggaucaugagguuaggaguucaagaccagccuggccaagauggugaaaccuugucucuaugaaaaauacaaaaauuagccggguacgguggcaggcgccuguaaucccagcuacuugggaggcugaggcaugagaucacuugaacccggguggaagaggcugcagugagccgaggucgugccacugcacuccagccugggcgacagagugagacuccaucucaaaaaaaaaaaaaaaaaaaagcuucaguguucugguuuggggcucagaguagucaguauuugguuugagaugcuguuaauaauaaaacauccauguuggacuugaggugguuuuuaggaaguaaguuggggcuggagucaucuaaugagcaguggcuaaaagcaucaaaacgguaagcaugcucuuacuccuccccccugcccccaacugagcacacagucuguuucuaaaucuuuuccauuaucuuuuguaguuuuuuucuuucucuuuuuuuuuggugggggaggcggggaaggaguuucccucuuguugcccaggcuggagugcgaugacgugaucucagcucacugcaaccucccccuccuggguucaagcaauucuccugccucagccucccuaguagcugggauuacaggcgccugccaucaagcccagcuacguuuuuguauuuuaguagagaugggguuucacuauguuggccaggcuggucuugaacuccugaccucaggcgauccacccaccucagccucccaaagugcugggauuacaggcgugagccaccaugccugguucaguuuccuucuuuuuuagagacaauuuugcucugucacccaagcuggagggcaguggcaugagcucacugcagcuuugaccucccauguucaaacgauccucccacucagccucccaagaagcuagcugcauaucaccaaacugagcuuuuagagauggagucucaucauuuugcccaggcuggucucaaacuccuggccucaagcgaucccaccucagcuucccaaaguguugagguuacaggcuugagccacagagcccagcuggucucuuguaauuucuaucacauuuauuccuuuguuaucugacugccacaauucuaacucaggccuucauuaacucuuguucaacugaccucucucauuuccugugccuguaugaaucuagccugcacagacagcugcaaaggacuucucccaaguuaacgcucuacucacacagccccuucuccccagcucaaagucugcaguagcugcccacugcauaugagaaaugucugcacagccuggccuaggauucaucgcccuuaaugaucugguuccaguuuaccucaacuccagucauuucccuggaagcgcccuaauucccaguaaacccuccaucucuaucaaaacucuagggccagcugggugcaguggcucacgucuauaaucauuuugggaagccaagguggguggaucacuuuaggucaggaguucgagaccaggcuggccaacauggugaaacuccgucucuacuaaaaacacaaaaaucagccaggcaugguggcaugcaccuguaaucccagcuacuuggggggcugagguaggagaaucgcuugaacccaggagguggggguugcagugagccgaggucauaccacugcacuccagccugggagaugagugaaaauccaucucaaaaaacaaaacuaacaaacaaaaacucuugggccaugugcaguggcucauaccugucaucccaacaauuugagagaccgaggcaggaggaucacuugaggccaggaguuugaggccagccugggcaacauagugagacuccaucucuacaaaaaauaaaauaaaauaaaauaaaaaaauuagccaggcaugguggcacacaccuguaguuccagcuacucgggagguguggcaggaggauugcuugaggcuguagugagcuaucaucaugcuacugcacuccagccugggcaacacagugagaaccuccauguaucaaaccacaauggaauucuuaacgcccauuugacagguggggaaacgagcuccagguggcaggaacugcccaccuuguuuucggcagggccaagaaggaagccaggacacugaacggucuccaccucuaccacucugcucucaaaagaaaaaaaaaaagcaacccacucuguucuuagaaugugcaagaucaaaaggauuucuuucuucuugauccugcccuugccgaaauuuccugagcuauuccagguuccaaccaaccucagguauggaaaggcauuaggcuuucugcuccagaguuuauuaguucauuuaacuuaaaaguuuacaucuuugugguauuuucagcuccuuguacaaacugccaaacaguacuagaaaguaacacaaaaaguaggcuucuauaagaacccagcccacuuuaggcaaaacaaacacacccaaccaauggguucagaguuucuccacugcucgccauguccaagccauaaauacuugaucuccuccugucaugccagcuuaaauuaacauaccaggagcuuaacugaugacaagacaaacacgaauuuaugaaauccuuuccaguggucagcuggaugagucaaguacagacccaggucuccagcagcauagaccaauacaacacacccaaauuuaaaauguguacuacaggcugggcacaguggcucaugccuguauccuagcacuuugggaggccaaggcaggcggaucacuugaggccaggacugguucgagaccagacuggccaacaggaugaaacccugucucuacuaaacacacaaaaauuggcugggcgugguggcacacgcauguaaucccagcuacuugggaggcugaggcaggagaaucgcuugaaccagggagguggagguugcagugagcugagauugcaccacugcacuccagccugggcaacaagcaagacucuugucucaaaaaaauaaaaaauaaaauguguaccaagaagccauaaggcaguguggaagauaucuauuccaaaacaaauuacgugcaauuuuauuuacucaaaugcaaugccuauuuaaggguauuugcuucaucuuacugcaaggaucuaaaaugcugccacucacauuaauagcauaguuacuacuaaaaauaaaacugacugucagaauugcuugaacccgggaggcagaggcugcagugagucgagaucgcaccacugcacuccagucugggcaacagagcgaggcuccaucucaaaaaaaggaaacaaaaaacaaacaaauaaaacugacugcuuuuguuuucaggaauuucccuagagaaagaauacaaaccaccauuuugacuuaggcacaggaaaacauagcuggcaagacucaagcacuuucuauaauuaaaagaaaggaaaguucuuauaacuuaccuagcaaauucugccaguuguuugggaucugagaggucaaugccagguauuccuccaggaggaaguuucuuuccugucauauauucugaauaaucaggaggugaguucucuccaaugaucuguucuucaaccacugucucauggucaauaucuuuuuuuucaucugaaacacaucaugagauuaucuuuagcugaguaaauagauuuuaaaaacuacaaaaacugcuuucaccaguaacuucuuaaauggggugauuuauagccaccagcucaauuuguucuccccucucccuuuuuuuuuuuuggagaacggucucacucugucacccaggcuggagugcaguggugcaguggcccaaucacaaucacggcucauucagccucaaacuccugggcucaagcaauccccccaccucagccuccugaguagcugggacuacaggcaggugccaccacacccagcuaauuauuuuuauuuauuguagagacagggucucacaauguuacccaggcuggucuggaacacaugcacucaagcgauccuccugccuuggccuccuaaaguccucguauuacaggcaugagccaccacacccagccuagauuucggcuuuucacucacaccacacacauuuccuggcaacuaccaauucaguggugcugauucaaaucugauuucauagccuucaccucuuagcuagucucuugcuaccucuccagccuccucccucuucacuccucuauuuuggcccuuuagcuccccaguuguaucauggcccaucuacccuaaccucaagguguuuauucaugcaauuuccauugacuaaaauuuguaauuauagcugugugauuuuugucauccucccacuagacuguaagcugcauauggacauggagguuggucaguuuugaucccgugcauuuacagagccuuguucaaaaucugcacauagcuggcccucaacaaauauauguucggcccagcaccagugguucaugccuauaaucccagcacuuuggaaggccgaggcgguggauugcuugcaaucaggaguuugagaccagccuggccaacacggcgaaaccccaucucuacuuaaaaauacaaaaauuagccaggcaugguggugcaugccuguaauaccagcuacucaggaggcugaggcaggagaauugcuugaacugggaggcagaguuugcagugagcugagaucaugccaaugcccuccagccugagugacagagugagagucugucucaaaaaaacaaagcaaaaaauaaaaauaaauaagcauauguucaaagaaauguacgacaucucuauuuguaugucuuacuaucaucucauauccaacagguuacaaaaaauaggccaggugcaguggcucaugccuguaaucccagcacucugggagaucaagacaggaggaucacuuaagcccagaaguuccuagaccagccugggcaauaaagggagagaccccaucuccacaaaaaaauuaaaauuagccaggcauggggugcaugccuguagucccagcuacuugggaagcugaggcaagacaaucacuugagcccaggaggucgaggcuguagugagccgugaccacgucacugcgucacugcaacuucagucuagagcaagacucugccuccaaaaaaaaaaaaaaaaaaaaaaaaaaaaaaaaaaaaaaaggaccaggcacgguggcucacaccuguaaucccagcacuuugggaggccgaggcagguggaucacgaggucaggagaucgagaccauccuggcuaauacaaugauacccugucucuacuaaaauacaaaaaauuagccaggcgugguggcgggcaccuguaguccuggcuacucaggaggcugaggcaggagaaucgcuugaaccugggaggcagagcuugcagugagcagagauugugccacuguacuccagccugggugacagagcgagacucugucucaaaaaagaaaaaaaaaaaaaauacauauauguguguguguguguauauauauauauauauauauauucauauauucagaccccauauaauucauuucccauaucucagacaccaaauccuauugauccccuuuaaaagaucucucggccaggccacaguggcucaugccuguaaucccagcauuuugggaguucaagaccagccuggccaacaugaugaaaccccaacucuacuaaaaauacaaaaauuagccaggugugguggcgggcgccuguaagcccagcuacucgggaggcugcggcaagagaauugcuuaaacccgggaaguggagguugcagugagccgagauugcacuccacccugggcaacagagcaagaccccgucucaaaacaaacaaacaaacaaacaaaaaacaccagucuucccucuuugauccacugccaucaacuuauuuccuauuaucucaaaccuaaaugacuguaguaguuucuuaauugauuuucacaauuauuuucucuagugauacugcaaaggauaaacuggcacagaaaauauagcugauauauucucacccaugguauaaucccuucagugcugcuguaaauuauuucaaucuggcauucuggguccaaugcugucuggucccacuuuaacaacauaccuggucuuaccuucuauuucuccuuugcacaugccuucuauauucuaaccagcuuuucucauggguuaaauucacaagugcauggcaggagguuucaguaagugugaguuuugcucucucuuaccaccucucuucucaacccagccuccccuccaaagucuagcucaaauucuagagaauuugagggcauguucauuuuaucaguucagucuugauuccuaccuuuucuuugagcuccuagauuauucccugacagacucaaucauuccaguuugaauuuuuguuggucuugccucuuuuuuuuuuuugagacggagucucgcucugucacccaggcuagagugcaguggcacaaucucagcucacugcaaccuccgccucccagguucaagugauucuccugccuccaccucccgauuagcugggacuacaggcacacaccaccaugcccagcuaaucguuuguauuuuuaguagaaacaggguuucaccacguuggccaggauggucucgaucucuugaccucgugauccacccgccuuggccucccaaagugcugggagccacagugccuggcgggucuugccucuuaagguagagcagaagugcccagaggccaaaaacaagucuucuucuaccuuugaugccuaaauuagaaauagguacuccgaaauuuucaaggcuaacugcaaguuuuugcuucucaaauugucugucucaccaaaaguaguaaaauaaaauauuucagaagugaaacuggcuucaacuuuuaccuugaauuaccuuuccaccaguguuaaaaaucaagaccaacaaccaaaccaaaacgaaaucuacaaccaccaaaaacuacauauaacugcuuagcacacagcuuucugaccucagagcaaagcuggaguaugagaggaagaucaagauagaacguagguuccauuugauucaaguggucauuaucaaguucaaucacucucagcaaugaaaagcacugaauacaauuguaaacuuuacaugacucuaauuccaccacucuucauucuaggaaauauaauuauacaucauuacaaggaaucacagauuuuuuucauuuuacugaggagaaugcgcaggcacagagagguuaaguaaccugcucaggguuaacuggcuaggaaguggcugauguaaacucaugagggccgggcgugguggcucacgccuguaaucccagcacuuugggaagccgaggcgggcggaucacgaggucaggaugaucgagaccacggugaaaccccgucucuacuaaaaauacaaaaaacucaugaagucuaccccuaagauuuauaugcuuaacuguuaagcucugcugccucuuguucagaaagaacacuagugauaauauacccaagguuauccauucacagaugaagacuaucuauuccuagguggggccuaggaaaaaaauagcuggauguauuccgaaaaagagacaggaaauaugguuacugacccuaagacacaaacccaggacucaaauucuuuaauuucauuccuguucccagggcugccugcuccuacugacacccccugcacgugcccaucccucuagccuggcacaucuacuucuacaucaaaacuuucacgggguacagaaauacuuugguggccaagggagcuauuuguccucauguuuuauauuucuuucuuuucuuuuuuuuuugacacagucucccucuauuguccaggcuggagugcaguggagcaaucauggcucacugcagccuugaccuccaagguucaagcaauccucccaccucagccucccauguagcugggaccacagacgggcaccaccaugcccagcuaauuuuauuuuuuguagagauguggucucacuauguuaccuaggcugguuucgaacuccugggcugaagcaauccgccuuggccuaccaaagugcugggauuacaggugugggccauguuuuauauuucugauacagaaugauagcaauguugagaaucagugcuacucugaauaagcuacugaugaaagugucuuaauccauuugggcugcuacaacaaaaauauagauuagguggcuuaaggcaacauuuauuucccacaguucggaagcuagaaguccaagaucaaggugccagcauggugguguucuuggugaggaccuacucccugguuugcagauagccaucuucacacugucuugucacauagcauagagagaaccagagggcuagcacucuggagucucuuuuauagggcacuaaucccaugcauuaggguucuacccucagaccuaaauuaccuuccaaaggaccuacccucuaauaccaucacauuggggguuaagauuucaacacaugaaucugggagagacacaaacaugcagucuaccccagagggcaugucucaagugugcugagacagaagacugaacucauggcauaaaggaaucacaggcuaaaugauuauuaucauuaguucuacacauauugagggccuccuaugugccuggcauuguucugggcacugggaauaaaagcuagaaacaaaguaucugcucucaaggaacuuacagucuagugagggaagucaaaugaggaaauacuucuugaguggggcucagaacccaaaucugagcaauucuaauauugaaagacugaggaauacuuugcaaaggagacugaagagguauauccacagguagggagacaacuagcucugucuaaagagaacuuagcgacauaucaagugcaaguggcauacacuaccaacacugaagaauaucaagaacccucaggauggucacuaaaauaauucagaaucagaaaccaaaaaaauauaugaaagaagccuaaaguagacgcugacaagacuuuaugaccuauaucaggaaucaacuaguacagccaguuggccaaauccaaccucuauauuuccacgguuuucguaaaaaaaaaaaaaauugugguaaaauauacauuaccauaauacuucucauuuuaaccauauguaaguguacaguucagugccauuuaauacauucagaauguguaaccaucaccacuaucuauacccaaaauauuuucuucauucccgcaaaaaacucuauacccauuaugcaagaacuuucacuuccccucagcaccugcuaaccucaauucuacuuucugucucuaugaauuugccuauuucagguaccucauaccaguugaaucauacaguauuugccauccaugccugguuuauuucacuaagcauaauguuuuuaagacccaccuguuguaacauauaacaacauuccauuccucuucauggcugaauaauauucuguacauacauaccauuuuguccaucuguuaauggauggagaaauaaacauggcuagauaauuaaucagauggguuggggaggaacagggaugccaaguaugccaccugaguuucuugcuucuaauuuuuagaagaugguggugucauuugaugagauggaggacaagagugugaaagagaugaugugcagaagauuuagaguuccucuuugguuugagguaucugugcaaaaucuaaugggcagaccucaaaaaggcaacuaaauaugcauguauaggggauaagaaaccuaggucagagagaauuauaucguaaucugugagaaucacuggcauauagauguuuuuuuuuuuuugugacagggucuggcucuguugaccagacuagagugaucauagucugcaugaucauagcucauugcagccucaaacuccuggacucaagugacccuccugcugcaaccucccaaguaggugggacuacaggcccacaauaccaugccugacucagacugcauugaaagccccagaaagacauuguaagauuaucuacugaaaaagaauacagucagagaggagaaggauuauaaucaaaaccugaacaauucuaauauuaagagaaugaggaagacuuugcaaaggagacugaagagagauguccacaaguagggagacaacuagcucugucuaaagaaaacuguacucagugacguaucaagugccaaguggcauacagcaaaagcaguuugcccuaagcacagacaagagaggcugcauggucuguacauaauuuuaaaaccauaauaaaacuggcugaaaauaaguguacucuugaucauuaccacauuccacacuuauuuauuuauuuauuuuuccugagauggagucucgcucugucccccccagguuggagugcaguggugcaauguuggcucaccgcaaccucugccucccugguucaagugauucuccugccucagccuuccaaguagcugggaucacaggggcacaccaccacgcucagcuauuuuuuguauuuuuagcagagaugggguuucaccauguuggccaggcuggucucuaacuccugaucucaggugauccgcccaccucagccucccaaacugcugggauuacaggcaugagccaccgugcccggcccucccacacuuucaaauaauaucaguuucuugccuuaaaauaaaacauauuuuguuggucuaaguuugaaauaauuuuugugguuauuguacauucucguaagauacagauuuaagacacauguuaucacauuuaugacuuauuccuuaaaaaacaguguuuccuacaaggaagauaacuagaacucuccaaagaccacugcacagaaauugugaacaagaaaauauaagaaaauaggcuggcugggcacaguggcucacaucuguaauccuagcacuuugggaggccaagguggguggaucacgaggucaguaguuugagaccagccuggccaacauagugaaaucccgucacuacuaaaaauaccaaaaaaaaaaaaaaaaaaaaaaaaaaaaauuagcugggcgugguggcgggcgcuuguaaucccagcuaacuugggaggcugaggcaggagaauugcuugaacccaggaggcggagguugcagugagccaagaucacaccacugcacucuagcccgggcgacacugugagacuucgacucaaaaaaaaaaaaaaauaaauaaauaaauaaaauaggcuaggcaugguggcucgcaccuguaaucuuagcauuuugggaggccaaggugggcugaucaccuaaggucaggaguucgagaccagcccggccaacauggcaaaaauccaucuugacuaaaaauacaaaauuuagcaggugugguggcgugugccuuuaaucccagccacucgggagacugaggcaaaagaaccgcuugaaccugggagguagaguuugcaguaagcugaaauugcaccacugcacuccagccugggcgacagaguaagacuccgucgaaaagaaaagaaaagagaaaagaaacauauaggaaaaagcugcaaaaagacuucuagagaaaugacaaaagacacuggcuuuuguugccagaagaaaucaaaaggacaauauuugaccugccucauuuucacaagcuggacacacaauaaagcaauacauuaaauaaugucaauauuugcuaucauuuggccauuuugcuaauuuuugcaaaaagaaaaucagaaguuuuuaccaaauagaauagaaauuuaugaugcuguaaaagaagcuaguaauuuuuauuuauuacauuacaggccauauguacauauguuucuuucuuuguucaaaaaaauaucuuggccaugugugguggcucacgccuauaaucccagcacuuugagaggccgaggcggguggaucaccugaggucaggaguucgagaccagccuggccaacauggugaaaccccaccucuagcaaaaauauauaaaaaaaaagauuauaggugugguagcgggcaccuguaaucucagcuacugggaaggcaaggcaggagaacugcuagaacccaggaggcagagguugcagugagcugagaucaugccauugcacuccacccugagccaacaacagugagacuccaucucaaaaaaagaaaauuauaaaaaauaauaauaauaaaaaucuuuguuaaaaaguauuaacccuggcccagcgcaguggcucaugccugaaucccaguacuuugggaggcugaggugggcggaucacccgaggccaggaguucaagauuacccugguuggcuggguacacuggcucacgccuauaaucccagcacuuugggaggcugaggcaggcuggucaccugagguuaaggugaaacuccaucaauacuaaaaauacaaaaauuagcugggcaugguggcacauaccuguaaucccugcuauucggguggcugaggugggagaauagcuugaaccugagacgcagagguugcagugagccgagaucacgccacugcacuccaggcugggcaacagagcgagacucugucucaaaaaauaaaaaagacuagccuggcuaacauggcaaaccuccauugcuacuaaaaauacuauucccuucauaauuacuacugaaaaagauuugcuacauagaggagaguguuuacugauccacuuugaaugucaaauuaugcuaugaauguuacugauuucuauugacuagcgaugggguaauaucaaauguacaucuagguaaaacauguucaggaagcaaaguaucuaaaucugcuuuaaaaauugucuggacccacuauaggucauuaaaaaauuguuguaugucuauucccugcuggaguuucccuugaggacaggaucuuuuauuguuucacaggacauaguuaaccccauuagaaguuucuauggguuucuuucuuucuuuuccuuugagacagggucucacucuguuguccaggcuggagugcaguggcacuaucacugcucaaugcagccucaaccucccuagcucaagugauccuccagcaaccccacuccaccaguaguugagaccacaggugcaccacaccaccacacccaguugauuuuuuuuuuccugguagagauggggucucacuauguugcccaggcuagucuugaacuccugggcucaagugauccuccugccuuggccucccaaaucccugggguuagaggugugagccaccaugccuggccugcaauggguuucuuuaaccaauauaacuuaaguuuacaauugcuaauuaccagaacacaagugggcaaggccaauuaaagccaaaucucagaauuccuauuuggaaaaagcugagaauacagucauugauucaaaggggguaaggugaugugggcaaccaucauguuaggaacuucuacccaaaacugucgauuaggugacuacagugcucacucacacucuggcuaaaugcaaugaccuaaaacaacuagaccaagacuaacuuggccuaagauagaauguguggaaaaacaaaaucuagccaacacuagucauauauguggaaggacaauuaacucacauuuaaaaguuucuauuucugcauaugguacuauucagaagguuaaagguauuguauaaauaagccgcuggcccaucccaaucucccagcugcucgguguucuucuauguuaccaaagcaauaaucacuccaagucuaguuugaggagcaaagcauaagacugaguuuguagacuccaauuuccagucaaaaagauauaauuaaggaacuaaauaaauggaaaggcuagaagcacucuacaaguccagagaaguaaaaagauggagucucaccugcccuccacgcuccaagcaaagugguuuucucagugucuaguaaaagguacucaauacaauuuacccucuugccuuccucucaugaccuaccuaagcccaguccacucuccaaaacccaaauuaagaucucuuccuuucaagaagccauucauuccugucacuccagccucuacucuuaaccucgccugguuuccucauuuauuaaacaaugaggccaggcacaggaguucacaccuguaaucccagcacuuugggaggccgaggcaggaggaucucuugaggccaggaauuagagaccagccugagcaacaaagagaaaacccugccucuacaaagaaauaaagagaagaaagagaagcaaagggaggggaggggaggaagggacaaagggagggagggaggaaggauaccacugaucuuauaaggcuaaaacaagguaacauguuaaaugccaaucaucaugucugggaaauugaguagugugcaaaaaaagccccuuuauuccacuuccccccucuccuagguuuaagggggaacaguaggucuugugccuugcacauaacagggacuugccaaguuccugcagaaugaagcuauacaggggaugcuagcacauguauuaguuuccuauuaccacuguaacaaacuaccaccaauuuggugguuugaaacaacaggaauuuauucucuuauaguucuagaggccagcagugagaaucaguuucagagcuauaaaguuguuguguggguuccuucuggcagcuuuaguggagaaucuggucccucacauauucuagcuucugaaggcugccuacauuccuugaccccuucucuucacuggacuccaaccucucacaccucuccuacuuccucuuuggcagucaaucucccacugccuuccugugaauacaaggacacuugugugauuacauuugguacccaccuggauaaaccaggauacucucccuauuccaagagcccugguuuaaucacacuugcaaauaagguuaacacccacagguuccaagaauuaggaucuggcuauauugggagucauuauucagucaaccagucaaccaguuagucaauauguuaaucagaaaaaucaaaggccuuauauauuauuucucucucucucuuuucauuugagacagaaucucauuaugucauccaggcuggaguggagcucacugcagccuugaccuccugggcucaggugauucucccacgucagccuccuggguagcuggggcuacaaaagcacaugccaccaugccuggccuuuuuuuuuuuuuuuuuaauuuucuguggagacaaggucucacuauguugcccagguuggucucaaacuccuggccucagauccucccaccucagucuccaaaagugcaccauacccagccacguuccuuaauacauuuuuuaggcaucucuaagacagcacugugaaauuugucacauuggcugaaaaaugccaguacuaccacucagugguccccuucauacacaaaggaauucauuccuaagaaacauuuuauuuccucagaauuaauaucagaugaagguaguauaaguuccuuuuuuuuuaauuuugacugccaguaaccucauuaggguugaugguaauuuuuccugugaucccgauuuucuauauucaccuucaccaacugagauauuuaccuauguauguaugcauguauauguuuggcuagauuuuguuucuccacaccuucuaucuuaggccacuccagguuacuucuggcaaaaaaagacaaaaaagagucaccgcugccaucacccaaccuuucacugaaacaggggagagcuaaacauuugcgauucacugcuuagcaacaggcaaaaaucagacauagguuguuucccaguuuuucccacuaauaaagaccuuaagaaaggauacuauccuuuauuaaguaccugucucauucuggcaacuugucacauuucucaauccaaacaauaucuuuaagguauuaaacccuauguuuuuggcugaagaaacugaccucagaaaugacaagcaauguaucuaaagagcaguaaguaggccgggugcaguggcucacgccuguaaucccagcacuuuggaaggcugaagcggacagaucaccugaggucgggaguucgagaccagccugaccaacaugcagaaaccccaucucuacuaaaaauacaaaauuagcuaggugugguggcaggcaccugcagucucagcuacucaggaaccugaaguaggagaauugcuugaaccugggaggcggagguugcagugagcugagaucacgccacugcacuccagucugggcgacagagcaagacucugucucaaaaaaaaacaaaaacaaaaacaaaaacaaacaaaaaaaaaaacgguaaguagcaaaucugagauuugaauugagaauugacucuaaaagcccaugcugcuucuaaaacagaaccuucugcaccuucucucuaucccuaauacuucuuuuccaccuauacaggaauagaccaaaauaguauuuugguauaagcccugauucugccuuacagcacaaauuccagccauucauucacucaauauucaaaguucaauacucuccugaaaagacagguccugacaccaacagaacagcuucuugcacagcaauggcagccccuuucccugacucacagaucuucuauuugagaaggggaauuaauuuacacaagaaagccaggcacggugucucacgccuguaaucccagaacuuuggaggcugaggcaggcagaucacuugaggucaggaguucaagaccagccuggccaacauggugcaaccccaucucuacuaaaaguacaaaaauuagcuggguguaguagugcaagccuguaaucccaguuacucaggaggcugaggcaggagaaucgcuugaacccaggaggugaagguugcaggugagccgagaucgugccacugaacuccagccugggcaacagagcaaaacucugucucccaaaaaaaaaaaaaaaaaaaaaaaaaaaaaaaaaaauuacacgagaaagaguccaucacaaacaaccauuuauauuguuuuaaugcuaaaccacauuugaaaccacuguguaaaaccaaaguaacugaauggcuauuaagaauuuuacuuggcugggcgugauggcuaacgccuguaauccuagcacuuugggagaccaaggcgggccgaucaugaggucaggagaucaagaccauccuggcuaacacggugaaacccgucucuaccaaaaauacaaaaaaauuagccagguaugguggugggcgccuguagucccagcuacucgggaggcugaggaaggagaauggugugaacccgggaggcagagcuugcagugagccgagaucgcgccagugcacuccagccugggugacagagcgagacaccguuucaauaaaaaaaaaaaaaaaaaaaaaaagaauuuuacucaagcuggguggaauggcacacaccucuagucccagcuacuagggaggcuaaggccagagaaccgcuugagcccaggaguucaaggcuguagcgcacaaugaucacaccugugaauagccagugcacuccaguuucaacaacauagcaaaaacccgucucaaaaaaauuuuuuuuucucaagaguuccuaauaucucauuugccaggucauguuaaaauggaagacucuugcuuuaagaaauugaguaggcuggguacaguagcucaugccuauaaucccagcacuuugggaggccaaggcgggcggaucacgaggucaggagauugagaccauccugguuaauacggugaaaccccaucucuacuaaaaaauacaaagaaaaaaaauuagccaggcgugguggugggcgccuguagucccagcuaccugggaggcugaggcaggagaaugguaugaacccgggaagcggagcuugcagugagccgagaucgcgccacugcacuccagccugggugacagagcgagacugucucaaaaaaaaaaaaaagaaaaaaaaauuagccgggcgugguggugcacaccuguaaucccagcuacucaggaggcugaggcaggaaaauuguuugaacucgggaggcagagguugcagugagccagaucaaaccacugcacuccagccugggcaacagaguaagacucuguaaaaaagaaagaaagaaagaaauugaguauauuguucuguuuguaaaggaauagaauuuccugcuauaaagauucaaagugacuuuaaggauaccgcuaccccaacucauuuuagaaagaucucaaggucaguccccucuagagaggaaauaugaugcugcuggcuuucuguucuugauaauuauucaugaaguuaaacagaauggaaccuacugagaagauacuuagaacgaggaaauggcuuggcuccccuuacgugcuguuaugaaaguccaucacacaugaaaaggugcaagccccccaacaaucagcuaacuucuaacaucucccuuggcucuuccuaauacucugcaguaauuacaugaauguuaucuucugcauccaagucaugauucugauaacccugucucuacaaaaaauuagccaugccugguggugcgugccuguagucccagcucuuggggcacugaggcaggaggacugcuugagcccaggaggucgaggcugcaaugagcugagauugugccacuguacucccgacugggugacaaagugagacccugucucgaaaaaaaaaaaaaaagaaaaaaagaaaaauucauuuuugcuuacucuuccuauuggaaguaguaagagcacagagagaauaaaaauggucaccugagcagaucaagaguuaaauaaaagaaugcaaauacuaaguaacauucauugcaauaacugcuuugcuaauauaaccuaaguuucccagccuuaaaacagacugaccuuguuaagcagguuucaaaaacaaaauagaaaugccuuuuguaaauauccaccuaggaguccaacauggauguuuuaaaaaauuuacccucuuccaaaagccuauaaaauacuaacuguagauaggacaggaacccugaccuuuuccugauacggauuuuucuuuucccacuagggggagucaguuguugauagugggagggaaaaggcaagguuaauaaccuggaggggagagucugacagcacaagaggcuuuauuaggaagcuaaaccuuucagagcuaccagaucaggauucgagaucuaugacuuaggcuacccuauguaggucaugggggugaagugauuacuuuggagggcuuuuugagcuuggcuccauggaaauucauguuuauagcaucuuagugauaaacagcgcaguuucuacuggggagggagggugugaaaaacccacagaggaauggcaaacggucaugacuagugauuuuuggcaaaccugcaucuucugaacuuauaaaauugggaaaaauucaaugcauuucaacuuccuugcauuuacugauuuuguaucaaugguuuucuggucuuacagguuuugcuuaauccagcacaagccgcuucucuauucaguguaacagaauaaugauuauuauuuuugccucuccuucagcaguuuaauuugucuccucucagaaggucacagcucagguggggucucaccaccccacauccccacaagguccaaacaaggguucucuacccggagcaugaggccaaccugggcacaccaggggagggaccaucgacuccuaggcgugaaggaggugccacucagcugccagcacuuugagaaggcacaugucccccacaacccaagcugugcugacuggcacgggacagaaugggggggacacuggccccgcaccugugcuauccucauuagccaugggcaggcaguaugcacaugauggccucaccucacaaaacccauguauggaaauggaaacggggugggggugaccauggacaugcuggcuuguuuccaggguuccaggcaucuaugcggcaguuuaugcacauggcaaugcaacuucugcuccgaauuaaaauaucaacagccuuagagagggucacaguuugucaccaccugaaaucucaagauuuuaaaaucaccuaaauuucucucugaacuaaauguuuuaaauucucaguuuuuaucauuaucuucccuauuaaaugcaaugguuaaguggcuuaguuuauaauuaacuaaguuauaaaacaguuacuccuggcugggcgcgguggcucacgucuguaaucccagcacuuugggaggcugggguggguggaucaccugaagucaggaguuugagaccagccuggccaacauggagaaacccagacucuauuaaaaauacaaaaauuagccgggcaugguggcacacgucuguaaucccaguuacucgggaggcugaggcaggagaaugucgugaacccgggagguggagcuugcagugagccgagaucgcgccacugcacuccagccugggcaacaaagcgagacuccguuucaaaaaaaacccaaaaaaccccacaacaacuguuacuccuauguaacagcauuaguaucuagggaaaaaauauauaguacugugccccaaucuaucaacacugaaauguuuauuaaucauauauagugaaaaaggccaaaguaaacacuggcauuaaagcaauugauuaagauuauucaaaacauaguugaagcugggugucuguagucccaguuacucaggaauuugaggcaggaagauacucugaacccaggaauucaaggccagccuaggcaacaaggcaagaccccaucucuaauuuaaaaagcaacaacuaaaaaacuccagaugcacagaguucucugacacacuaaacaguuaaguauauucagguuaaauacagaagaaacaggacaggcgcaguggcucacgccuguaaucccagcacuuugggaggccgaggcaggcggaucacgaggucaggagaucgagaccauccuggcuaacauggugaaaccccaucucuacuaaaaauacaaaaaauuagccggguguggcagcgggcgccuguaguuccagcuacucuggaggcugaggcaggagaauggugugaacccgggagguggagcuugcagugagccgagaucgugccacugcacucuagccugggugacagagcgagauucugucucaaaaaaaaauaagaaauaaaaaauaaauaaauaaaaauaaauacagaagaaacuaaacauguguaugacaauuaaaaauuuaggaaaaaauaaagaggucaggcacaguggcucacacccauaaucccaucacucuggaaggcugaggaaggauugcuggagcccaggaguuugacaccagccugggcaacauaaggagaccccaugccuaaaaaauuaaaacauuagccuguggucccagcugcuuggaaggcugaggugggaggaucgcuucagcccgggagguugaggcugccgugagccgugacugucucacugcacucuagccugggugacagaaugagacccugccucaaaaaaaaaaaguaagggguggggaguggggcgggcagguugguaaucccaacacuuugggaggccgaggugggugaaucaccugagaucaggaguucaagacaagccugggcaacauggcgaaacuucgucucuaccaaaaauacaacaaaauuagccaggcaugguggcacgugcuacucggaagguggagguugcagugagccgagaucucacacugcacucaaaccugggugccagagugagaccccugucucaaaaaaaaaaaaaaaaaaaaaaaguaaaaaaggaaaaaaaaagccaaucucuaaggauccuauaaggccuaaaacuacuaaaaaacuauuagauuccuauacugauauuacauucaaaagaugcccaccagagugcucuuacugugggaaauuaaaggaacauggcaugugcgcaaaagaaacccauuugguuuccagaaauaugaugacucccacuaauuuuuuuuuuuuuuuuggagacggagucuugcucugucgcccaggcuggagugcaguggcgcuaucucggcucacggcaagcuccgccucccguguucacgccauucuccugccucagccuccugaguagcuggcacuacaggcacccgccacagcgcccggcuaauuucuuuuuguauuuuuaguagagacaggguuuuaccguguuaggcaggauggucucgaucuccugagcucgugacccacccgccucggccucccaaagugcugggauuacaggcgucagccaccgcgcccggccaauuuuuuuuuuuuuuuuugacagugucucacugucaccuaggcuggaguacagugguguaaucaccgcugacuugcagccucgauuucccaggcucaggagauccucccaccucaaucuaccaaguagcugagagugacuacaggcaugugcuaccaugacuggcuaauuuuugugggguuuuuuguuuuuuugcagagacggggucucacuauauugccaagguucaucucgaacuccugggcuuaagcgauccuccugccuuggccucccaaaguucugggacuacaggugugagccacugcacccagccugaucuuuuugcuuuuuaaaccaagagggucuaagaaguaacuagacccucggggaauacccuguauguacaacuauuuuuauaaggacuucaaguaacucagcuuggggcuuaugcaaaacuguuacuucacaguucauuccaaacuaaggggcuauuuuagugaaacuaaaguguaguuaaaaccuucaugccuaggaucaaaugagaucaaguacacgaaagcaguaaugcugcccaccaugcucaacccauauguacacauacauacagauuuacccaacaauuaacccacuuucauuucuccacuuguuauggaauuauacugaguauaucacgucauuucaguucugaagaugaaaucaccuucagaauuucagcuugggaaaugcagaguuauccauaagcucuuuagcuucucuuuaguaauaauuccaaaucacaaggaaaaguaagggggauaguuuaccacaaaacacauguccgagaaacaggccauccuauguuacugccaucaaauauuuauaacuacccuuaugcacagcguacucuaccacacuagcuagacaaccagcgcuuuaaagaaauggacauuauagccagggguggugguggaugccugcaaucccagcuacuugggaggcugagacaugagaaucccuugaauccgggaggugaagguugcagugagccaagaucgugacacugcacuccagccugggcaacagagcaagacucugucucaaauuaaaaaaagaaaagagaagaaaagaaacggacgugaaaacaaccccaaacugugccaccuuaaaagcagccacuuggcugggcgcgguggcucacaccuguaaucccagcacuuugggaggccgaggcaggcggaucacgagguuaggagaucaagaccauccuggcuaacauggugaaacccugucucuacuaaaaacacaaaaaauuagccgggcgugguggugggcgccuguagucccagcuacucgggagggugaggcaggagaauggcguaaacucgggaggcggagcuugccgugagccgagaucaugccacugcacaccagccugggcgacagagcgagacuccaucucaaaaaaaaaaaaaaaaaaaaaaaaaaaacaaaaaacaaaacaaaacagccacuugcacacuuguaaaugcucacuuaauuguaaauugacuuccaucagucaagccccucagacuuucuccccuaacuggcugacuccauacauaccacuucagcaagcaaagccguacacuaccagcuucucuggauguggaaaaguggaccagcaauuuguuaagauaaaaugcagaucauguaaaaauaugucgguuuucuaaauuccucuaauuccacacacuaugagaaaaaguaaauuuacuuuugugguuaauguaucuuuaccuaaauaucuuauuucaaaucguauucugaauucugcaaauucaucaauaacuaaaacccccaucccuuacucauugguauuaacaaaaaaaaaugccccccccccccuuuugagacagagucucgcucugucacccaggcuggaguguaguggugcaaucucggcucacuguuaaccucugccuccuggguucaagcgauucuccugccucagccucccgaguagcugggauuacgggcucccgccaucacgccuggcuaauuuuuauauuuuuaguagagaugggguuucacuaugauggccagcuggucucgaacuccagacuucaagugauccaccggccucagccucccaaacugcugggauuacaggcgugagccaccgcgcccggccaaaaccaugacuuuuaguuccaacaugaucaguauguaaucucuugagcuaccaaaauacauggaaauuaucuuuugauaaccauuaaguacuaaaguauucauguuucauuuaaacauaguuucugcuaaacucaaacugcuaugaauucuacaaggcacccuggaugcaggacagcgccuguuagcaccuuccuauuagauuuugacagcuccuagaucccuuugcucaggccucuuucaaucacagauccacccagcuguaguugucucaucuugaggcuuucaccagauacaaacuagcuuuuucaguccagccuuuucauuucuguuucauucauuccuccgaauuuuaacgaucuuuuaauacucaaaggucaccauauuuugagucuccauucaguucugagaauuuaugaagcuuuaaaguacuuauagggaagagguuccaccgcuuauauggaguacuaaacguaaucaucacaggcauuagauuaacuacgauggcaggauuauucucagucuauuuaguaucucagcaauuuagcuagguagcauaugaauauacuaauaggauacugaccuaaaaaaccagcauugaauuaauaauugccuuugaaguaaaaacagauuuuacacaggcagauaagauccuuuugcucuagaugguuuucaggccuucguuaaaaguaguauuaaaacaguaaaacaaaacucaaaaaaacccgcuuucuauuaucguucuuuucauggggaaaauagauaccuuucuacaaaguaaaaaccauaaaggcuuaaaauuaaacuacccgauuuuauuuacuggcaaauguccacaguugaguaaacuaacccaaccuauucagaagagcuaaauacuugagggaaaaaaaaaaagcuuucccaaaacguaagugacuaagaauuauucgcuaacauucacaggcccuuuccacuagguaccgcaggaaggcgaaaaggccaggaauucgcuggcaacggcggugacaggcuccgacugacgcucggagcccgcacacgcgagcccuacgugcagccccaagucccgccccgcagcaaacgacgacuugggcgagcgugaccgccggggcaggguccagcccggcgcugggugggcggggagcaaggaggccggagggcgcccacgagugccaagcccccuccuucuggaaggugccaccggggagcaguugggaguccggggaaguugggggcgggcggggcaagcgcccgcggcgcccuccagcggccgaugggguaacggcagcgccgggcgggggcgggggcgcgcgucccggaggcagcaaucccuggcccgcgaggccgcggcgcagccccgccaacgaccucccgcgucccgcccgggccgggggcgcgcagcugccgccacaacgggccggcgggcgcgcccguugaugcgggcgcggggagcgagggcgucggggagcgagcgcgccggccccucccccggccgucuccgccccgcgcggcgcuucccccucucggagaaacuacgccauugcggccuagccgggcggcgccggccccucccccccgcggccugccgccaucuucgcggcccgccgcccgccgccgccgccgcgcccccgccgccgcacggcccgccaucuuuuggggccgccauacuugcccuggcgaagaagauggcggcgcccaucacacacauaaaacauggcuucccuucaaaacaaaaacaucccggggccggggcgcgcggccggcgcucaccugaggaccacauggugaccgagaacucgcccuccagggucuugaucugcaccugcuucugcucccacuucuuguugcccgggucggcgccgccgccgcccgccgcgccggccccgccgcugagguaacucuucuugccgcucuucuugccgccgcccuucuugacgcggccgccucccgacgacgacgagccgccgccgccgcucuugccggccgccgccacggugaccagcguuuguucaauguagucgucgucgccgccggccggcgcgggcaccgggaugagaaucugauccucgaagccguccucggcgcgcagcccguccgagucgucgccgcccaccaccuccucgcgcgucugcaccaggaucaccuccuggugguggugcaccugggucgggucgucggugaccagcggcugcagagcgaucaugggcgggugguggugguggugaugguggugguggugguggccggcgugcccguggccgcccccgccgccguggucgccaccgccgccguccucgucgucgucguccuccuccuccuccucgcccaccacuguggucucgauggucuccaccgggauggucuccaccucgaucucgugcagcuccacgaucucggccggcaucuccgagccguccguggcgauguagagggugucgcccgaggccauggcugagggcuccgccgccacggccgcggcggccucggcuccucggcugcgggcgggcgggcgaggaggcggccggccguggggaaggaaggcagagggaggaaggcggcgagcgggcggggggagagggggcgggcggcgggggaaggggcgggcgccgcggcggcggcggggcuuccccgccucccucgccucggugcgcccgcgcccgcgcucgcucggccgcugcucgucucggcuccccgccucgccucgccucgccgcaaccgcccgcccuggccgcgccuccucccgcccuccgggccggcgcuccgcuucccccuuccuccugcgccuccgccuccuuccacacaaauaccaacuccucaacccgagcccagaucucgccgccgccgccacacucugcucgggcccg

SEQ ID NO: 17152 - RNA, 35232 nt, Homo sapiens
gaggacggccagccaucggggcgauuccccccacacauugugccugaauucacccugccuggcgagccgggcucacgcagggaaaaagcacccgcgaccacaggguguuggucauggcggccaggggcacugcggcagaauuuuuuccucccuucuuugcugcaaucugggugcggcuagagcaauuugucauagaaucuggggggcucauuuuuccggccaaucacuuuuagagaaaugagcgcauugcagcagaaugcgcugacgucagagaccaccccuucugcgccuccauauaaaccccacccagccagccccuagcgcagacggcggagagcagagagggagcgcgccuuggcucgcuggccuuggcggcggcuccucaggagagcuggggcgcccacgagaggaucccucacccggugagugguuggccauccuugccgcaaaggaugugcaaaaggaagacggcauccgcuucugggaugggcucuguccuccuggacaugccgagagccugccugauccuggguccugcugcuggaggcggccacuucgccugguccccgagcguccgcaacaaaauuugucagaaagaaaaucuugaggcacauuucccuggggggaagucagggcuccucucuggaggguccaguccuuaagggugggcugggugguagggacuucaguucagaggagcgggaggaaucagauggaacuccucuuggauucggguauacggcagucacuggggggcgaaccccggauuuccuguauuagaagccgccucuagaaucgcguuaauagugggagauauggcggcgaugccuucugcgugccccaugaauuagggggggaagcacccgaauagaagggucucccgggcauauuugccucgccagcuguuggccagguuuuugguggaucgugggcgggaggaguggagguuccucuucgcgagguuuuccgaauccaaauacacagguuuagugcaguguggaccccaggcaaaauguggaguaaaauuucuacccgauaucaucugguucugcccugaucagccacuuucacaguggagagagauggcgcccaagugcaaaccugccaguagcccccuaggaucaguccuugccgaaggggggucgugggauugggggcacugggagaauagaugcaggggguggguuggggaggagagaaggccguguccuugggucugggaagagggaggagagaaaugcagaaaaggggguguguugcuggggucuggacgcugggagcuggggauggggugccgcgggggucuucagagcguugcgugguggucgcucgaaaauccugacauguugcagucuuggacuuuuggucaaaucgccuuuugccauuuccuuugucagagucaagcccccccaggccgcccccucccacccugggccggcgggccuggugggggcgcaggcggguggcuacguggcagguuucuggaagguuuccuggcuggccgcgagagggcgcuggcggcacugcggaauuuuggggggcgggguggggaggggagguggccuuuguucuccugauggagggggucgggcgcgggaucuacuggaggauccuggauucguuuacccaagagggaacaguuuugagaccccccggauucacugcggaguggccgcagaggccggggucggccuuugcgccguggcuucggguguuguggaggcgcacagaggcacguuaguugauuuccagugguuuuugguuucgggggucuuaggaagguguggcucauuugagcaggauggagagagaggcugugacaaggucagugaggggccaucgugcgggggcuagaaauuguuguuguggcgaaggagggaggcacgacuuuggaggcgugauguugaugccugggggcgaaggcggggagcggcgugguggcccccuuugcguuacuuuccagcgaugucacagguucugucucucguuccgagaccacccacaugcgugacagcggugccuggaggacugggucuuucugacuuuagugaacguguguuuaauuggauugacgaaggugggagucgggauuucugcuuuucccuguagcaggcggagcggcgcuccagaggggccuggcgcagguccgcuggguggcccaccuuccucuggggcuggggcccgguggcugggggcgcaggaggcgccuggugcgggcgggaggcgcugcgccgcagccacaggugggcucuggcuggugguggcuggagaggcguccagggggcguagcgaccuggcgcgguggccuggggugggcuguggagcccuuccuagccugagaccuguugggcacccccuguccauccaggcccgccgggcgcgggccggggcgccgcagguggcugcugcacuccuggguuacgggugcgggccgcgcgcccccuagcggugugugccagccccgcuaccuuggguuuugaguugcgcacacgcacacagcuaacacuugugaccugucagucaaaucauccuuacccccucccacuccucuccuccaccucccauuucuccucucccuccacccuuucucauuuccucgucccuccucccccuccuauuuuucuucucccuccucccucuuuccucuucccuccucccucuuccccccucauuuuccucaucucucuuuuccccuccccuucucuccuccccucucccugccccccuccuuccucccuccauaccccucccucuucccucccagccccucccuacugccuuccucaguccuccccuuugccacuccucccugccuuucccucugccugcccccuuuugcucucugcuguuccggugcuggccguuagaggucacgaagaugguuucuaaccugccccccucccaugccauagggucucuccucagggaugacaucauccguccaccuccuugucuucaaggaccaccuccucuccaugcugagcugcugccaaggggccugcugcccaucuacaccucacgguacuucaacccuccugcuaucauuucauaaccaacguggcgggcagaaucucccaaccccaccaccauccuugcaccacccccagacccacuagcaauuaaaagacaauuuuaaauuuuaacuaaucagcuuuaauuguaauuaaugaacuuaaacuguaauuaugaucuaggcuugggcuuuuaagcagguucucuaaccuuugaucaauugcagagggcacuaggagcacgguuuccuggaucccaccaacauacaaagcagccacucacugacccccaggaccaggauggcaaaggaugaagaggaccggaacugaccagccagcugucccucuuaccuaaagacuuaaaccaaugcccuagugagggggcauugggcauuaagcccugaccuuugcuaugcucauacuuugacucuaugaguacuuuccuauaagucuuugcuuguguucaccugcuagcaaacuggaguguuucccuccccaagggggugucagucuuugucgacugacucugucaucacccuuaugauguccugaauggaaggaucccuuugggaaauucucaggagggggaccugggccaagggcuuggccagcauccugcuggcaacuccaaggcccugggugggcuucuggaaugagcaugcuacugaaucaccaaaggcacgcccgaccucucugaagaucuuccuauccuuuucugggggaauggggucgaugagagcaaccuccuaggguuguugugagaauuaaaugagauaaaagaggccucaggcaggaucuggcauagaggaggugaucagcaaauguuuguugaaaagguuugacaggucagucccuucccaccccucuugcuugucuuacuugucuuauuuauucuccaacagcacuccaggcagcccuuguccacgggcucuccuugcaucagguaggggcuuugcagagaccaucgacgggcugacuugaguaagaacacgaauuaugcauguggccauuuccagagcacuuucuaugugauaugaacaugugauuuuuauguaauauguguauguaaacgaggcagccucauuuccaggugaggaugcauuugguaguguugauuuuuguaauuuaaagaagcugaaagggagagaggacccgugaggacugaacucucugucccaugggguagggcuuacauuuacauuaaagaaacagaaacuugcugggagguguaaguauuuggucacauugcuggcaacagaagggguuggaguuggacccagggugccacgcuagcugcccucaccccuucuuccccucuggcccagaguuauacuaagaguccuuuuauuucaaaccaaauguuugacaaugggacagucuguuugaaaucccagcugccugggguggucuugggggucuggguggccccagugcugguaccaugugcuggcuucaccuuuuaauaacagugugaccuuaaacaagucgcuuaacuacucuaaguuucaguuucuuucauggucuaaauggagauuaaaacacacacacacacacacacacacacacacacacacacacccccucguguaucuaccccacagggcgcuuuugaagaccaaaugcuguaacuacuaugaaagugcuuuguaaauugcuguggaaagugugagcuacucaagcacccgaggcugucccuccuugcucacauguccagcccaauucucccuuagugagaacagcacucaguaggugcuguguguguuuguguucaauuaagaaauuccagaauaaauaaaaaugaauuaauucaacaaacauuuucuggggcaccgacaaucugcccagugcaccaggcuagguaucugauacaaagauaaugaaaacagucucuuggaaccuaauugggguccucauuugaccaggaauuucuuucgucccguuuuaagccaaccaguuuuguccggacaagacaaaaacaacuugggcugcuuuagagaagcccagcucaguguagacaauagcugcccagccucugaaaggggcugauuggauuauguggcaaauggaggugcaaggaugacuuggacggugacaaaugaagugggcggagaccugcuuugaguuaauccaggcuauuaggaggggaccuuuugucuuccagagacuggcaggagcuuuuaccagugguuuuuacauccuuaauguucaggacgaauaauuuauggucagugaaaauccaggccccagugagauucgagugggcuguaaaaucgagaguccugcucccagugaguaaugguagugaauguuucugucacuuuuugcaaccguccauucauuugauccucacaacucccuguccugagccaggaccggccacugccacucccagggaaacagaggcugucaagaggcuccacagauugggccccacuggaucauugaaccccuguucccugaguucuagaggaagaauuguaccugucucagucccggccaccuccagaaggccucccucugcauuucugacuuugcugugccggcagccuggagccucccaggucccugcugucaucuuuucuagccacuacagucucugucuuuccuuucacagccaagcuucuugaaaggccugucuacacuugcugucuuccuuccucaccuccaauuuccucuucaacccacugcuuccugacucgcucuacuccguggaagcacgcucacaaagguaaagacuuuucuguggcuuaauccuugucauguuuucggcucauggacacaaggacacauuuucaugccuucucucacagggcucugcgucuccgguucacuucugugucuuuacacucccuucacagagacacuugcucccccuucucucguucuuagcauccccuaggaacuugcacacccaggucucucgacuucuggaccugcuucuuaccaugccgucuuaagcagucaggagucgcugccuggguucgaguccuaguuaaauuacuuagugcugagaccuugggguagguaaacuuuuccaagccagguuuaucucaguuucaaaauaggguuaaucgucuuuaucuggcaggucaggugggaugucucacagguaagcaccagaugccauuugaaaggcuugaagcaaagucaauaaagcauucaugggaaaauacaacuggaggcaccacuagauuuucguauacauuagguucccacggggaggaccgaagagagaagaaagaaguggaaagggaggagcgugcaggagagacaggagaagagaauaacuaaacaaagacauuaaagacaaaaaaaaaguaggaaagggagacuuagaaaauauuaaaagccaccaaaaacacauccaaagacgguuuccccuuacguuaguugggcuaaaagaaagcaaaugggaagaagguuuuaaauugauuaucccagugacaaaucccaggaagcuuucacaucaaaucacccuauucuggguuuuuaacuccuuccaucgaguuuaaccucuuuaccucccacauccugguaaacccugcccccucccuaccgcccccuuugcuggugauuaaauccugaagguacacgaaguauuucagugaaugaauggcuaacagaaaagggccuccccucccccuuacccuggcgguguuuuucaguuuuauuccacuuuccgcccuuuucccuuaaugaacacagggcuaaucucgggccuugucgaaggaagaggcugcagacguuaaugagguuagcugcuggauuccaguauucgucgcauaaggauccuucuuugucugcgaaggaaaaacacacugauuaucauaaugaggugaacuggccaccgccgggccggggcgauguggcuucuuaagccacacuucuaauuuuggugauggagccgacauuucuuuggcuucucauuuaagucuuugccucugucccagugcgaaguccauucagcgggguugaaaguugcaggcagcuuugggaaggggggcgucggacaggguugcauuguagaaaguggcuuuguucgauccuucgcacagaugcaaauggccagagcauucauucccuuucuucaagagcugaggacugggggggccacuggugaucaguucccaacucuagcucuccucugacucaucucaggacccauugaggacauccaaaacucacucaagaucaccaagugguaggaaaguacuaacuccugggcauagcccuaggggagugacuacaaugugaauacucauggaaugccuagccaggugaagaagugaaugcauguuggcaucccagagggaccccccuuaagagggcauaguuugggguucagauuugacuccagcauacuguugaaauugggcacagggggcuagugauuagucaggaucaaucaguggagaggagauuaaaacucacaucugggaguccggaaucagaacuuguaguucuuuuuuuugaaauggagucucgcucugucgcccaggcuggagugcaguggcgugaucucggcucacugcaaccucugccuuccggguucaagcaauucucccaccucagccuccugaguagcugggauuacaggcgcccaccaccacagccggcuacuuuuuguauuuuuaggagagacgggguuucaccauguuggucaggcuggucuugaacuccugaccucaugauccaccugccuuagccucccaaagugcugggauuacaggcgugagccaccaugcccagcccuauaguaguucuucuuuugccccuuaauaucuucacccacauguccuguacccugccugaacccuccuccucuuuuuguucugaucuuugagcucccuagagcccauaauucuuuagagcagguaugucccgagucugaaacaugcccuuauuugucccaagcucuggacauuucucaccccaaggcggaucaaucaugauuaaaucacuccaauuaaacuuuaggcuccagucagaccuucagccaaauggaaaaaaaaacuaggggauaagggagguaguuggagcaagaaaauguuauuaguugaaaccuuacgggaccuuccucccuuagugagucuguuggcuaaagguucucuggcuucgugaauuagaaucggauacuguuuccaaguuagcaaaaccaacucuaccccagcaccccacgaggaagaauguggaaggaucucccauuggccgguuggggcaaaagccugaggcaaucuuucauccccuuuugccaaggcgagacuuucccagugacggugauguaguuggccacucugacuauggguggacucggguguagaccucugaagcugagaucacacgaaaaccuggccuccccgccauguagcuguuggagaguagaaaaauagagcacgccugauguuucuaaaugagaagacuuucaauaguaaugaagaauccauggcacucuccucacccucaaacacauggcagucauucacauacaggccccaaagccacuguuagugcugcaguagcuccuguggacauuggaaagcccggagagggcguggaagaaaucagcuggcccccggcagguucucugggguuuugugcccaaggcuccuggagcccuaaaaacuuucaaaaguuaacuccccacguccccauccugcuuggguuucuggacuuuucugaggcaccggcagaggggucucguugcucccuugaguguaggggcagcccuuuaaccuggcuccuugagucccugcuuuuucugcuucuguugccuucuuccucgucuuccucucucucaauaucucccucucuuugucccuccccaguuccugaccuggccaucccggggugcccuugaccagccccgugucuccucagggugucccagcaccagccuggcacagaguggggcucaguuagaguaugugggauguugguuucgccaggugagugaaugaaaggacucgaccaccacagcugagccacuagcugggccaugcgaagaguucuaggugcaaaggcuggaggguggaauucauuuuugagaggugugugagcagcuuccgaccccugccccauuugaacgggggccuugcuggucgcgucccugcauucacccgcgcggccaucccgucauccaacaguugauccuaacugagcacgcccacggcccuggucuggccugggcaccggccaccguagcccaucccuugauggccucuguguccccaggagggcgggccgggggguugcccaggggcuggagcaguggacuguggcuccauagagguaggccggagggugugagggcagauucaagcuauccccagggcucugcucuggucggagccagccccuucucccucucugccuuccccgccccauuccugaugcugaacuguucuggaccccuggcccugagucucucaggaccaaagugggcacgggaacagcuguagugugugcccccccgggcuuuggccacaggucucccucucgaggugugguugugacugcgacccuucccuugccgugaugccuuccucccccggggcuugguccagcuccuucacucucuagcagcugcuggggcccaccucccaugccgaggaccagcaggggaaaccuccagggagcaucugcaggcucugcuucugcccggcugcuggcuugcucucccugguggcucuccagcggccagcuuccucacccacccggcacuccgcuuugcucugucuccugaggugggccugaccaaccuccccuucucugccucagucccugggcuccagggcucagcuccacagcccucugccuagcaggcugguucucccugccaagcccauaccuguggucaccuggcccuccuguggucugaguaccacuccccugccccaggagccacucccacuccagcugccuguuuccagcagguucccagugcccccgacaagccccugcuggugucuccaucuccugccaagcauccuccagugccuccuccugugggccuggccucagggcuauggacagacuccugucccaucccagagaccccucgugaucgugcccugguggguguugcccccgccugccuuugccuccgccguggcccugagaguccugggcucugccccgcccggucccuugcuccccacucaguucuggauuuggggcugccccuaacccagcccguugcugcuuugcaccuuuuccugucauugggcaucccccaguagucaccccacuccaccgaaaaguaaacugcaggugaggccgugccccgagucuuucuucgguguguuuggcuuuuccggggcgcuugccuugccaugauucuaacucucugcccuuccccaaggcacgugggccguggcccggcugggucggcugaagaacugcggauggaagcugcggaagaggcccugauggggcccaccaucccggacccaagucuucuuccuggcgggccucucgucuccuuccugguuuggggugaguuucuugcuuucuugagacccaggauuuuauuagggucagcucaugucucuccucucugaucaacaagagugucaacauuuaauuuggggaggaggcacccugccaaggugaauucucuucacaucagccccaggggucugggggccggagagcugccuggaguggagacccuugcuauacccagcaagcauguguggggguccacccuggcugauggcaugcugugggccggcgacgguagguggggaguguccaccuccacucuagacccccgagagcggcucgggccaggcacucaggagcccucaguacggcuuugcugaacacauugcaaaagggauccagggggcacuugcccugcccacacccggcccagggaccccuucggagaggaggaaaugggaaugcuugccugcuccucagcuaggaagacauuucuuuccaccagccaugguagcgucacccccugugagaaccgugguuucucacacaugaggcuuugauaauguccuuuaaucaaauagugguuuuugagcaaguucuucucuuuccuccuuuccucaccccugaaauugcaaugagacgggaauguuuuuguuuguuuaaauaaaacagcaaugguagagaagaagaaagcgggauuggagccacacaauucacucgaggacccaucauuuguuuauuuguguuuuacuaauucaagaugcagccgggagccguccagggcucgggccugggguuguucuggggcgccuaaggcugggcuuugcacuaaggaccagagggucuacuugggugccguggagcacccaugcagcaagguggcuugcacagcagccaggcgaggugucgucgagggcgggggcucaggguggcaugcuggacggccaugccaggcugaaguuugggcuggcaggaagagaggaggcucagcugaggccacuuuccuuucugggggucccagggacugagucuguggcucacucagggcgaugggguguuuuuagagccacugcccugggaggcagugucaggauccuggcaccccucauauaugacgccccugggguggccauuguggugaaugagugcaguuagacuucccagagaagcugggugggcgcugagaaaggucugaaccguggggugaggcuggcuccauucccccagacauuuauggaggcuugagggggcccuagcacuguccuuggcccagaugccaauacuccccucuggacgcccacgaauggggucucugagaaggaaguggaugaacacagcugcacgcuggguggggcccagccucuaguccucagccaugugcacgcaucagcccuugugcaggccuccgcccuccgccaccccccacccccggagugucucugguuuccgacgcagccucguaaugcucuuuaaucaaacagaggauuuggagacagcucuccugcagcccugcacuucuccccugaaauugaaaugggauggggauauuauuuuuaaacaaaaucuggcagcguaggcagagggggcagaggcgcucuaaccuggggcuguugccuuugucugcuuguuucugcucucuggagagccccagagccuggagagacggggaggggagugugugcccagggcuaaacccagggagggggcccaggaaggcucugccccgugacauuuacuccaaggcuagcauuugcugagccaccugcaaacacagugauguggagaagaggcccgggaggggagguuugcacaggggcaggcugcugggguccuggggggauccugucccaagcuuacuagaaugcauucgaguaacuggucugagccagaugcccucagcucuuggacugguuucucacggacaucucaggacuuucccaagguggacuaagcccagggacaaagucaaagugaaggccaggggcacacaggagaggcccagauaggaccaagcuuuggcagccccuggcucucagggguugaaauggaacccucuuugcacugaguuguauuucagguacucaugaguguuucggucucaggcaaacacauauuugggguuuugugugucauuagguauaaaauagguaaaauaugccacguucucaaugaaagaaguugaaacgugacuuacuacgucagccuugcuggugaucuucucgggaacugccgaaaggccacuaguaagugcugaaagacaugaucauuuucaggaaaauucuauuuugauggauuggccaaugccugagccauagcggguggagaugagacccugacugacuaggcagugagccacagaggacccugucacaucagcggagggcggugaggggucucuggccauuugucaucgugcugauuccuagggggcugccucuagugggacucuucugggugggugcaagugucaggguaaagacggcggucuggucuggaaacuggcucuccucucgcaccugcccgcccugggugguugggaaaggaaaccaagaggguagcucaggccugagcucguggaaaggaagaacaugaccccucauucgcucacucgcccccacauucucucaccugcgaguugcucauugcugcuuucagggccccugaccucaugccuccugaguugugauucaaaccccaaaugaauuuccaaguacauuucuccaaauaaugucaaaaccuggcaagacuuaagggcaacaggaugcauguguuucuuauucauucauuuacauaaaauaacuuaaguguguuuuuuaugagcaaucugacuuccaaaaagaaugaaaaggaaaaucuacccaucuuuaaugaacuugcuaaugaauuuuuccuugcaaagaggaagggagcuuccuacagaaggggguguggagggagacagauucaggucccaaaggguuaaagggcaguggacaaugcggaagccagcauugugagcugcaguggaaaagcccugggucgcugggaguggcuucuuuuuaggagacuggaauuaaugaguugugaagugucccaaggacugguucccccucccugcuguuucucugagcccuguccccucuuccaaaggaggaauaaggaggucuagcuucgucucccauccccgauuugagcagauggaagagucuagaaaagagguguaccuuuugaaacgaggccucagaugugggguuccuggucuggaaaggggaaggaugaaucugggguaggagagggucucguauggagccccauucagacagggcagucccacaccugggcugcccacagguucuugggggagucuaaggaaaggggagccacagaacaggcuugccuccuuggcauggauugggucaguguuucagagccaggaaaggugggaguguggggggcccucggggcugaugagggcgugcagacccuccccucccaccuccugucccaggagcccugcagacacugcagcaggagggcacucugccagaagagggguuccagcuccagccggauccagcagacauggagagaccccuuaucuuugccaagacgagcucugcggugccugagaggcccguaggucuggaauucuagggccuucuggguuugagucagguccugaggccagggccugggcccugauccucaccauggaaaacuggucacuuuacucaggauaaacugugaugaggacuugggacauaucucugucuguccucucagcucgcgucaccccugagcccuuggcgaucgugggcggcccguguacagagcaggugcugggucacuggggccgccgugggccucccaacaugagggacugugugugagagaggaguucauuaagggagaggaugguggugaaggguguagccaugacuuucuuaacugcucuccaauuucuuugagcuuaaaaauaaauccagauggagaguucuuaaguccccuauccugggagaaaggaaggcugcccaccaccuucggcuugccucgacucugagcagugaauagggucuuuggcaggggcuuaaggaggagacucuuagccugggagcucccagggcuguuucagauggaaacaaaggcucaggccgagaggaaugugggggagccccccguggggaacagccaccuggggauaauugggagggcugagcgcagaugaguuuucccagguucugugaaugcgcccuuucaauggaaggugccuuuuuuuccagaugaaaagaagaaaacgucaauuaccuuccccugaaacggaguguguguguguucccucccagggguuguguggggccccuugcccuugugugugugucgggagcuccaaggcugcacaaugacgcacuuaaccagccacuggguucgcgcgacccugggaugcucacgcucuuagauucuagggcuugauuuugaaaguuucuuagcaaaggggaaucagagugauugagccuguaaacaaaaauuugaucaaccugggccugaugccugaaauauagccaaagagacagaauggggcugcggggagagagguccaggauggaaaguuggggaaggaggacagucgggggccaaaggcugaccgcaugucugcgccggccuccgcgcucacagcugggcugcuccuucugccaccccagcccuuucucugggccuuccuggcaguggacauagagugauucccuacucaggaaguuggcgguagggggcucagaaauccacagggcuguuguuucacaguuagccaggagaggagggggucaugguggcccgcagggauggugggcagcugcgagagaggggacgcuucagguuagagcgaagcuguuugcaccaccacugccccagacugccguaaggguagggccacuccagaggcaccagggacaaagucccugccgugacaggaggggggcacaggucucagucuuggcuggucacugacuuugcugcugcuggcuucugagccucagagaggucagcagucuuccagagaccugguuagagccugugcucagcccugacuaugggugugaccuuggccccugucuccagccccuuaggccucaguuuucccgucuacgaaaugggcgagugcaggcccauggucguccgaguggcucgggguuucuucaggccucccuggaggucaucugucguuuguuugcugggucuuuggaguuguugggacuuugggggucacugguccgcugcccccucugcuuuagagguggggaaaccagcgaucccagaggcccggagccuugcccgagguugcacggugagccggcagcaggcccuggaggugaagccccugccaguugccagcuccugugugaccuguguggucggggggggucacagucaccggucauuagugugggucagagcucuugcccaaagaagguuccaaggggcugccccaugagcugggaugcagggaucguguuuuauggggcauuauuccaaacaggcaggcugcuggucuggucuggaacaccuuuuuggucuguagagugacucuuguuuaaugagacuggacuuguggcuucagaaccaggagauguucguucccccaacccccguggcucaccuugugccuuuuggguccugagacccucgccagcgccucuguuggcacgguggcccagucggcugagaacuuccugaaaaagccaacaggaugacaacuucuggaaaagugaucaucacccgccugcacuggcugcccaucuuagacucagcuuugccaacauucccagcuaucucugugugcugcaguguguaguaaugaacagcucacaaaaccuccggcugggccugcaccugguuauuaccguggugggcugcagcuuuuguuuugugaccuugguugcuacaauaccugcgagcugaaaugaggaaucgaaaaauugccagcuucaauuagacgggcagacugcuuucccaaggcugccuccgccacuccauccauuaacgguaaacaggcaccaaauaggcccuaauucucucuaauugcccacuccugaagcaaagaggugaaauuccaggaagaggcguauguaaacauccucuguaaccugaccaaguaaaauuagagggcugaugggggccugcgagagagaggggacaugauuucaaaagaugucccaauuaccucuccuauuuucauaaaugggucuguaauguccagggccccggccucacaaagguacaggaaauuagcucugcaaagagcuugcauuugucaggggaaguuguaagggggugguguuuacucaacagguaggaaguacgagaucugaggcaagacugauuauuuguguaacgacgggcucuauuucuugagaucaacauuuuaauaaaagucauccuuuuagguccuuuuguguuugaaacagccauaaguuguuuauaccaaagacaugccagaucaguuaggugcuguuugccuccagaaaagaggaacuuuuaaaauccuaagaugcagagcuagaguuuucuaaucccauuaagcuguggaagauguuuuuggaguguucaccaaugcuuucugcgugggucaugagcucacugcacgcacuuaugaggucuuccaucaaaugcuugugacaauuacuccucuggacucuauaaggaggccucguguuuuucuuugguuccagacagugacucaucucugcagcuuuucugacauuuguuaagauucuagcccagcacugcguuauuaacacaucacagcaagcccagagcuggcacacgcagcuuuuaaaccaaggcacgaauuugcuggggcuucucuguagcagagcagccugcggucugcacacaagaguuaauuaaggacggucagggacucugagguuucauggggucccuggagcagaagcaggaaaaaacccagaugcuccuuccugcuucugauuucuccgcuccuauuaaaaacacaaaaaagaacaaaacaaaaacagccaaacaaagcacccgccucugauuccugcgggaaauggcagugccuuuggucgcgcuguguguucuuggccugagucucguugccaccuuaggacguggcgauggugagaggccaccccagccacgcacagucucggagggagggugggaaacggucucgagugguggucaguagauaauggguggucuggcagccuuuagguaaccgaagucggccccucagucacccaugcacugaucauugcuucacuaacacuuauuuuaagacuuguuguuucuugguuaucaaauuaaccaguuauggcagaacaggguuuaugaagggcaaggccagggaaggagauuuuaggaagauuuggaggcaagaaguguccccagugcccuggccgggucuuggacauccuggcuggagacaugacuaggaauagagaggcagaggcagcagggguggcccagauggcagggguggguuggagagaucccugagaggccugaggacaggcggcagucuugggagccccugaagaccugcaguggggcaggcagcuggagucaggugucucccgggaccuguuuuuuuuuuuuuuuuuuuuuuuugagacagagucuuguucuguuguccaggcuggaggguaguggcgcaaucuuggcucacuguaaucucugccucccacguucaagcgauucuccugucucagccucccgaguagcugagaccauaggcacauaccaccacgcugagcuaguuuuuaguagagacgggguuucaucauguuggucaggcuggucucgaacuccugaccucaggcgauccaccugccucagccucccaaagcgcugggaugacaggcaugagccaccccccuggggcugguaccuguggucuguggcuucugccugcccuggugcccccacaucucucucauggccuuucuguuuccuggguggcuuugugggggugucccauggucucccccuggcuuccugucuccaccugugccuaauccaggaaacgguccccagagaugguguuuucaaacagaccuuggcccuguccuccuggcccagccccuggcugcccuaucaccuagcuugcugcguuggugggaccucagcugucacaggcuaccuuucuaugacgccuccucaccuuaaguagacucugaacagauuuuaaaagccauucauucaacacauuuuuuaaaugaauaaacuuuuuuucuguguaguuuucaguuuacagaaacauuggugggaaaguacagagaauucccagaucccguccccaccaucuccccugucauucacacguugccuccgugugguguggucuguuuguuccgaucgauggaacgacucugauacaugauuaacuagaggccuugguucacaucauuagggcucacucuuuguggcgcacauccugugggucuugacaaaugugucaugauacgugucugacauugcugaagucaccuuuucuuaaagcuuaacauuuugggaguauucugaacuauguuuggcccagccugcugcccgauuuuuauaaaaaagaaaaaacaaaacaaaacaaaaaaacaaguuaaaacguaaggcagaucuugacacugaagacucgaugugccuggccauggugcuucccggggccuacugcacugugaacaaaauugccacaguggaguugucuguccaggcacacaacgugugugccaugguuuugggaaacgcugcccauuaauagcccugcagcccucugugggcugcccucccggccacaccccgcuucccuggucuccuccagggccagccauccugcucgccgaccugggcaccuugcuucugccagagcacagguucaugcccugucuucagggccugggccacccccguuucucaucuaugcaggguccuaagccuuugggucccacagagcacgacuucgcuccgugaacagcaccaacccaagucuguuccaugucuccacaccugccccuuccgcuccauaggcagcuggugggugaguggagucaggagagaaaugcguggcuucuccaauuccacacuugcuggagguuggggagucucugcuccaggccaccccugcccgccccccagagcuguuguccucauccgcccuccuccuccucgccggccugagugagguucuacucugugaccuagugccuucuuguuacagcggaagccaucaccuggaugccuacgugggaagggaccucgaaugugggaccccagccccucuccagcucgaaaucguaaguggcuggaguguaaagaacacacauguggccuugcugcugaggguggggccagcugcccggagcacaccgccaggcggaccucguggaggggcuggcgggcacuggccgggggucugugcaccgggaggugggugcccaucgagucaagccaagugcagaccugggggcuccuguuuucuaagacaggagcccccugccuccuuguguugucucuguggcaaaagaauucuauaggcgggcuucaaaugucggaccccaaaagaauuucuucuuuuucacucuucuaaaugaauggcucuuucauuauugagucucccuuuggcucuugugccgcagggcagacuaggauggaagugcccugugagcuggggggcccuucaaagggccaaggagaaaacgcaggccgagggaccagccuuccaaaugggcuucaagcuccaaugaccuccgcucgcccccucgaaaugucuggaaaacauaaugggcagauuuucugucuucaaaguuuccggcuaaaccucuucaaguucuuuauuguuugggacugagacacucagccauguuaauggguaguuucuuuuguauuugccuugaaaggccaaaauauuuuuauauugccacagacaaagccaccuauuuaaaaaugaacuccauguccgucguuucccaccaggagacuauguaccaugugugugucucuauguauucuggggucuugaaacagguuucucauggggauggucauucaccacgguccagaggggcagaacaggcggcgcuugccuugcccagggggccuggggaacgugggcccucaucucagaucugcccccaguauguuuaggacgcgagccccagaaggaucugggaguaaacuuaacauucacugugucucugcucugcauccgccauuuguguguguuucuggacugugggcuguguguaccuugguuggugacucagugagaagaagcaggaaugccaaagauacugugaauguucugaguuuuguugcuguuguuguugagagguuguuucacugguaucuauugcauuguauaauaaaugaccagaugaaugaaugagugaagcaagagagaaugaauaaacaaguaaauagguaaagaaguaagcaagccaggaugagaguguguguacacaagaccaugguucauccgcuuugauggcuaggcaaucaauauauaaauagaaaaaaaccagugaaucacuaaguaauagggcaacacacaaagcgauaucaggugauuauggacuaagggguauguguaacucaaauauaugccucugacauuugacaaugaaaaagaaccuaaaugaaagaaagaauggauguaugaguagugaagugcagaaugagacauagauuuugaggcccgucaaaaugaaaagaugcaaguuagggaacaagugaucaaaagggagaagggaaagguuuuuuuuaaaaaaccaaaacaacaaagaaagguuaaaaaaaaaaacagacuagaggaugaguaaugaguaacucuguaaggaggaccaugucagacuauuguaagcuaagcauuaggacugauacaaauaauauaugcuccuggcauagaaaaauaaaccacagagaacgaguucaaagaauagcaaagaaagaaagaggacccagugggcgaaagaugagaguguacuuuuaccaaaaguuaucuaagccugagcacuugaagucugcacauaaauaaauaaaugacaaaagaaagaaaaaaaggccaaaaagucuacauugcguguguggauggaugaaugagcagugggagugcagcgccaggugacaagauguugugagggguuuugagucauccaguccugggcacugaggucuguuagaugaaaggauaugagaaagguaauauugguaaauaaagaaauaggaaacaauguaacaaauguuaaguacagaaauacauuaaugggugguaaauaaagauguaaaagaaggcaaugcgaucgaugguggcaaaagaucaucacagauuaagggcuauggcugguccacuucuagaaaaccacaggcuguccauuaaauaaugaacaucuaagugaacaagucagugaguaccuaaauagacaaggaugaggugaaugagaagacauggccccauggguccuccugaugaggguguugggguccccccugggcaccccagcugcaugaaaaugaaggacaggagguauggaaagcuaugacagaagagagaaaggaacgguaaaaagaaauaacaaccaaauggauaaauggguagauccacgagaagaguuaggcuaggacuugucauaagggcaccugacuccacuaauagaggaauaaaugccuaauaaaaagagagcaagcaggaaggaaggaugcuaugaaugcaggaaggaaguaaugagugagacguggaaccgcacggccaaggauggacguuugcggguggcuuuuugaugcguacagccaagccacuccauggcaaugagcuccgaagacaaagugcaagagagaaugagugagagagugagagagagagaaacaauaaaaaaugggaagaaauguaaaaaggaagaaaggaagagagguaauauauuaaggaauaaauacaugcaugcagauuuaagacagagccaugcuagaacaggaaugaaaggcugugugaaccaagcagaccgcuuaauuggcaccagugcugcugguauggucaaucaccuacucaacuaaggaacggcucaaagcauacacaugggagggaggaguggggccacagagagagggcccauuaguugcagauuacgauguauccaguuaggugcaccugccuucgagaaguguaaaaauaaguauuuacauagaaagaaagacugaauggaugcacggugaaugcaugaaugauugaacgacagaaaagauuugcauugaccgaugaggagggcauuguagacagggaugagggucauugauccugggugcagaucuccaaaagaaugacagaaagaaagagggagugguggaaagaaacaauaggaugggaaaaaaugaaaauagaaaaaaggaagugaaagagauaauaaauaauuagaucaaauaaguugaugaaaggggacugguuuagcacaagccauccacauuaauucaaaccuguggcucugaaguuuguuuuuuaaaugaccacaaguguaagacugaaugaaagaauaaaugcgugcauuccauaggaugcaagaaaaggagugaggaaugggaaaauuggaagaacgagagagggagagauguaagaaaagaaaggaaaagugaaguaggcauaugaaagaaaaggcacuucuuggacaagcacugaaauauaaugagacaguuuuacccauuaaauauaauaaacaguaaacguugagguucaucaauaaaagcacagauaccugaauagaggagugaccugaauagaauucguucagccgaacgaaugagaauggaugauuuucacuauccugugcacucaaggcccaaaagagaaagcaagagaggagagaauauggaaacguaugacaggauguauauaagcaauacaaacauauugaaugaauaaauaaagacauaaauaugugggagaguggaccacgcaaggacaaaaagaggagagaaggcagcaagaauuaugacuaauucaaaacuggguuccugagauaguuaaauaaauccugcaccaaauccccagggggagaaauuaacaaacaaaagacagccccacacggaccagugugcagaaggcuccaggaaccgcagauuaugguuaauccaauucugugcaccugagguccauaaauaaaagaauaaguauugaaaugaaagaaugacagaaagaaugaauggacacaugaacgacugaauuagaaauggaaaugccuggcacagccaggaaggagcugcccaugggauugucauucaucucacucugggcaccugagguccauaagcgugaaaagaggcaggaagagaagugucagggagucaaagauagagcuaaggaaaggcaaaaaugaaacuaaaugaaagcgaaagggaaaauaaagaaaaaccaauaaaaaagagaacgaauacguggguguaucuguaagaguaggaucuguuaggauuagucauaagacugucaguaauccugaagauggaugagauaauccaggcccagguucccagggggagggaaaauggagaaaauauaaaaagaugugaaaaaggaaaaaggaaagguaauaaacaaacaaccaaagugauaaauggauaguuaagggagguugucugaacagggauuauaauuaguuuacauacauacuccuuaaacagauaaauacauuacaccuuucaaagaauaaaugaaaaauagagagacauaccuggcuccaaaacaaggcuguaucuucugccacuguaauaaaauagaugcaauugagguucauaaauaaaagaauaaauacuuaaacgugaaaggugacuaaaugcggggaagaaagauugcaaauaaauacaugggccaaagauguuugguuugcccauggaguuuuaauuaaaaaaauuaauaaggaaaacaaauacccaaaauaaggaagacugacaaaugagugaguggaugagagagugaauggugcuugacguaggagcaguagugcuuuagggaccagcaugaagguggugaccgggagcccugauucaugggauucuguccaccugacuuuauaagaaccaagaauggcugggaaugguggcucacgccuguaaucccagcacuuugggaggccgaggugggcggaucaugaggucaggaguuugagaccagccaguuugagaucagccuggccaacauggugaaauuccaucucuacuaaaaaaauacaaaaauuaugggcgugguggcaccugucuguaauccuagcuacucgggaggcugagagaggagaauugcuugaacccgggagguggagguuguagugagccaagauugcaccacugcacuccagccugggcuacagagcaagacacuaucuuagaucaaaaaagaaaaaaaaaaaaagaaggagaaagaaccagagaaacauaaggaagagugagaggaagaaagaaagaugcaauuugggaagaaaugaaaaagaaaugaauaaagaauaaaauaauguaacggucaauaaauaggacuugugaauggaggccuuuaggccaaaggcuaugauuaauuucaagcuauguuacugaaguccauaaacaaaggacucagaucuaaauggaugaacgaaugacuggaagaaagggugguaggaagguaggaagaaaggaaggagggaaaaagggaagagaggaaggaaccuucuuuccaguccuguguucuagacaguggaaugaagugguccccagggaggguggcuguaggcaugucaugugcuugucacaugcacuugcccuggcagggaggagcuggcucaggaagacccuggucuuggggugcuguugcccuaucuuggcugugugggccauuucacugcaucugucucuuccucaguuuccccaucuguaaaccuggaguggcaccagcugccuacuagaguugaucuuaugugucucuguugaugguaccccaucuauggccuggauaggcaggaagggcuuggacccugagccccgcagaagguugcaugaacgaguggugugaagccuguuggguagcuuggccacucccgcggcaugggucaccugcacaggagguuuugcccaccagggggcagcagagggucagggagcaauaggcccuggguggagcaugggccccgccugcugugugccacccuggguguggcaccuacucacauccagggguuggugcagggaaaggccagaagguggccaggcgcaccugagaagggggacccagaagccccgggacccaggagcccugggcaagccaccagaaaccuuguucuugcaacucucugcagugugcccaggccacccucuggccuggucuuccauggggcagggcgcccacccuucucaacucagguuucccugggcagcaggugcaccucagcaccccugggguugcagaagugguccggggacccuggcuuccuugacaugccauccccagagccugguucaaggccucucugucuucucggcuguuucacgacguguuuuguaacuuggcgggauugcguuucgcugugucgagguugucucuucucugacucgcccuccgggggacugccgggguaaaucuggagaguugcucgugcugacaguccucccccagggccuccccgguucuguugagucuccuuucucuguaguggaggaaauguguguaguuuuguguugugugccuguguuugucuguaaaagcaaggaccaaagucucccuuguugaccucucaauuccuauuugggacauauaaaaacacuggauucuuaacaagcgcccggagcaguaggagcacagcuuggauggacucaggacuuguggcagggagcacgugggaggcaggggagugggguggggccaggccaucuggagugggaggcgucaugcucagagugacucuguagacgcugggugggauggggagugcgggcgcaggcauggauggggcuguuagcuagugugaugcuugaggucugagcugauggcagcaaaguggggugcucaggaaucaaagcuaugggguuauagacaggauaugaaggagggagggaggcaagaagaagggggugguucccacgcuucuagcuccggccgaguggauggcaacagcauuuggaaggcggaggacauggaauucaugugucaggagccaccuuccgagccuccaguaccacgugucagggccacaugagcugggccucgugggccugauguggugcuggggccucaggggucugcucuucuucucuuucagaaucuggggcuccaggcuaugccuuggcuggacugaggucugggggugcacuuauuaucccuggggacaccugcugaagcuucucccugacaagcugugucacuguuggaugaggauggggcgggagggguucagggcagaagaagaccgggagggucuuucaaaagaacucauguacggcuguuaaaaaaagucagcagaggcucaggaagacuuaaagugugcagaaggcggggaagggagggcccauugcaugcaccaagaggaaauuggaaggaacaagcgacguuggcugcuaggagagccugcucccaacaucuaggggcuguccugacgggucacagugggucgaacugagccaaugagagcagcucuggggagacccacuggugcccuggaggcuggguggguuuggguuggaugaauucuguguguccuuuuggaaauguggaggccaugaggggggaucagggcucuuaggguuuugacccuuaagaguuuuguaucuguaauucaaagguucuuuaguucugggaugcugagauucgggauaggguuccuaauggcacaaaagccagagauaaaacauccuucacgugcucccuacccgguucuuucuguaccagacccacaagguccgaguugggauccuagugcuccugucuggucagggccuaucuuuauguguucguuaaacuuuuaacaaugagaauuaauucugucucuugacauugucauuugcaugcuccccacacacaaauccuuuccuggugacaccaggagcuacaacucuccuuggccuccucuugugacucccaacucccuccuugggaagcuuggccucaggaccucugggauagacaggccacgaauccugcugugucccguuguguuccuaauauaaaugguguggauggcacuugaccuagagcagugggaaaugcaugcaccacucaacauucugacaugucacccauuuuacauucuuacaggcauacuuuuuuuaaaaaaagagugucuauucuuuaaugagcaucccuucuuuaaaaaaaccuaauugccauuauucaccacauacacuuuuuuuuuuuuguauccugccucuucuauuuaauuuucugucaucaacauuuucccuuguuccaugaaucuucauaaccucacuugcugcguugugccuuguugaguggcuauggcaucauucacagaaccauucuguuauucuuauguauaaccaccuuuuaaaaauauuaugaauaaugccacaacuaacugcuuaaaacacccuuuuuuucauucuuaagaauuauguucuuccacccagaaauuaucauugcuucacuacagaucaguuuccccugcuagacugugagccccauaagggcaaggagcuuauugaauuggccuuuguaucucugaugcccaacauguuguagacuauaaauaaaugaugaaugaguggauggaagaauggaggaaggagcgagugagugaguguuuggcugauggauaagaggguggaaggauaggcggaaggauggauuggugaaugaaugaaugaauuuccuuugguuaagucucuugaaagaaaggcuauggaucuuuguauggauguugaauaauuucaguaagcuuacagcauuuuacaauguucagcaauguaugaccacuuaauuaagauauggcuaguuugucucuguuauaaaguacuuuugcauuacuuuaacuugcauugcuuuaauuacuaaugaugggugaacacuuugaccuauguuuguuaacaaauuguauuuuaucuucugugaacuguuuguccaaguccuuugggucauggcuuucugaagagacuggucccagauguccuugggauguagggagcccauagcucacuggaggcauucaaggaaccagccaggcagcccucagagaaaguaguguuuaggagauucucauggugugggguuggccuagguggccuuucaggucuguuugauguuaggauuugcuucucccugggaagugggugauggggaaaaagacaccuuccauuggcagguguagacacugcaggcuggaccuccugggugugcuuguggacuccgaucuugcccuugauaaaaccccugugggacaggaauagcucuuugaaccuccaagguccagacagccacauccuagcacccuguacaaucaguuaguggccuucccaccagcgcagucacucauuccuauuagaucccgaugaagccaggcccugggguuuccauuuucccaccucuuaggggaauuggguuccccgcguccugugauaugucagcaaauguccucagcccuggccugcacauguggccucagugguggucuuugggguuuaacugacgaauggaacauuuuggaucaggacugaugggagaaucuccuuucauuuuucuucaccuggggcaauuacauucuaaggagcggaauaaagggcauguucugcccaaagcaucagggcucacaggucagucacagccauuuagggagggcaugucacccaaggagggcucgcccuucuuuccagagcauccuccgcucucagcagagcugcuucugcccacccaucccucuacuauagcacugagcacuguuugcccgugucagaaucccucacccacauguuuagcuugguauccgaguuugggaggccggcaaugacuuucaacaugaauugcuccaucuacccauccaugcauuuggccuacuuaucuugaccccgugcuuuuggccuuuucuucuccugaaagcaaacccuuucauuuugggugggcuguguagcgccaugggcugugguuaugaagcaaacacccuuucuuguagcugccuccuccgggguuacugcccugagcacgucccagcuggaucucgucugccacugucacccauagcuucuuccccauggugcuuuccaugugucacacaccacgacugugacccagggucggggucaagaguagccuggggccaagcccucccacccaugagcggagaaguccuccccaggccucaccuugccuggcgcauggucccucccaugagcuuugcuuucagccuuucagcuuccuccacaggguggcagugguuguaacucauccauucaucccuucaucccuucauucauucacucacagccaacagacguuuuuaaaaaauuagccagugcuauacuagagcuggcucccaaggacccgcugccgcauugccuuuugaaacaaaacaaugaacacguugguaaaggggccgugcuugugugucggugacaaggcgagaucccugagucaggucaggcuuguagauucgaguucuguugcgaguuugauugccccucugacuuuguccccuguacaacuagguugauuaggaaucagccaacuguguucccugggugcucagaaaucacagcccauauccucgagaggccaaaaugagagccaggggguuccaagaugaguggcugcuucuggccgggagcagguuuucaagucauuagaacacucuggccuuuccuggaggugaucuuggagccauuccugccccuuucaagaggaguuaaugcccagcucuguuuagagaaaauugggggagaugauugcucaugugggugauaagaaucaccucccgugcaggggucugcauagaacacuccauaggcaaaccuggguguccaaggcacguggcauuuugcaaacucugggugcagcuccgagcuguccugcaggucccagaccaggugagaacucccugaguuccugcugccugggucgggggugaggcauaggucuuggggguucaaccuggaauucugaaugucauucauugcauuggagaggaaggagaguaggcaaagccaagacccuggaacuggacaaacucgugugguuuaaagucacugugagagcuggaguugagucugccuacgggggaggacugcggcaccuaccucgcagggcuguugugaggagcaauguaaccgugauuuugaacugugauucuggaagggcggugugcguguccccgggggugugccaggggagugaggagaaaaggccagggagacagccucacucaggcagcugagugggagagcauuuaucucuaaaccuggagggguauauggugggacaggaggaauuugggcaggaacuuucaugcuagggguuugggggacucgcuggacaaugccccuggaccccccggggguacgcguucacgcucaccucugagaggcuggaaacgccuggcugugcuuucugaaugcugugugcuuccugccucugugccuggccugugugcagcaccuacuuguguccgccuucaaaaggcccuucuggguggcguccuuuuccccaaaauauuaggcaccagccaucaaagauacugcauuguugccucccccaccccuccccccaacugacaacauuugggcucaaaugcagcaggcugggugcccaacacagugccuggcgagugguagcgcuuacguuucuuuucuguugaauggauggauagcuaaugaaauuguaaccaaugacaagccuugauguuuauaaccuuuacuaagagauuauuauuuugcucuucauggaccuguuaacaaccaccauauuguaucuuacggacguuuguaugccacguuugaagagcaggagccuuguuucggcgucauguugauggaacuugagcugucugaugcgaaucuguguuuuauguuagaaagcgcguagccuuaggaucuggcagacccaggggccacuuaauuaacccuuugccucuuugacccucaaucuccuuuucucuaagccauaggucaccugaaagccuaccucacagggcuguugugagggccgaggguggguguguuucaacagugugcagaugcuggcuuucccugggaaugggcauauguugggauuugucuugaaagcaugagugauggcuuuacuaguccuaagugaauaaaaagucagcccugaccuuacgcugggauugcauuucccacagucaguggcaugugcagaccacuggcagagcagccugcaggugcuuagcgaugugggcccagaguaaauauuuguuugauugaugagugauggcuuuuuccuuccucagaguuugcccugccccccauuccaacgugggcugcugcuucuccccagcggguuguagcuggcagggccguugugcuuugggguuugcuguaccugucgcugccgugaggggacgaucugucugcccggagggguuucugcaaacauucauguaugccccugcuuucguuuguuagggagaaggaguggggugaccuagagagaggaugaggaagggguucuggguggcauccuugggguaccaacccugcuuccauccugcgcucugaauuuccucacagcccuuuucugucucugguagaaggugcagaagguaggcuuugccaccuucccugggccuggcaccaagcucgggggucuuguacacacuuucccuucucuaacuggggugugggcccauuuccuagaugagcuugcugagaaucaggacagcugguaucagagccaggacuucccagucuugcacaaacaaccugugcauuuuugaguccaccaaauaaggccuccugccugguccggcucaccccugccagcccccagcaaaugcagccuggugcguccccaccccugccaagagcccaggagugcucuggcagagaagugcagggaugaggaaggaggcugugcccuccaggggacucagcugcguuagaggaggugcugcugcaguggcaggggucuccagacaucccacgcagggguccuuucagaucaggcaucucuucaccagaccaccguauuccuuuuucagcccucgucucuugcacgugggggugcaguguuuggcucucacauccccacauuccagcugguggggguuugagcuggguguuccuucugcuccccacuccccacucacggcccccaccccacgcaagccucccuugcccccacucuuugucuccagcuuucacagccuuggcgggcaggcugcugcgccuguugcugccccggcucucuuccacccgccucuucuuucucagccugagcuuuaccgugaggucugggcgccacaccuuggccccugccaugccugcucccagaagcacccacguggguccccugauucucuccuccccugggcuuugcuaaggagcccuuucauuguggccuuuggugucugccucaugcccauccccuguucuugagaacuuggaagcagagggggccccuccuauugcucccaagaggcuccacaguagggagccccucccaggagauucugagucuguguuuaggugucgauuccugggugggccuugggguccccucaggccaggccugugugugaccuaaggcuggggggcucugucaggcaccuagugucccuuggaggugggcggggcuggguccuggucuccugaggacggguggggagacaggcucagggagauuuccacgaagcugcccuugaaccccuccucugaggcccacacugcccuggcccuuuacacccugccuccugcacuaguaggcacauaauagaugcucgccaccuguggagggcaggguuuaaauggcuggaaagagcugagugggcuguuuggcuagcguacgcgcauuuguuuaaaaggaaaggguguguuucuuggcaaagacucuucggaggaaacgcugaacuggggaugggucucuaccuguucuggggccucacugcccuuccugccggggacaggcagucacugguggguuuccccccaguggaaacacaauauuuuggaaauauuuguaucuaggauaaaacuucaucuggaccaacaugucuuuguugguguuguggcccaggugauuuugagaauguagaauacauuuggcaauuuccaaacggagugaugaccugcuccuccgccccccaugcccucccugaggcuggaggcuucagaagccccugccuugggaggaggcuguucuaccugagaagucuuuguccccaccguuggugacaaucagcauugaccugugaggcaccugccagguucgggacgcagcuuuagacauccagaaaaccggggguggagggguggggugggggcuuaagaccccagagcuugauuccuuuuaacugucucauccccaaagaaugguacauggguaccagguagguuacuugaaucacccugagccucgauuuucccacccguuagaaacaggguaauucaugacaguguccgcuugggagacggcugugaccccugagaauucucgcugcaugccgugggcuggcucgugagacucaaggucuggguucgaggcccccgcaaccccuucugacuguguggccugggcgaguuuguuguuuguaaccuggaaagcgucacaccugccuggcacgguuauugugggcuucaaugagauuguuugugugaaauaaacgcuuugugacuggcacacaggcgcucucaucccggcucuccuggugggcccggaccgcugggugcuggcugcggaggcccugugcucccuggaacugucugcgcuggucccagggacucuugggcagaguggagggcaagggggaaagcaccagccugcucuggggagacaguggcagagggaaguguuugcuuuuaaauacacucagcagguucagacaggagaggauccgaggggaaauguuuagagcccucaggaggaggaagagaccgaguuuuaggaaaaacaucaaagcuggauagguugggcagaagagcuggggauagcauuuagagaggcugagaguccuggguucuggguuaucaaggugagagaaaccagagguugccaguuguaggugggcgucaggacuagagugaugcuuccagaaguuucugcaagugggccgagucuaagguagggcaggguacgccagaaguugaggggcacuagguagacaggccgagcugguggcugggugcuccccucacccuccaugcugcuaggagcccgugagcagggacuugcucuccucucccucccuccuggggccugccugucugucugugaacucuugucggccagcgaggccgggagcagguggccuucaucugcaacugugucucucucagccuccacagccacggggacacccugcaccuauucccacgggacaggcuggacccagagacucuggacccggggccuccccuugaguagagacccgcccucugacugauggacgccgcugaccuggggucagacccgugggcuggaccccugcccaccccgcaggaacccugaggccuaggggagcuguugagccuucagugucugcaugugggaagugggcuccuucaccuaccucacagggcuguugugaggggcgcugugaugcgguuccaaagcacagggcuuggcgcaccccacugugcucucaauaaauguguuuccugucuuaacaaaaac

SEQ ID NO: 17153 - RNA, 4300 nt, Homo sapiens
ggcuggcgcugggucucugaggacuggguaguccguuagcacagguggcauugcugguugaugaguugaagaaguuguugcccuucacaaguggguuccucuugggucaggaguggcaggaagggaagcgaagcaggcugaggcgcggggaggccaggggacgucgggagguguuggggugagaaauagaggggacucuuugcuggagacagggaggcgucuucagucgagguuagcaucuucguccucaucaggcagcucuucuagccuugccugcucccugggcuggcucucccaggcggggaugggcagggcccgccuguagaucagggucaggaacuggcucagggcccuggcugccugcucccggcugagcaggugcagcuggccaucugcacuguggauguggagcaggcggcuaccaaggaauuccaggaccuggggauccaucagguggcgugggcgggguggguggguggcugcuguguggcuggguggggccuccugcacgucguuguccugcuuguccugcgaggugucuugcaggccgucaugcaggccacacugacgguaacguugcaggucgucuugcagggcuucucgcaagacgacauccucaucaccaacgacgugcagcuccagguagcgguucugacgcagggcagggagguggcccuccuggggggugacucugacaccgaagaacucacacagcgucagccagaagccaggggugaacugcaggccucggugggccugggagugcagagcauuucgcugccagcggccagggcccaggaacagcucagccagcuccugggcugggaugguguuugcaccuacgagagcgggcaucugggugagcagcugggugauggcugucgugaugcugcugccugcgaugagggacgaauccaggaugagucguagggagcgcuggggcuggggccgagccacccgcauggcgggugccggccgcagcgagaggcauugccucacgcgcaguagcacgaggauggcugccagggcuaggguguucuuccaguacaggaggccucggaagaagugcagaaugacggcccugaucugggccaugcugaagugggcgaggaagcuguugaggaucuggucgauggguaucauggccagcagcucuugccguaggaucuguucauugagcucauccuguucuucauucucuucuuccccggauuccgucgauggaucccuggggaauccccuugaggccagcagcaggguuugccuggcggcaguguuccucuggaaggcucuccuccaccggagguuucucacagguggcagagcucggccgccgucuuguucuggcagcuccaugacgucaaaguugaagugggagaagaagaagacccaaugcccggggagaaguacggugagccugucauuauucagagaggcuagauccucuguguugagaaggaucaugaugggcuccucgguguucuccagguagcggcaccacaccaugaaggcagcccguauuggaagaaucuucaucuccgcuugagaguacucaaccucgauaggggagauguugcgggaguagaaagcgcagcaggcucucuugccgguuuggucgucgauuuggaucagggaggcgugcagggccgugccggugacgccgguuuccaaguagaauggguucuggggcuuggggugguggaggagaggcgccuugcggaaagcccucuucaggcacucgaaggccucuugcuccucgacuccccaguagaacugguaggagcucagcagcugccgcaccaggggcucugcgaugaugcugaagcgcuccacgaaguggcgguaggggaagacgaauucgaugaaguuucgcagagauagcuuggagccagggguaggguacccuguuaugauggucaugacguucuuguucaguuucaccccuuugggggugacgacgaagcccaggaauuccacgguuuggcgguggaacuggcucuuguccagggagcaguagacguugugauggcggaagcggaccaggacuuggcggacgugguggaggugcuccuccugacucauugaguagaucaggacuuccuggccauaagaaagcacaaagaacccuagcauguccuuuaggaugaagugaaucacguucugagguaugauagggucuggggagagcgcaaacggcugguagcucuucaucucuucaagcuccaaaccaaacgcugcuuuccacacaucuucggugcggugcccguucacgcuuuccuccacaauggucccacgcagcuccaguuuugugaaccacucggcuccguguaacuggucaaacaguuccggaaucaucuguauguaguccugucuguuggucagcauguccugcaggucccaguauuccuccuguagccuggcucuuucuugcauccuggcacccacagguucccaaggcgcgguggagggacacucguaaaaggucucgcugugaucacugucuccagccugcugaagcucagagggcucugauucagaaagaucaucggauccgucugagcuuggcuggucggaagucucaucaucugcuuccuucggguuaaacacgucggccaggucugaguauggguguggcaguccggguagcaggcucaugccgugccucucuagggcaaugcauggcgggggcgggcggaagcaguucuucaggcaguagggagaguggaaggugcagcggccuuugauccagucgacuucgggggcguggacucggagccagcggaugccuaggaccacagagaaguucggugaagguacgaugucaaauucgauggacuccuggugguucugguggauacacaccaggggcuccguguagagccagacaggcucguugccaaucagcgagccguccacggauuggaccggcuguggguacggcuucucguagagcucgacguagugcucuugggcgaacuucucauccaugaaguugccgucagcucccgaauccaccagggccuggaccgcgacgcugugguagggguucacucucaccaugagcagcaggaagaggugggcgcgauugauguccggauggacuucgcugggcaaccagcugcugaccauccaccucucuggagcaggugagucgauccaggucagguuccgggggcgggccucggggggcagccugagcauagcucuucucucugccagcuucucuucuauuugcaggaugagcacaaucagacugucuagggaauccggcugagggacccggaauagauagugccugaucuccucguugagccccuggcacaagugggccugcaggacuucaucuggccagcccaagauggguaccaggcucuggaacucaucgauguacucaguggcagagcggccgcccugccugauggugaacauggccucuucugccacacgcagugccuggcgguacucaaacacuucggacauggccuccaggaaggcugggaagucuccgaucagggggcuguuuuccugcaguagagcuuuggcccauucuaaugccaagccggacaggugauugaugacauagccaacucucagacggucguuauagaacauucuuggguagcucuguaaggucaguuggcagaguacgaugaacucguggaauucucugcgaucgccagagaagugcuuuggggcgggcaguuggccugcauugaucccuuugaucaagaucucuucugcuacucucuguugcucuuugaggucuugcauucggaaguacagcgagaugauggaccucaccauggccauaaguucugcgguugagugcucggucugguuuugcucuugaggagucuccucccuucccgauuccuucaggucagugugagccucuuguucuucucgggcucccgauggguugacugaugcuucuuucauccuaucagaugcuccacugaguggauccccccuugccuggugugaaccguugcaugacuccuccaggucuuggaguaggucauuggguggauccucuauuuccuuacgugggccacuggauggcuccuccaugucuuggaguagaucagugggcagcucuuccauuuccuggagugggccacuggggggcuccuucuuuuccugggcugggccgcuggcuggcccugccucuccccgcacuccacugcccgacgucgccucggugguguuggaugagcccucggaggacuccauuuguuuugaugauggauucuuaugcuccaucaucgucucaaaugagucuucagaggguucuaucauu

SEQ ID NO: 17154 - RNA, 4300 nt, Homo sapiens
aaugauagaacccucugaagacucauuugagacgaugauggagcauaagaauccaucaucaaaacaaauggaguccuccgagggcucauccaacaccaccgaggcgacgucgggcaguggagugcggggagaggcagggccagccagcggcccagcccaggaaaagaaggagccccccaguggcccacuccaggaaauggaagagcugcccacugaucuacuccaagacauggaggagccauccaguggcccacguaaggaaauagaggauccacccaaugaccuacuccaagaccuggaggagucaugcaacgguucacaccaggcaaggggggauccacucaguggagcaucugauaggaugaaagaagcaucagucaacccaucgggagcccgagaagaacaagaggcucacacugaccugaaggaaucgggaagggaggagacuccucaagagcaaaaccagaccgagcacucaaccgcagaacuuauggccauggugagguccaucaucucgcuguacuuccgaaugcaagaccucaaagagcaacagagaguagcagaagagaucuugaucaaagggaucaaugcaggccaacugcccgccccaaagcacuucucuggcgaucgcagagaauuccacgaguucaucguacucugccaacugaccuuacagagcuacccaagaauguucuauaacgaccgucugagaguuggcuaugucaucaaucaccuguccggcuuggcauuagaaugggccaaagcucuacugcaggaaaacagcccccugaucggagacuucccagccuuccuggaggccauguccgaaguguuugaguaccgccaggcacugcguguggcagaagaggccauguucaccaucaggcagggcggccgcucugccacugaguacaucgaugaguuccagagccugguacccaucuugggcuggccagaugaaguccugcaggcccacuugugccaggggcucaacgaggagaucaggcacuaucuauuccgggucccucagccggauucccuagacagucugauugugcucauccugcaaauagaagagaagcuggcagagagaagagcuaugcucaggcugccccccgaggcccgcccccggaaccugaccuggaucgacucaccugcuccagagagguggauggucagcagcugguugcccagcgaaguccauccggacaucaaucgcgcccaccucuuccugcugcucauggugagagugaaccccuaccacagcgucgcgguccaggcccugguggauucgggagcugacggcaacuucauggaugagaaguucgcccaagagcacuacgucgagcucuacgagaagccguacccacagccgguccaauccguggacggcucgcugauuggcaacgagccugucuggcucuacacggagccccugguguguauccaccagaaccaccaggaguccaucgaauuugacaucguaccuucaccgaacuucucugugguccuaggcauccgcuggcuccgaguccacgcccccgaagucgacuggaucaaaggccgcugcaccuuccacucucccuacugccugaagaacugcuuccgcccgcccccgccaugcauugcccuagagaggcacggcaugagccugcuacccggacugccacacccauacucagaccuggccgacguguuuaacccgaaggaagcagaugaugagacuuccgaccagccaagcucagacggauccgaugaucuuucugaaucagagcccucugagcuucagcaggcuggagacagugaucacagcgagaccuuuuacgagugucccuccaccgcgccuugggaaccugugggugccaggaugcaagaaagagccaggcuacaggaggaauacugggaccugcaggacaugcugaccaacagacaggacuacauacagaugauuccggaacuguuugaccaguuacacggagccgagugguucacaaaacuggagcugcgugggaccauuguggaggaaagcgugaacgggcaccgcaccgaagauguguggaaagcagcguuugguuuggagcuugaagagaugaagagcuaccagccguuugcgcucuccccagacccuaucauaccucagaacgugauucacuucauccuaaaggacaugcuaggguucuuugugcuuucuuauggccaggaaguccugaucuacucaaugagucaggaggagcaccuccaccacguccgccaaguccugguccgcuuccgccaucacaacgucuacugcucccuggacaagagccaguuccaccgccaaaccguggaauuccugggcuucgucgucacccccaaaggggugaaacugaacaagaacgucaugaccaucauaacaggguacccuaccccuggcuccaagcuaucucugcgaaacuucaucgaauucgucuuccccuaccgccacuucguggagcgcuucagcaucaucgcagagccccuggugcggcagcugcugagcuccuaccaguucuacuggggagucgaggagcaagaggccuucgagugccugaagagggcuuuccgcaaggcgccucuccuccaccaccccaagccccagaacccauucuacuuggaaaccggcgucaccggcacggcccugcacgccucccugauccaaaucgacgaccaaaccggcaagagagccugcugcgcuuucuacucccgcaacaucuccccuaucgagguugaguacucucaagcggagaugaagauucuuccaauacgggcugccuucaugguguggugccgcuaccuggagaacaccgaggagcccaucaugauccuucucaacacagaggaucuagccucucugaauaaugacaggcucaccguacuucuccccgggcauugggucuucuucuucucccacuucaacuuugacgucauggagcugccagaacaagacggcggccgagcucugccaccugugagaaaccuccgguggaggagagccuuccagaggaacacugccgccaggcaaacccugcugcuggccucaaggggauuccccagggauccaucgacggaauccggggaagaagagaaugaagaacaggaugagcucaaugaacagauccuacggcaagagcugcuggccaugauacccaucgaccagauccucaacagcuuccucgcccacuucagcauggcccagaucagggccgucauucugcacuucuuccgaggccuccuguacuggaagaacacccuagcccuggcagccauccucgugcuacugcgcgugaggcaaugccucucgcugcggccggcacccgccaugcggguggcucggccccagccccagcgcucccuacgacucauccuggauucgucccucaucgcaggcagcagcaucacgacagccaucacccagcugcucacccagaugcccgcucucguaggugcaaacaccaucccagcccaggagcuggcugagcuguuccugggcccuggccgcuggcagcgaaaugcucugcacucccaggcccaccgaggccugcaguucaccccuggcuucuggcugacgcugugugaguucuucggugucagagucaccccccaggagggccaccucccugcccugcgucagaaccgcuaccuggagcugcacgucguuggugaugaggaugucgucuugcgagaagcccugcaagacgaccugcaacguuaccgucaguguggccugcaugacggccugcaagacaccucgcaggacaagcaggacaacgacgugcaggaggccccacccagccacacagcagccacccacccaccccgcccacgccaccugauggauccccagguccuggaauuccuugguagccgccugcuccacauccacagugcagauggccagcugcaccugcucagccgggagcaggcagccagggcccugagccaguuccugacccugaucuacaggcgggcccugcccauccccgccugggagagccagcccagggagcaggcaaggcuagaagagcugccugaugaggacgaagaugcuaaccucgacugaagacgccucccugucuccagcaaagaguccccucuauuucucaccccaacaccucccgacguccccuggccuccccgcgccucagccugcuucgcuucccuuccugccacuccugacccaagaggaacccacuugugaagggcaacaacuucuucaacucaucaaccagcaaugccaccugugcuaacggacuacccaguccucagagacccagcgccagcc

SEQ ID NO: 17155 - RNA, 3633 nt, Homo sapiens
cagaggguucuaucauuucgucggauggaaaggaguguauucugaagauugguaagguugugauggcguccagucaguagcugggaccguggagaucagaaccuggugguggaaggggaguguggggaguaaaggcaguaguuuaggaucuugugaaguggcaguaucagggucucaaggacaaaucagaugcccaacuaaucagagcagagagaaaugggggaaagccuucuuguaucgagccagccucuuuggcuggucacuuggggugcccccagggagggaagaucugucaaccccugaccugccucccaggcuuauucagucugccuguccuguccuuuuccuccauagaugugagaaauucacagcccauaaauucuguggcugggagcagccaccguggcaggcggguaccuggcagggugcacaggcugcuccauuccccccuggcacaugcaccuggucaauccucuuuuccugcuuuggucaccugagaaucacagaggucacaucucagcaccauccaaagccaccccuggcaggcucagggcucuggagcaagcccagccaccuugguuguggagcgggaaucucuagcaaagaugccuacuguuucaccagugcaguggaagaggagaaaaugggcacuuggccacugucccgucaguugggucagcagcccaaaauaguucuuauuuccuuccccauguucaaaauagaaauuucaggggguguguacaggucuggguuuuuuuuuuuuuuuuccauaaauuuuauaacauaccuacuaugugcuggauaacugcauauuuguuacuugauucuaacucagacuuuuggccaauuucucuuucucgauuuggucuccuuccaaugcuauguucucccgaccucugagcuguugaggagaucuucaaauaaucuccuucucuuccuacaaucuccacucucccaggacugcccucuuugugaggcuucuggaacuucacacaucuggccucaauuucaccagugcaagcauaucugcacgccucuccaaucuuauccucccagguccccuucuuaacgccagugggucuggucuccucuuucuagcaaauaucuuuuucucucuguugcugguugagcccucccaacagacauguaucuggcagaguugggacauugaguguggggguuggggggaacaugugacaucuuuggaaucugacggucccagaguggauuuuuggaaaucuaguguugggugguuuuagugggcugagacagaauugaaagggaaugucuugguugggguuauuugcacauuucuucucugcuggggcagagcaaauuaagcuuugauuaucugauagauuaacuguaaagcuacugcucuuuauaaauuuaacaccuuuuguuacuucugaguuuucuucuaagccacuggacccauccguaaaaaaaaaaaaaaaaacugcguucccccuuacgugaaacucauuggcuaaaauccaagcuuuccaacaggauacaaaauucagaucugcuguuucucaaaauuaaguacacccuuguuagcaugacacuuaaauuugaucaugcagucucucugauuaaagccuuccacuguuuauuuacugucugcaauauuaaauccaaaccuucuagcguaaacauaucugacauguaaacucaccaaaacuauucucugguuaaaauguaagggccuuaauauaauauaaaauucuuauuuugucauuccucaagguagagaucacauuuuuuuaaagcacaguauacaaaucagcaugguauaggaauuauaagaaucaucaucaucaucaucaugauguacauagcacauugcagaaauuaacucauuuccucuccauaaaaguccucugagauaugcauuauuacuguaaaauuccaaaccucuaauauaaaauucuaauugaaauacaaauaaauaauucuaauugaaauacaaaaacuaaguaauucaucugcagacuuaucuaucaggaauaaaaaucucagcaugucucucacuuaaaacucuuuauuggugaaaauuuaaauuucuuagcaagacgauuuaaaaacuagauuaugcccccucuuaauauaaagucuacacugcuuaacauauuuacaaauucgaccaugugaaugauuaaauccuucaauguuccugccuucagcucaaaaucuaauauccucggcauguuagaaaaaucuuaauacuucuuaacaucaaaguuuaaacuguuagcaagaugaauaaaggucaucucauaauuucucuauuuaacacauauaaaaauucauuuuuauugccuguaaaguuucaaccacuuagcauaaaaugaaaauuuucaccguguaauuuacuugccaacugauuaauacgaacccccaaaucucaucaggucacuccuaaaacccuuuauuggcuuaauuccaaaccucuucgcaugauauaaaauucugaccaugucauuccucaaaauaaaaaggucacucucccuugcaagauacacgaauuugcucuuauaacuucugcuuaaagcuuuauucuaucucuuaauuaccuaugagauaaggucuaauuauuuuuagcauagaacaauacauuuuacuauaaaauuucucugacuacucuacccaagacaaaauuucugccauguuacugccuuaaaaaucucuuaaugagccaggcacggugacucacagcuguaaucccagcacuuugggaggccaaggcagguggaacacuugaggucaaggguucuaggucagccuggccaacauggugaaauccuguuucuacuaaaaauacaaaaauuagccgggaguaguggcucaugcccguaauccuagcuacuucuccuaggcugaggcgggagaaucgcuugaaccuuggagguugcagugagccgagauugcgccgcugcacuccagcuugggcaacagagggagauucccucucaaaaaaaaaacaagacucuuaauggcugaaguccaaauuccuuagcauggcauaaaaauguaauucugucaucccucaaaauaguguccaaacuucuuagcaugcuauguaaauuuaaucauauaacuucuuuuuauaaaaacaugcuuugucuauaaaugacccgucuccucagcauggagcccagccugggugcccuugugcccaggggauaccucugcucacgaguggucugaugcuuauucauuaucugguucagcaaauccagauaccuuaacuuaaaauauguuuacaauccaguuucucuggagacaaaacccucaucaauuuacuucuuaaaacgcuuuacuggcugacauccgaacgccucugcaugagauuucaacaaugagcucaaugagcucaucccccaccccuuccaaacacagcacuugaaugccuucaacucuuuuguaaaaucacaucuccuuagcaugugagcaaaaucugaucauaucaucuuuaucauagagauccugucuuauagcugugccaaaaugcacuuguuugagcauguaacuucucaacuuaaaacuucucgagguuucuucauugccuguaacauaaagucccaacuacuuaacacaaaaugcgacauuuuaccauguaguuucucu

SEQ ID NO: 17156 - RNA, 1641 nt, Homo sapiens
gcagcucccucugcugccuggccugcuguggccuccuguggauggaaggcacagcgucacagugaggguggacaugcagggacccugggaggguuuguuauuauuuaucgauuauuauuauuauuuauuuuguugaacucgugucaagguuaagauguguccauggcagcuugaggcuuggaagccuuccugguuucccugguaugaacaagugucaaggauggcucacuugaugggacuuggugaggaggcuggugagauuccugggggcuuccugagggccucauaaggaguuuggguuggguccuggggaucccaguggacuguggagucugcaggggcugcuggccuggcauagcuuauguuggagucccuccccccgggacccuucaaucuugcacaccccugacuuguggcuaaagacgacuugagccuuacagggugggaggccguuggcaucucggcccagggcagcccagucucggacauucccucucuuccccuauggucuggaccgagguccuugaaugccaggccccaugggccucggacuucaucguagugauggggaaacugagucuuuggaaggaggaacagggaguuacaguagaacuacgcuguccccagggcgugucuaaaucccaaaccacccagcagggugggggucuucuguagagggacccccagccccucaccuugcuaagccacugaggugacagggagugccugggcccagcagcgcuccugcugcugugucccugcccccucuaugcuugacuggcagcuccagggggcagcuguaucacucugcccagaauaacccugggaaggggcgugugccgccugcgggaggggcugugcgaggggucacgggugagcuuguccuucuugucuugcccaaaucagcggggccaaucagcugcuccugaggcugaucuugccuuucaaggcaagugggcagggacaggucugcaccggccuccuagccuagaugggcucugacugucaacaugaccuuccucucccagguccucaguuuccccaugucugcagggaggguuucggugguggucuucucacugugcuccuguagcucugggguuccuaagaggugccugcgggggucccugggaaacaguaaugagaggagguggcuggcccaacagguggagcucagggacacccauugcugccuuaguuccaccagcugcuccuauaaauuggggucgucguauuauuucauuuaaacagagguugccagaucugagcaaugguugaaagcacagacuauguggucucuucuaauggcuugucuugauuuuccaaccugggcugggagggguguaagaguggaaccugcucaucucuggugggcucucuacucucacccagugggcugcauggacaagcccagguggcugcaggccuaggaguggagcuguucuuagaguaggaaggugaagacuuugaggcaaacaaggagggccccaccucagggccugguggaacuagaaugagggcagaaggcagaugagaggcuggcuaaccuugcagaaccucaguuucuaaggggaugauuagaaagguaggagcaccuccuuccagggaagacgggugugugaagcccuuuguaaacuguaa

SEQ ID NO: 17157 - RNA, 2330 nt, Homo sapiens
auuaauugacaguuuuauaagguuccacacaauauccauaaagaauguuuuuaacuuuacaauaucacuacaguucaucugaaagaauauacaaauaagacuaacggagaaaaucuugaaaaauaagaauuaaggaagacuauugcuacugaguaauaacacauuuuaacaauacaauauacuaaaauaaagcaaugacaaagcaauggauaauagaaaaccagaacaagaacccgagcuauaaaaguaucuagcauguauuaaauguggaaguggaacaaauaguuauuucucacaauaauuaagaugauaaguaaagauucaaauauaaaagaugaaaucaugaaagaacuaaaaaaaaaauuaaaguucaguuugggaaaggacuuucugagcuaaaagaaaaauucaagugaagaaacuguaaggaaaaauuaaagauaaauuuuuagaacauaguaauuuuuaaaauaaaaaauaauuuaucaacaaaaugaaauggcagaugaaaaagugggggauccugguaacauaugauauaaaaagaguuacuauucuuguuaaaaaggccuuacaaaaucaaaauuaaaaaugaacacaccuacagagcaacauggguaaacgauuuccaguucuaagugguaaacugaacaaagcuugccugcucugcagggagaaaaaaguuucaaaagaccuauuauuaauauuaucagagauauuaaagaagcaauugcauucauaaaacaaauuguuauauaauauuuagaauauaauuuaaaaauuaaaaauuagaaauaugaaagcagaaaugaaaauaaguuaaaacauaaagauagggaaauccuucuuagaaacagaacaugaauauuaaaaguugaaaaucaaaggaaaaauaugggaauauuacaaaacuagucaggaguuccaacauacaaacaauagaaaugcuaggaagagagaggcugggcacgguggcucaugccuguaaucccagcacuuugggaggccaagguggguggaucacuugaggucaggaguucaagaccagccuggccaacaugaugaaaccccaucucuaccaaaaauacacauauuagccaggcgugguggcacacgccuguaauccuagcuacuugggaggcugaggcaggagaauugcuugagacuaggaggcagagguugcagugggccaagaucaugccacuacacuccugccugggcaacagagugaaacuccaucaaaaaaaaaaaaaaagaaagaaagaaagaaaagagaaagaaaagaaaagaaaaugcuaagaagagaaaacaaaugugaggaaaugauccaaccaguuguucaagacaaguuucuagaacugaaggacaaguaucuucaagguuaaaagaaccuggaaaaauggauaaacauagauacacaucaagacacaaacacaugaaauuuuaaaacacuggaagacaaugagaaaguucuacaaguuccagaaaggaagaaaaaaaaaucacauagaagggaugaggaaucacaaagacuuaagacaucucaccaauaacacugaaagccacaagauaaugauuugugcuuucaaaaucugagccaaaauaaacaaagguuuccaacuucgaauucuauacccagccaaccuuucaaugucagugugggcuagacauuuuccuuuuuagaugugaaagaucucuaaaaauuuaccuuccauuaagcauuucuacagaaacugcuagaggaugcacucuagcaaaacaaaggaguaaaucaaaaagaaugaaaacauggaaucuacaaaaguagguaaucuacaaaauccagcuaaggagagaggaucaaaggaauccucagaaggagaaugugaaagagauuccaagaugguauccagaacccuaaagauuacccaguucauaacaaaaccagccagaaggcucuaggaagauacuucuagauaggauaaaacauaucuuuuaaaaaauuaaaaauaauguguuugaauauauugagaggcuagggauaaaucagcuaggcuccuaaaaaaaauuaaccaaucaaagagaaaaaaauacaaguauuaacuccaagagaaaaauaauagucaugaaggaaagguaaauuguagugcuguguugcucagauuucaggaaugcuuacacucucauaaaaagaugaacucucaauuuggaucaaacccgaacuauguacuaaauauauugaggauggugcacagaaggaagggaggagggggcggugaggccaaggagucaaauccucaucuucuacaguuguaaagucacgauaaugccuaagccucaaaaaagaaaaa

SEQ ID NO: 17158 - RNA, 47312 nt, Homo sapiens
cauggucuacuucuucucaauaucacaucucgccuuggaagacuuccaggaggugauaucagcuuugcggaagagccacuguccuggugucaguacggcugcugcuugguacuuggagagaggugguccguggcgcguucgcuuuauuuauggcgcacauuacacggucgaccucuuugcaguaucuaaucccgccuugcaagcuuuccuggagcuaacaucaacugcgggggugggggccacuaggucugcgcucagugugacccagcgggguuugugauguguuugucuugugugugacgauaacucacguguggcagccuucuucucagcacacugcucuggcuuggcagcaggguuaacuugcggacaaggagcguggugucagcacgugccuggauacaugagaugguugaccagagagcacacgcuuuauuugugccguuugugaccugguccacuaacccucaguaucuaaugcccccuuggagaacuuccuggaagaggugucaacuuuuugggaaagagacaguaaacuggggccagcugcacucuguuagacucugaagagagcaucugcgaggcguuugcgacauguaugccaaauguggcugaguuggacugauuuucacuccgaucucuuuccuuggagggcuuccuagauguggaggcauccaaguucaagggaaggggcaugcugucuauaccaucccaaaguccuccagugaucagcugaccugaguguaugcacuuuaauuuacaaccaaggucgccuggcccgucacaccucagucuccacuggguccuuagcaggaccuuugguggagucagccuugcuuuggggcaucugugccucucuugaguaacugagaaaagauggcccuggagguuaacccuaaacgcgauagcugcugugaccagccuuuuuauggcaucaccaccucuggcugugaugucaacuuccagacgugauguggggucugcuccacugggguacuuggauagaugguuggcaagcagcaugcauccaacucuuggcuucuuccggcaaaucaacuaacuaacgcucagugugcaauuccauauuuaacaggacuuccagcacugaaugucaagucuggggaagaaucagugguguucuugucaguguuaaucagugguaccugaagagagguuuucuggguuucuguuucuuuaaugaggacgaaacacaccugguuaaccucuuuuccaguaucaaaucccaucuuggaggccuucugguccagaccucagcuucagggaagggcguuacucucagcuccaguccacuggacagaaaucuaugguuaaccacgaagccugugcuguauuauuuugacugaugucaucuguucuacuaaccccaguguccaauccguauuuaacaggacuuccaggacugaaugucaaguuuggggaaggaaucagugguguucuugucaguguuacuuggugguaccugaagagagguuuucuggguuucuguuucuuuauugaggacgaaacacaccugguuaaccucuuuuccaguaucaaaucccaucuuggaggccuucugguccagaccucagcuucagggaaggggugcuguggacauaaauaaggagacacgagcaaauggcugaucacuaagcgugccccauguuucugaauuuugccaccgauugcgcuaacccucaaugucuuaucccuucuuaggaggacuuuucaaugugauggcagccugggggaagacagugucaccacgacagugucacggaacaugcaggugaguugucugugguugccuucguugugcucccaacggaucguguguguaauucaggcucuuucggcaucugacccugcuguagggggaugccucguccuugccacacucagugaugggcuugaaugagcccagcccacagcaggggaaugccagcaugcccuggacagauagugcagguguccugcacgccugccccuagccugcaguuuauucugaaaggauguccuggauauaaugacaccuuagggaagaaaagcugauucugaggucaagaggagaccuugggggcccuggaauuggcccagguugagaccuguuuauuucucacaggaauuguggaguugacuuccuuuaaaucuggaggaauccuugaugucaugccagcuugaagggagggcauugucaccagcccugauccaggggaagggaguggauggcccaccacggggcauguaccuccccaggaacacaccugcuccacugaccagcacaucugaccuacccucaggguuguguuucugcagaugguccuucuuuggggugcucaaggagagguuuccuuuggcauaucuguuucuuuuauauaaaucauuucuguggaccacucuucaguaucaaacaccaguuuggaaggcuuccggauaagacaguugucaggcccaggccagggugagugggccgagaugggugcuuccccuguucuaagcguccugucuggcaguaaugcuuggugcccgauccuuuccaggaggacuuccuggaggugaugccagccucuggggaaggaaaaggcucccugccagcucuaaagccaaggcacagaaguagguuuugcuggugcugcauuuguuuugauggcacuuagcugugacuguggguccucggcucaucuguggcauuuggggaugggacugugagggaggagggccucagguucuggagaagggccagguauuuccaugucaacccugcuuuuuauaaccagagagaacauaugagguagcaccaaugaccuccgccaccaauccuuccuauuagcugauacccaaacaccguuccuuccagccgaaaagagcccucauaaagagagggcagagagagugugucaaggccaugugacagcaggcaguaugcuguugccuccgggguauccaggguaggcggcugcuggguccauguagauugggugcucugcuggcuacggaggggucaaaggacagguggcaagggugcagagccgcagccuggcccugggauuuucuucucagaccucugcuccgggguccaccuucgggggaaaagagggcacaauuuuacaacuuuguaagaggaaaccugaaguuuucugaccccugauucuccccagcccugucaggauugaucuaacucucuguugagaugcaaaagagucuggagauaacaguacuccccccaccaugaaaacaauuauugucaaaggaguuuuauagcaaacagaaaauccggcccagaauuggcuaaaacauuuggggagcucacaucaggaaaugagauucguuuuuauuucuugauucugcugaauuggauugaaggcagcagaaggcauuaagugggauuugaccuggaggaagguggccuggcggugcuccuggcuuccccgacccucccucccuagccguguguagcaggcacucacuuugcuuacagcuuccucggugccauguaucuguuuuuggaaucacaccuugccuggaaggcugcuuggacccauggccagugccacacaggggccugggcaccggcuaacugcagacccagccaccugcuucuugaccacagaauucgagauuuacucaugagcucucuugacgcacugacuuugggaugcaaaccauuaugacuaggggcacuucccguggccuggacuuccacaaggaaacccugguuccaccgucaggaaagcuccaauaccuggaaagagguuguaccuaaaguguucucuguauuggcggaaaauguuucccgggcaaccucuuuucauugugaaggcuugaagagcuuuuggcugacuucccaaaagcaaccugggacacgcaaauagaagccaucugacgucuggucuacccagugccauguagauucggggaaucuuccuggaggugacaccaacaucggcgaagauucggcaguucuguuuugauuuuuuuuguuuguuuuuugaucagugcuaaucuucgauacucgaaggagagguuguccguguugucuucucuuuauuuaugaugaaacauacacgggaaaccucuuuuuuaguaucaaaucccacccuggaggcacuuccuguuccugaugcagccuucagggagggacguugccggcuccacucucgguaggcgcaagcgaggcugacagcgugccaugcgucguggggguguggcucucaggccccagccauggagggccccuaggaggggaagcugaguuuggagaagggccugugcuucugugguugaaggagguugcucauugugguguuugucuauuuguugauucacgguggguggcgccucuucagugugagaucuugcuuggauggccuucuggacacgcuagcaacgucauugaagggacgauggugccaucugcucuccaggguagcugaggggaugguagaccggugacgugcacuucauuuacgauguaggucacccguuugacuauccaccagcgcccgguccaucugugggaugacaucuuggugcacauggcaacuucggagaagaugugggaggacguggggcccgugggacucugcaggauuuuaggagggguuucccuucggggcccccuccuccuaccucguuaaaaucaauauaagcaaucaucagugaauaaucucucuuuugguuucaaauccugcccaggagggcugauagucuggccacagacaaugccaggauugcagaggccugggcuucagugccccaucagggaaagucccaccccacaccacaugcugacugcaggaggugugugugugaccugguacaggggugugguuuauccucggaaggguuugaggaguguugugugugugcaggacagggcaggcguugggacagcugugguagugagggccacuuuauucugugcuacaugaagagaggcugucugacaaagcuugccauguguuugaugaaugcuacguggcccaucucuuuuccauaggaggacuuccuggacaugaagcuagauuccggcagggccacuggugucagcagcacuccuggugagucguggaugggggacugaggagcuggcagcgugauugagaugagcccuuccuguguugggaccacucagaauccagccgcuucgugggcagcguucaguccaugcuuggggaaagggcuuuguugccguugcucaucucugucuguuguucagcucugcuugccuuacgaggccccagaugcccuggaugcccucagugucagacugcggaagaugugucccggcugugacacgcgcuucaggggagggcuguuggcgucagguccauggagagguaugggaguggacaucuugucugagagcagacauucuauuucgggugugugucuugguccguucauccucagucucccucccauaccuaggauggcuuguggagagaaggccugcccugagggcugaaguugggacccacagcucucaccccggccuugguaugcucccauggcuacggcagaggcacaagaaaguaauuagaaacgcagaaacuccuuaaggccaaggcugggaacugcuauauuucuacccacagaucauugaccagaacaauuacacggccgaacccaaggcaaggggcggggaggcccacuccacccgggaggggguuguggugaggugugaaugcaggaaccggugaggauuugccaccaccaagucaguuguccacguggaccaccugagaacuuggguuuuauucauugcucauucaucccucccuaacccgcagcuuccggucugccccgggggcucuucuccggcucaggcugaucgacaguggugacgcugugccaggaccccuggucauuccaucuguuugaggcaaauguuaaaaaaucccuugcgcuacccauucuaugacgacucccuuggcucagaggcuccaucagggcagacacuuugcuguuugucccuaaagggugggugguagaucucauccaucuuaucuggggaguuauugugacucuccuggucccuccucauguauccucaggaggacuuuuaggaugcaaaaucacuguuucugugccauugucauauucugugcuacuggaggagacuuuuuguuauugagaaauugaacacaucgugcucacaagcagcuccaggacacaaugccaccugugcagagggggcagaccuguuagaugucucccaggucuugaggggguuguaugcacggccauaucuuugucaccgguugcccggugcgcaucaggacccaugugcucucaggaagcccgcaggagugauaccagccgcggagaagcaguguugucaacggugcugacgugcgguacuuaaugagaaguugcccguguuuuuuucgcuuuauuugugacgaaacauucgcggugcacuucuuuuucaguauccuauucugccuugaagacgucuugguuugggugcaacuucagggaaggcacaugggccccuguaguggacgcugaucaggaccucccuaccccaugucuuuucuccuuccuaaauuucuccuuguuuuuuuuuuuuuuuuuuuuuuuuaugaaagcucccgucuucccgccgugugcuuugauugcauugacccugccccacuuccuccaccagcccaggcuuaagcgaaucucuugaucucuucuccuuugccacugcaauugcuuccggaauaggcccaugaccccacugggccagugauaggcaaggagaugcuugcugcagcuucugggaaagaaacuguuucucccuuuccugugauagcugccagaguagacacugucuauuccauucagcugggaauagacagugaacuuugacgugagcuucgaaggucccacagccguuuaaggacugagaggagagggcuuggugccacgcagacacagcagagggagucuguaccaugaaaggcaucuuggagaccuagagaagagccuggaugauaucauuugagucccuagaucaaacccugccugaagcuugcucugucucuguacuuuuuaguuauauacgucuauaaaucccuuacuuguuuaagccaguuggaguuagaucuuaucuuacuugcaauacaaacagaugauaccacaguguguuuuccagugugacugggaaagccugcauuuuuuucaaugauguguuucucacgguuugccuaucuaucuucaguguccuauuuaaggcaggguuuugguggaaggugacuuuucuuauggacuuaugcuuucaaagcuuugucuuagugauuuaauuuaugguugacaaaugaugcacaauuaccguguuuuguguccagcaaugggucacuggguccucucuggaaggccugauggauggugggccccagaacuucugccccgauucacucucccucgaauccaccucucucugggaggcugcccugcaagugauguggacuuggggaagccguuguccuuuccuggccccugcuguccuuuggcucucuguggguuggcuguauuugucacaacucacacuuaacugucaguguuuuagaaccaagccaugccuccagggaacccggagcacuuuagagaggaggugcaguggucagcaccaugcaaggugcacagagagauggguccaccgagagccggggcugccuuggugguuuguuucuccugauucgauaucuuugucuucccaucuccuuccuggaaccaugggcucauggaggagauucuauuuuuggguccaggaccaucccauuuucucugaagugaugcucuccaugagcauuugcaggguugauaguaaacauuccgaaagccgucugcccugauuauugaauucugcccaugaagacuuccugggaucccgaaguagagggagucugggaucgguuugcuuuauccgugaugacuguccgccucugcucagugucagcccagcccuucgaagcaugucccccaccuccccuggggugagccaacuuaccugaugcuuuuaggcuuaauugagcauaaguuugauuggcagcgucugcccggcccugcccucacgcccugacccucagugucccuucacgcccaggugugccucuggcagggaggacgugcucaucucugguaccugaaaagaaguugcccauguuauuuucgcuuuauaugugacgaaacaaacauggugcacuucuuuuucgguaucaaauaucuccuugaagugccuccauccccgacgggacccugagcaugggaccuggugucacuaccucucuugguauguacauggaggauuuguccuggcagccccucggugacuuuguguguuggugggcucagggaccaugcucaguccucaguccucaguccacgcccaccucucggacaggcacaguuggcgaggccucaaccacaugccaguuccccgcugccagggaggcuggggagaugcacuuccaggcuccauugagaagcguuccccaacauuugagaagaguucagaucauagcagccaagaaaaaaauaaaaaaggaagcagcugccacaacaacaaaaacaaauaagcaaugaagaccccugcccccauccgcucucuccagaggcuugaggggauggcugaaggggacaugaggacaugccaucugggggacugccacccgcaccuccacagaagaauugauuggggguagcaauuguggcagaaggcgucccugugguucugggagaugggauuucucagaguggugauuuacuggagccuaauccucccugccccgcucuuucuuuacuuuucuuuucuuuuuuucuuucuuuuuuuuuugacacagagucucgcacugucuccugggcuggagugcaauggcacgaucuuggcucacuguaaccucugccucccagguucaagcgauucucuugccucagccuuccaaguagcugggauuacaggcgcccgccaccaggcccagcuaauuuuuuguauuuuuagcagagacgggguuucaccauguuggccaggcuggucuugaacuccugaccucaugauccacacccaccuuggccucccaaagugcugggauuacaggcaugagccagugcgcccagcccccgccccacucuuucuaggugccaguucugccucugagagaugugcuccuugaucaccagcaucagagagauggugucugacauuggugucugccccaaaucgggagcagugaacaauggcugacggcagaacacaugccuucccgaagacacugcuguccggguguccaguccccacauucaguccauccuugggcccuggaagagaagagguuuccccaguguguucauuuuauuugugacgaaucauuuuuggccacucuuuuuucaguaucaaaucccacuugaagggaaaggcuguuugagcugggagcuuugguggcaucagcagcucucuggggugagugauggguguugcccagagagcauacgcgucauccccacggccaccugguccucugaaccucagcaucccugucccccgaaccucagcaucccugucccccaggagggcuuccuggagcucugccagccagaacuagaggcugugggacugcucuccgggcuacacuuugguacuggaggagagguuaucuguguuuuuucccuuuauuuaugaugaaaaauauggugcacuucuauuugagaaucaugugccaucgggaaaggucagaacccacuucuggaaggagaugcuaacggcaguccauuggugacacugggaccaugcuggccucagcaggugcccuucagacagugggcagcugcuccacccauccuuugggcucuggccucccuccagagaacuucccgguggcagaaacacuuuggagaagcagcaccggucuucaugucaggacauuccaucaagaaaggcuguccaagcuguggccugcauagucaaccuguuuuacucauuugagugccaccuuucuaaaugauggggugcccacuucagggaaggugcagcugugggagcagaaggcaggccccacagucuguauaugacacgugccacuuggccgguggacccucagccugaggaccucuggaggggacacuggcucugaguccccuguggaaggggaagcacaguuguuggaugacgcgacauggacaguucucuuucgaccagauccuugucucccaucgaggggggauucugcucucacugcugcuuaugucaggagagggucacuguugccuccaucaccucagguacgucagaggagggccucaaggaagccuugcaucucugaugguacguauccuuguguguuaacccuugccgucuguuuccuuugcaggaggacacccugggcucuggaagagagacagcaccccagaagccggccaggaaugguuggagggaggcuauuggugauguguucacucuguguguggcagauaccccacaguggaccuccuaaagcacugagugccuccuugaaggacuugcuguacguggugugaaguucaggaacacagugugggugucugucagccccucgcagaggguaugugcgcagaugguggaacagcuggcaaguguuuuccuuuauuuguuuuuucuuuugagaauugagacuuuauugaaugaaucaccauauaauccuguuuccuaagguaaaucuauacauaaaaaguuagguccuacaccaccaauuucuuguuaagaaauggaccaagaaauaugaacaaaaccauguguaacacaguuuucagaguuuuagaagaauggcaaaauauacacuagcuugucucuugauugccaaagcuuaaacucuaaagaauagggaggacauagguauacacuggaaaaaaaaauggcaaauacgugaggaggaugggaauguuugugacuacaugggaggcaaacugauuuuuuuuuuuuugagacggagucucacacuguugcccaggcuggagugcaguggcgcaaucucgacucacugcaagcuccgccucccggguucaucccauucuccugccucagccuccugaguaggugggacuacaggugcccgccaccacacccggcuaauuuuuuguauuuuuaguagagaugggguuucacuguguuagccaggauggucuugcucuccugaccuugugaucugcccgccucagccuccgaaagugcugggauugcaggcacccaccaccgugccuggcuaauuuuuguauuuuuaguagagaugggguuuugccauguuggccaggcugguuucgaacuccugaccucaggugauccguccaccucggcuucccaaagugcugggauuacaggcgugagccacugcaucuggccagcaacuuuuugcaucuaaaagguggauguuccuucuaugcuuacaggauuuaugguuaaucacagaggaaguaccaucagggaagcccauuccaggaggaaguggggagggggcaggugaaaaaagcggaagaaaccaauuaggggcauaugcaauuaaggacaaguccugagcagggcugcugcagccacaucccacagcagggccuggggagucagcugcaccuagagcugagggcccggggcagacacggaugugucaguucacuagccuggguacccuagccaggccccucagggagggaugccagccccuuggaagagacagugugugggcugaccuuucucccaacacaggggaagaagaguuccuuggcugguuacuacaccuaccccagcucuuccaggcugccgcuguuucaguuaccaaaagaagaccccuaagcccagccagcagcuauuccucaaucacaugucccccuccuucaggaccauccuggcaagacccacuccuugggacacgaaugaugucuggccacacagaauacauguuuaugacucagaccguccaauucccuaaccagcuaugucccacugguucucaacagggccucguggaggcagccccgaccugggggaaguggccuugcucuggcugguaugugcagaaugcuuguccauguagacgugcuuuauuuaugccaaaucgugcuugggggcuucgggggaucagacuugcuuccucaacaagcugugacugcaggggagggacuggcuaauagcagacaauggguguuaucugguccacucacugauccauucgccaguaggaggaaugucuaacucugcaugugugagaaguagugguuuucaaguacaagacuuuuuugaaccaguuccagcuuuagagaagugagauugguguagguuguccguguguggaaugugaauggagggugggacauggagcauacgcuuugcuuguggaaaaugucuccugguccucagaacugaagccguuuuagcggcacuuccuggagugauggcacccuugcgagauaggguuugagucugggauuauugguccuucauuuuuugcuaugggaggcauguguugucgcuauuuuaguaagccucugcauccacuccaccccaaaaaugauuuuucuggaagcugugaucauuguuuuuggagggugguauuagugguggugguggugguggugguggugguggugaugguggugguggugaugguggugauggugguauuggugguggugguggugguggugguacugaugguggugguggugguggugguggugguggugguggugguggugguacugauggugguggugguggugguguuggugguggugguguuggugguguuggugguggugguugugaugguggugguacuggugguguuggugguggugguguuggugguggugguguuggugguggugguugugauggugguggugguggugguauuggugguauuggugguggugguggugguggugguacugauggugguggugguguuggugguggugguguugguggugguggugguggugguggugguacugguggugguggugguggugguguuggugguggugguguuggugguguuggugguggugguggugguggugguggagggugguggugguaggggcuggugagcaucauguuuugcuaccucucucaguuguauuuaaagagacauuguuuuugaccuguuugccuauuccucagucugucacaccaacaugaccaguccugccgauugaaacuuucuggacacaagcuucagucucuggaagauucuuggguguccuucucccuccaagguaugugaaggaugcuccagcccacaguuacaugacauuggucauuaggugccuugggagggcuucauggaggcgaugugacuuuaggaaccugacaggcuuauuuucuuuuuguuuuugauauuuuucgaauucaaagcauagaaucccuacuuugccugcuuuacuuguggcaaauuuuugauguacauucacuuuuuuuuuuuuuuuuuuucagaauuaaaugcuacuuuggaaacgcucuugaccaugaagccuccauuagggaagagacauuaggguuacccccacccagacgagugacagcagggcagaccccaaacuuacguuugccugcauaggaguuccaucucuggaugugaagaggccaggggugggcccugcgcuucccacgugggacucgcaaagugcucaccugcuucuguuaccuucugucuuucaugaaucauguuugcguuugugcucuccagggcuguucccacuuuucccaucuaaaagguggauguuccuucuaugcuuacaggauuuauggugaaucauagaggaaaauccgcauuuucaguaucuaaggcugcuuuuaaaacauuucugaacauuucugagaggaagguuagcucccucccccaugcggagagugauggaaggugaaucccagaaccuaagcucuuguuagcaaggucuguccugggacaugcguccuccgcagggcccaugucacugccgcuagcccgggaggccccugccgacugcaccuauccugugcugucuuuaauuuugauagauugugcuuagguucaugcuuuccaggacucaauccuucuuugguauuuaaaagguggauauuccuucuauguuuauguuauuuaugguuaaacauagaggaaauuccacguuuucaguaucaaaugcugcuuggaaacauuccuggacugaaaccaccaucagggaagagacaauaaaguccccccccccacuccaggguaaguggaaagucgguggaccucagaacaugugcugaauucgugccauaugucugcggaccacccacccgccuugaggagaccccucucgcaagcugcccgcucggccaagcggcugggcuccgucgucauuuucuccaugaggccgaaugcucuccucugugcuauguuacuuuuguguuugauggauuguacuuagguucgugcuuuccgggaugaaaccuucuuugguauuuaaaagguagauuuuccuucuaugguuacguguuugaugguuaaucauagaggaaaauccacguuuucaguaucaaaugcugccuugggaucauggcuggacugaagccaccaucagggacgugagguggggcugagcccuccaggguaaguggaaagauggugggccgcagaacaugugcugaguucgugccauaugucugcugaccaucaccuuuagaagcccccuuucgcugaggagccagcuuggugcacaggcugugguguguugucacagcuaugcuacgggacugaaaacgguugcuuuacugucuugcuuccauuuuccaugaacuguguucagauuuguccuuuccagagcccaguccuucuuugguauuuaaaacguggauauuccuucuauguuuacgugauuccugguuaaucauagaggaaaauccauguuuucaguaucaaaugcugcuuuggaaauguuucuggaagagaccguagggccugaguaggugcaaagaugguaggccgcacgucguaucugaaugaacgggguaugcccgagaaccaucucgagacgccaacuuggugaagauuaaauugugggucucguggugccaguucuucccuggaagcucgucugccucaugugacuuucuuuucugaugacucaagcacaggugcacgcuuuccuggauggaauccuucuuugguauuuaaaagguagauucuccuucuaugaguacauuauuuaugauuaaucauagaggaaaauccacguuuucaguaucaaaugcugcuuugaaaaccucggaggacgugaagucgccauggaagaggagauguuaucuguaccccuccuggguacaggacggacagacacagaauuguacuuuguaugaaauacgccgucagcuucucugcuguuugcucacugcccuuggugcacacauaauguguuguuacaaggcuguguucucaguauugccucauugaccuugaaugaaguuuguucucuguauguuuaccaugauugcaaugcauuuucuggaaugaaccucuuuuacugugacuaguuguaccuuagagaauaccugagugggcugucaauuucaggaaggggcacugcuucaggggcuauggaaggaauagaugugugauucacccacgggccugcacuucacaccucggugugcugcucucaccaugcagaucccaucugugucucuaaggcuugcuccuggagcugguggcaacuuagucacagaggaaauggccuuccugucacugccaucauuugcuacuugaagagagguaauccuucacgcauuugcuuuacuugcaaugauuauacaagggcagacucucucuggggagcaaauccugccugggaagccuucuugggaacaaggcugacuccagcaaccuguuagauggccaggauagcccugggguguggaugguugaccacagggcaugugccucugucuugcuguuugugaccugguucucugacccuccucaucucaugcuuccuuccaagaacuuucuggaagagaugcuggcuuuggagaugauauaggguuuucucuucagaccaccuguucugccuagcaaaaagggccuaccuuggccgggcacgguggcucacgcuuguaaccccagcccuuugggaggcugagacgguggauggcuuaagcccaggaguucgaaacuagcgugggcaacuuggcgaaaccccaucucugcaaaaaauacaaaaauuagcugggugucauggugugcgccuguggucccaguacuuaggagguugaggcuggaggaucacuugagcccgggaguugggagguuguagugagccaagauugugccacugcacuucagccuggcugacagagaccccugucucaacacaauagguuaaaaaaaaaagaaaagaacaaagggccucccuugaugggcccuacuuaucacaaagcauccaugggcugcuacuccggcaggucugcccagcaugaugccagccucugagaagaggucucguggucagugcaucucccagauacaugaaagaaugaccgucagcaaagucaaugucuaauguagaugugggucaucuggucuacccacucuccauaccuagcccauccuuggagugacuuuuggaccucacuguccacuugagggaaggccaguccacaggaaggaggccccagagcacccaguguggcuacaggacuugcugcugggaccucuaagccccacugcucucuuaguccauugguguccuuuagggauucuugccaauggaaagacccuuggauuccugguguuagcauguguuuauucagagagaguuggcccaugagaaucucauuuuccuuugacgaaucuugcccuagaugaauacuucugaguaacaacuaacugcucagauggcuuucugaauacaaugccaaauucaggagaagggacacuugucauagugcugcuuugugauuugcaaacggagugcguuggauuucuguuucucuuuuuucuuuaaugaugcaugugacugcaucuucuaaccucccuuagccaguguucaccaggagggcuuccuggaggcaguggcuuugggcagaggcagagguucuucucccaggguguuuuugcaggcccuaaagggauuucagccauuuuacauuuacauuauuucaaaugguacaggauugccugucuuuugguaaccaauccugucgugaagagaugcugggaaguaaagucaacuguauggcaggccccagcuccagggccagccagaugaggcuugucaccuggccccucccccuuggucucaggccucgcaggaggagauguccacuccggcgaagacccggcauaguccucaccugcucuuugagccacucuuugguacuugaagagaggauacccuuuguauguucacuugauuaauggcgaauauacagggggagacucuuauuugcguaucaaacucugucgaggaagacgcucagacccugcugucuccaggacaaagccucggaugucagccccucucagguacggcuuggcuucccugucugggaacgugagcuuggcugugauccuagcccuuggguucugccuucgcucucugugcugguucuuccuguggacucccuggaggcagugggagaggaggguccuuuuugugugcacugaguuuaauggugguuugcuuuuuuuaaggauaaaucacauggaucugccucuucuccauaccaagucauacccagagggcuuccugcguccagcacuaaccucgcaccucuccggacacacgaaugggugguggaugguggagcgcagagcugaugcugcuucucaccugcuacuccccugaccugccacucccugguggucuccauccuugagagagugucagccuugagggaagcacauggaugucagguuguucuaaggcaaguuacugguggagcucccugagccugccugugcccucugggacugucgcuggacuccaauggccaguccucggagcacauuguccagugauugcaccugagugugccuugggcaggugugucuggucuucaggacuccuuugucgcuagagucugacgcuggggcccucuuuuuguuuguuucgagguagguacaggugacacauucuuggaucuggucaucucuaggacaaccagccucagaggagagacauugucucagcgcucuccagcucugagaaugccugcagaugccuucuucucugauaacuccaugucuugccgggcugagcccucacacccugugccccuuuggagaaaggugaugguuccauuguccauguagcuuguggguauuugaagcagguucacccaugcaugcugagcacacugauagucaugccuaccuguucccuuguuuagaagccagucucgccugcagggaguccuggaugugccaccuuucggggccaggccacaaugugcaaggugcaggcccagcuccagggucagccagaugaggcuugucaccgggccccucccccuuggucucaggccucgcaggaggagauguccacuccggcaaagacccggcaugguccucaccugcucuuugagccacccuuugguacuuaaagagaggauacccuuuguauguucacuugauuaauggcgaauauacagggggagacucucauuugcguaucaaacugucggagaagacacucauacccugcuugucuccaggacaaagccucggaugucagccccucucagguauggccuggcuuccauguccgggaacgugagguuggcugugacgcugccccuggguucugccuucgcccucuaugcugguucuuccuguggacucccuggaagcagugggagaggagggaccuuuuugugugcuccaaguuuaauggugguuugcuuuuuuaaggauaaaucacacauugaucugccucuucuugguaccaagucauacacagaaggcuuccuguucccagcaucagccuuagaagggggaccuggauguuggaucauuucaaggggaacacagacagcagugaugguggaccacggagcacuggcucugucuaugcuguuuucgagccugguaggccagccccaggagggcuuccuggaggugguauugaccuuggggaaggggcugaggugugcucaucagcgcuuuuuuuuuuugaugcuuggguguucaugauccagcucgcaguccccaggcugaaucuguaagaaugguuugcuucuauuugucauuugugauugcccaugaaggcagcgcuggggaugagccgugggagcugucagccccgcaccaggugcgugcaugugggaggucagagggcgccugcuucugccucgaugucugugccccgucucugacugcuggcuuucugcucacaccuaggauggcugccugagaaugggacucuuguucuguguuuguggagacacuccuugggccgugugacugccggcuuuuuacaccccgacugccaugggggucaucuggacccgaagccagcuucaggaaggacauucgcagcauccucagcccaaggaaagcgaacguccagcugaagagaggugagcaccacgccuggguaaugagucacauaaccugccaccuggaccaggcggcucccgcuccucuccccuucuugaaggagagaccacuguggggaaugggcugugggucugcuuccucaguuacuuggggguacgugggguuuacuacuguugacccugugcucuuucuuagcauggcuucauggccacgaugccagccucuggcagggguggggcaagggcuggcauggagaaugacacuggugucaacggcucugugagauggaugaagggauggugaccacagggccuuugcuuugucuaagguguaaauucauccagugccugggaccucggugcugagugcauccuuaggaaaacuuccuggagaggugcccacacugggaaggagaugguggucccaccccagggaauuccuauagaaagugagaagcugagcucugcgugugcccaggaaggcccgugggguggaucuccuuuucaggaacaaguucuaaucuggagugaugccuggaaaagaggcugauucuggugaaggggcacuggcgucugccccuuccuggccccuuugggauggagagcugaccuaugggcacacagcuggcaggugguguuugccaccuggucugcugaucccgcaucucccacccccucccccgccaggaugaaccccgggagaggaggccggccccgugaaugauagugaggaaccugcccagugcuauuguuugguacuuaaagcgagguugcccuuuguauauucgguuuauugacauggaauauacaagggcaagcucucugugaguaucaaaccuugucuuggacccaguccacacucagcaagggaugcgguaugugugugcaugaccguguguauccguuuuguguguggcaaaucguucacggguccccacuucacagagaggacuucacgggcaccuggaugacuuuagggaaggcaguggccucugggacauccccucuccuggugcagugugggcggggccaaaagcaugcacgauguguguggucugggucccugcuuccugagcgggaagucaucagcccgggccgauggcugggguggcgcucgugugggguaguggcuuuguggucccugcuguuacucgguccgugagugugcauguucugcuugggguaugugacccgguccacuaacccucagcaucuaauucauccccaggaccgcgccuugaagacguaccaaguccacccaaggcaguggcuuucuuuuccgugcuaaccuuugguacuuggagagugguuaucccuguccuguucguuuugcucaugucgaaucguacagggucauccacuuuuucaguaucaagagcgcagacucuggagcucgauuuccuguguuuggaucccaccucugacauuuacuaaccguccaaccuugggcaaggaucucaucgugcugugcccauugucucacaugucaaaggggaaucacauuggcguccauuucuuggggcugcuggggcugaacgaguuaagacuuguacacggcucagagcagagccccguggucggcacuucguaggugguagccaggacccuugugugcugugaaacuaucauuggugguggugguggugguggugguggugguuuuaugacuaaaaucucuccauggguuuuuggaacagugucaaaacauggaagucaaguccuucaucggguauggaauggacuaggaagcccagagcauacacgguguuuacaaugggggcuagugaugcucuugaugcuuggcagcuaagccauucacacaguggcuuuugauacagaaugccacaugcagugggggucagcaggggugccgagaacauuugcuccacuuaagagagacagucccuggguucuugaccucggccacuaucuacgcuuugaaggagucuugagcgaggaugccaagcugagugaggauucuauggcaucuugcuucccuggugcuuaaagagaggucaaacuuggugcaugcauugugcaugccugugugugcguggugugugugcaugagcgagugugugacuggguuugccacgaagcagucaccaucuaaccuugagccaaagaccuggagguggugguccgugcugcuguuucauacuugaggagaaauuauccuugguguguucgcuuuauuuaugaugaaucauacaaggacaauuucuuuuugaguaucaaaucuugccucggcagacuuccuggacgccaugacaaguucuguaaagggaugcacgcaucagcccuucccaggggcucacgccuggguggggaugagggcgcaugcaguugguuugugguggggacacuugugcccuaaccucagaacccuggaggcggggccacgcuuggcagggggccacgggacuccuuggugcuaucagggauuugcauuggccauggguguguguugugggugacgcagcauucaagcuacuuaucaaauccugcuucuuggaggcacuucuuggacaugaagcaaaccuuagggaccgaucauuggggccagacccccuuccccugcccaagagugugacugacccccaggcaugggcuugacucucaaugugugaagcugaccugcuaauccucauuguuuggacuaccugagaagaacuuucuggaagagacaccaacuuuggagaagaugcccagcucuucuugauggcacaguucuuuggugcuuaaagaauggcuguccguaguauggucucuauauuuaugaugauuaauaucggacaaccauuguuuuaguauccaaauuugcuucagaaguuuuugaaagcacagugcugacuucagugaggggacauuggugccugccccaccauggagugugacuguguugaugauuuauaaugaugaauccagugaucucagaaugcaagccaccagugugauuuccuuggacaaaugcuagcuuugggguggagaugccauuuaggggcuuggugccauaucuuuuuauuggaagauguucacaauuauuucaucucucuuucucuucuuguuauuaaaucuuagccacgaggaauuccuuggagagaugccggggucaagccucucucuagguagaugguggaccggggaaccuggguccagccucuccuaucuguagccuucauucugaguaugaaacacuuccuguagggaaugcaaacauuaguaaaaacuccguacauuuccuguuacuauuacuacuuuuuggcagcuccuaagcagcugccuguuggguauuuggauuauucuugguggacguggcauggcuucgugccuuccuugggaaccaccccaucuuagacagacucucauggaauaagacguuguggucgacagcaccucugggguguguguguguguguguguguguuugugugcgugugcauaugaauaguuggcuagaguaguguuucucaaacuuuaaaaaugcuccuaagauuuucaucaccuagggaucuuguuaaaaagcagauucugauucagggaccaagauucugcauuuuuagcaaguucucaagugaugcuaauaccgccggucuguggacaacacucacagugguuuggggcuggagaccaggugcuuucccugugauaugugucgccugucuccccacaugccauauaccguccaucgugggagaacggcccagaaucaacgugccauguuuugguuugugaacaaggguucacuuucacaugcguaaauagcaugagauuacuuuucuuuaaaaucaaaucaugccucaaagggcuucccagauacaagaccugcuucagggaggggccgccggugucaagcugcugcaagauugucgggugcaggucaacggcacgcuuauucauuauugaugugcugggcccuggaauucugugacccuccguuuccaagcagucaucgggaggaaauuccaggaacugagaccaucucugcgguagggacccugucuucagggaucagugacaccccauuuuaucggaaacagaauucuucaugauggcuuugcuuaucucugacaugcauucugcugguucucgucaucaaaucccgucuuucaggaauccguggaggaagcuuucauauauuuuuaauggaaccugccuuagaagucuuucugagcaugguuccaaugucaggguuuugacuuuggugccagggcugccugggcccugagacugagguacgggaauggaaggucaaugccaguacgugugcuuucuuugcaggaugugaacaccucccugccccaacccugggauucagcucaucccaagaagaaucuucuggaagcaaagacaacgguggggaagaggccaugguuuucguuucagaacuaugcaaggauauuugaggagagguuauccguguuauguucgcuucauucaucaugaauaauacaugguuaaccucuuuuugaauaucagacucugccucggagggccgcccccacaggagacgugagagugugugccuugugugagcugagagccccugccccggcuccgugcugcgugagggaagcuuccuggaagugaggcugguggagggaagagcccuggguugcuuugcuguguuugcugugaaugcgauguguuuuugcgaguuaugugagguucccuccucuuugaaugccaacuugugccuucccccaguggcugggucuguggcuuagccacagggcuaggucccuuccuggacccagugcuuuucagggugggucccugggggcaaggacaagguuuaccacuccacugggacacuugaggagagguuaacuccuccaugcggacuccuuugaggacagccuguuuuccucucaggguggcucccuggaugaaguccagcaccucugugggugugugaagggcaggccgacuugggcuguguucccacuccucacccaggucacuggcccagugccacuuccuccucaggucagcuucccucugccagccgaccugguggggucuccugguccauugcuuggugcucauagacacuggcacggugccagguucccuucacuccuucccgauggagaccaugcagcuaaugaaucuucggcucugugaugcugccuuggagggcuuccugcacacagcaccugguuugagaggagaacacggacuccagcguguccccugguuauggagaagggaggcuguccuugaucccccguuugguggaugauauaguuuggcugugucuccacucaaaucucauuuugaauuccuuuguguugugggaggguccuggugggagguaauugaaucaggggagugggucuuucccuugcuguucuugugauagugaaugggucucaugagagcugaugguuuuauaaggcagaguuucccugcacaaggucucuguuugccugcugccauccacguaagaccugacuugcuucuccuugcuuuccaccaugacugugaggcuuacccagccacguggaacuguaaguccaauugaaccucuuucuuuugcaaauugcccagucuuggguaugucuuuaucagcagccagaaaauggacuaacacaguggagggcaguggcaccaagccccgcccccuucaggauguggucccuguguggggcagcauccuggaguggcugcaaagccccacugcucucugccuccguggcuuuguccuaucugagguggccagugcgcuggggucccuguguggagucaguucuuuaugggugccugcaggugccggcuucacaguaagaaaacugucagcuucgccugagguaugggcacagaggugacgcagggauaugaacuuuguugacgaauguguucucugcacagcuaacccagagaauucauuccacccucaggagaagcccuagaagugauacaggcucuggccgggggacccgaugugcucgugucgcggcguggggcuuggugaggaaccaccggagugcucuugcauuuuucaugacaaagaccacacaguuggccucauuccugcacagugggagaauguguggaggugucccgccaccagagaggaggucuaugucagcaccaucaccagguaccugggggagggucugcugacgaugcccaauguucaauggcccaagcaacccguccuugggggacuucugggcaagaccauuucggugcucagccccacuccgugucccaggcagagagggggcugaauugaugauaccuauuaaaugggucauuaauucucauuauccaugcagccugcccaugagggucccccagaagggagggcaacuccggggaaagguucuggccaucagcacgaggccacgauccaggaggugcugcagagccagaggccacaggacagauuaucaagccaggucacaggcuuucucuguccuugacccucagcauccaggcuaccuacaagaggaggcagggggacuccucugacacaccuggggaggucucgucaauggcagguucccucuacaaugcuuucucugcugcaaaugcaacucagcaucaccucuuuccuggauauaauuccaaggaauuauuaaaggaggcauuggugucagcaccucgugaaauacucguaaggaugacccauggcagagccugugucuucauuggaguaagacucacaugcuguggccuccaggcucuggaggccucgggggcagagcaggguugaggcugaccguggggccucgccuggguuuguggcuuaucauauuggaccacuguuuuucaggacaaacuccccggagauguccccuggcaggacccugaccuggaggcagggugcuguccaugauaggggaauggaugguugaucagagaacguacauuuuauaaaugguguaugucaguugauccacagucccuaccuauccagugacuucuggaggccacaucagcucagaagacaagguggugguuuccuaggccaugcuauuuucuggcacuugaaaggaccuucuccuugccggguuugcuuucuuuaugcccagucucaugagggagugccuuuuuugaguauggaucuugcuggggaagcuuucuggaaggagcuguugcccuucgucccucuccaggggcaagaaugcaugguuggcuggaaagcaagggcuugauugacauugugcaccccucaacucuccuaacccucuguccccaauucauccucaggcggacuagcuggaaggaaggcagacucuggugaagacgugggccgucaccgucagccuucgguacuugaagagugguuaucccugcuguguucgcuuaauuuaugacgaaucauacagggacauccaguuuuucaguaucaaauacugcuuuggaaggcuucccggacagcgucccgccuucaggcaaggggucuuggcuucaccucccacccaagguauguaugugaacgggccaucgcagugcacuagcuucuucaugugccacagccaugaccagaaucgaaucucugaggaagaugguuacuucuaaggcugugauuuucuggaaggggcuuuggugucugcacuacauuauugggggaaguugaccagugagaggcccauucacacaagacgucugucaccugcuccaagugacccucacccuugguaagaugaaucucuggagacaugcuggcucgguaguguuacugucaucagccggacugacugauagguaauuggucaucauuauugcuuuuguuccagggcagaauuuuugagugccaaaucuugccagggaaggguuucuggaagcagcaccgcccucuggggagacuuggcauccacaucuguuggaguuuguggagaguuaguugagcagucugagcuuuguuucugaggcgucucccugagcucacucuccugccagagcuguguccugcccauggccauaauggcuauugagaggguuggugacuuuggccaccaugauuuuguuucgauaaaguucucucuuuuuaaaaaaaucagauucuuuuguuuauagcauaacuacaugguucaugaguugaucaaauaacaaggaaugacuuggucauuccauaaauagugauggagugcacacuguguucuaggugauucuggaccuuagcagagagcagugaaugaaaucaaguucuugcucauguggacuuuacauucugguggaagagacggaugagaacacaugaauuaggaagcguaauuuuguccacugcuagguuuuauggggaaagggaaagcggguuacagugacagaaagagguaaaagcagguggaccuuuguguuaaauacaggggucuggaaagcucucucugaggaugugggugggaauggagugggguggaccagaggaaggucugggguaggagcauuucaggaggagggcaaggcccauggaaagcccccuggcaucuuuaagaaaaagcaagaaggccagugggauugaaccgagcugcugggagucgcugggucugagcugggagaggcaggacuccagguuuuauucugagugagaugggggauuuggaaggguugugagcaggggggaugcguggucuguguuggaaagaucacucugaccacaagggcauugauagagaaucuacccagggcagugauggggaaccuaccaggagccuggcgugccugagcugggcaguuucucuaggggcaccugcaguggcaaaagggggcccccucuggaccucccuaguucagugggcccugcgggagccuggcuggcaccuugaugugcuugauggauaacucagugugcucuguugagaaguccaaggcccuguucagaaacccuggggucuacacacugcggagugcuccuggcgugugacaaguggcuucccucuucuuauuucuaaaccuugugcguguggauucaggaccacaauuucaacuccagggaagggggacugugccagcaccacuccaagggaggugagugaaggguugcccaaacuccaguguguuccuaggacacccguaagcugccucacuaaugcucgguguccacucuguccacaggauggugguuggcagccacuccccuuggagaaguggaaggggacuccuugucugucuugucucugcuuuucugugguacuugaagagaaguuguucgugguggauucgcuuuacuuaugacgaaucauucacggacaacacuuuuuucaguaccaaaugcuaccucuaaggacuuccuggacacaauggcagcuucaggaaagauagucuuugugucaaccauguggaaaagccaagaauggauggcgggccauggacaaugcgcugaccuagcuguaagucaccuggcccgauaauccgagccucccaugcaccuauaggaggucuucccaugggucucaccaacucuggggaaucagcugugguucugucaccagcgucaccucacaagacuuugaagagaggcucccugggccccaggccgacuuccagaagagauguuggugucagcaccguccagggugugugacugguugaccagaggggcaugcacuguguucacccugugggccaccuagucaccaacccucagcaucacucccacuccaggaagacuuuccagagcucccaccaacucuggggaagcggccauggacuugcugugacugcuugguggacugcgaugacacgugcucuuggggguguauguuuacuuaaaaugcaaugagucagccuuggcagccccuucaccacugugacagccuccuugaaguguugacuuccgaugugggacgccauguugucuucuguugagggaccugaugugggccagcuuuucuccugggugugugacugaauccuucuucccagagcaugugcugccuuuguuaggucugucacgucguccucuaauacccagcauccugucucucccuaggaggcuccauggagauaaugcggcuuugggaagcggccaugauucuccugucagggaccagugagcuacgcaaaagcucccugucuugucuggaaggacgaacugcauccuugcugcuggggagaaggcagugcccucagcacucccuuaagguaagugcgccucgggugagcaugcacuuaauguggguguaugucacucggcucggcccacuacccaauacuaucccacccauuccuaacaggacucccgagaagggcggccaccucugccagagaggcaauggauuucucaccaguguucaugugugguacuuggagagaggcuggccgugaugaauucgauucaucaaagcgagucauacacggcucuccucucuuuuagugucaaauucugccucggagggcuuccugagccagugcugcuuccaagguagguuucuggauggcugaccccauggcaagcauuuuccugaggaugcauguaacugaccuacuaacuuuagaguccaagcugacccuaaaacaacuuccuggggcacuaccaacuuuaggaaaaucgagagagguuguugggaugcccuaauuuuuuaaaaguuaagauugaaauacacauggcugacuucuuuuuuuauuccuaucaaauucaaccuuggaguugaaucuugggcaucuagaagcaucuuuuauuagucagccgucgggauacagaagaaaacaggaacaggacucugugcgaccccugguuuacuaacccacagcagccuuacacccuccagagaauuccuguaagggaaucccagguuuaccaaggaggcagugcuuagccugcuuuugcacacacauuugugugugguuugcuucauauuuaaugacuccugugccacugacauccuugcauuauuaaauguugccugcauggccagcugagcacaagaagugguauuucugugcacacuaauccuggcuuggugaaccugggguuggccggagagcauggguuugagccaccugguccacucauccucagggucccauccacccucagaggccacucccaagcugcccaggcugugcagaagaugcaggaaugcugcgagcagugccaccucaugguacucggagggagguuguccguggugaguucgcauuauuuaaugaugcccaauacacggucgaccucuuuucgguaucagaucucaccaggugucuucuuggaccugaugccgauuuaggggacaccauacucauguugguuccacaccagugcaacugaacauguguguggcccuggaaccaauggguaggugcugcuagcacuccuaauccucagccagugcauuccuggggaagaagcaugugaucugugcucaagaccccucugugacugaggaagugguggugcccaugaugcuucugggguuuuguguuuuuuuuuaaagaaaaacaauguauaguucucuucucuuucacuauuaaaucuuaccauggaggaaggacuucuuagacauguugacaaauucagggaaggggcguugauuucagcauucuuggggacucacuggaagggugacucaccacaucuguugaucuggaggccacagcaaauuuaagaacagaagacaguugcauuuucaauuucuuguuuuucuuuucaaaaaggauaauuauucuaccuuauuaccauauuuaugaaaaugacacaugcuuaauaaaauucaagcgauguggaaaaaucuaaaugaaaaagaaggaaaauugcccaauucucuggcacccagaaauaaccauuaagggcuuuagaaauuucauacaccugucugagcauacaugcaaauagaaaaacaagacagacgcagggaaaauaugagaucacacuguaccuaaucauuuuauuaaaaaugcuaacuauaauuuuccuugaauuuaucauaaaaaacaagcuaaaggagauugaaaugauugauaaauguuucucgcuuuaccaccacagguagcaacuccuaaaagaucccuguaaaauuaagaaaaauuagaguguaaaaauuaagugguuaggauuguuaugguuuuuaacuauuucaauuucacuccuaguucagaaagauaaagaagucagcauucuuauucuuccuuugcuuacuaucuccugcuuuuucucaauuauacauuuuaauuuuacauuauaaauaucugcaauuuguucuagaacuauaauucuugcagguguuuugccauaguucuauauuuaaaugaauucauuucugaccacaagguuuguuuuuuuuuaacugagguuucuccguucuuuaguuuuuaaguuuaauuuaucucucaauggaaaugaucuuauuguuucugugagaauagcucauagacacuacccuugaguuccugugcauuugagaguauauaucucuuuaugcacaagggacagcuuaacuagguauaaaagucucagccuacuuguuuuuucucagaaauuuauagcuauuguccacuguuuuuugcauugaggcuuucacuagcugucuuaauguggcuucuccauguagcucuuacuuaccuggacuauuuuaucuagcgaucuucacaaaccuuguuggaaagacuuugagguacuauguucugugagguauuucgucucugagaaugucugaccauugcucuuacaccuuuucccaucuguccauuuuuuuuucauucuguucuauuuggccuuuaugauuucaaguuuuuaaaauuucuuuagucacuuuaaagauauuuauuguauaauuucuuucagcuuuagggauacaagccccuuucuuuguugaaucuauugacucucaugauggugcuuuucuucaugguuuuuguagcuuuguguugugagguuaucaucaguugagcacuuagguguuucuguuuuguuucaaucccuaugcacaugaguuugcauuugguucugccugguaccccaaggaauuuaccaguugguaccaguuuuucaacucauuuuguuggcuuaaggauucccagacauauggcuggcagaaguccucaccauaucuuuguccugaaccuuugguaucucacaggagaccucauucuauccacucccuaaaaaugacaaauucucuuaucccuggccauuauaaaauuuucugguuccccuuuccauucccagaucaacuucuccuggaugcacggucaugucuuuucauccugcuuguacuugaacuugacuguagacccuuggagccucuagccagcacagcaucccuuagaucccuuaguggcagguugcaugaacuaauucuuuucauuaacaccugaggguuuugccuuucagcuguauguuuauuugggaauugauuuugccugcuguugcauuuuauccaacacuucucaauguuuguggaggagaggguucccuaucagugcuuguugcugggauggagccuuugagcugaaugaugggugaacuuggcaugacauucuuggcucccaguuucuucccucugaacuuuguaaacuugccuccauugcuuucugguguuaaaccauugcuguggacaagccuggggacagcugcuuucccuuggauggaugaacuuuuuuuuuuuccugcuuagauuuccugauucuuucuuuagucuugaacguuggugacuuuaccggguuaugacucagucacuauuuuuauucauuaguuuuucugaaucauaauaugccuucuugaugaguagauuuaaucguuccuuuguuucaaggauuuauucauuuuaugagcacuuuucuacuccagguguugguuuuuucuuuggugaaauaaucuguuuuguucauuucauuguguacuggaggagaagaaagucugucaucuggccccuugcugccaucugucugcacgucagucuguugucauuugcacugugcauuugucuauuuaaaacaauccuacccagaugcccccuccucagugucaccuuccacccuggcaggaugccuuauggcaaugccacuucugagauggucgugggagucagcaccacuggccagguaugugaauuuucugcuaacaauggaagaguuugaaaaaccauauaugaaguaccauuaaccccaagcaugcaaucuauccuuaggaagacuuccuggaaauuaugcucaccuuuggggaugaggccaugauucugaggucagugccaugccauggucuaauaaaguuugcauucaaugcuguuuguuucuguaugaucaauauuguaaagucagucucuuugucauggacucagcuuuggaggguuccuggacacaaggccuguguaaggaaaggaucauuacugucagccucgaugcuaaugugagaugagggaaugugcccugcucugauccaaaugcugaguuucugugcacuuggccucuccaccaucagguucccuggcagugcuccuuuagacaugcacccaccuuggcaaaggcauugaggucuggauggcugcaggguccgggauggaaugguugaauacagggcgugugcuuucuucucaacccucuugcaguccgucugcuaaccgucaauguucacugucuccuagggggacuuccuggaggaggccaacuuuggagaacaggcauugacauugggucugcgcuagcgugugguacuugaagauagguuauccguguugccuucgcuuuauuugugacgaaucauacacgguugaccuauuuuucaguaccaaaucccgccuuggagggcuuccuggagcggagucuuacuucagggugucagcuccucuccaggguaaggaaggggaccauugaccauagccgacccagcagugugcccuggcccuaacccugugugugccccguccuuggggagguuucuagagauggugccaccuuuggggaagaaguggagcuuuuccuaucagagcuacucugugguacugguggagaggucuuccaugaugcauucgauuuauuuuuugaccaauccuacauaguggacucuuuugaaagcauuaaaucuagccuuaaagcacccucggguggugccgaguuuaggaacuagaacuggugucugaaugccugaacgcacggcgaagcugacagugugcacacucuucuuggugggucgugcaccugcaggcguccugcuugcuuaccauggcaguuuccucgaaagaggcggcaguucccucaucggcucacugcauguuugacaagacaccgucuugcugucuucccugcugcccucucuucauguaucacagauggugcucugcagaccucucugcuguggcacuucccucccugaauggcuuccugcaagaggugcuaauugcaaguaagggauggagugcggcccggaccgcagagcuuauuucgugggugguguguugccaccuuccugacucucaguaucccguccguccucaggccugcugcugggacgcgcuggaagcgagcacccaagucagguacucgaauggagguuguccaugguguguucauuuuauuuaugaugaguauuacauggccaaucuccuuucgguacucaauucuucuugggaaacgucacgaggggaaagcccagccggcaccugcgcaggguaaggaaguggaucaccuccgcaugacaggugcucucugugugacuuacaucacuuggcucauaucccggccaucauuaggaggaauuccccgaaaugaugcugacguuuuaguugacaugguggucuucuagucgcauccuugaagacucgucagugaauaaaccacauuuagucaaccuuuuuaggugugaaaucaucuuggcuguguggcacacuuuagggaaaggaacuccuggcugaauggaagacauccacauuacgcccucaaauaccuuaucuucugggugaccucugggaagcaaggggugaaggggguuuccucagcagugagaauuaauguuguuuaaagacacauuuccauggcacgacucgguuauuccuacugcaagacgagaauuguuaauagcauuuauuacuaccuuauguugccagcugugugcccuuggaaaaucccuucaccuaucagcucucugggccucagucucuuccucuguaaagcaggguuaacagcggaguggaaacgugcucuuugugaagugucuagacagcgucuggcacguggcuguaggauaagcauuguuucugaggauggucauuauaugaauguuaugucaucugcacucauuguccucucgccacuagaauggaagcucccugagggcagaguccuugucuguuuugccuggugcugugucgccagaugugcacaguaggugugaugcugaaugaaugaauaggcagcgugaccuguuuucuugguugaacucucuuugaggccuccuggaauggagugcauggaguacagucaccugagccugugcugucccugugacgcagccccacccacccucugaggaugcugcgcuggacgaggagucgccagccuucaggucggguccucccucaaaccccuguaggcuggacugaacacggucacaugguucauuggcagcccccuucucugugugaaauccugcuucagagacuuccagaggagauaccggcucuggagguggaccuugguguuccagccccucuaggguaggugaccaggggcugacucuagcucgggcugaccugugaugugugugugcauagccucgcccccacugccugcuccagggcuacagaagcugguccaugaccaaccauguucugaccacugccuggggggcuucucggagguagagagagagagagagcaagaggggagagagcgagccagcaagccagcgagccugcagcuggagucagcagggaggucccgcaggcaaugccgccuuuggugaagaggcaucucgguguguucuugcccgugcugauguuugacccuugagcagagguugcccuuggugaauucgcuuuauuuauguugaaucacacaaaggcaacuuuuguuugaguaucaaauccugcuugggauggcuuccgggacccaguggcaagcucaggggcaucuacaccccucccgugagcaagaauggacgggguagacguggguggucugcccucugcgguccucugcgguggaugagaacagaugucgcucagagaacacaagcuucauucaugaugggggcggggcucgcggcccggggaggauggcguuggugucgcgucggcuuuagcucuuacccuggacccugucucuuuacaucaccauuuuggcuguguugaucccaaagacauuuugacuccaccauuuuuuuuucggaagguauuugaccucgcggauacacaaagagcucacacuuggcagggucugugacgagucugcagccccagacccccgucuagcucacaagcacugugcuucuuucugcaccuuuccuugucucuaucuuucucuuucuaucccccaaccaaacauuguucccaauuuucuccuggguuaugaaacaaauagaggcuaucaguaucucaucccauuuguauuaaauaauacugauaaaaauaaucaacacaaaauaaaacuaaaaacagcugaaacggcacagugcuaaauguguucaguugacuacaaauuggcagaggaauccaauuuucuugacaacauuucagcugugacauuugaccuggggaaauagcaagcugccgacguggcagccauggaaggaaauucacgguggcggcggugauaaacagugauauuugauguagacaagaacacauugaggaaucaaaucuucaugcagauuuuuaaauggaaaaaauugauccuaaugaaaaugauuuggggaaaauaacaagggaaauaagagaaaugaaaacagcucaacagcgcggucaggaaagcuaaacagggaauuggauuaguauaauggcauuggcucugaaaaacacguuucuaugaauaucaguguugguacaauucuugugaaggugguuacauuugugcguguuuacaguggaguugguggggucaguaggaaccuagggucaaaaaaugggauacagucucccccuuuaugcaguugaucuuuucuugcugccccaaaccuucccgagagcuucccggaaaggugugcugacuucaggcgugacacacugguaaggcguccucccggggaucugggugcauguuguccccagagcauucauacguaagugacaggcaucaccuggucucccuccauccccacggaggguucugggugagacgcugacuccggagggaagcagaaguucuacggucaguggggucuggucuuucaggacaguugcuucugugaacucagaaaaucugagacagcucuuaguuaauuuagaaaguuuauuuugacaagguugaggauacacccguaacacagcuucaggaaguacuguggucaaggcacagcuuggcuuuauacauuuuagggagacaugagacaucauucagcacauguaagaaguacauugguuuugucugcaaaggugggacaacuugaagcgaaggcaggaaggagggagcuuccaggucacagacaggugauacacaaaugauuacauucuuucgcguuucucaugagccuuuccaaaggaggcaaaucagauacgcaucugucucagugagcagagggaugacuuugaauggaaugagaggcagguuuauccugagcagcuuccagcuugaguuuuccuuagugauuuuaggggcccgagauaacuuuccuuucacacuuccaaggcuauugaugaacacacaggcauccaggaacauucugggguucaguccuuccucagacucugcuguugauaccuuacaugguuccaugcuggccccaaggacgugcccuucguuggugccgaaugucauuuggucauagaggcugaaagucauucuggaguugauguuuccaaggucaaaaaccuugcuggggcuguggaaagagcucguuguuugcuggccugcuuuguuggugaccagcauugcacauggcuuucuuuucagaucaaacccuaccuggagaauuuccagaagcaacagcacccucaggaggcggccugcagccggagcccucuccagggcaggugccugagggccgcccaugggacaggcccgauuguacccacggugcaugucaucuguuccacuccugcugacuccggugcguuccgggaccaccuugggaggugaugccugccccaggaaggaggcucugaugcaggucagugcccauggcuccugaagggaagucgucugugacaucuuuucuuucuuuacagcaggccucgcauggcuggccucuugcuccacuuguagcaaggcgcagagggcucucugagcucaugccaacgucagggaaaggauucugcugucggucccacuccaaaguucacagaauggguggugggcacagaaucuggacucugcuuguggcauccaucgucuggcccgaugcuugcuggcugcccgcuccaggaggcaccuucuggguguucucugagucuggggaagguuggguucugaggucagggcugcccugacccuugugaagagaagacaucugugacucaccugcuuucuucugcugcauuuauccccccagucccuuauuuugaaugucucacuugcuuuaugaggcuaaucagauggucagccagcuguugauaacugugaaguuacucuuugagggauccuggggugaugccucugugggcuggagauggugcuggugagaccgcaggucuggggucagcguugugccccguugagcucccgccaaaggaauccucugcugggagggaggcucugugcuugugcaggggucccuacagggucacccccucucagggucugggaaugaaaagcgggugcgagcaggguuucauuuucaucuuuagcaaggugcccaaggaagguugccgucuuuucaguauaagauccuaccugggucuugcacucaacuucugggaagagucucuagauucauucuggaagggguuggaaucguuggacuuggugauugggaacguccuuggagagugugaggcucugggcucugaaugcccagaccuugugcugcccuugggggagggucuucugcaagcacagccgccugcaagcauucaccuuaguccgagcaucugagccucuccaugguacucggggagagguuacccgagcaacuuugcaucuggacgacgaauguugcucggugaaccccuuuucgguaucaaauuccaccagggaggccgucuuggaggcuggggcaccucggggaaggacgccggcaucagcaccauucugggguacggggauggauggucgaccaguuggaaaguaauuguuucuaauguacuucaccugguccacuagccguccguauccgcugcagccuguggggccugcgggccggggagccgaucgcgcuucagcucagcgccuuuccugguacuugaagggagaucgaccguguuauauucgcuuuauugacuucgaauaauacaugguugaucuuuucucaguaucaaaucucaccuuggaggacccguuggagaugaagcccuuuugaggguaggagcaggacgggugcuuuggagucgcugccucaguggggccuggucaccgagagugggccgggcaggggucucuuuccugucucugugucuucucaccuuugaugucccauccguccucaggacugcuucccgggggcagcgcuggcaccacgggacgcggcagccacguucuugagccgauggcacucuggguaccugagaagagguugucugugaugaguucgcuuuuauuaaugacgaauauaacacagauggccuguuuucaguaccgcuaccgcccgguggugugcgggcgccacgccugaggcgggacuuuccaggguacgugaaugcaugggcuggugugacauuugucauccuuuccccugacccccgccauugaaucauuuugggagagcuuucggggggccauguggacuuuggggaagaugcuaggguugugcacugugguggggggcggucaugaagcugaugagcaauggugacggggcucagucuguuuuucauggccagugucaucgaggcagaggacacgggggagcuagucccgcuggaaggcauccugcuggaaggccacccaccccucgccaggauguugggggcggcugcaugcauucccugcaccugggcugccuucugcucaucucagugcugugagacccugggugggagcuggugccuuggguggccgugugcgugugcugcuccuuguggugccugaggagagguggccuguguugcauucacagaaaucaugacacacaagacacgagcggccucucuucaguaucagaucccaccugcaugauuccugcaccugcugaugucggggagguccgguugcgcgcccugugggcccccagaggcauggcugguggccgagcacgcgcuugacuuccaccugcagcccugugcuggccuccauccuggaggcggguggguggcagggcccuucccuguggaagaagccuccucccuggagucagugcugcucagugguaccugaaauagguugccugugagguguucacuuucuauaugaugaauauuauacagucaaccucuuuccgauaucgaaucccaccuuggaugccuuccucuuugcugucaacuccaggcagcagcuggcucugcgcugguugacccuguggacuuuguguaggaccugugucacuuggccuguuaauuuuccagcuccacucuguucuggggggcuuuggaagugugacagaauggcauccccaauuccagugucagcgggagcacccgccaugcccuugcuuccgguuggcacaucccccaggcugggcuggcucucagcuacccgaugcuuaugucauauuugcaccccuggccugcccagacuacaggaagaugaccagaggccuguuugcagcugaccuggagacuuagugacuccagaacaugcugcccaugcccaggguccagggcugaaggcaaggagcaccucaggagugaccccaaagaaugagcuaaggcuguccuuuaucacucauuguugaucagugagcuccugggcucgggagaucuuccugagcugggcucccgucauccccuaguugagacgucgcugccuuggaagucacagccugugccugcccucccccuuguccuccuccucgggaccgcuccucuccaugccuagcaugggaguggggaucccuggcaccaucccucugggcugccugcucccacucucccucagcaccccucuuccccagccccugggccacagcccugcuggagaggccgccccacaggcuaggucccuccagccuguggcacuugggucucccuccagugccccucccucugccagggagagcauuuccaagugcagaguccagcuguuuaacuccgcugcccagggcaccucugcaggccccuucccuugggcuugguaccaaaaugauccgaggaccccccaggcccucagaguggcagccccccucuucuuuuggagccacagccuaucccccacguguuuucauccuucauucuggccuugcacaugccccuccuuccggagcuggguccugggccgcccugcucugcccucggcugccuccuguccaggcucuggcccuuccuuccuuaaaggcccacauccuuugcauuuuccuuucccagggguucacaauucccaaggggauggaauggcucuuguucagcaaggucaucccugauaacccuauaaaagcagcuccccuugccucuucccuaucacauucuaccaguugccccguuacuguuuucuuccuagcuuacaguucucugaaauugccuaauguuaaugucuaccuucuuugugcccuagacugugagauuucucauuggcagaaauuucucucucucucucucucucucucucucucucucucucucucucauccccugcuguguucaguagcagaacagugaguguuuguugauugacuaauggaguccccaaaggcagggaccggaucagaugaauucccaggcaggugcugggcacaaagcaggcagucaauaagauguggugauggaguacaugaauauguuaauugauuuuuagaaauucuucccauuuguucaaagcuguuugguuuucuagcuuuuucugcccuuccaggaugaggcugagauuagcugcaggaggcacgagucaguugggucuggguucucucuuccacuugucggggggugggggcaccaaagccccagaggaagugacaggcccuguguuccccugcagaugccgacugaucgcgcccccgccccuccagcaaacgccccagcgcugagagccaaaugcucuggggaacuccaucugcaacgggcuggagcgugguguuagggcucauauuuuaugcauggggcugacuaaaugggaacauuuggagaugaaaauugcuguuaaugcaucuacacaucuuuggaauauauuaaaugugugugugaggggaagagugacauuagccuuauuuaauagcuucaauauaaccauccccgcacaccacggcguuaacaggcacggcccccccgccgagucucccaggccaccacucaggaagagugcugggugcaucacgcgccacuugagaauuagggggugaguccggcgucggcccggcaugcagcagcgugcauguuccccgccgauuucuaacccaaacacagugacccugugccacuugaugcagaauuucauuaaaagcaaaaaugauugauuuaucuauuguuugcggagaagaaaaaauaaacaaagggccuuucucaucagauaagccaaauaagaacgugugccccacagguggccaggaugaaagucuccauggacccuucaaccagaggcucugugacuugucccgucuucagugcgguguguaaacccugccgccgguccaaguucacgaggugugcucccuucuccagugcaagggcccgguuuauccccacuaugucuccuggacgugguugggaaauugaacaaccuggaccuccguucccauuuccuuguuguuucagcgggagauaagaggagaaguaauagcugucguguuggggcgcuugccuugguccugggccccaucagcugcugugaggagacaguuucuuuuccauaguugaggaaauggagcgcagagagguugagugagucaaccaaggucacccagcuggagguggggcagggucuggcuccaggcugugugcucucacccacccugcuugcacgggcuuuaggaauagccccuguguccuggaagacagaucgcucaccgaaugggccucuuuucuugguaucauaugaugagguaggcucacuuucccccagacuuagcuugccagaauauucaugguuuuuucucuguacucaccugucaucucuccaacuuggugccaucacccaugaagugggaugcuuuggugcgugucuggccuggggagagggcugcuugcuuugucagaagacucaaagcaugaugggcauccaaauaccaaagaccuauguugaccuguguuuuucacuccgcuugauggcaguugagggcuauauucacugccucaguugcauggagugaacaagaccuagugaagguggugggugcgcugagaccaucugguugaucucuccugggugggaccaggugcuccccucaccacccccacccuugucuguguaccaccacucugcacagacacguuggcuggugcaguccuggagacccacggagcucacggucgucagggguccucaaggauucagagaacccccaaaugucagggcugcucccuucuuguccugccucucugcucacacccuuggacagguaagaaaacugagguccacagagggcagggugcauugcuguggcuuuuguucugagcacugucuccccagcuuugggguugagacucuggggucaagacccaccucugaugaacgagcggcuuccuucuuuguaaaaauugaggcgacccagaccaagaagggcugcaaaaucaccaagccaggaccucaauacccaaggggcugggguuucggccacccuguggcagagcuuuuagaagccagggcccuuggcucggcagugcuggcucauaguaggugcuuaguucaugccugucuccuuggaugaaaucugaccauagacaccagugcaaagcagguguucaacacaggaggguguacugaacccgaucucucuaucaccaggaggaagcacacgggaggcacucagagaacguuuguggaaugaauaaauaaaagcauauuuugagggaauaaagaagcagaaaaacaaagaagaaucuggggaagaugggcauaaaucuccaccaagugcugccaaggcuucccaggcgaggcugcugaaaagacccuguggagguagagggacaauuugucauggaugggaaugggcuugagggccgggaagcagggcaugauggggccucauucaucauuuucccguuaucccagcagcgugcaggggagcagguacagcaccugccugugcagcugcacugccugcccgaaggcccuaggcccugggccaagugagugaccagagggggacugggaauggaaaggaccucaaggaaggacaagcugagcucugggaggccaccuccuccaggaagccuucccugauucauccuucacaggcagucucaauuugcagucagauauccacugcucugauucuuagaucagcaaguaucucccuacccagacugcaggcucugcuggggccgcggcuguuucugacuugugcacaauggcaucccuguaccuagcacaggacugaguccagagaaagugcucagugaugcuuguuggccuugucucuccucugugggcagcacagggcacccggcggguccugaggguguggacaucccacggcagagccugcgguugaucccgaccaugaaccaaggccuggggcggggguggccacaucaggccacuucugccaggagagauguggcugugagcugggggucuggccuguccccggaggcauuccuuggguuugcauccaucagaagauccacugguugccucuauuugggccuggagcagggaugggauuuuuccaagguacauggggucuaggggagacccaggcccauuauuagggucggucuugagaaggcagagaucaggccaccacuuuauuugguguagcuccucgcuccauuggugugugcugagugaaugaaugcaucagggacuccugcuuccugcccagagcccccuccgcaccccacacagccuugcuccaaggagaaggggucagagccaacuggacagugcuacagcauggggagccucgaccaggcucggcccucgacgaugggauaggcagacagcccccugugcaaggcagcuagcuugcagggucccgagaggccaaaggcccuggucuuuccuggggcaagaggcugcugagaaggugcacagagccugggugcaggaaaccauccagaaugcugcuucccgccaucugugagaucuucguuuucucuaacacucaaaaauagauguuucuguuaugcucucucguuggcaggggagcggcaggaccugccaaggccugggggagcccgccagccugcugaguucuacuguacaaacaguuggggagggggcgcugucucuguuaacuugaaauuccccgaucaguaaacaugccaauuuaaaguguaauuaacucaggccggaaaaaauucagauuuggacugcuuuucacaguugagguuguuuuucuuuuauuuauuuaucucuuuccggguguggugguaucuguggcugguuuuagccaggaaaaauagaagggggaccggguggggagggggcugguugggagaggaaaggcuggaaggaaaggaagagaaacgggcggguggccugacacccagcagccaggugucuauagguuuucuguccugggagggggcugucagggugaugcccgccugcagagagggggucauucugcgagguugggcugcagaccccugugccagcgggccuggugauucggaaaugauggggcacuguggagagaccccaggaaaacacccagugcugcuuuugacauucucucuccaucuccccuuucagcggcugcucugccugggauaaacacauuucaagagucucaguccccgcuuugccaccaucuccuccucugaucuccuuuccugcuucaaaagacuccagaaucuucucgguucucagagaaggcugaauccaccuaugaccuagugggagcacccugugccgaaacuguuuaccuucugguccccggagccaugggucacgaccugggccucauguaggcccgcuccucagcagaccccaaucugcggcuucucccaccucacuggggaagaaggagagcccuggggauguggagaagccaccccccaccccgccacaucccccacaucuuacagaaucucgauugaauccccgggggcacaucccucagcaggacagcaacagucuuugccgcagccuggggagggcugugcuggggaugagcgccgaguggccguggacuaagugaaggaaaugaccaugcucuucucccagcuggauggcgaggccgggcaggaaccgcggaauuccugcucuucguuuucaaacacuuugcugucaagcuauuugaauaauaaauacacauuauaaaaauguaaau

SEQ ID NO: 17159 - RNA, 18609 nt, Homo sapiens
guucuuuuuucagucugcagugccauuuuaaaauauuuuccuauucucuugaacauaccaucaaaacuuguaugguauacaaguuuaguauaguauacuaaauaaguauaguaaacgcagcuguuuuauagccugcgucaggucacacuaguaucugagguguuugacacauuuuguucaugaugucuuauuuccuuguguaccugauuuuuuuuauuguauauuggucauuguauucagauaugugaaauaaauugaaaccuagaaucaaagugucuucuucaauagggauuuguuuuugcucugccagacaccuggaggcacugccaaucugggagugccuuaaaccacaacacugguuuguuaaaucaaccgacccaguuguucugcaauauaucccacuuaccccacugcgguuccuguaaauggaaaccuuuuuuggcugaaauacaucagaggcaacgcuuuauaacuuaggagauagugacauuauugugagagaugcauagccucugguugccuaucaucagaagugaugcuaaauuuucaguuuuacuagugaauucaguugaugacagauugauaucucuauugaacaauuacauauuucccuuuacaauucaaaaaguacuaguaauagucugcaguguauauuuuggcauccuaccaauguguauucccugucaaccaugugcuaaugucuugaacaacaguugauaauccuugccugagucaguaguuucaguuucacuagcgaauucaacauuuacucuaacguucuucugaaagcagugauuuuucuuaccaaccagagauacuugguuaucuugaaauggagcuccuacugaaaaagaaggauaagcuuaauucuuugucuuuuauuaccaguucccucuaauggugacagcugaagcuuuuuucuagcuuucucuuuguuuuaauaucauuguggacuaauauauuguugauuucaguguguuuucauguaccaaaagcauuagucuuucugguguucagauggcauaauugcaaucauuaagugcccuuuaggguagcucguguguuuuuuuguuuguuuuuguuuuuuuacauagccucauuuauuuuugauuccuugauuucugacacagugagacaucccuugggcucauuuaauaccuucucuuccccagacuucaaaucagccauuuuucuuuucuuuuuuuuuuuuuugagacagucucauggucucauccaugcuggagugcaguggugcaaucuuggcucccugcagccuccgccucccacauucaaaugauucuccugccucagccucccaaguagcuaggauuacaggcgugugccaccaugcccagcuaauuuuuauauuuuuuguaaauaugggguuucacuauguuggccaggcuggucucaaacuccugaccucaagugauccacccaccucggccucccaaagugcugagauuacaggcaugagccaccacaccuggccaaaucagcuauuuuucaaagagcccugguuccuuucaguaguaaauauauuagcaaccaaaaucugggucagagggauguuuauugcuacuggucugacauuacuuuuaaaugcuuucaauggagggagcgaggauauaaauuuucugaaucguacauucauauugauauuuuaaauuuaauuuuaacauuauaguguuuuugaagcaggauauuucccugaccacuucacgggcaggaacuggacugcgugggugugggaacuagcuggccccuucagcgccagcaagggcgaucuccacuuacucgcugcuccaccccucgugggaggggaagugcaggugagcuggugcaggagcacuuuugggcaccagcaggagcaaaccccauaccagccccauggcagcgucuucaggggucccugugaucccugaagccccagagaaaguguugcaguacucuuuuagcucugccauccauggaugacuuaaguguuaacagcucaguggagggucagugggacaaccuuuuacacccauacucauggcacccaaguuguuguccagcauccaggaggaaugagguugcaugaaggaauugaagaugguaaaugcaggggauuuuauugccaaugaaaguggcucucagugggaagggaagcuaaaaaggagacagagugggaagguaaucuuccccugaagucuggcugucuccagccagauucuucucugaaguuacgccaucaaguugucccucugaagucaagccacuucuuuccaacauccaacucuagucuccuauguccaguugcuucucuucucucuaccagcugagccugggguuuuuaugggcacaggauggaggcacggggcaagccaugggugguuuuggaaaaggcaacauucgaguggggaaacaggaaugcauguucucacuuuggaccaagguuccaggcuuuucggcuugaggcuagggcccucacaagggacgugcccucuucugcccagaacuucccugcuuccuguuccuaucacuuucacuuauuucuuggcuuucauaguuuuaucucugucuuacacugaaaauguugauuucuagcaucacuaauguaauuauggguauauucucuuaaacaguucccaaaaacaauauugauauuacugcaaacaguuggaacuuugaauugacccauagucauugcagaaagaaacagcuguugacuuuauuuauuuauuuauuuuagagacaguuccaugcgauguugcccaagcuggucuugaacuccugggcuuaaaugauucuccugccucagccucccaaguagcugggauuacaggcacgcaccaccaugccuggcuacuguuggcauuuuuauugggauccuguuacauuuugcaaauaucugagggagggcuggcaucuugugaugugugccuccucuaagaguaugcuaugacuauuuuccaaggccacuuucauguccuuuaaggcuguuuuuaaguuucccuuguagguuuugcaugucucuuacuaagcuaaugccuagauaaucauuaucaucgcucuuguaaauagagucuuuucuuccauugugucuucuaguuauuaguuguuuauaugaaggcuauugaauuugggggccuugcuuucauaaccugcuuccuuacugaauuaccugauuguuugcaucaguuuuucaguugauucuuuugaauauucagguauuaauuagagcaucugcacauaauuucaccucuguuuauaauuguaaacucacaugucuuucucuccaguugacuaauaaauucaguaaaacaauuucaguaaaauguuacauagugguggugagagugggcauacuugucuuguuucugacauuagugggaacgagaggcaugauuuuuagcaaccguuuauuauuucauucuguggauaccccaguuuuucagcuauuauaaaugauacuguucuguuaaucuuuuguuaucguuguuguucacaucuuugaaccuuuccuuaagcuugaugaaggagguacuggaucaaagagcaggcauuuucaaaaacccuuaauagauauugucuacacacuuuccagagaguagcaccacauacagaguaugugagaugccuguccaucauaccucuccaaugcugagaucauguaaaaguuguaguuauuugauaaguagaaaaagguauuucauauuuuuauuuuuuuuuaaccagugagguugaauauagcccucagaccuguucauuguaagauuauucugaauuaaugccuucauuuaacauuuuuggacuggaagguggaaguguuaaauaaagagaccuuuuuuuuuuaagauacuuauaggaagaguaaauuaaucauggacuuguuuuuugaggccauuuuuagaaaagaaaagacuaggagaagucaaaguuauagcagaauaauguaggacuuauuaucggcuaacuaacuagagacccuggggcaaaagaguugccgaguauuuggucuuuugugaaagaagucauuacauuauuguuagaauuuacuugaauuguuuaaaauuggcuuuugaauaccaguuaaauauuuuauaucucuugcucuccucucaugcaaauacaauacuucacccucauucaaagcaguuuauuuucuuuuuugagacacgguuucgcucugucacccaggcuggagugcaguggcacaaugucagcucacugcagccuggaccucccaggcucaagcaguccucccagcucagccuuccaaguagcugggaccacaggugcgcaccaccacgcacagcuaauuuuuguauuuuuaguagagacgggguuccaccauguugcccaggcuggucucgaacuccugggcucaagugauccacccaccuccgccucccaaagugcuaggauuacagccaugagagccacugcgcccugccuauuuucugauacaauugaaagcuuuaccauaaaaguagagguuuaacugccuacaaaugaauuaugcauauauuuacaggaacuuuggcuucuugccuguuaguugaagaauaauaaaaauggacugugcggaaguuaucggagugccugcugcucuucuagucagcuuagaaagagccgcgcagggaaucucugcuuucauuagucuuuucuucucuugcauguuuugauuuuugugucuucucgugauuugccaugauaucuuaaugagaggacacagucccuggauugcugaggcaguucacacuggccaucugugcuucucagagcaaggggaagguguucagagcgaugacccaagguggcccuugcccucagggaaccagcgggcccggagucacagcgguguucuagcuucagccccucuaagccacagagaguuaccaccagggccacucccucuucagaacacuggggagcccguugccugucagacagccugagcccagccagccagcccagccccuccaggguacccccucuccauggcccggggcuacacacaugaccuuggccguuacuccauggucagucucagcucucucuggguggcacccaugggguuuaguuuccagcugccagcuguaaucucggcucauuaccgcacacagagaccacuucuuggacauucccguccucugucugguccagcgcccugcugccucugcuccucaaguguuuccugaacugcccuggcucaagccguccuuaucuaaaaaaaaaaaauuuaaaaacugaggugaaauacacauguuaaaacauaauauuuauuauuuuaaccauucauaaguguacaacucggugguauuagauacauucaaaaugcuguacacccaucacuacuaucucuacccaaaacuuuucaucauccccaacaaaaacuccauuaaacaguaaguggcugucuccccauucugcuuucugucucuaugauuuugcccacaguaggagccucuuagaagcggaaucguacaguaucugucuuucugugccuggcuuauuucccuaaacauaauaucuuccagguccccccacauuguagcacgugccagacccucgcucccgucgaaggcugaugccauccuucagugauguguggacggacacauuccgcguaucccccaaucaguggauggacgcguggguugcagagcacgccacacacauucagucaguacacgaguuaacaguugcgugcuugucugccugugucauccauucgagcaucugccaaggacccaggaaacacacagugugucuccugaaggaaugaaaagcccuccuggccccucugcccucuuucuccacccucuccauuuucaccgagaugguuguggugucaccucucgugggguggccaaaaccccagccagggccaccuaucccuucaccucccuccaccucggauuuccucuuggaaaaugaggcuccugacucacuugaccuacugcguaggcuccuaaaagggugucggcaaguuggcaaguuaaaaaaaaaaacaaucagcaugaaagcacuccgauguaugcauacuuuuacuucgcguugguucccuacguucuuagaacaaggaaggagugugaguacuugcuuuggauugaaagguuuuccagacuagcuguaggaaguaugaaaguaaccaaggucucacacacagccccagcacucuggguggauuucacuucaucuacuccacucaccuacgcugagcuucccuguggacaagcucguccauccucuuuaaucacucccaggccucgcucacacagcaacaagugccugucccuguguccuugcuguuggcaagcagaaguucccuggcagccuuugaacauagcugaauguuagguaucuuugaucugucuaaggaaaaagucuauuuuaaacugugaagugaagccaauuuuuuuaggucagauucuuacccaacaaagcauacaucauccgugcucauauaguuuccaguuuaaaaaaaaaaaaaagugcuggccagcgcagugugagugcacugugcacaugaugccacuguucucuagguucagaacaccagccuucuguuaauuacaauaaaaugucuucacuaaaauagaagcauauuuaauuugccuacaaaauugcuuggagagccuuaaaaaauaaaaccuucagcugaaugauguagaaaugaaaauuugaaaguuuuaaucagaaauacuaccuagaaauaaaaucaguaggauguauuuacagguaguuuguuuuuaaguaaagaauaaaacagugacagagggaucaaagaauaaagaauaauuccuuuucaagccaggcacaguggugugcaccugacuucucagcuacccacuaggcugaggacggggagaaucaugaguucaagcccagccugggcaaaauagggagaccuugucuccaaaaaaauaugaaauaauuguuucuucauuauugucuaguacauagauuauuguaguuauagcauuugaugggagaccauauugagcacuguggccuuuuuggcccauugggcuguggaagguaugcuaggugggcugggcccagcaaagcgcccuuccuugguccuugcucaagcccuucacaggcagcugcagucucaggaaagguucagaaugucacugcgaggccagcguagaaggcagguaggcaugucacaggaggugaguggaaggcauccacuccuuagcaagugcaucaugggggaccuggaauggggucuguguucaggggagagggaaaugcuguucuugagaugauuugacagcauaucccucuuaauuaugugcuaccuggaagagguguaaaggguagcaaggugguuuuguaagaucagaauugggugcaacugcuugauucauucauucaguacauuugauggaacaccugcaugccagccauucuguaggagcuggaccaaggaagagcuugugguccaagccacagaccgggagggaagaggaagccugccuggaugaggguggucuaagccgagauuccucagguggcucugcugcauccccacgccgcagcugaagggaucuuucuguuggcagauggcccauguuuuuccagugggacaaugcccacugcuuccugcauuuugcucugauggccggagcuguauuuaguuguguccugccucagucccucccaagcuguccaccucaacucagcauggggagcgcacuccauaucugacgcuggcuucucuaaacgugaggggauagggagaugacauauaugcccuuuuacgggugaggaaaggaccagcggggauuuauugaaggcagccucgcuccccaugcugagcgacagcucugucuagccccucccugagcaggugaugaaaaccuggcccagugcgagugacaugguugcauuaugagccucuucuggguugcauuuacuuagaguuuguuucaucagugaggaaaguacucuggagacccaguugaacucugauagcuucagugagccuacagacucaaugcaaaggugacaggcuuacaggagaagguccaggcgguucaaaauugauuugagacagggagucaaccuccucuaaucuguguugguuccauuuuccaugccucauuucagcuaauuuuuguuuguguuuuuuauguaccugaucucauuuauccagauuuccuugguucagacuuucuugguucucaucacagcccuuucuuuguuccuagccugugccuaagagacaguauucauuaagggauucucccugcagugacuuaaucuauaucucuuuuuaaaaauuauuuuuaugccaggugcaguggcucacgccuauaaucccaguaauuugggagaccaagacggguggaucccuugagccuaggaguuugagaccagccuggacaaccuugucccuacaaaaaauuuaaaaauuagccaggcaugcuggugcacaccuguagucccagauacuugggaggcugagguggggggaucacuugagcucaggaugcugagguuucagugagcugugaucgugccacuagguuccagggugguagagugagacccugucucaaaaaauguacguauuuuuuuaaaucguuacuuuaggccaggcacggugggucaugccuguaauccuagaacuucgggaggccgaggcaggcggaucaccugagcucaggaguuugagaccagccugggcaacaaggcgaaaccccgugucuacuaaaaguucaaaaaauuagccaggcgugauggugcaugccuguaaucucagcuacucaggaggcugaagcacaagaauugcuugaacccaggaggcagagguugcagugagccaagauggugccauugcacuccagccugggcaacagagcaagacucuaacucaaaauaaaauaaaaauuaaaaauauauauaaaauaaaauugucacuuuuaauuacucugaaaguaauguaugcuuguuuuagcaauaccaaaaaaaaaaaaaagggaaauuuuagaaauaaaaaacauccauaugauccuacagccuuacugcuggguauauauccaaaagaaagaaaaucaguauaucacaggggcaccugcacugccauguuuguugcagcaucgcucacaauagccaagaaaugaaaucaaccuaagugucaaucaguggaugaaugacuaaacaaaauguaggacauauagacaauggaauauuauucagccauaagaaagaauagaaaccugucauuugcagcaacauggauggaaccagaggugauuguguuacgugaaauaagccaggcacagagagacaaauaccaugugaucuuacucaugugggagguaaaaaaauaauggaucucauggagguagagaggagaauggugguuaccagaggcugggaagggaagauagggagagagggugguuaagggcugcaaaaauacagucagaaggaauaaguucuagaauucaagaguacaguaggggaauuguaguuaacaauaauuuauuauauauuucaaaguagcuggaagagaagaauuguaauguuuccaacacaaagaaaagauacaugcuggaggugauagguaucccaguuacucugaccuggucauuacacauuguuaacaggcaucaaaauaucacauguccccuccaaauaugcacaacuauuauauaucaauuuuaaaaaagaaaaacucauacccauaccacccaaugaugacacuguggauauuuggggagugauucuuccuaugaucauuuuauuucugauuacacacugccucuuucacuuauauuuucauuuuauacauuuauaaguauuucugauggauauguaauauuucacuagguaugugggauaaucccuuuggcauuaaaguaguuuccaguauuuuagaaccauaaauaaaacaugaugcccucaaaaagaguaagauaguuagaaaugaaguuaucaaggagagaaaagacuugcacacugcaaacuaugaaauguugcugaaagaaauggaagaauacaccaaucaauggaaaaacaucucucguuuaugguuuggaagacuuaauguuguuaagaugucaguacugcccaaagcaaucuacaaauucagugcaaucccuauuaaaacuuuuacagcauucuuuuccagaaauagaaaaguuucauccuaagauucauagggaauaucaaagagauaagcauagccaaaacaaucuugaaaaagaacaccaaaguuggaggacucacacauccugacuuuaaaacuuacagcaaagcuacaguaaucaagacuguguaguacuggcauaaagaugagcccagaaacaaacccucacauagguggucaaacgaguuuugacaagguuuccuagaccauucaauggggaaaacacagucuuuucaacaaaugguguugggaaaacuggguacucacaugcaaaagaaugaagcgggaccuggccgggcgcgguggcucacgccuggaaucccagcacuuugggaggcugagacgggcggaucacaaggucaggagaucgagaccauccugaccaacauggugaaaccccgucuguauuaaaaauacaaaauuagcuggguguguuggcacacaccuguaguaccagccacucgggaggcugaggcaggagaaucgcuugaacccaggaggcggagauugcagugagccaagaucgcgccacugcacaccagccuugugacagagcgagacucugucucaaaaauaaaaauaaaaauaaagaaugaagugggacccuuaccuucauaacacauacaaagauuagcucaaaauggaucaaacaccuaaaccuaagaguaaaacuauaauguuugaggagaaaacauaggagaaagauuucaugacauuggauuugacagugauuucuuggcuaugauaccaaaagcucaggcgacaaaaauaaaaauagauagauuggacuacauaaaaauuuaaaacaucucugcauuaaagggcccagucaacaagaaaaggcaggccacagaaugggaggagauauuugaaaaaucauauaacugauaaggaguuaauauccagaauaucuaaagaacuccuacaacugagcaaaacagcuugauuuuuuaaaugugugaaauacuuaaauagacguuucuccaaagaauauaauaucugcaaaugaccaauaaaugcaugaaaagauccucaacaucucugucauuaggaaaaugaaaaucaaaauuacagugagauacuucacacccacuaggauggcuacuauuuaaaaaaaaaaaaaaaaaaaaaaaggagcaaaggcaggcagaucacuugagcucaagaguuugagaccagcccggacaacguggugaaacuccaucucuacuaaaaauacaaaaacuagcugguugcaugugccuguggucccagcuacucgggaggcugaggugagaggauugcuugagcccagagggucaaggcugcagugagccaagaucaugccacuacacuccagccugggugacagagcaagacccucccugucucuaacaauaaaaauagugcucgcuucagcagcacauaaacuaaaauuggaaugauacagagauuagcacagccccugcgcaaggaugacaugcaaauucgugaagcaguugcauauuuuuaauaaauggcguugggaaaacuggauauucauaugcagaauggaacuagaccucucuuucucacuauauacaaaaaucaaaucaaaguggauuaaagaaaucuaagaccuuggccgggcgcaguggcucacaucuguaaucccagcacuuugggaggccaaggcagguggaucacgaggucaggcgauugagaccauccuggcuaacacggugaaacccugucccuacuaaaaauacaaaaaaucagccgggcgugguggcgggcaccuguagucccagcaacuugggaggcugaggcagcagaaucacuugaacccgggagguggagguugcagcgagcagacaucgcaccacugcacuugcacuccagccuggacagcagagcaagacuccaucucaaaaaaaaaaaaaaaucuaagaccucagacugugacacuacuacaagaaaacaauggggaaaaucugcaggacauuggucuuggcaaaaauuccuugagcaauaccccacaagcacaggcaacuaaagcaaacagggacaaaugggaucacaucaggcuaaaaagcuucugcacagcaaaggauacaaucaauaaagugaagagacgacccacagaaugggagaaaauacuugcaaacuacucaucugacaagggauuaauaaccagaauauauaaggagcucaaacaacucuauaggaaaaaaaacuaauaauccgaucacaagaugggcaaaagauuugaguagacauuucucagaagacagacaaauggcaaacaggccuaugaaaaggugcucaacaucauugaucauuagagaaaugcaaaucaaaacuacaaugagauaccaucucauaccaguuaaaauggcuuauccaaaagacaagcaauaacuaaugcuggagaggauguggggaaaagggaacccucguacacuguuguuaggaauguaaauuaguacaaccacuauaaagaacaguuuggauguugcuuaaaaaacuaaaaauugagcuaccauauauucagcagucccacugcuggguacauaccacaaagaaagaaaaugaguauaucaaagagauaucugcacuccuauguuuguugcagcauuguugacaauagcuaagguuuggaagcaaccuaaguguccaucaacagaugaaugaauaaaaaauauauauauauacacaauagaguacuauucagccaugaaaaagaaagauccagucaucugcagcaacauggauggaacuggagaucuuuauguuaagugaaauaagccaagcacagaaagacaaacaucacauguucucacauauucaugggaucuaaaaaucaaaacaauugaacucauggacauagagaguagaagaaugguuaccagagacugggaaggguaguaguggggguuggcgggggggauggucaauggguacaaaaaaaguuagaauaaauaagacccacuugauagcacaacagggugacuauagucaacaauaacuuaauuguacauuuuaaaauaacacuaagaauguaauuggauuguuuguaacucaaaggauaaacgcuugaggggaugaauaccccauucccauucuccaugaugagcuuauuucacauuggaugccuguaucaagacaucucuugugucucuuaaauauauauaccuacuauguacccauaaaaauuaaaaauaaguuuuaaaaaauaaguguuaauguccucguggagaaauuggaacuauuguugugcacuguuuuuuguuuuuuagggucuguuuguuugagauggagucucgcccugucacccaggcuggagugcagugaugugaucuuggcucacugcagccugccucggccuccugaguagcugggccuacaggcacgcaccaccaggcccagcuaauuuuuguauuuucaguaaagaugggguuucgccauguuggccaggcuggucucaaacucuugaccucaagugaucugccugccucagccucccaaagaaagcgcugggauuacaggugugagccaccacacccggcccugugcacugucagugggaaugugaaauggugcagccacuguggaaaacaguauggcaguucuuccaaauauuacacauauaccuugaaacuguguaucgcuauuaugcaucaauuaaaaauaauagaaugggaaaaaaauaaaaauagaacugccauaugauccagcaauuucacuuguuggauauacacccaaaagaauugaaaacagaggcaugagcagauacuuguagccccauguucauggcaacauuauucacaagugacaaaagguggaagcaacccaaauguccguaaacagggaagagugaauaaacaacuucaguguaugccaauggaauaucauucagcccuuugaagguaggaaauuuuggcacuugcuacaacauggaugaaucuugcggacauuaugcugagugaaauaagccagucccaaaaggacaaacgcuguaagaucuccuuaugugaaguacccagaguagacaaguucauagagacugaaaguagagugaugguugccagcacuggaaggagggagaauggaaaguuacuguuuaauggggacagagugucaguuuugcaaggugaagaguucgguggauggaugguggugaggguugcaagacacugugaaugugcuuaaugccacagaacuguaugcugaaaacaguuaagaugguacauuuuguguugauguauauuuuagcacaauuuuuauuuuuauuuuuuuguuuuuauuuuaccuuaaguucugggauacauguguagaacgugcagguuuguugcauagguauacaugugucauggugguuugcugcaccuaucaacccgucaucuagguuuuaagcccugcaugcauuagauauuuguccaaaugcucucccacccccugucccccaccccccgacagguccuggugugugauguuccccucccuguguccauguguucucauuauucaccucccacuucucagugaaaucauuuaguguuugguuuucuguuccuguguuacuuugcugagaaugauggcuuccaguuucauccaugucccuacaaaagacaugaacucauucuuuuuuauggcugcauaguauuccaugguacauaugugccacauuuucuuuauccauucugucauugaugggcauuuggguugguuccaagucuuugcuauuguaaauaguggcacaauuuuuagacaauuguuuuuuaaucaauuauaauauuauuaacuccuuguauuuauagcauuuauauuuccuuuugcuugcuuuuggagagaacauacagaaauuugugauuuuaagaucgggcaugguggcucaugccugcaaucucagcacuuugggaggcugaggcuggaggaucacuugagcccaggaguuaaaagacuauucugggcaacauaguagagaccucaucucuacugaaaaugaaaaaaaugagcaguuguggugauucaagccugcggucccagcucugcaggaggcugaggcaggaggaucacuugggcccaggaggccgaggcugcagugagcagagaucauaccacuucccuccagccugggugacagagcaggacccugccuccaaaaaaacaaaccacagaaauuugucauuuuuaauaugagcgcuauuccugagggguuuguucagagguauuuacauguuauuuuuuugcuugagaauugauuauucacuuucccuuucuucuaaaaguuauagggauuugggggggugguuuugauugauuuuuauuuaacuguuuaagccacgucaaauuuuauucugguaugauguuaagacuuaaauugacuuuuuucugcauauaguuaaucaguugucugccccaagauugccaagcaauuaucuaauucuuccccuuccacugauuugagauauacucuuuauuauauuacauuuaugucaacauauuucucaguuuggggcuguggcuucuguuccauuaaucugccuuuuuugccccaucacacugucauuaauucauacagcuuuauaguugguaggacuugccuuucucauuaguaguguucucauucuucuuguucuuuuauuuuuugcaggugaacuuuagaauacuuuugcuaaguaccuggaaaaauagaggcccaccugaauuuuaauuggaaauacuuuaaaccuguagaucaguuuggggggaaauuaucagcauagcugcaguauuuauauuuuuauauuuccaauucagaaguacaccuuaccuuuauucaagucuucuuuucuucccucauauuauuuguuuauuuauuucuaucuuagagucuguuuuaucaaugauggccagaucagccuuggguucuuuaaagaacuacuuacaugcauaggguuucaaaagagugugggguaaaucacuaauaaaggcaagauccuuugaucugagaucauuaggaaaaauacaucaaaaagugucuucacuguuucuuugacuccuauuccguauauuauauauaaagcucuuaggagccuuucccccuuauuucuguauucccacucaucagcacaguuguaggauaggcacauuuuuucaucuuaucucguaugaaauauuaaaucauuggagggcaggucucugucuccuuaaagcccagaucuucaauaagcaucugcuccugggcuccuuccugagccccugaacgccucguuccuaauugugucugaguucaucuggcaucacucagaggaggaggaggaggaggaggcugggguguggggcagugagagucaucaacacugcuuccuaguggucguuggugaucgguggccauccccuccagacagacaacccacaggucagcagugaaggcuuagaggcaggagggcagcuaagaucuaaauuccucuuacccaacugaaagcacgugcucuuuaaaaaaaaaauuaauucugcuguucagauagcagcaaagucagagcaggugugaggccggcagccugcucagguggugcgugcccacugcccacuuguguuagaaaucacaucaucuccuggccggccauggaauccagcacugucugucagcucuggggaaagagggggaagggugggauuugguuugcuuuuaucuauuuauuuuaguugcuauugauacacacaauaaaagcuacauucuugugagggaggacuugauuagcagcccugaagggcgguagcaguucccuuacucauugaauguaucuggcgcuaaacccucagcuggaacugcgagcccuagcuguauuucagguguuucuuacucuacugugaauuauguuuaggaacuaaagggcuuuuguauccuucacaaguggggggaagagagcaggggaauugugugagaaacuauuaaaaaugaggagccaugguuuggacaaacuuccuuguuggugugaagaaaggaggaauuuuuuucaguuccaccugccgaagaggcuuuucuuauaguucguuuucauuuggaacuacuaauaacacucauuuuuguagggaaucaucucaccgcacccccucaugggauccugcaauacuccauccaauucagaaauaauguuuuucuccuuggaauagcuuuuuacauuaacuguauuugaagauagaaaauuuagaucugaauagcagcuuuuaauagccccauaaaaauaagugaaaauaucuuuaauuuuaaauuuaaacaaaauaucuaaaacuuaaaagguauuuaauaugucagcauauuugcaauacaaaaauaaacaugcuccauuucauuuuuuugcuuucuuacucccacggccaggugauauaaauauuucaauuugugucacuuucuagcuaucgaauuuauaaagcggcuuucauuuucuacguaaguuuuuaagcuuaauuuuuucagggaaaaaauagaucucaagaaaaaaaguguuugggaucauaaguuaauaacucauccuauugguaagggaaguugaauaagaguccaaacuaauggauuagaauuguguaauauuugcuuaaccauuuguuaaaaaaaaaaaacaaaaaaaaaacacuggguugccagaauccuaccuaagaugcagauauuaauuagaacuagcaagucgaaguugcacagguggguauaaaaugaauuugggaucccucacugggaaaugcuaaaguucacacagacauauacacacacuuuuuuuuuuuuuuuuuuuuuuuuuugguggcucccucgaaaucauuuguuuacagucuggccaagguuguggccuccaguauucccccuaagagaugggaucuuugccuaaaaguuacugagaaacgaaggcugcaaaaagccggaaaauaucccagcuuuuaaggcacacugacagccaaacagaacgcucuuuccguuugcaguuuuuuuagugucauuuuaaguugcagcuuccggccaaucagcgagcuucaugccugcugacaucacgaaccagccaguucccuccagcugcagagagcuucaguuugucuuuuuuuuuuuaaacuaaaauggaggcugguuucuugccuuaaggagcccauugccuuucccgcugaagucuagauguugacauguaauaaagcgggcagcaggauggugguggaugcggccaacuccaaugggccuuuccagcccgugguccuucuccauauucgagguaaguuauuguguguuucacugaaucggaaccuuccguggguaguuaauaaauggcuauugugcuucagauaagaaaagcaggaaguccuuucuagcagaauucaccccauuucgcugcagacuuaaccagaggagguugggugugucacugcaguuuggcauuuuacgaacuacuuacagaauuugaggcuugaaagaggccuugcaugcauaguucaaagcugguuuuucugcuuucugcucgcucucccauccc

SEQ ID NO: 17160 - RNA, 510 nt, Homo sapiens
auaaauguuuacggaauaaguagagaaauaggugacaauguucuugaugaguugauguacaagaaguugucugccucuuuguugaaggcucuucaggguuacagguuacagucuagaauauuuugaauuuguagaaauaaucauaauuuucugguccaagguaguucauuacccgacucacagguuuaacagcaaggacagccaccugaugucucaggcacaaccuccagcaagccauccacuugugucuuucagguggcagagcgagcucucuauuacuggaauaaugaauacaucaugaguuuaaucagugacaacgcagcgaagauucugcccaucauguuuccuuccuuguaccgcaacucaaagacccauuggaacaaguaagaaagaacuggcugccaucuuuuucagucauuuuaaaauauggcacguuuuacugcuacuucaguaagaauaaauaucagaauuuuaaauaucaauuaaaaaacaagaaggucaguugcuuug

SEQ ID NO: 17161 - RNA, 723 nt, Homo sapiens
ugagauaggcagacagcgccacagcgagcagccgcagcccuuccucccuagagagccccgagagcugcgacucgggcaggggccucagcggguuucugagcagccucagcuucacacaagcucgguuccaagucacgcucugccaaagcuguccgugacccuggacaguucggaagcucuggggcucuccccggaggccgaguuacuucuguuugaccuuuacacuggagaaaggaccucuuccuaacuucucuucacccuuuugaacgauuuuaggauccuuuguucagguucuuugagagagaagugaagaugggcgcaaagcugcuucaggacguucgccaggaccuugcagaugucguccaggugugcgaaggaaagaagaagcagaccaacuacuugcgcacgcugaucaacgagcuagugaaaggugcgugagaggccgaacucgugguguggcuuccggcgggcaccuuggccaggggccacaacccagcccagccacacagcaccacgugcagacagccaggccugcaggagcuuccgagagcagcucugugcucuuacccucaaggugggcggggggaggggaggagcuuagaaaugcugaagaauuuguuuuucuucugugcugguucacugaauguugaccaaaaucuuuacacaacuucuaguuuuuuaggggucuuccaagacgacagugaauggggaaugugguggucc

SEQ ID NO: 17162 - RNA, 655 nt, Homo sapiens
gacccccgcggcggggccgcucuguucgcgugcggcgccagcucuggcgcugcugcagagccucggggagcccgcggccgcccggcccauuccugaagcggggugcggaaaccgcagcggucccgaggccuccggaauagaaagcgcggccgcccgggagcgcggcccuggcugcuucagggaucugguccggcccccacagccuccgccccgcgccagccgcccccagucccgguccccaguccaccuccacaggcccccacaaccacccgucaccuuggcuaagugaccgcacaggaccaacggcacagccacaccgggacgcugaagcaacugacgcgccacccccgcgccugccuuauauagcgacgggcccgcccagcgcgcggcgcuuuuuccagaagccucccgaaccuuccggaagaacccuccccagccgccgccgcggccgcgcgccuacgcaugcgccguugccgcggcaccccgcccccgcgccuuccugcgggcgcgcgcaggcccugcucguggcccggcccgggcaaccuucccucaaucgccgccgcgcgccucucgcacgcccccgcgccggccucaaugcgccugcgcggcccggaauucucgggaagguccgggcgccuucuggggccgcccgcgc

SEQ ID NO: 17163 - RNA, 1306 nt, Homo sapiens
uggccccacugucaccgcccugcucccggccucugccuacgccgcuggcuggcuccggugacgcccgggucgguaccuugcggacccccuuguagauauagaaguacagcucccggcccacauugaagcagaggcggucgccguugccagacuggucguugagguuuacgaaggagacgcggacaggguuggaucccugcgaguugaagggcacccgguugggccggcuguacuccgagugcggcagcagcuuguacagaccuucccggguggugaauugggucuuaaucucguucaucuccuucccuccucccuccgucgccaucuuggaaagcagcguucauccugcccuaagugcccggaucacgcccaccgcgcaggcgcuguuccuggugcucccucuucccccacccccugccucuuccuucucgccccucccacccgcgggccagcccugcgagggcgggccaaagggaaggggugggcuuguuuacggcccgacugcgcaggcgugcucaccuggcgugcuccacccgacugggcguccgcaggcuccucccccggguguggccuccgggcggcauggcugcuucccaggugaugccggcuucagcuaguggggucuaguugaccguuccgcagccgccagggccagcggaaagccggucagggggaaccgcggcggggcuggugucaugagccugaggugaacuugagggugccuccucagcggucucccgcccugcccugaggggcgccgggaccccaaagagcggaggaagagcgccaccccgacggccaccgcuucggagccagcacgcgggguacccuacggggagcgcggaugcccccguguucgggcggggacggcuccaccccuccugggcccucccuucgggacagggacugucccgcccagagugcugaauacccgcgcgaccgucuggauccccgcccaggaagccccucugaagccuccucgccgccguuucugagaagguaccaagggacucaagauuuacgcuucacuauguuuuauuucaggcgggguagggggagagaagaaugugguacagcauagguguucucaagccagauauccuaauuccugcgugugaugagcacuggcggccuccgcuucuuagcggagguuuguccucuccagcuguucagaaacacggggcggggaagcgcuuugggaaccggggacugaaucuuuuuaggauucacugaucuugcucaguagguuacgaagagcucuuaauaaaauuuaagguaauuguuuuuuuuuccagaagccucaggu

SEQ ID NO: 17164 - RNA, 84727 nt, Homo sapiens
aggcuucuggaaaaaaaaacaauuaccuuaaauuuuauuaagagcucuucguaaccuacugagcaagaucagugaauccuaaaaagauucaguccccgguucccaaagcgcuuccccgccccguguuucugaacagcuggagaggacaaaccuccgcuaagaagcggaggccgccagugcucaucacacgcaggaauuaggauaucuggcuugagaacaccuaugcuguaccacauucuucucucccccuaccccgccugaaauaaaacauagugaagcguaaaucuugagucccuugguaccuucucagaaacggcggcgaggaggcuucagaggggcuuccugggcggggauccagacggucgcgcggguauucagcacucugggcgggacagucccugucccgaagggagggcccaggagggguggagccguccccgcccgaacacgggggcauccgcgcuccccguaggguaccccgcgugcuggcuccgaagcgguggccgucgggguggcgcucuuccuccgcucuuuggggucccggcgccccucagggcagggcgggagaccgcugaggaggcacccucaaguucaccucaggcucaugacaccagccccgccgcgguucccccugaccggcuuuccgcuggcccuggcggcugcggaacggucaacuagaccccacuagcugaagccggcaucaccugggaagcagccaugccgcccggaggccacacccgggggaggagccugcggacgcccagucggguggagcacgccaggugagcacgccugcgcagucgggccguaaacaagcccaccccuucccuuuggcccgcccucgcagggcuggcccgcgggugggaggggcgagaaggaagaggcagggggugggggaagagggagcaccaggaacagcgccugcgcggugggcgugauccgggcacuuagggcaggaugaacgcugcuuuccaagauggcgacggagggaggagggaaggagaugaacgagauuaagacccaauucaccacccgggaaggucuguacaagcugcugccgcacucggaguacagccggcccaaccgggugcccuucaacucgcagggauccaacccuguccgcgucuccuucguaaaccucaacgaccagucuggcaacggcgaccgccucugcuucaaugugggccgggagcuguacuucuauaucuacaaggggguccgcaagguaccgacccgggcgucaccggagccagccagcggcguaggcagaggccgggagcagggcggugacaguggggccagggugaccgagagggguggccgucgcucuuacuuuugagugggccgguaacuccacugggguacuccugaggagaggggauucaggaguaaggagggugguggcgguggcguuucgaaggggugggggcaguggaaagggaccguggggcgcggggguucuggcugggaggcucccgggggagccggcugcguccccuccagccugguccaucaggcucugacauggccagggagcgggccugcgaguccccggaagaggugagguggccgucuugucugcuucgauugccucgccucccuggaggguuggaagucucgcccuggguuagagaacagggacgcaagacggcuuaacaagaucucuguaaggcggaaccggggccgggaagcggagcauugagacuaggucagaaagaaccugcucggcacgcagggcuacuccaccugcugccgcacugacacuuccuaggagccucuccugguguuaacauuucuauuuccaaaaacauccgcgggaggacggcugucacugucuccgccguggggaccuucugaaagauuguuaaggagagucaucuugucccuuguaguaugcgaagggcugaguacuacaguugaaaugauguuuccagugaacuaagcugguucagagggguugugugagagugcccagauuaaucuuguccaacaagucagacugugucccaaacagggagugauaugcuuuaaaagcugcuuuaaagggaccauccuucuuggcgggcgaguuaccgguaauucugugaaacauguaagcauccuuuaaaaguaucucuuuaaaagcagccauuuauuagaguuuuucuuucauuggcuauguaacuauguuuucacugagaauugcuuauuuuugagauuguagucuuugacuugaugucauggaagagugaggaaauuaaugcaucccacagcaccuccaaauaggacaaggugauaaaagauuaagucguaaaugcauguuagcaugaaaauaaauuguucauauugaagagugaacauucuucaggauuuaauauagccagauccaguacaggauuuucgcuuguuacaagagcuagggaaaugacagugguaucuaaauguagcaaaguuguuucuuugauucagggugaaucuuuuuuucuuagucuuuaugauaauaaguguaccacuguauuuaggguaugcuguuggaaguuauuaaggguaaaucgcuugaccuuuuuuuuuuccucguuuggaauugcaaaagcucgaaguagucuucagucuaggggcugaaguuuuacuccuacucccaacuuugucacugacuuguuugggugaccuuggauaaguuauuuaacuucuauuugcaccucuuuaaaaagggaauguuacagugcacguuguaauuaauaauauaauaaucauaaugaacuuuaaggcccugaaacacucaguagauguaaaauauaguuaaauacugacugucaaauaagaagcugcugucuugacauugauaaucagagugaaaggaccaauuuugucucaggaaauuaaguuuagaauuuuaaguuauaaaaauuuauauuuauauaaaaauacgaugugcuuaaaaacuaaauucacuaacuagcaauuauuaauguaggaauuacuuaaaaauuuuuuuuucuuugaaauguuaugacuucugaagcauccuaauggcagaccuuaucuggaucugguagcccuguuuuacaucauaaagacagguuucuugccuggaaguaucauuacaauaguguucucuuuuagugggacgcuauucccugaaggguaaaaggaggcaagguuuuuaaaaccacaccaaaaaauuauuuuaaacaagauaaaugugaaauacguaaauugcccuuaccugcauaauuugaguguuuuaacgcuuuuuggguaaaauuucauuuucaugugguaguaucuuguagauacauuugcauuguguugcagauguuucuacucucuuuuaauuguaacuuaaacauuuuuuuccaugaaugaguuggcauuuauuuguuguuauuucugaguauaagugacuuuuuaugacuauuuucugauuuaaaauauaggaaauacauuuuccuuaauuggaaaaccaaaauuuacuuuuuagaguuaguaguuacaaacauauuuuugacaguuggcuauuaaacauguuuuuguuuuuguuuuuagagacaggaucucauccuguugccuaggcuggagugcgguggcgugcucaucguucacuacagccucaaacuccugggcucaaaugaucuucccacuucagccuuccuaguggcuggaacuacaggugugcaccacccuggcuaauuaaaaaaaaaaauguuuuuuagagauggaggucuugccguguugcccaggcuggucuugaacuccuggccucaagcgauccucccaccucagccugcuaaagugcugagauuauaggugugacccaccaugcccagcgcacaguuggcuguuuugacuuuuuuuuuuuuuuuuuuuuuuugguccuuugaggcguguaaaauuuuacaauaauuauuuggauuauucagaagaucuaauuuagaugaguaaauucaacuuaagucuguguguaaaaugaguagaaaauaggucuuuuaaagaacuuaacucauuaauuacgugcuaccauuccugagaggaaacaugggguccuggggaaauggaguaggugaggaaguagucuaacguucaugcugaggagugcaaucuugauccuuuuaaaagguuuacaggucagugucuggagcuagaaggaacuuuagaguuuguuauuucacccuccucagagcgaaccaaggccagagaggggaugcaaaccuguuagaauuuuuucucauaguaaggaaaaugaagcacagcugagucuaaaccagcuuagaagagacugauccaccuuuuugaucacagggauauuauauacuccgagcacuucagaaucuaccccggcauuuugccauauauuauuuuauuaaauucuugagguagauuaaaacaucuuuucacaaucgaggaaguuuagagugggguuucuugugugaggagauguaguuuugcaaauuuauuuaaagacaguauuaacauugauuuaauacugacacuaaucauuuuaccagauuugagugacuacugugauaguaauaauaccaggcaaggugaugugagguauucagagcuaaauaagacccugucccucuccccaaaagacuuucaacuacuagcuuuuaaacaucuuuuuuuuuuuuuugagacaaagucuagcucugucacccaggguggagugcaguggcacaaucucggcucacugcaaccucugccuccuagguucaagcgauucuccucccucagccucccgagcagcugggacuacaggugcguaccaccacgcccagcuaauuuuuguauuuuugguagagaugggguuucaucauauuggccaggcuggucucgaacuccugaccucgugauccacccuccucggccuuccaaagugcugggauuacaggcgugagccacugcgcccggccguaaacaucuuuauuacauacuuuguucuccuuuuuuaaaaaaagagauuguggucgggugcaguggcucauaccuguaaucccagcacuuugggagacugaggugggaggaucgcuugagcccaggaguuugagaccagccuggauaauauaucaauacccuguguccacaaaaaaauaauaaaaaaaaaauuagcuggccauggugguaugugccuguagucacagcuacuugggaagcgaggagggcucuugagccgaagaguuaagguuacagugagcuaugauugugccacuguaccccaaccugggcaacagaaugagacccuuucuuuaaaacaacaaaaaaggggaguggggcuaugcgccauggcucacaccuguaaucucagcgcuuugggaggccgaggcagguagaugaccugaggucaggaguuugagaccagccuggccaacaugguaaaaccccaucucuacuaaaaauacaaaauuagcugggcgugguggugcuugccuauagucccagcuacucgggaggccgaggcaggagaaucacuugaacccuggagucggagguugcagugagccaagaucauaccaccgcacuccagccugggcgacagagcuagacucugucucaaaaaaaaaaaaaaaagauuguuuuaggauguaggauaaaagaugccaaagguaagguagcugggcuuauuggaccaauccucucauuuuauggacaucuguuuuuacauaaauaugaauggccuccauucagaucucagcuuaaccaucacuuccucaggaaauuuuucuuugaauccccaugguguaucaguuuuacccuauuacauguuuuuuuguuuuguuuuuuuuuuuguuuuugagacagaaucuugcucuguugcccaggcuggagugcagugaugugaucuuggcucacugcaaccucugccgcccgggcccaagugauucuugggcuacucccgaguagcugggauuacaggcaugugccaccaugcccagcucauuuuuguauuuuaauagagacgggguuuugccauguuggccaggcuggucuugaacuccuggccucaagugauucaccugccucagccucccaaagcacugggauuacaggcucuauguucuuagagcaucuugugcuuugccuuccuagcacuuuucugaauuuguaauucugugugaugauccaacugugccuucuauaaaacaaagcucccuuagaauagggacauuaucuuuccugcucuccaucuucucaaugcacagugcaguguccaguuuagaguuaggcccuugcuguguacuuguugagugaaugacugaguaaagccaugucugucuauaccaaacuugaaagagaucuuuagaagaugaaaaaccuauucaguuuugggcccaaaaguaacuuggguauuuuuuaauagcucauaucuuuuaaaagacauuuaaaaauauugcuaguagguaaaaaauuuaaccuucuuaaaauagggaaaucguguaagagacaaugaaguaauaguaaacaaaugacacagauuacuuuugaucuacuucugucaaaccaugucaccuacaagauccauguacaacuuuuaaaaacuguucucaggccaggagugguggcucauaccuauaauccuaacacuuuugggaggccaaggcgggaggauugcagggguccagccugggcaacacagugaaaccucguguggguucgagaccagccuggacaacauagugaaacccugucucuacaagggugggcguggugucaugugccucuagucccaccuacuuggaaggcugagguagaagggucacuugaacuggggagguugaggcugcagugagcuguaaucgugccacugcacuccagcccgggcaagagagugagagccuguuucaaaaaaacaaaacaaucaauaauaaacaaaaacuauacucagaauuacuuaacauucaagccaaagaaccuuccuaccuucccacaucuuaagauuccaggucacaaauguacugcccagagaaguuacugaagugguaacuacaggagguaggaaguagauuuagaggauucuaagguuuuuccaucucuaaagcuuauaugauucuguacucaguuguuuuuuuuuuuuuuaaauggaaauggauucaucauucuauuggggagguaucuucaucucuuugauucauugccuacuugauuuggaauugagaggggugggguguuugggaaagcaagcugaaaacauugugauuucuagguauuuaugcuggaagaguuuuuuuguuuguuuguuuguuuguuuguuuuugagacgaagucuugcucugucgcccaggcuggagugcaguggcuugaucuuggcucacugugaccucuggcacccggguuuuaagcgauucuccugccucagccuccgaaguagcugggauuacaggcacuugccaccaugcccagcuaauuuuuguauauuuaguagagacaggguuucagcaucuuggccaggcuggucuugaacuccugaccuugugauccacccgucucggccucucaaagugcugggauuacaggugugaaucaccaugcccggcuagaagagcuuuauguucaugaugcugagaugaaguuggggccagaagaagagucaguugauaaaagcuaaaguauuuuuagauccugauuaaagaagaagguaauggguugacuugagagagaaugagcguucuguuaugggaaugcucauaugggaaauguucugucucuuugucaaaaacugcaggaccaccuguuggugacauuggaggaauuccugcuuugugugggagggugaacuagaugccuuuaaaaaaaauuucccccccacagacuuguuuuagauauuuuacugcuucagagagggucauguucacaccauucuccccuuuuguaauuuuucacaccucccuggcuccccuuuuauaauuuagaaagagguuuagaagucuguaacuuuuuguauuagauuuacuuugagaaaucuuguacuuaauuuaguaggucacagaggguugcugaaugacuggaaacuuguguuucuuuuccauuaagggcuauuugcugacuucugaaauauugaugauuuauuugacuuuagaauuuugcauacugaggggaaagcaucuuaauguaucauuuaaagcaggagauacuuucauacuauaccuggguucucuuggcuuugaagaggaggguggucaugagauauugaaagauugcauggguggcuuguaaucccagcacuuugggaggcugaggcggguggaucaucugggguuaggaguucaagaccagccuggccaacacggggaaaccacaucucuacuaaaaauacaaaaauuagccaaguaugguggcgcaugccuguaaucccagcuacucaggaggcaggagaaucacuugaacccaggagguggagguugcagugagccaagaucgugccagugcacuccagccugggcaacaaagcgagaccuucccaaaaaaggaggacuucauggguagauaugagcaauggugagaagcaccuggaauaugucauggaaguccgugagauagucaugaaugccauucuuucagcaaauauucauggaguaugccuaccagauaugagguacuguuuuagaugcuggguguagucagagucucugcccucaagaaaugugucacuuauacgauauuuauuaucauugacuuaauauagugacuuaaggguaaagugcuuugauggcaaacuugagcuugagcaagcaucaaaacaugguggauuuugucacugagugguuuggcuguauggcuaaagaaccuuguuuuauuuuauuuuaguuuuaguuuuaguuuuggagacagagucucacucuauuccccaggcuggagugcaauggcaugaucuugguucacugcaaccucugccucccggguucaagccauucgcaggccucagccucccgaguaacugggauuacaggcaccugccaccacacccagcuaauuuuugucuuuuuaguagagacgggguuuccccauguuggccaggcuggccuugaacuccugaccucaggugauccaccugccugggccucccaaagugcugggauuacaggcgugggcuacuacgccuggccaagaaccuuguuuuaaaaauaggaagauuuuugucgucuggaauuuaguaucucagagaauaauucuguuuguuucucagugagguuaguuugugcaguaauaugaaaugugaucuuguuugguuauucaggagaagaccuuaaaaauagaaguaaccuuaauugguagacauuucuaauugguagacuucaguuuuaauuuucaggacacuugaaauugacagcaucagugacaaguuaccuuggcucuugcccuuaaucccaguauuuuaggagaccgaggcaggaggauugguugagccccaggaguuugagaccagccagggcaacauagugagagcucaucucuacaagaaaaaauuagccaggugugguggugcacgccuguggccccagcuauucagguggcuuaggugggagaauugcuggagccugggagguugaggcugcagugagcggaaauugugccacuggacuccagccugggugacagagcugagacucugucucaaaaaaaaaaaaaaaucauaauccucauucaucaagcauuuauugaugacugguauauacaaggcacugcugucuauuguggcggaugugaaguguauuuaacacuccugucuuuaaagaguuuggcuuuguguguguguguguguguguguguguguguguguguguuuggaacagggucucacugugucaccuaggcuggagggcaguggcacaaucauagcucacugcagcuucaaccuccugggcucaagugauccucccgccucagccuccugaguaauugggacuacaggcaugugccacugugccuggauaauuuuuaaaaaauuuuuuguaggccaggcgcgguggcucacgcuuguaaucccugcacuuugggaggccgaggcgggcggaucacgaggucaggaguuugagaccguccuggcuaacacagcgacacccccucucuacuaaaaauacaaaaaaauuuagcugggugugguggcgggugccuguagucgcagcuacucggaaggcugaggcaggagaauacuugaacccgggagguggcgcuugcagugagcugagaucgugccacugcacuccagccugggcgacagagugagacucucucaaaacaaaacaaacaaacaaaaaauacauacauaaauacauuuuuuucuuuuguagagacugggucuugcuguguugccuagucugaccuugaacuccugggcucaagugaugcuuuugccuugugcucccaaagugcugggauuacagaugugagccauuguucccggcugauuuuguauuuaucauuauaauacaaaguagaggauaugugcucugcauguggcauagcaauguaaguaucaaguggaauuaaggaguaaaggugaaguggaaaaguauuucucugccuaguagaagaauauugcauuggguuucaaauagauaauuugcccuaaaauguugugugcagaucauauuuuuuauaaauuuuuaaauuuguugccuuguauuucuaauuucagaaaugcuuuauuuuuauuucugauugagcguaagauguccacugcucuuuuagcauuuuucucaacuuuucagcuucucugccaguugguaauuuguaaauugagaaauauuuugugucaucaauucuauuuuauuuauuuauuuauuugagacggagucucacucugucgcccaggcuggagugcaguggcucgaucucagcacacugcaaccucugccuccuggguucaagcaguucucugccucagacuccagaguggcugggacugcaggcacaugccaccacgcccggcuaauuuuuguauuuuuuaguagagaugggguuucacuguauuggccaggcuggucucuuaacuccucaccucgugauccacccgccuuggccucccaaagugcugggauuacaggcaugagccaccgcacccagacgucgauucuauuuuguaguagauuuuuaaaaaguagauauauuauucuaaaaacaugccaaaucaguuuguguuacagcuuaucuugcuuuguaucaauaggaaaauagcuuaaauauauagguuuuauaagaaagaagcaagaaucauucaugaggaaggaauuuauaaggauuuuauauuuacaaaguaagaaucaggccuggcauaggauuacaucacgccuguaauccuagcacguugggaggcugaggugggaggauuucuugaggcuaggaguuggaaacaagccuggacaacauagugagaccccaucucuacaaaaauuaaaaauuagcugagugugguggugugcgccuguagucccagcuacucggggccgagguaagaggauugcuugagcccaggguggggaggucgaggcugcacugugauugagccacugcacuccagccucagcgacagaaugagaccaucucaaaaaaaaguaagaauaauucaguaagagggaauauuuuaacaucuuaguuaccgcauuguagauuauugcucugccaugaagcuguuuuuuucuuuaguugacucacagccagcuuacccuuuuacuacccuuuuuuguucugcuacaguaaaacuuguacaggugcucauucucuuuacuuacuuggaucucugcuuuagagcucugucuugccuuaauauuucauuuaauaaauauuugaguaguuuuugugugaaaagcaguaugccagacuuugggaaaucaaagaaguaugagguaugggcccugaccuuaagaguaucaucuaaccaaggacggacaugauauucacacacucauucuaagaggacuuacugagugccugcucuauauuguuaagaaucucugcugucaaagaguucacaguccaauggaauaaucaagggcuuauucauucaacuaacauuuauuggaccuguggauccaaagauaaauaagacauagucccuggcccaaagugccuacagucuaguggugagacagauaaguaaaccagcaaugauaaggcagcugcuaaaaggcauucagaacugaacauugccuauuaauaggugcuguguacaguuggugagaggauaaaugcauaacucuuuaaaguuuauagccuuuuuauuuucucuucaaaaccauccauuggggaauuuuuuuuuuuuuuuuuuuuuuuuugucauuggagagauuguaguguguccacggauaaugaagggcuacaguagagccugauguuaaacccaaggccugugccuaggccucuuacacgagcuuuucugucaaaaaacgaacuaugacugauacugaugugauuccugagagugggaaauaguaggcuaaaaaguaauuaggagguguuuuuuuguuuuuguuuuuguuuuuguuuuuuugagacagggucucacuuuguagcccaggcuggagugcaguggcucaaucauagcucacugcagccuugaacuccugggcugaagccauccucccaccuuagccucccauguagcugggacuacaggugugcaccaccacgccuggcuaauuuuuuuuuugguagagacgaggucuugcuguguugucuggguuggucuugccuggguucaaacgaucuuccuuccuuggccucccaaaauguugggauuauaggcaugaaccaccaugcugggccaggaaauauuuuauagaagagauaugacauggguacucuuuucuuuuccuuuuucuuuuuuuuuuuaaugaaacaagauuucacuuugucaccuaggcuggagugcagugacacaaucauggcucacugcagccucaaccuucugggcccaaauaauccuccugccucagccuuccaaguagcugagucuauaggagcaugcuaccacccacacccaccuggcuaauuuuuacuuuuuuuguuuuuggacacagggucggucucgcucuguugcccaggcuggagugcacuggcacgaucucaacucacugcaaccuccgcuuccugggaucaaggggucuucccacuucagccuccugaguaucugggacuauaggcaccaugcccggcuaauuucuguauuuuuuuauagagacaggguuucaccauguugcccaggcuggucuuggacuccugaccugauaucauccucccaucacagccucccacagugguaggauuauaggugugagccacugaacccuggcccaugaguacucuuuuucuuccucucggauauaaagaaaugaucugaacaucccuggaaguauugauaagaaagacagcaagauuuaagagaucacauaauaauaguaauagcugacauuauuaauaacauauuaaucauguuaauaauaguguggauuauggauaauuauggauauugugcuaacagauuaugcagggucucucuuuuuuuuuuuuugagacagagucuugcucugucaccaggcuggaguacaguggggugaucucggcucacugcagccuccgccucccagguucaagcaacucuccugccucagacucccgaguagcugggacuauaggcgugugccaccaugcccggccaauuuucguauuuuuacuacagacgggguuucaccauguuggucaggauggccuggaucucuugcccucauaugauccaccugccucagccuuccaaagugcugggauuauaggcgugagccaccguaccuggccccaugaucucguuaaaucuuugcaaauaaucuuauaaaguagacacuauuaguauccuuauuuuacaggugagaaaaugagauuuguagcaacuggauacuuugcauagguuauaaaacuaauaagccauuguccugggguuugaauccaguucuguucaacccuagaaccagagugcuuaacaauaagcuagggacuuauauugucaguaagcacaggacuaggagucucauugggagcucuggucccugcccaaaucucauguugauuaguaaucccuaguauuggagguggggccuggugggaggugauuagaucaagggguggauuucucaggaaugguuuagcaccaucuacuuggugcugcccucacgcuagugaguacgaguucucuccagaacuggcuguuuaaaaguguguguggcacuuccuugucucccucuugcaccuucuuucuccaugugaagugccugcccccccuucaccuucugccaugauugaaagcuucuugaggccucacuagaagcugaguagauggcagcacuaugcuuccuguagagguugcagaaccaugagccagugaaaccucuuucuuuuuuuuuuuuuuuuugagauggagucuugcucugucacccaggcuggagugcagcagugugaucucggcucacugcaagcuccgccuccuggguucacgccauucuccugccucagccucuggaguagcugggauuacaggcgcccaccaccacgccuggcuaauuuuuuguauuuuuaguagagaugggguuucaccauguuagccaggauggucucgauuuccuaaccucaugaucugcccgccucagccuccaaaagugcugggauuacaggcgugagccaccgcgcccggccaccucuuucuuuauaaauuacccagucucagguauuuccuuguagcaauggaagaacagccuaauacacugcuagaugagauuugcuaguacaacuugugcccucccuagaaccucuuuauacuaacugcuuccucuacuaggaaugcucaccucccuuauuuuaugcauugcuggcuccuucuugcuguuuagaucacagcugaaaugucaccauccaucagagaaccuacucuugaccaucgauuugugguagcuauuggccaccuucaguaauaucacucuuuuaaauacccuuugucuggguacaguggcucaugccuauaaucccagcacuuugggaugcugaagcaggaggauugcuugaggcccagaguuugagaccuugucucacuauguuaaaaauuuuuuuaaaugagcuagaugugguagcacgcaccuguaguuccaggggagacugagaugggaggaucucuugagcauaggaguuugagguugcagugagcugugcucaugcuacugcauuccagccuguguuacagagcaagacccugucucaaaaaaagaaaaaaucuuucauauacuacuuacuacugguugucuuagucucucagacuacuguaacacaauaccauagauuagguagccuguaaagaacagaaguguauuucucacaguucuggagucugggaagucaagaugaagguguuggcggauucauuaucuggugagggcucucuuucugguuggugucuacucacuguguccucacaugguggagggggaaggcagcucugugggaccucuuuuauaagggcaccagucccauccaugggagccacaccaccaugaucuaaucacccagaagccccuaccuccugauauuaucacauugcugaugagguuucaacaaaugaauuuugaggggacacaaacauucagaccauagcacugguauugucauguuuacuuauguaugcauuugucugucucuuucaccuuccuuauugaacauaagcuuccugagagcaugaauaagccuuucugucuuauucaucauuguauccccuguucgguaccuagaacagugcuuggcauguugcaggcacugaaauauuuauugaaugaauaaaugaguguauacuuuguugccuuuuuguuuguaugcuauccuugauuauuggugagaaugauaacuucacagucuauaaagcauuuacauagagcacuuuaguugagcuuuaugggagguaaggucaggcagucauuuauuguuauuguuccuacuuuauggaagaagaaauggauucaaggacauagauaauaauugauaggauuauuaauaauugauaggacaaagacuugugacuuuguccagcuuuuacucccugcauuaaccugaagcugccaucccagcaguucugaguuuaaaauagaccaacucauguuuggagccuuuuuagagguugagauugcuccaacagugcauauuuugccuuuuguacgaugaucugugugacuuugagcagguuguuuaaccucucagagccucggguuucauuuuuuguaaauagagaugagaauaucuguccugccuacuucacuguuuuuuuaggauuagugagauaauuauauaaacacucuuucagaaaugguaagguacugucaaauguaagauauuucuuuuaguuauacaaggauauaccaaagggcugcaacugacucauucuacuaucucucacaugugacuugcuaauugacugcuguuuucuuucaucuggagcccugcaaggauaagggggaacuggguaagaauggggaaaggagagcagccuuagagagaccagagagagauuacugggagagcagugugggaauuuucaaagguugaagagacucuggggagaagggaaagcagauauaggagcucagcauuuuccaucccuuuguagaugugcagacuaugucugcucuauuagacagcauugacucauuagggcuccuuagccugacuagaauuuagaggguagccugaaugggaaaaauauuucacuuuaaaaaauuuauuuauuuauuuuacuaacuucugacauuuaacauguuccucaguuaugaauauagacaucacaauaauaaugggaccuguggcaauuaucaaugaaaaucacagacauuuuuuccuuuuuuuuuuuugagagggucucccugucacccaggcuggagugcaguggugugaugugggcucacugcaaccuccauccccgggcucaaaugaucuucccaccugacuuucucagguagaugggucuacaugaagcuuggcuaauuuuuaauuuuuuuuuuuuuuuuuuguggagacaaagucucacuauauuauagccuaggcugguguugaauuccugggcucaugcgaaccucccaccucggccucccaaagcauugggauuagaggcaugaggcagaggcagcacucccugcccacagauguuuucauaucacauugugguuguugcaugugugucaaauaucauuuacauccaucacuacuuugaaauuaccauuagaucuuuuuuuuuuuuuugagacggagucuuggucugugccccaggcuggagugcaguggcaugaucucggcucacugcaagcuccaccucccggguucacgccauucuccugccucagccucccgaguagcugggacuacaggcacccacccccacguccagcucauuuuuuuguguuuuuagcagagaugggguuucgccguguuagccaggauggucucgaucuccugaccucgugaucugcccgccucggccucccaaagugcugggauugcaggcgugagccacugcgccuggccccauuagaucuuguuauucaauauguaauuaagaaauuuuugaaaaguuauaguuauuuaguauaauacaacuguacuuuaauguagaauuuuuuuuuuuuggaaaccgggucucacugcagccuugacuuccugggcucaagugacccuucugcucuggccucccagaguccugggauuauaggucugagccaccaugccuggccauagauuucuuuuauagauuuaugcauuuaaaaacuauuggggccaggugcgguggcucaugccuguaauccuagcacuuuggaaggcugaggugggcggauuaucugaggcaggaauucgagaccagccugaccaacauggugaaaccccuucuuaaaauacaaaaacuagcugggcgugguaacaggcaccuguaaucacagaaacuugggaggcuaaggcaggagaauugcuugaaccugggaggcggagguugagugagcggagauccgcgccguugcacuccaucuugggugauagagcaagacuccgucucaaaauaaaaaauaaauaaaauaaaaauuauuggggcugaggugggaggauuguuugaggccaagaguuugaggccagccugggcaacacugugagacccccaucucugcaaaaaauuuuuaaaaauuaucgggcauuguggcacgugccuguugucccagcuacaagaggcugaggugggaggaucacuugaacccaggagguugaggcugcagugagucauggucacaccacugcacuccagccugggcaacagaaacccugucucuaaaacaacaaaaaacaguuguaaggaguccauggcacagaaaguuuaagcacccugauuuagguaagucuucccuuaacuucuuuaguaucucaugugugauugaauauaagaagggugacuaguuucuuauguccugugaaguguaacuuuuagcuccaugaagagcucucuugugguacuuucacucagcaguugcucaucuagaauucuaagcuggccaugcuuuuugcuucauuuuucuucuuccugaucauucuugcugcccuaacuagagggcagaauacaagaaccacuccacaagguggacucuguuccauuugguucagauaguaggugaugacaguguaauauuugucucaauugcagcaggaacuuuagagaagauuuaauaaggugucauuugaauucagauggugggucagcugaaaggggaggggauucuaaaccaagagaacuagaaguucaaggccuaaggauguggcagcugcuggcuccuucugggagugugagcugcagugugagggcugaagcuugugcaaggcuuggggaggguaggauuaucuuccuuagugguggucauuuaaauguuggccucuuuuagaauucuuaguaugauuuaaaaagugugucuuaaaauguauuuucuuuuggugcuaguuccaaaguaauguacuacauuaguguauuguccuccuuuagggcugaagucaucagauuguaucagugcugucucggggugcuaucgcuucccuuccuuucucaauguuuucagccccugccucacugccacugucucaagcauuaccccuguuccagugcagugagcaaucauuauaacgccccucguauacacacucgaucccagucuuggcuaaagugaauccucugccuacugcacaucugcacgugugcccugcaugugguugaaggauagcacaucugugcugccuacacuccccuaagauucagaaccaucaccuuggaggggugcauggugcugacaagcaguugcaccacacugaccccacccuucuagaugacaauuuuuuuuuuuaagauggagucucacucuuguugcccaggcuggagugcaauggcgugaucuuggcucacugcaaccucugccuccuggguucaagcgauuccccugccucagccuccugaguagcugagauuacaggcauguaccaccacgccuggcuaauuuuuguauuuuaaauagagacgggguuucaccauguuggucaggcuggucucaaacuccugaccuuaugauccgcccaccuuggccucccaaaguguugagauuacaggcauuagccacugugcccagccuagaugacaauuuuacaacuuuguccucagaucuucaauaaccuacuucccuauccuuauucuuaguugaugacuguacuucuuauuucacuuagaacaauuaaacagucaaaagagaauuucuccagauuucuacccucacaucucagcuucugucuguaccggaugccuucccuucuauuuuuaaggaagagcucugccccugucuaaagucaccuccccgacucguucgcuaaaucccaccucauuuuggcuaaucgguauucucuguuuccuacaaacgugucgcuguuucucucauuuuaaaacaguugucagggggagagacucuuucugacacccacucauuuucuuucuuuuuuuuuaaggcagggucucucucagucacccagacuguaguguaguaaugugaucaaagcucaccgcaaccuuuaacuccuggccucaagcgauccucccaccucacacucccaaguagcugggacuaaaagggugcaccaccacaccccuggcuaauuuuuacauuuuuuguagagauggagucucacuauguuacccaggcuggucuugaacuccugggcuccagugguccugcuucauccucccaaagugcugggaugacaggcaugagccaccgcacccagcccacccacucauuuucuaugggucaugugccuccaguugcugcuggcccauuucucagcuacuucuuagagcaaagcaccucuaguuguuuaaauugucucagcccucaaagugugauccacagagcuacaucagcaucaucagcggucaccugggagccuguuggaagugcagaauauuggccccauuuacugaauuaaaucugcauucuaagacaauccucaaguguuucagguacacacuaaaguugaagaggcacuggucuuuacuagcuuucuuugauuguuucaccgccucuuaaaacuuaauccagcugggugcgguggcgcacgccgguaaucccaacacuuugggaggcugaggugggcagauugcuuuaucucaggaguuccagaccagccugggcaaaacagaccucaucucuauuaaaauuuuuugaaaagaucaacgaggaguggugaccugugccuguagucccagcuacuuggaaagcugaggugggaggaucauuugagcuggggagacagagguuguagugaaccgagaucaagccacugcacuccagccuaggcaacagaggaagagccugucuccaaaaaaauaaaaaccuugauccaguuuugggaggcugaggugggaggaucacuuaagaccaggaauuugagaccagccugggcaacauugugagacccugucuuuacaaaaaauuuaaaaacuagccaggcauggugguacacaucuguaguccugcuacuugggaggcugaggcgauaggauggcuuaagcccaggaauucaacgcuucagugagcuaugaucauaccacugcacuccacccugaguaacagagcgaaacccugucucuaaaaacaaacaaaaaacuugaaugcgcucaaauuauuucuucuugcuaucuguuuuaaguguacaauugaaugauuuuuaguaauuuauugaguuguacaauuaucacuguagucuaguuuuagaacaggagagauugguuuuaaaauuuaauuuuauauuucaguuaugcagaacauuuacaugguugcagcauauagaacaagguuauauucagagaggucugucuucuaguccuguccuccuucccccuccuagcucccuuccucuaacuauagauaauauuuuauuuguuuuugacuuauucuuuuguuguuacacgaauaagacaacauuugagcagagaugggaaggaauugagggaacauacuguguaugguauuuuacaucuuguuuuuucugcuuaaugaucuauauuggagaucuuuccauuuuaguaaaagagagcuucacucuuucuugucauugcuuuguacuccaugcuguggauguaccauaauuuauuugacgacaucacucuugauugauugaugaucccuuuaaaaaauaugaauaauggccgggcgcgguggcucacgcccauaaucccagcacuuugggaggcugaggcagguggaucacaaggucaggagaucaagaccauccuggcuaacacggugaaaccccgucucuacuaaauauauaaaaaaaaaaaauuagccagguguaguggcaggcaccuguauucccagcuacuugggaggcugaggcaggagaauggcgugaacccagcgaguggagcuugcagugagccgagaucgcgccacugcauuccagccugggugacagggcaagacucugucucaaaaaaaaaaaaaaaaaaaagaauaaugcugcagugaauaaccucacauguaugauaaauuuccagaggaggaucauuuccucacauguaugauaaauuuccacauguaugauaaauuuaaccucacauguaugauaaauuuccaguggauacacugggucaaagcauaacugcauauauauauauauauauauauuuuuuuuuuuuuuuuuuuuuuuuuugaggcagagucucacucagucgcccaggcuagagugccguggcacaaucuuggcucacugcaaccuccgccucccggguucaagcaguccuccugccucagccucccaaguagcuggaauuacaggugccuagcaccaugcucagcuauuuuuuuuuuuuuuuaagacaggaucucucucugucacccaggcuggagugcagcggugcgaucauggcuuacuguagcuucagccuccuggucucaagcaacucuuugaccucagccuccugaguagcugggacuacaggcucgagccacugugcucguuuaauuuuuguguuuuuuguauagacaggguuucgccauauugcccaugcuggguucacuaguguguuuuagcauuuagcauacuuaggaauguugugguuuacaaguaacaggaaacccauucaaacuguuuaaauuuuaaagggguguauugguguaugucacugaaaauuccacagguacagugggcuucaggcaugguuugauugggaugccagcuccguuuugcugagauuccauugguucugcuuucuaccguguuucagcccgguuuagguggcaaaacagugguggaaauguuaggcuucacaucaccguaccacauagaccaaaaugagagcuaauauccaggaugagaaugaacagcucuucuaaucaggcugucauaaaaauaaggaagcuuauuuuauagaagccuuuaccaaaccuccuucuuugacuuguuguuccaaauuggauuaaccagcccauuccugcggccaaggaaauacgcacugguuaacccagucuuuacuaacccauaccuuuagcaaagagauuggauuacccaacaacuugauugcucuggagacuacuuuggaguugggguaugagauaguagauaggagaaugaucuguaaguagauauuggauaagcgaguaagaaaugcaaacuacacugaggucuugcacuggucuagguuuugggacccagauguaauagacauaguucuuuucucgagacaagcucauaggagaaccgguacagcagggaauacaacacacuggaauuggcacauugagugcaccuuugacugcauuguacuguuucgugguuuaaaccugucuuuccuuugcccuugcuguuugacuacuaugauugagcugccaccuuuucacacaauauuggaauuuuuuguuugaaucucuguuuacccuacuggacugugaaucuugagggaagaaaccauaucuuauugaucauaucaauaagugccuguacguaguaggcacauuauguucauuuuuaaguugaacaaaauuggaacuaauuuguugaaauuauaguccuccaacaaggacucacuugaauacaucagauaaucuuucuuucuuuuucucucucucucuuucuuucuuuuucuuucuuucucuugcucucucacgcucucucgcccucucacacucucucgcucuguugcccaggcuggagugcagugugaucucagcucacugcaaccucugccuccugggcucaagccagccucccacagucucccaaacaguugugacuacagguguguaucaccaugcccagcuaauuuuuguguuuuuuuguagagacaggguuuugccguguagcccaggcuggucuugaauuacuggacucaagguaucugccugccucagccucccaaagugcugggauuacaggcgugagccaccuugccaggcccuuagauaaucuuucaaaaucccuuucacaagccaaaauuaucugcuggugacuggaacucacagacagaggcuugcuagcccuuuugcauugauugagaggcuuuucaaaauuaaucauugcuaugauuucaauaucuguucccaccaaaacucauuuuaggauuuaauugacauggggccuuuaagggcugaugagaucaugaaggcucugcccuuacgaauggauuaaugccauuauugagggaguggguuaguuauuaugagacuggguuugacauaaaaacaaguuggccaauuuccugucucuguguugggcacuugcuucugcuucugccaugggaugacuuccaccagauaccagcgccauauucuuggaguacccagccaucagaaccgugagccaaauaaacuuguuuauaaauuacucagucuggccaggugcaguggcucacgccuguaaucccagcacuuugugaggccgaggcgggcggaucaccugaggucaggaguuggagaccagccuggccaacauggcgaaaccgugucucuaccaaaaauacaaaaauuagccaggcgugguggcgugugccuguaaucccggcuacccaggaggcugaggcaggagaauugcuggaacccagugggcagaggcuacagugagccaagauugcgccgcugcacuccagccugggugacagagcaagacucugucucaaaaaaaaaaaaaaaaaaaaaaauuagucugugguauucuguuaauagcagcagaaaauggaguaagacagucacaaccuccaaucuuauguuguuagaauucuuuugggauaacccagaaggaagcuuuacauagugucuucauugccugaaacuagcuuuguuuggaaguuuugcuuucccuauccugguguccuggagaaaaugcuugcacucucccuuccagaagcagguggcuuugcugcugucucuacuucuuucccauuaguugcaagaauuacacuacuccuuacauugccuuuuuccucccuuuaaauuauagaaucgguguacacguaguuagcaagacugaaggcauuauuagcucagcuaauuuaaaaaugauggcuguugugcucagggcuuuccuugauguggcagcagucugacuuugccagggagcucagagaguaucucacaaguugagcuggaaagggcuucacagaacccugacugauacacuggaagugccacauuagaccaggcuuugguccauuugccacuccuggcaucccuuuggagccucuacccuuagacucaugacaccuuucucucucuuccucauggccauauauugacuucccagccacuuuuaaucauugaagacuccagugccugacucacagccuuccuuuccacuccaguucccgccaucaucuugggugguuucaucuucaucacaugacccaggaaguaccuuggugcuagcuuucuuggcuuccauguccacccuacuaaucuccucuaguccaccucuggcacucucucccacagugacaugcgggaucuugucaucagcugaaaugguuuagcuccaaaaucgcuaauucagauagaaacagccuucuacugcaauauggccuugcuucucacugcucuaauuucuccaggauacugaugacucaacuucauguugccagauccauuggacaccgcuuggcccacaacuuccuugaccucucagcagcauuugacacaauugaucaucuucucuuuauugaaacauucuuugucuugacauuuuaaccucaacuuuuuuuuauacauuuuugacccacucaguacuucaccuccuuugcuaguucuuucuacucuaccuagaauuuaacuaucggauuucuuuaauugcucaguccucuucccuuuucuuuuccauuauaaguuucugcuauaucagaagucauauuuccuuuuuguuccuaaaauuguuucuugugccuuuucuccaucaccaaaggaaaaacuauuuauugcaauaaauuaauacagcagguauuccugugaaagcgcaaguuaguuuguuagggcaauuaaaacuucuacgacauaugcuccggcagaguuccgucucugccacuggcagcuuaagaucugccuucuugagagugguuuuugccaguuccuuuucccacucaguugccuuuugcuuucuggaccaccuguuuccagucguggguguggucauuuuuggguggaacuguggcucuccccuccucagcuccagucauggguguggugauauuuggguggaacuguggcucucccuccucagcuccagagcuccugugcacugucauuuuucugcugcugcuuggguggcugcuggguucagucaccagcuuuagcuucaccccuucauucauauuuuaauuuuuuucuugaacagacuuauaagaguuugucaauuaaaauuuuuuucaaagagucagcuaguaucugcuuucuguuuugugaaugucaucuuuauuuccuuucuuuagguuuacucuguucuuuuucuagcuuacugaauugaaaacguguucauccuuucuugcuuuuuaaugguggcucaaggcuguaacauucccucuaaguguuguuugaggagcuucuuguauguuagcuguguggguauaaucauugugguauuaaauaauagucuucagcaugucaagaccuaauuuuuuguuucuuuuucuuuucuuuucuuuuuuuuuuuuuuuuuggagacagggucucacucuguugcucaggcuggagugcagugguucgaucacaacugucugcagccuugaccucccaggcucaggugauccucccaccucagccucccaaguagcugggacuacaggcacgugccaccaugccuagcuaauuuuuuauuuuuuuuuaguagagacaggguuucaucauauugcccaggcuggucuccaacuccugggcucaagcagucugccugccucggccuccugaagugcugggauuaccggcaugagccacuggaccaggccuaguuuguuauuuccauuuuuauucucuccuuaaucuuugaguucuaagcaagugauuuucuuuuuuuuaaagacagggucucacuuggucacccaggcuggaguacagugacaucaucacggcucacugcaaccuucgccucuugggcucaagugauucccccaucccccaccccccuucucacccccagauuggacuauaggcguguaccaccacgccuggcagagaccggguuuugccguugcccaagcugaucucgaacuccugagcucaagcgaucugcccgucucagccuccccuaagcaagcauuuuuaaguuucuaugcuguuuaauuuuuuuuaacugauuaauuuauuugcauuguguggucauggaauauguuuuuaugauauugguuguuugagauuuggugagucuuucuuuguaaccuaguuaaaccauuccauaucuuuuuaaaaggauguauauuccuuaucuguuaggcugaaggugacauauaucugugcaugcauguuugaugaaguuuguaauacuguucacauguccauaucauuacuauuuuuaugacugccccucuuauuuaucaguuucugauagauguguuauaaauaucucauugugauucuggacuugacaguuucucuuugccaguuuugcuuuauauuaaauucaaaauuguuagucugugcauuguucuuuguguugguauacuauacucuucauuaucucuauuuguuuuugcccuaauuuuguuuugaggauuggacaguuuauuuugguuacuauuugcauggaaugucuuuauaugccuuacugucuugucacucaugagacugucuuuuccuuuaccucacucccuccaccuacuuucacucuaucacuaauuccuauugauuuucucucugaaguauauaucuugacuacaucugcuuuuguuuucacugcccucacucaucucaccugggcacuguacagccucugacuggucuccugguccacuguugcucccucuaaucuauucucuggagagcagucagugaucuuuaaaaaugugaaucggauugucacucccaggcuugaaaaucuuucagugguuccuguugcuuuuagcaugaaagacuaaauuccuaacacagcguacaagcccugcaugaaacuaccccuugccuaccuuaucagucacucuucccuucauuauaucuuucugacuugcuggcuuccuuuuaauuccucucacaaaccuuaaccuuuuuugacauagauucuucuucuuauuuauuuauuuauuugacacagggucuugcuuugucuuccaggcuggagugcagugcugcagucauagcccaccgguaaccucaaacuccuugggcuuaagcuauccuccugccuuagccuuccaaguagcuaggacuguggacaugugccgccacacucggcuaauuuuuuucuuucuuauuuuuuuagagacaagcucucgccauguugcccaggcuggucucuaauuccuggccucaagcuguccuccugccuuggccuccagagcacugggauaauaguugugagccaccgugcccagccuagauucuucuuaauauacuguuuccuuugccuggaaugugcuucuauuccucacucucugccccuucaucuguuuaacuccuacuccuugaaaucuuagcucauauguaauuuuguccaagcguuuuacccugaccuucagacuagauccggucucccuguuaccgucuaccaagucgccucucuaaugcaugccacgguaguaauuaaauaagaaauugaaauguaaugucucuuuacucccuacccaccaaacuagauugcagacuauugagggcugauuuuaucugauugauugcugaacuccugucuauucugcaugcuagcucagugccuuugaugcauuauagguacuucauaaauauuugaaugaauggauaaauauacaagggacuuugucauuuacuuauugacagugggcagacugcuaugguaagcauauuguaugcaguagguauuugguuaaauauuuucaaugaacaguuguucgccugaucuuucucaucuguguuuggugacaugauauauuuaaagaacagcaggugguuauuuguaccccucauuucucucuacuguauuucucucuuccccccacuucccauacaucucccauaucuuaccauagcacugguaacaaacagguacaggcaugaaagaaagaccugagaaaucugccuaguuuaggagcuuuuuuagaaggcaagccuguuaaucauucaaaucacuaaaucaauuugcugugugggaauuuuuucuuaauuggcagcaguaaaaaggaaaaauuuuuccccccaaagauaaaaauagaguaguuuauuguagaaaauuggaaaacucaaggaagaaaaaaacuccauaucccacagcuguuaguaauuugguauuuuuaccugucagucuuuuuuuuuugguguucaguuauauauuuuaagcauaauuuaggucccuaguaccgaguauuaugccuggcacgguguaggugcucaguaguuagagaaugaacccaaguauguguuuuuucaauuuuaaaauggcugcagcuucccaguuugguauguagaugagcauugcuuuuuuuugaugguguucauaaccuguuuuagaguaguugaacuuuauaugaaggugugacuuuuaaaaaaugagcccauuagaucauuguaaaaaguuguuuggguuaaauauuuuuggagucaccugugaguucuuuuuuucacgaucuacuuccaguccuuucaguagagccuguugacucugccucuaaauauauccagaaucugaacacuucugcuucuaccacuaccacccuaguuuaaggaagcagcgucucucacuuggauuauuacagaggucuccaacuggcugcccaccucuauccuugccucuuacagucuguucuccugaugucagccagagugaucguuuaaacaguauaggucagaucauauucuucgcugcuuaaaacuuucuaauguguuucuauagcgcuuagaauaagaucugaauugcuuuugauacagugcuuuuccccuccccgauuccccagugugauuugcugccaccuccuccucauuuauuccauccauugcauuccaugaagagcagcugcaccccuccccgucccacccguggagccaaugguacacgcucugcuuagaauccuuagccccucugcuuagaauccccuccccaguggccauggcgcuggcucccucacuucuucaggucucugcccaaaugugguucugugaaagaagcuuucucuuagcccugcccagaaaggcacugccaucaccuuuccaccucagucguuccacuccccuuuccugacugauuguucuucauguuccuugcugauguucauuuuguugccugcuuacugacuagucccaccuaaaaucuacaagaggagggcuuuaucugucuuuguuggugagauaccaggaucuaaaauggugccugaagcauauagaauucaauaaauauuggaugaauggauaguggauauucucaaguaacuuuuuuuuuugaggugaagucucacucuugucucccaggcuggagugcaauggcguaaugcucacugcaagcucugccucccggguucaagugguccuccugccucagccucccgaguagcugggauuacaggcgccugccacuacacccggcuuauuuuuguauuuuuaguagagacaggguuucaccauguuggccaggcuggucucgaacucuugaccucaggugauccacccgacucggccucccaaagugcugggauuacaggagugagccaccgcgcccggccuuucucaaguaacuuagugagaaagucugcauugggaauuagguauugugacgucucauaggccuauuuuauuuuuuaauagguaauacguucacaugguucaaaauucaaagagcaugcaaugaagucucucacacuuugcccuccagugccacccugucccccuccucugaaguaaccaguauuaaguucuuguauguauuuccagagauagccaauguuuuaauacacaaaauuacagauauaguuuuccuccuuuauaaaaaugcaaacuuuagcaucugcacuguuuuacaccuuguuuugauuuguauacuucggagauuguucuuugucaauaaagacauuauuguguaaaagcaucuuuaaugccuguacaauaucccauuguguacauuuaucauaauucuucuuuugauggacauugauguuucuagucuuuacacgcuauacugcaauaaaucacuuuguacauacaucauuuugccuuguugcuaguauaucugaggaauaaauuccugugaggaauugcugggugaaaaggauaugugcauuuguaauuuuagagacauagucaaaucgccuucuaaaaauuguaccaauuuuuacuuguggcauaguguauuguuauuuugaucuuugcuaauuugacagaugaaagaugguauaacacuagaguuuucugguguuucuugugcuaugaauuaagcauuguuuuguauauuuaagagccaucuguauuuucuaugaguuguucauguccugaacccgcuuuucuacuaggauucuggucuuuaaaaaaaaaaaaauuaaguugguaggagaucucuuuuaugauuauuuauuuuuaauuuuuaaauuuuuuuagagaugggaucucacuguguugcccaggcuggucugcgaucguuccaccucagccucugagcagcugagacuauaggcaugcaccaccaugcccagcuuuuuauauaaauuagcccuuaaucugugaucugagggacagacauuuuguuccauuugucaguugucuucugauuuugcucaugguaguuuuuuccuacauagaaauuugcuuuuuuucccuuuauuuuucuucuuccuccuccuugggaaauuucauuuuuguuuuaauaauuauuauuauuuuuugacauggagucuagcucugucacccaggcuagagugcaguggcgcgaucucagcucacugcaaccucugucucccagcaauucugucucaggcuccugaguagcugggauuacaggcaugcgccaccaugccuggcuaauuuuuguauuuuuaguagugacgguguuucaccauguuggucaggcuggucucaaacuccugaccuugugaucugccugccuuggccucccaaagugcuggaauuacaggugcaagccacugcgccuggccucucucuuuuuuuuuuuuuuuuuuuuuuuuaggagacagggucuugcucuguuacccaagcuggaguacaguaguauaaucauagcucauugugaccucaagcucuuuggcucaagggauucucccaccucagucuggugaguagcugggacuacaggcaugagccacacuguuggccucuucuuguaccucugagguuucauuucuuacauaugauuucuuuuugauacugcugagauuuauucugguauaaauugugaggugagauuucaccccauguuuuaaaaaacaauuuuaggauuucuugaucuuuuaugucuugucuggagaguaauuugucagcuguuuucugcuaaacugugagugguguaagaccaguuagcuaugcccuguguacuuuucaguuuaagacauaguugccuguaucuucccaaagaucuuaucuuucguugacuuaaaaauaacgguggaaauacagccuauuggggaguauuguguuaaaacaaauuuuauagaauuuucaguugguaaagauugauaagauuaguaauaauagguaauuaugcauuauauuuaaggaauauguuuaguacauuauauaaugcuaacgaaauagggauuuuucuguuuuuuauuuuuguuuuuuuguuuguuuuccuuuuuuuuuuuuaauuuuuauuuuuauugaucauucuuggguguuucucacagagagggauuuggcagggucauauguggagggaaggucagcagauaaacaagugaacaaaggucucugguuuuccuaggcagaggacccugaggccuuccgcaguguuugugucccuggguacuugagauuagggaguggugaugacucuuaacgagcaugcugccuucaagcaucuguuuaacaaagcacaucuugcaccacccuuaauccauuuaacccugaguggacacagcacauguuucagagagcacaggguugggggguaaggucacagaucaacaggaucccaaggcagaagaauuuuucuuaguacagaacaaaaugaaaagucucccaugucugcuucuuuccacacagacacagcaaccauccgauuucucaaucuuuuccccaccuuuccccgcuuucuauuccacaaaaccaccauugucaucauggcccguucucaaugagcuguugggcacaccucccagacggggugguggccgggcagaggggcuccucacuucccaguaggggcggccgggcagaggcgccccucaccucccggacggggcggcuggccgggcggggggcugaccccccaccucccucccggacggggcggcuggccgggcagaggggcuccucacuucccaguaggggcggccuggcagaggcgccccucaccucccggacggggcggcuggccgggcagggggcugacccccccaccucccucccggacggggcggcuggccuggcgggggcugacccccaccucccucccggacggggcggcugccgggcggagacgcuccucacuucccagacgggguggcugcugggcggaggggcuccucacuucucagacggggcggcugccgggcggagggucuccucacuucucagacggggcgguugccaggcggagggucuccuccuuucucagauggggcggcugggcagcgacgcuccucaccucccagacggggucgcgacugggcagaggcgcuccucacaucccagacggggcggcggggcaaaggcacuccccacaucucagacgaugggcggccgggcagagacgcuccucacuuccuagaugggauggcagccgggaagaggcgcuccucacuuccuagaugggauggccuguuuuuuauuuuuauuuuuuauuuuuauuuuuuuggaggcagccuuauucugucgcgcaggcuggagugcagugguaccaucucagcucacugcaaccuucaccuccuggguucaagugauucuucugccucagccucacgagcaguuggaacuacaggcuugugccaccaugccuggccaguuuuuuguauuuuuaguagagaugaggucucaccauguugcccaggcuggucucaaacuccugagcucagacaauccacccaccuuggccucccaaagugcugggauuacaggugugugccaccgcgcccggccuguuuuuuucuuuuuuuaaaauuauuauuauuauuauuauuauuauuauuauuauuauuauuauuauuuuuaucaauagguuuuuggggaacaggagguauuugguuacauggauaaauucuucaguggugauuuccuagauuuuggugcagccaucaccugagcgguguacacuguacccaauguguagucuuuuaucccucaucccccucccacccuucccccugcguccccaaaguucauuauaucauucuugugcuuuugcauccucauagcuuagcucccacuuacaagugagaacguaugauguuugguuuuccauuccugaguuacuucacuuagaauaacuagccgggcgaggugauucacgccuguaaucccagcacuuugggaggccaaggcgggcagaucaugaggucaggagaucgagaccauccuggcuaacaugcugaaaccccaucucuacuaaaaauucaaaaaauuagcugggcgugguggcgggcgccuguagucucagcuacucgggaggcugaggcaggagaauggugugaacccgggaggcggagcuugcagugagcugagaucgcgccauugcacuccagccugggcaacagagugagacuccaucucaaaaaaaaaaaaaaaagaauaauggucuccagcuucauccagguugcuuggaaugccaugauuauuauuauuauuguuacauuuucuuuauccaccugauugaugggcauuuguggugguuccauauuuuugcaauugugaauucugcugcuauaaauaugcaugugcaagugucuuuuucauguaaugacuucuuuuccucuggguagauacccuguggugggauugcuggaucaaauggaagaucuacuuuuaguucuuuaaggaaucuccaugcuguuuuccauagcgguuguacuaguuuacauucccaccagccauguaaaagugcucgcuuuucaccacauccacaccagcaucuguuauuuuuauuuauuuauuauuauuauuuuuugagacagagucuugcucugucacccaggcuagagugcaauggcacaaucucggcucacugcaaccuccaccuccuggguucaagcgauucuccugucucagccucccgaguagcugggacuacaggcgcccgccaccaugccuggcuaauuuuuuguauuuuuaguagagacgggguuucaccauauuagccaggaugaucucgaucuccugaccucaugauccacccaccuuagccucccaaagugcugggacuacaggcgugagccaccaugcccagcauuuuuuguuuuuuaauuauggccauugcuacaggaguaagguuguaucauauugugguuuugauuuucauuucccugauaauuagugauguuuagcauuuuuucauauguuuacugucaauuuguauaucuucuuuugagaauugucuauucauguccuuagcccacuuuuugaugggauuauuauuauuaauuauuuucuugcugauuuguuuuaguuucuuauagauucuagauauuaguccuuugcuggaugcacaguuugugaagauuuucucugcaacccuguggguuguuuacucugcugauuauuucuuuugcugugcagaaguuuuuucauuuaauuaagucccauguauuuauuuuuguugcauuugcuuuuggguucuuggucaugaaaucuuugccuaagccaaugccuagaaggauuuuuccgguauuaucuucuagaauuuuuaugguuucagguuagauuuaagucuuugauucaucuugaguugauuuuuguauaaggugagagaugaggauccaauuuuauucuucuacauguggcuuaccaauuaucccagcaccauucauugaauagggugucuuuuccccacuuuauguuuuuguuugcuuuguugaagaucaguuggcuguaaguauuuggguuuauuucuggauucucuguuauguuccguuggucuguguaucuguuuuuauaccaguacuaugcuguuuuggugacuauagccauauaguauagugugaagccagguaauaugaugcccccagauuuuuuucuuuuuugcuuugucuugcuuuggcuaugugggcucuuuuuuguuuucauaugaauuuuaggaugguuuuuccuaguuuggugaagaaugaugaugguauuuugaugggaauugcauugaauuuauagauugcuuuuggcagugaggucauuuucacaauacugauuuuacgcauccauggcaugggauguguuuucauuugugucaucugugauuucuuuuagcagugucuuguaguuuuccuuguagaggucuuucaugucaaugguuagauauauuccuaaguauuuuauuuuauuuuuuugcaguuauuguaaaagggguuaaguucuugauuugauucucagcuuggucgcuguugguauauagcagagccacuaacuuguguacauugauuuuguauccagaaacuuuacugaauucauuuaucagaucuaggagcuuuugggaugagucuuuaggguuuucuagguauaugauuauauaucaucagcaaacagcagcaguuugacuuccucuuuacugauuuggaugcccuuuauuucuuuucucuugucugauugcucuagcuaggacuuccagaacuauguugaauaaaagugaaagucagggcuggaaacgguggcucacgccuguaaucucagcacuuugggaggccgaggugggcagaucacgaggucaggagaucgagaacauccuggcugacauggugaagccccaucucuacuaaaaauacaaaaaaauuagccgggcgugguggcaugcaccuguagucccagcuaccugggaggcugaagcaggagaaucgcuugaacccaggaggcagagguugcagugagccaagaucgcgccacuguacuccagccugggcgacagagcgagacuccaucucaaaaaaaaucaaguguaaguggggccgggcgugguggcucacgccuguaaucccagcacuuugggaggccaaggcgggcggaucaugaggucaagaaaucgagacuauccuggcuaacauggugaaaccccgucucuacuaaaaacgcaaaaauucgugcccggcugaggauuuuuacaucuccguucgucagggauauuggucuguaguuuucuuucccuuuuuuuuuuugguuauauucuuucugguuuuggguauuagggugauacuggcuucauagaaugauuuagggaggacucccucuuucucuaucuuuuguaauaguuucaguaggauuggugccaauuuuuuuuuuuugaaacggagucuugcucugucucccaggcuggagugcaguggcgccaucucggcuuauugcaagcuccgccucccggguucauucuccugccucagccuccugaguagcugggacuagaggcgccugccaucacgcccggcuaauuauuuguauuauuauuauuuuuuuuaguagagauugggucaggcugguccugcacucccaaccucaggugauccgccugccuuggccucccaaagugcugggauuacaggcguaagccaccgugccccaccuugcaguuaccauuucuaccauguggcuaacuugcccgagauuuguaaugguucacuuuacugaugacaucaaauccaagcuaagccuaguaaguuacccugucagugccucuucaaaaucucucuaucaucauuucuccugaugagauucucccauucagauauugaacuagcugagcugagaccauuguuuucacacacuuguuuaucuauuugucucacucuuuucucaagugccuucccacauauuucuacuugccaaugccauugcccaaguauuuuacuucuuacguuuacagaagcugugagacugcaggaacugugaaaaacaucgguauuugucccaguguuacuaggcaaaaggggcuugcuguccaaugugccagaagccuguacugugacacuggguuuuugagaaaguuuucucaaaacccagugaagggagucuacuagcuaugagaaauauagccagaugagaaucgagccacuggguuuuugaguauuuucucaaaaacccagugucgugauauuggcuuucuuuuuauugcaagucgacucacaaggagucaggaguucagcucaaaucugucucucugugcuggcuuuaaggcaguaacuuuauuagaaaagcuuuagggaguggauucugggaguagcaggugauugauauaaggaaagggguggucuggaaagucuucaggcuuccgcaguuaucuauucaugccuccucaugggucccaugugcaaauuugggggaaguuaguaugaaccaugugguagaaauuuaagcuuguucuacacaaacuccagucaccuauauugauuccaaccaauuuuagccuguuauguuuucugucuuacaaguggagggcaugucaguaaguuguuucuuuucuuaucugcaauccugcaaacuugagaauuucuguuagucauuggugucuuuaacucuuggggucaugguuucaccaguccugaaggaucccugugccuuggcauccucauuuuuuauaacaugaguuuguaucuuuuguagggugguggaguuugagaucuguauauaugggguugaauuguuauguggcuaggugcaguggcucaugccuguaaucccagcacuuugggaggcugagguggguggaucgcuugaggucaggaguucgagacuagucuggcuaacauggugaaaccccgucucuaccaaaaauauaaaaaucagccaggugugguggcaugagccuguagucccagcuacuugggaggcugaggcaggagaauugcuugaaccccagaggcagagguugcagugagccaagaucgugccauugcacuccagccugggcuacagagugcgacucugucucaaaaaaaaaaaaaaaauuguuuggcguguguguauuccagauccucagugaguuccuuguaggaauggaccauguuugugcaccucuucucccucucuucccuuacaccagugguucucuuaggcguggucccugcccagcaguaucagcguccccucagaacuuguggcaaugaagauucugggccccugcacuugaacacugcaucaggaacugugagagcaggcucagcaaucugugguguaacuagcaugccagguaauucugaugggcuaguuugagaaccacugccuuauaggaucuaguauugguuuaccucacagcgaacgaaaacucagcucacugacuauuuaauuuguagacuauacuaaucacugcugauuuguuucuaucucaucacagcucccauuuacugaauagcuacacugggcuaggcacugaacuaggugcugucacaugcauugucccuuaugaucucacagauacuuugcagaagagggaguggcgcgucccacuuuauauuauauagagaugagagaggggaaucucugagggauguaguaacuugccaaggcuacacagcugguaaguggcagccggagauuucagcaaggccugucagacuccaaagccuauguucuuucuagcaccccaccccgcuuuucauguaaacucuugcucccagagaaugcgugugccuguguggcugucaugugguuuuauaauaaaugguuguaauaccuguauuucuagauuucucuccucauauacuuaacccacccaauaagcagcaaccuuucagcuuuuuaaaaaaagacuauuuucuauuuaauaauauucauuuauuuacaaugugucagaauuaggagguauuauaaaagcggccuuugagaucauauucuaaccucuguauuuucacagguagagccaucauaugugcuacucuauuuuugucucagaaauuaaacuuucauugagguguaaauugguauacuacacaguucugaccucugaacuucuaacuuuuuuuuaaaguauuuuuuuuuuucuaaaaaaaaaaaaaagaaagaaaaaagaaauggggucucacuauguugcccaggcuggucuugaacuccuggccccaagcaguccucccaucucagccucccaaagugcuaagauuacaaacaugagccaccacacccugucuguauuuauaacuuaaaaaaauuaugcuacaucaaguacaguaaaaucuuaacugauuggaaagaguaauuuuacugguuuaacuuugcccuuccucacccccuucauuuucaaaucccuccccucauauuuguacauacauuuuccaacagguggcuaaauauuaacuuuuauuuuuuaaaugcuuuguaaggaaucaaauacuuauuuccacgcuaacucacuguaguucuugguuugagugcauuuaaaaaauguaaauugauacuauuaauaaugauaacaguuacgucgggacgguggcucacgccuguaaucccagcacuuuaugaggccgaggcaggcggaucacuugaggucaggaguucaagaccagccugaccaacauggugaaacccugucucuacuaaaaauacaaaaauuaaccaggcgugguggcaggcgcuuguaaucccagcuaguugggaggcugaggcaggagaaucacuugaacccaggagauggagguuucagucagcugagacugcacuccagccugggcgacauagcaagacugucucaaaaacaaaacaauaauaauaauaacagccaguacuuacauagcacuuacuuuguuccagguaugauucugaucacuuuacauauuuuaacuccuuuaauccucgaacgcugccuguagcagggucacuguuguauuaaccccauuuucccauuuuguggaaguggugguauauaaaagcaaauagcuuguucaagcucacaagacagaaccugaaggcaucuuggcuccagagucucugcucuuaaccacucuuuagagugucuugcacguuuucaaccagagcuuucucuauauaacauaucacuuuacacuuuuaaaauagcauacuauuuauugcaacuccuggguucaagggauucuccugacuuagccuccggaguagcugggauuacugcuuggggugaagaauucuguaagaauuuugugagagcagggcaaguacucaggcuugcugugggcaacaagaaaaguggggacguuguguuauuuugggucucuucauauuuaaagacaaaucuaguuguaguacucuacacggaggagagaucagaucuugcugugucacuuuagagauucucuuuugguuuguagucacagcugcugucuaugagaccugcugcuauuuggagcuuuacccuuugucguaaccaugugaggggcuggccugcauuucuuagcuuuccauaucuuuguacccuaguuuaaaauugcugccuguuuccgccauccuuguauuugcauacagaauuuugcauacauccuugcugacuagaguuuuuuuggugaguauuuggcugcauggcaaagggaugauuuuccugaagguggccaaaagcuuuggaaagagcuguggauguggucuuugucauuaguucaucaggacacauucagcuugaaagcuuugaauuaucaagaggcaagcaacucaugucuuccaguacaguugcugucuccugaagaaggcuggcagcauucagaacauaacuuaugaacuuuaaccagaugagugucauuugguuuauccuaaauuuaaugaguuuggguaagucuucuguaguucauggcacuguguuauaaauaauagaauaauuucagguucugucugguaguuacugucugauguagaagcaagaagaccacaggugagaggagaaggagacugagaaaugagggcuuuggguuagauuaccuuagugcucuuccuaguuuccugggcaugguguacuuacagugaaugagaucagagcuccgaguugagcugcuguguuaauugguuguaugauuuuaggcaguuaacuucuuuggucugaguugcagcaucuugagaacaagugugacuuuuuuuuuuuaaugaccauucaccugaggugacuuuuuaaagugccacuccagcuuuaucuauuaucugauccccugauguaagacuuagauuacauaagauuuuuccauauuauaaauauauuacagaauuauucacacugggaaaugaguugcuucuguagucuacuucuuugggaauagcuuuauauuuaacuuuuaagcuaguaguugcaaaauuuuaauucuauauauuacgucauaugagacugcagugcauuauacgagaucaugagugguaagcuuagcauagagcauagccauagcauauguggaauuguugacaagcguuaaguuuuggauuaugguugauuuuagccuucaguguggagcuuccuauucaguucuaaguggguuggccugcuaaccuacauuuuaaauacagcacugucccuuauugagacuacaaauacaccuccuuucccuuucaguguaauauuuuuauuucagguuucaagauuuuaacuucuaaaugcuaaaaauauuacugaauacuugaaaacaaauuucacuguguaacccuuuuagcuguuucuucuggauuaaggguaguguaggauucaguuuuccuagaaucuuuagaagacuguaaaauuggugauaaauucucaguucaguucuuaugaaaaagauauggauucauauuauaaauauauauuagagaaaaaauagggagcuaaacuuggaacagauuggauuucccaaagaggacucuggggaaagcuaucuuuauuugccacuguagcaaauuaagagcacacagugaacuguucuaacacugaaugccauuugaagaguaaaacaaaagaacuagccauggcuuccucaucuguugccugaaugguuggcuucuuuaaauaauuuuccuggccucucuccucucauugagugaugucacugaugccacagaaagaugaguaauagacuccuguggucuuaauuggugugaaacuuuaugauuuggccuguuuggaauauauuaucaucuguugaugauauaucauucccauucaugcauuugcucaguguuacaguaagcuuccuuuuauugugaauuuuacuguucaucaagucacagauuuuucugugacccuaauaccaagcaaugacaugcuuuuaaacuacuagaauaauuuugaaauaguuuuaguaguuuuuuugguuauuuuuuucuauuaaaaaauuauauauaauauaugauuauugacaaaaaggcaaaaaauauuaucuaaauauuacccccucuuuuaaugguagacacuuuuaauauuuuggugaauaucuuuucaaacuguuuucuuugcaaauauguacauguaaauaaauauauggcccaaacagaauuagacuuuuuuuauuccauaaaauacauauauauacagguggugcauaccuguaauauacaggugguacauaccuguaaucucagcuacuugggaggcugaggcaggguaaucacaugaacccaggagguggagguugcagggagccgagauugcgcuacugcacuccagccugggcaacagagcucuccgucucagagagagagaaaaaaaaagaaaguugugccaugaacauuuuuuuuagguuauuugaggauauucgacauauaugacaaaugacuaacagcacaagugccaagugaguaguugcagugaugaacuaaugcuguugaacuuccgaugaaggcgagaucaaagcuuuuccucacacuaguauuuggaagaucagcucucuguuacccaaauugauuugaggcuguauucuucagcucacgccugguuggaucagagauuauuugaauuacagaagccaagucaagcauuuuggccacuuguuuuaguagcugaucuccauuaauguuuaagauauguuuaauguucucucacucuagcucuuuugcuuccuguuugaaacacagcaguguacuauguccaaaaugcugucauaugauauacaauuacugcuacacguguuguuuauugaaauuuuagacauuacagauucaguagcuuguucuagcugacgcugggugauugaaaagggagaaacagcuagauaugguuaaaggugaaguuguaagcauuaugaaccuugggcagaucaccaccucuuccugggccucaguuucucuguaggaugaggaaauggaaguuuguaggcccucugcacaacuggggacuuagggccguuuucacuuaggaugggaacucuucuaccgauuguugcuuauguuacucagcaacuugaauuggaaauuuaaaaucauuuaugugcucugcugaauauaaugagcccauggauggcccaaagguuagaacaacaacaguguaguaguuaggcagcacacaggaauuacucucugcucuacaaugcucuguaauuuaccaguguugucucaacacuuucagaaaggcauagaauucuaucuuuaaaaaacauuuuuuucuaagaauuugaaaucaucuuuugcagaaaugaaugcaucuugccuuuucgucagugugagauacugguauucccuuuagaaugggaauacguauuccuauacauauuuaacagaaggguucaauaaaaauaggucauuugaauaugucagcauuuuaaugugaugagaucugguguuaguaugugugcaaauugaauuuaucuugauguuuauucauagcuuuucuuuaaugaagaaaucaguauuucauuagccuaaggaagccucacaacagccauuuguggugacuugccuugcgauaggagaucuaaccuuccguggaguacagcaucagagaaugaagagcugguaaagauguugcaguguagcuguuuuuuaaguucaucuuuaagaagcuacucugaaggaagagaaguagauuguaauagcuagcaguuucuaaaugacaggcugccuuaggaaaaagugacaugugagaacaacagaagcuuguuauuucagcagaugcuugacugagggugcuaggccagggaagaugcugccacagaauguccgcccucugcuuguuccugcuuuccccugguggccacccucuccccacccgaugcagagcuccaaaggaggggcuuuugcuggccccugggagaagccaucugaugagcagcaagcaauuccagagauugucacugugaaauuuuuacuuaacgcauguuacgcacuuugugacugugugucucuucucauuuugggaugacaugaaggugauguuccacacgucuuacaucuugcuauuugcugacguuugacuuauugucuugccugccuccccucugucuaauucucugugccgccucucaaagccuugcugcggcuaaacgcagccccuugaacgugguuggccggggcucauuccaggucagagcccaucagaagcgcgcuagagacaaugcaccaacgguuggucuuuagugaaggggauggguuuggaaugccaagcaagugugggcuguacuaguauguuugagaaugaaggaggaauggaaacuaagaaagagaagcuacuguuuuguuuuggaagauuauacuggaaggaaaaccugcugaaagugggcuuccacugcugcuguccuucugcaggaaauuuagggcagaaagaaacaucucuguuuuuccuuaugucuguuucuuugaagguauuaaugaaugaugagaauuuucaaagcccauaugauaaguagcaaguccuuauguauucagaaggaaacuaauguuucccgagugccuuuuaagugccagggauucugcugggacuuauauuauuccauuuuaauaaaauaauucugugaggcaaaugauugaaaagaagagguagaucuggaaucugggccacacugagaaaggcuggaauauuugagucccacuucaagaagccuaggaacauggaguuacauggugauagaaucguagaacuaggugccaccucacaugucuguugcaucaccccagcaguagacggcggugcagcagaaggcacacgggcuggaauuucgauggccagacucuaccacuggguuccucugggcggcugauucuauuuucuuguuuacaaaaugggaguggcaguuguacuuacugcgcagguuuguagcgagguuucaaaaaacugauccauggaggugcuuuguaaacuguaaagugauguacuaauauuuacugauggagacuguuugcuuucauggauggacacccaagaaggcauuuauucuuagcauuuuggucagcaaaagaauuaucgagauugcgccacugcaguccagcugggcgacagagcgagacuccaucucaaaaaaaaaaaaaaaagcauuauauauuugcuuuuauauacauuuggcuguaggucucuugguuucuaucacuucacuguucuuuuccuccauuuucagaauuguuuccuuucugugacagauauucagugauaaccuucugugugccaggcccucuauuagauguuggagacagggagguaaauaacacagauaaguucuuguccuuuuugaaaugaaacacugaaacuguacaauugauuacuguuuguuuuuccuaugggcauaagugacccaagccuaacugacuucuuauguuucugacauacauauauuuuaaacaaguguuaggcucuuuacauacuguuaaugccaacuguucagauacguuggcuguaacuacugaauugaagauacugugagaaacauggauugugugggucuuuccauaagguaaaccugguuuuguggccccuucaagggcagcggugggacuguggaauuggcaucuguguggugcugugcagcugauuguuacuugagcguuaaacuguucgccuacacaugaagugugggcaguugaagguguuugaaaaucacugugugguauuuuugucauuagacccacccaguuauuucccauuauguugaagaaaauuuugguuacauaguugagcuuuguucaaaaggugaauaucagcucugauuggccaaggucucuuuucaucuucagugccuccccccacaacaccccccuccgguuucaccagggugacaagcagaugugguccagccccaggcccuggacuguggacuaaucaaucccuaacaggcacuagcagccccaagccugacuagguuaaaaguuccaccaagggccgggcgcaguggcucacaucuguaaucccagcacuuugggaggccgaggcaggcggaucacgaggucaggagauggagaccacccuggcuaacauggugaaaucccgucucuauuaaaaauaaaaaaaauuagccggggugguggggggcgccuguagucccagcuacucgggaggcugaggcaggagaauggcgugaacccaggagguggaucuugcagugagccgagaucgugccacugcacuccagccugggggacagaacgagacucugucucaggaaaaaaaaaaaaguuccaccaagaaaaccugcggaacagucuuugcagugugguuuauuuuggaucucagguuuuaagauaggccccuagucguuccacuucuuuucuaguaggugauccuuuguggcccuuggaaguaauuucuuggccacuuuuggucccuguuuugguugucugagauguggucaagaggaaugauaauagcacuacagucguucucuucugauuuucaaaauggcuuauggcaaccuuugauguuacucagacugcuccagcuaguuuugauuaauucauucaggcugucagugacucagcagccuccuggcuucuuucuuguuuuuaaaaggagcuggacuuucacaauauauggaacauaguuaacauauugcagcuaauaaguguggcacauaaugauaggcaucggugaaggggucuggaagaaugucacacauaggcugggggggggcucaggaggacaugacaucucugcuuuugugaauaugaggauaggggacuuuuuuugggugaaagaaggaauggcaggaaaggcaaggugucagaagcacaggcagcagccaagggucuuugggguaauguauguggaggggcgggggugauaaggccacauugggcagccugugagugcuaagcuguaggcccugcagagccguggcagugguggagugggagagugaccuaaggcuucccgaagaugugucuggcagaguguagggcgaauugcaugugauuggaaauggguggaaggagacuggcacagagcuagagaggcugagcuaagcuggggaaacccaggcuggaugagggcccugaagcuguccuuugggcaggggugccaggcaggggacccaacagagcgccaaguauaaagcugguugggguggggcuuaaggaugggaggaguggacuuaggagguagagagugcuuuggguguaggccagguaaguuucuggucugccugcauuaggcacuugguagcuguuagcuaugccaguaaaaggaucuuuuacuuuucuggcaagacucugcaagaccgguucucucuuaggugauucucagguggggauggggagggaagaugugaaauuuagggaaaauaaaacuaccuuuauuaccuacacuauuuccaccugauucauuuaaaauuaugucuaagauuauaauuugacacacauuuuucaaaagagcucugagauauuuuucauaccacaucagaugcuucugggcacugaggaguuuuaucaaguaaaacuuuaccaggccuaugugaugugacauggcuguugccugugaugccacaggcuucccaaagcccccuacugaggcccacuaaguuggugggaaccaggcugcaagcuuuuugccuuugguggaauagccccucucggguucaaguccuuccuccacauuucuguccacucagcagcauuccugagggaagagugggcaggcagggcuauggugaaggcaugaacuggaacuggagggcuucuuuugcagacccuuugugguacuggaaagaaauuccucaaggaccuauaggcucauuagugccaugcuaaacugacccagcugacucugaauuucaguaguauuguuccagaaaaaaauuccagccaggcauggugacuuacaucuguaaucccagcacuuugggaggcugagaugugaggguucuuggagccuaggaguuugauaccagccugggcaacauggcaagacacugucucuacagaaaauuaaaaaaaaaaaauuaguugggcaugguggcacgcaucugugucccagcuacuugagaggcugaggcaggagaaucaguugagcccaggaaguugaggcuguagugagcuguauuugcaucacuguacuccagucugggcagcagagcgagacccuguuucaaaaaaaaaaaaaaaaaaaaaaauuccagagaucuuaaggaugaaaagucuaaggaaggccagguaugauggcucaugccuguaaucccaccacuuugggaggccaaggcaggcagaucacuugaugucaguucgagaccagccuggucaacaugguugaaaccccgucucuacaaaaaauacaaaaauuagcugggcgugguggcacguaccuguaaucccagcuacucggggggcugaggcaggagaaucacuugaacccgggaggcagaggucgcagugagcccagaucgcaccacugcacuccagccuggguaauagagcgagacccugucucaauaauaauaauaguaaugaagaaaaagaaaaaguccaaggaaaagagaaguauuacauuuaaaaauguuuacuuacugaucgaggcuuugguaacuaguuguuucuuuaguaggaauuuuaaaacuaucacuuaaaauuuuucuauuaaguugagaacuuaauaaguaugaugagacugucaaauuauuuguaaucaguaacuccuuaugcaaacucaugagcauaaugauaaaauuuaaacuuuccauagaaaaaauuaagaaacaguugugguuuaauguauucuacaaauacuuagccucugugccaggcuggauaccucugcuggggcugaagaccaaauacccgauucuuaaaauggauaagaauguuuaauaaauugguucuucuauaaauucauguuuaucugucagaaucugaguggaaaaaaacuuacggugaagaacuuagguaauugauaauaauugggaugcaaaccauuuuuugaaaucucaguguguagaaucuaucagaaagcugaaaaaaacuaauuuuguggaacuauacagugguaacuguuuaauaaaguucuccuuaaaagaguuuuuauuauaauuuuauuuuaauugauuauaacagacauaaaacaauucugaaaucauauaagugauuaaauauuaaauguuguggaaugaauuaaguacuugagaauucagauacaggagcagcacaaagaaugguugggaaaauccuugcugugggcggugggacgugaacugacgggcacgauuccuggggaggugggcaaaggagacugucccuaccaagagggugacguaagccaagaaagaggggcugucugcucuggccauugcuuaugaguuguguggagggccagugaaggguggagaggcaagaugguguagagcugauaagagcacagccucaugacccugaacuuccuuccaggucccucaucaauguaauguggauacauuaguaccagcuuugaggggugacuaggauuggauuggaugaugauuguaaaguuccuggugcaggccuggcacauaggaaguguugauuaggccaggcgcaguggcucacgccuguaaucccagcacuuugggaggccaaggcagguggaucaccugaggucaggaguuugagaccagccuggccaacauggugaaacccugucucuacuaaaaauaccaaaaacaaacaaacaaacaaaaacaaaaaacaaaaaauuagccaggugugguggcaggcgccuuuaaucccagcuacucaggaggccacggcaagagaaacacuugaacccgggaggcagagguuacagugagccaagaucacaccauugcacuccagccugggcaacaagagggaaauucugucucaaaaaaaaaaguguugacuagacagaaggugauauugcuguuggggaggauggggcugaacccuggagggcaggggugcuagguacuuuuuccuacauugacuugauagaaauuaggaggccacaggccaggugugguggcucacgccuguaaucccagcacuuugggaggcugaggcgggcagaucacuugaggucaggaguucgagaccagcauggccaacaugguaaaacccugucucuacugaaaauacaaaaauuagccgggcauguuggugcaugccuguaaucccagcugcugaggaggcugaggcacaagaauugcuugaaccuggaaaguggagguuacagugagcugaagucaugccagugcacuguagccuuggcaacagagcgagacucuaucucaaaaaaaaaaaaaaagaaaaaaauuaggagacauuuugauuagagauaagauguggcuggaauuaaugaauaaugguagcuacccaaauacuucugugugcucugugcuuucuguuaucugcagccuucaccauugccuugcaggggaggggugggccuuugaucuccuauuagugagaggaaacuugcacuuugcccaaggccacuuggcuaccaagagggaaggcaggauuugaacuuaggcuugccuggucugggcucuuucucucgcuaccagacugccccugccugggaagccaucugccaggggcugaugaccccauggggaagaggaauagcuggcuugggugguuacuccugcuccuaaaaagguaugugagcucagagugcauguuggcagacaccccaucccccgccccccagaagaggaggaaauaggauggucacuuaucaguggaaauugaguuagaacucagugauuaauggaaagaggacaggcgagugggagacgguugugcuuggacaugaaggcaggcacugggugaccuggccuuucucuaucugggguggggcuccaaaaagcucuggcccaagaguggaguccauagauuuuucagaaauacaauuuuuuuuaugggcacauaaccuagcagucacuucugacuucuugguaauucuuacuugguaaaggugacauguugccuggcuggacuucugcuguucccguuuggucagugccacuggaaagggauuggggagggaggagugaccuuaggugagagagauucuaaguguuccuuggggucagccaggucuacuuuugugucuucuagacagugccacucacacuaguguugacagaucaacuuuaaaaaaauuuuagucuauguggauugauacuuuuguaaaauaaaaagaauuaauaggaaaagaaacugaaaaagacauacagaauauaaacucuaacuuuuuaucauuacauucaacagauauaaaauuuguccguugccauaaaaguuucuaaacucuuauucucaaugucuguacuacaggcagugcauuugacugcagacuaauaaacuaguccuggacugguacacuucaagagcagugaccuaagaagaaaguuuguuaagcaaauuaguagaauaaacaggauauuuuuagaauauuuaccugaauuuuuuuuuuuuuuuugagacagagucucgcucugucacccauacuggagugcaguggcacgaucucggcucacugcaagcuccgccucccagguucaagcgauucuccugucucagccucccgaguagcugggacuacaggugcccaccaccacgcccggcuaauuuuuguguuuuaguagagaugggguuucaucauauuggucaggcuggucucaaacuccugaccucaggugauccacccgccucagccucccaaagugcugggauuacaggcgugagccaccgugccuucuggcccauuuuaccugauuuaagaguaaaaauaaucucuucucauuuaaaaugcuuccaucuuuucaguaaaguuccauauugggaggcagggauguaaaaauauaccaauaacugaagccauuauaguugugaggggucccuaagucuaacucuaaacugguggcaguacuuggaaaaacaggugcuuuuacuuccucuguuguuucugagaaacauuacguauuuuuuaauuuauauuaggcuauuuucucuguuaauuucuggccagccuuuaaauugaucuguguauuucagcgcauaauuuuagguauauucuuucaggggaaaguucccuaagugguuguugcugucauuugucuugcuaugucaucuagccugaagugcaguggugcaauccuaguuaacugucaccuugaauuccugggcucaagcagucuucccaccucagccuccugaauaacugggacuacaggcaugcaccaccacaccuagcugauuuuuuauuuuucuuaagcaaacuaaaaaaaaaaaaagucucaagaguugaauaugcugauacaguaauuauguauaacuuaauuguucguauuucaaauuggauuuuuguucucuagcugccaguuauaucuuauuuuauauuuguagguuuuuuuuuuguuuuuuuuuuuguggcugucuuccucguucugagaugaauggcaugugguguucucucaggccaggauucucuuucccugccauccgagccgcucagaagcugccuuccucagacagccuguccguggccaucgucccaggccccgcugcucacucgcagcacucggcugagcugccuucagccugccuugcuguacagcggccgcuccccuccacuggccgcuuuucuccucgcuccagucaggacucccuuuuguuuuguaucaugcuuuguauuacacuuuucaaggcucuuucauguauauauucucuuauuucauccuccagacaaucccaugagguugguagaacagagauucucaucuccguuuuaacugaggugaggcugggagaguguccgcauggcaugcacccucauuccuuugcccuggggcucccagaacuacuuguuaccgcucagguccagacuucuacaugugcaagguuuugaguuugcucaaagacgccuguaauuuugagguccucuuuucuacucauuacuuauauuuguuauuggaaaguccaacauuagaauacuugguucgaugucacaggccucuuuggaagaaagaaaucuucagaaccugagggggcggucaguagagaacuagagccgggagccccagagggccacacagcgugaacugggugucuugagggacaaguucugcuucaggguuaguugucuccacuggagauuuucagacaagagugggaggggguggguuucccuuauuucaccaauaaaagcccagcauauugggaugccacaggacauuucucaugaagaaaagaauccuucuugaaaguggggagggcacauugaaaaaucacuuuucacccaagugagaaaucauuugcuuuugacucucucuccccauccccuuaauggucaaacagaccuggguuccaaauccagcccugccacuuacuuagguagguauggugacguuggucaaguuauuuaacuucccuaaacuuguuuucucaucuguaaaauggguaaaauauuguccacuuuggagcauuauuguuaggauuaaggacaaugcauguaaaguccuuugauuauggccucgauaaguaauguuccccgaaaccuaauccagaagagggauuuugacccaggaagggagccaccuguauagagugggcuccagcagugguucuuagacuugagcgggcaucagaaucaccuggaagccucuuuacgacuugcuggcccuacucccauaguuucugauucauuuagucuggggugagguuugagauuuuugcauuucuaaguucccacaugcugcugcugcugcuucugguuuggggauuacacuuugagaaccacugggcugcagguaacuggccagugggcauguaggugcuguagauacauuugaaagccgagcuuuuuaugugguuacucuguuagacacugcuugaaaugcauuuugaaaauacugaauuuaauaucucaaggauauuuccugcugaaguccaggagucuuuguuacauauauuugaaggagaauaaguugugaaaguaacaguuguaaacauauuauagauagucuaauaauaucuaauuggcuaagguaugugaaagugcuuuuauaaaauguuagaugauguuaagucacaacugaaaaaacauuuuaaaucacuuuguuuuuaagaugaaacaucauaauggaguauaaaguagcauaacuuagauuucucaucucaaugugcuguuuacuguauguauuuuucucuuucuccuccaggcugcugacuugaguaaaccaauagauaaaaggauauacaaaggaacacagccuacuugucaugacuucaaccaccuaacagccacagcagaaagugucucucuccuagugggcuuuuccgcaggccaaguccagcuuauagacccaaucaaaaaagaaacuagcaaacuuuuuaaugaggaaguaaguagcacccugucuuagcuguuaagaaucccuuuaagaguugauacauucuuaccgaggguagucggccuuauuuugcacuucaagcuaagcccauuuuuuauucgcccagcccuccuaccuaguaugcccaaguuuaaaugugguggauuaauuuguugaccuuaccuguucuuccuuggggugacuguuuugugcauuuuuauggagcaugcucaggugucuauaacagguguuuuaaaacucuucuauaauggagauagggacaguacuguaacucgguauuuauaauuuaaguaagaaaauguggaauuccaaaguugguucacaucaccagaacauuucaugcagaucaaagaacuugaugacauuuccuuaggcugcuuaaauuguagccaaagcuuuuguauguauguuugacagucauuuggcuaaggaguacuucacuugcucuugaaaauaguuacuguaaacucaucuuugacauaguuggaaauccuggcgcuuaaaguuuggucacaugacauagcuuuugccaguguuguaguauguacugggguuucuaguaucuucaauuucauucuggaaagagccugagauaucugagcugucuguucaggaacaugucaggacuguuaaauguggcauauagaaauugccaaguagauuauauuuuuuaaagcuguuggagcaucuuucagccucaaguauugcuauuucauauuuaauauucuuccucgucuguuucaguaugacuuuucuaccaaguggaaaagauaagguaggcuugcugaguuagaagcccuggguuccaaucucuacuugggaccuugccccugaggcgcaagggucaggcuaugugggacccccucccuuuugcauuguugcaugguuuuaacaucauuaacuuggaacaaaaacacauuauagaguaugguuuuuaagaaauaauuuuguuuggggaagaaaauucaaauugacaaauggcaguuaaaauuuggauucuuuugcaguuaugguacuugcuauucaugcaaaucaguauccacccagggugcuccuguuugacauugccaguggauuugauaagaucuuaugaaccaugccaucucuucuaguuuccucugaguugacuggaaacaaaacuugccaucuggacugacagauuguagaggaaaaguauuuaaucccauuuuccauuaaaaaaaaguuaagcagaaaauauuuuauuuaccuagauguuuuuuuaguaucaucugcagaagugauuucuaaguagcuggaugauuauuuuuuuggugcugaguuuggggagcagcgcacaaaauuggccuccucugcacuguuagcagaaauugugaauuuggaaucauuguggguuuuuauuguuuagguaggggagagugugauuggagggggcagggauuggagccauguaagggcuguuaguaaacaagacccggaggcagcccuggccgaggaugguacagaaugccgcuuagagaacaagaaaguuuugugugucguggcagggggagggcagggaguuggagaccacacguccccagaaucucagggcucugggagcacucaggcugcauuggccagaacuaucccugcccuggugacugggaguugcaggcuggaaggcagcuccucauucuucaugauuuaagcaugaguuaucucauacucacuuuacauuuuauuugagaaauugcuauuuagaaugcuaagacugugugugguuuaaugccagcuuugcauuuacagcuugaggcugaaaucgauugcccuucauaguaaggagauccucuggccauguggauacauuuuuaucagauuuuggucagaaugucuaagagcaagggucaccggagguuuguuccuuagagagugccaggaaugguggugaaguagucaucgugucgugcuuugcuguggugugacauuuacagguuucaaggcacuuuuaccuauggccucuacagggaggguggggaguuguucccauuuuacagaugaggaaauagucaaagagcacauaagugaauuguccagaucagguagcaaguugaugauagaguuggaaccagaaauuaauuccagaaacucauugguuacaggacccaccaugcaugguugccagaugagcucuugcccuuccgggagcucacaguuuaguaagaauggacagagaguacugggcacgugucagcacagcgauaugaacaaaauaccaagggcuagcugccgcaggaauucuuuaguaugcauuuuaaaguuuuuuaaaauguuaaguucacugggggaguuccaagaaaugcuuuuagaaagugauguuugaugugggucuuaaaggguacauagucauuagaggaggguaaggaaggccuucaaagcuggaggaacaacuaggcaugugaaagaacauccaguaacagcuuggccacaucacagugugggacuuggagugucagaguucgaagcuggaaagauaaauuggaaccagcuugucuuauaaaagccuuuucaugucacgugaagcaauuuggaacugacacuggaagaugugggggaaccuuuggccuuuuaaugaagggagugacaggaucaaauguguuuuuuuagaacucuugucagcacuuguggaagguggauuggaaugaagaaagacagaaugaagguagcaagaccagugaggaggcucuaguaacuguccaggugagagcugagggcuugaacuagaguugcggccauuguuucauucauucaggaccuugacuaccuaccacaugcccagcacugggucugcagcagugggcaaaaccugcccuccugugaccccucucaggagggaagagagguauaauagcaccacccccgaaacacuggugaccacagauggugacacuuugugauguaagaggcaagagagcaggcccaagaaagggagagaaucacagaggucuacuuuauuuauuuauuuauuuauuuauuuauuuauuuauuuauuuauuuaugagacagagucuuacucugucacccaggcuggagugcaguggcgcaaucuuggcucacugcaaccuucaccucccagguucaagcuauucuugugccucacccacccaaguaccugggauuauaggccaccugacuaauuuuuguauuuuuaguagagacgggauuucaccauguuggccaggcuagucuggaacuccuggcuucaagugauccacccaccucagcuucccaaagugcuggaauuacaggcgugagccaccacgccuggccaacacagaggucuacuuuaaacugggaggcagaggacaucucucggacgaagugcuauguuuuaagcugugccucaugugagaagaaggccaaccagguaaggaacuggagauggagcuuuccugcaaaaggaauagcacaugagggcccuugagcccaaggaaacugaaagaaggacgguuuaccuggggaagguggcaugaaguaagggcaugagauuggagggccacaucaccuacggccugauccagauuuguuucuuagccugaaguacgggauuccuuagaagggagcaggugcacaaggcaggcagauugguguuuuugaaagguacccuggcugcuuuuuggagacugaauuggaaagguguauuaauaaaucagguuucugggugucucuugcuguguugggugagacugggaaaggagcaguugucagggaauggaggggaagaucagagguucuggucuguacuugcuaaguucgagagaccuguagauagugggauguauggaucuggagcacaaaacuagggguuacaauuuggcaguugucagcauagaaauaauaaucacauccuugagauuagaugaaagguucuuuggagagaugauggugagaacaaagaaggccugggucugaggccugauuauacuccaagauucuggccaucucagcuacugcuuucaaaggggcacuuaacacacaguuaauuaccacgacauuuacaacuucacagcccagaaugcugagggcucggacaccagcucugccacuuucugcuugcaggaugaugugggucuuaccucuccucgguuggaaaaugggugggaacagcacccaccugagagguuugugaugaggcucagaugagugaguucaggcaggguguuugugaagggccugaagagcgagccuugguggaugcucagcaacguggagguugagagaaacucaggcuuccuuuccugggaggggugguguuggacggaaaggguuccgugggaggugagauaccaaccguuuugaaauacaaauaauuaauuuuuuaggacaagcagguaggagcauggcaacccaggcagagagucaacaugugugaggcugaggguuggcccgcuggucacaauuacagcaauguggccuuucaguguuccucaccagaacaccucucagacccaccuguuaccacacgugcacacaccuucacacaccgaauccccagcaucaguuacucuggccuuugccuccuuucuggugccugguacaugaaaauguaauaaauguugggauggaaagaugagugaaauggaauuauaaauuucagaaauccaccugagauaaacauagaugaaaaauucccaucugggaacaaguauauuuuaaaagaugauuuucccccugucaauuaaaaauugugugcauuuaaaaugcuuguugauagaaaaauuggaaaauagagagguacaaagaagguaggaaagcaucaccucuaaaccgugacgcucacuguugacuuucacagucugugauuguuuucaaugaggggacaccauagggcucacaccuuccauugggggugaaggcaaacuucaccaaacuucaucuccaagucuggcccugaucaggucagcccagugagcaugggcaggcccugcccucuucccgcucccugggacuguccucagucacacuggagguccuugcuggugcaucuguucaagacccaaagaaagucgaaugcccaguccuuucuagccccucucaggaaaucauccccagcucccuggagucucugcuuuccccaaucuuccagaguagauuuuggguuucuguuuguagcguucuguacauaugaugcccuugaaaaugucuaaugggccauuauugaaaguaucuuggcgcacgguucaucugacaagcucccagaucguggagcguguccucaucaucagagcugcccacagaggagagucacccggucacauucagcucacuguggugaagcaccccacaggggcgaggaguuuacuuuuuaaauuuuuuuuuuuguguguguguguguguguguguguguguguguguguguguuucacucugcccuguucugaaguuugcuuuuuauaacuaaugguuauauauuuggggaggaagaguuacaaagggacaguuccuauaugguaaugaaugcaaccuuguugucuguguaaaaauccugauuuuggaguauauucacagaauaguaacuuugaaggauuuucaaguauguguuaauuguuggcugaaauauaaaauguuaaagaacuuggcauuuggcuucuuucguuacugacacgauacccucugcuguugcccuucuccucucgcaggcugugaggcugaggcagacacacuggguaggucccacgucuccuuguggcauuuagauccagucuuacugaagggcaugcugaagaggagauggcccugacuccugggguauggagggacacugcugccagcccaggcugcguggcacauccugccagcugcaggugccucccaggcaugggguaaagcuuagcaguguucugucuauucugauacaaaggaauggucugcacauuuuguuaguuuuguuucuguugauuuucuaaucgaaggaaggaaaugagcccguaaugaucuacuccuuaaagcuugaacacagauaaaacgacauccgaucccaucuuaauguggcuuugaaauacccuuuccuaauacuuccugagcccucuucagaugccuuuacaucaucagagccuuuaguugccauuuuugcuugugguugcauuauggcuuuucaagcagcugcugugguuuuugaauuguuucaguauuuuuguuauaaauuaauaucugcauuuugaaaugcagauccacucacccccaaacuaauuuuugauuuuugcuuaucauauugauaguaaugaaaaaaaagaaaaagaaaaugaagugccuuagaaagcgucagugugaauugcuuucacaaaaugacacuuugaugugguuauagacuuauuuuuauucuuguuucauuuuaacuaguguauuuugaaaaucuugucuguugauggcauuugggaugguaguguuuucgcuguucgugggauuuuucuuuguauucauaucuuaaguggcacggucuguuuggccugcagagcuggaacuauggggagggccgcgcugagcguugaguggagacauggagccugcauccccacagagcacuggcccagagcaggugucuugacguacauagaaaugugucuguauuucguuuugcuuuuaagguuuauuugcguuuuggguuuuuuguguuuuuaugaacguguuuguuaagaaugggccuuggagcauuuuggaguuggacacugauggagagcccuguggccaggccagcugcucugccagcaccucuguuacuuccccugccuucccuccgccuccucgcugagcaccugcccugcccaucucucaguguaccccugcccuggaggggcugcgacugggacuggggcucuccuccacugcuucccaccagagccuuccugccucugccugucucuguuccccagcaccucccuucuggcccagggagcaggucucuucccugucccucucuccuggagcucaccuuccuccaccaggcaccugcccugcacccuccuccccuacggugucccuuugcucucagcaccuucucugcccccacccugcuucccugugcucucuccuaaggaccacccccucccugugcacuccaucccucuagggcucagcuuccucaagucucagaggccuguccucugaggcucuggccuccuguggcagcuccuuccucuucugccugcucuccucauggcacuucuggguuguuugcuuggauauuccuucugcuuuccuuguuuuuguccugugcccuguauggagguuuuuuuuuuuuuuuuuuuuuuuuugagacggagucucgcucugucgcccaggcuggagugcaguggugcgaucucggcucacugcaaaccucugccucccgaguucacaccauucuccugccucaccaccugaguagcugggacuacaggcacccgccaccaugcccagcuaauuuuuuuguauuuuuaguagagacaggguuucaccauauuggccaggauggucucgaucuccugaccucgugauccgcccgccuuggccucccaaaguacugggauuacaggugugagccacugcgccgggccuguacggagguuuuuuucagaguuucacacacucuuccuccgcugcaccugcuuccuuggagauauuuauuuauuuauuucagagacagggucucacugugucacccaggcuggaguacagugguguaaucauaacucacugcagccuugaccugggcucaagugauccuccuuggagaucuuaggauguuacuauucgcagccaauuucugugacauucgugguuauauuuauuagcugcagaccuuucuagcugcauacugggcaaaacccaggggucuuuacacacccccgcuuuccaucuugcccuccacccagccacauucugccacgcugcccauggucaaguuuaagaccuauuuguccauggcauggacaguugucauagccuccuaacugguuccucaucacccccaccccaccuugcauucugcaccuacugcugggggauuucauguuauucugccacuucccuuucuagaaacugucugugccuccacugucugcagcagcauccccaguagaaauacagugccagccacgugugcaaguuuaaauuuucuaauuaccacauuaaaauaguaaaaaccaggugaaauuaauuuuaagaaaauacuguauuuuauauauauaucuccaaaauauuauuucagcauauaaccaguguaaaaacuauaaaugagaucauugacauuuuuuuucauaccacauuuuuagaacccuguguguguuuacacugacagcacauuccacuugagaccagugcugcgggacuggggagugcaagcgucagggucccagccgaagcccuuuagcuugggacuucacagccacagccugagucccagcucacaacuccagaccaaauuccccucccagcucaugugcugcgaucaagacagaugccacacauggccuggauccccaccccccuggccugcuguguuggcugggcuuuuccuuggagcauggccccuggugcuucugccacuccugccucccugcccacccccgaaaccccaucccucagagggaccggguauuuuucaacauccucauccagaucaaggccccauugacauuggagagaauucaagcccaacagggaauuccauuacuuaucauugagcacugacuaagauuuuuuuuuuuaacuagacuuuuucugaaacaaaaauauaccuuauagugcagaaacuggacugcauaauuuuuauucuuguauuuauuuaauuaaauguucuagguauuucuuucuuaauuugaaagacaggagaaaaauguguucuguucucuuccucuuuugucaaacccaauccaaauaagccagagucauguaaguuaaaugacugugcuucccacacuggccuggggucugagacaggcuggugcccuguuccuuagaacgcuugggaguggcccugcaggcuggucgucggagccaggugaugugugucuguggaacgggagacagcaugcucgcuuuggggucugaugggcccgucuguuccccuggcacugguucggcugugucucuccgccucggaguccuugaaguuguucucuguggggguacacuuccccaaacauccucuuagccugauauuugcugucuuucuguccuucugucuugcucagcuguccagcaccagcagaggaagaggccuuucuuggccauccuauucaacauugaaaucacuagaguccccuucuccccagcacguucucuucucucccugguuuauuuuucuccacagcacuuaucaucaucagaucacauaaauuucacugucuucucaucccacuugaaccuaaauuucaugagggaaagaugccuguuuuaauuuauauuguaucagugccuggcauaugguacgcacucaauacuggauggauggaugggacuucaggcaaguuucuugaccucucuaagcuucuuuucucacugauaauauggcgacaaucccugccuuccuguagggagacaggcaugacugcauuuuccauuuuccaugcgaggcaauuugguaacaucuguaaaaaucauaaauguauauaucuuuuggcucaguuacuccacugggaguuuauccuguagguacauuacucacacaugugaaaagugcgugugugcaagggcauucauugcuacauagauguccaucaguggggcacuuccacaauaaaccacaguuuauccaaacaguugaauacucugcagcuuuagaaaagaaugaggaugcugucuuugugcccauacagacugauguacaaauacacuuggaggcugggcaugguggcucacgccuuuaaucccagcacuucgagaggccaaggcaggaggauugcuuugcuccugaagccaggaguuugagaccagccuggacaacauagcgacacccuguauuuacaaaaaauauaaauuuuuaaucagcuggguguggcgacacucaccugaagcaccagcuauacucaggaggcugaggugggaggauugcuucggccugggaggucaaggcugcagugagccgugauugcaccacugcacuccaaccugagugauggagcgagacccugucucaaaaaaaaaaaaaagauauggaaugagaaagcagaggugagacagugcauaguaugcucccuuugguaugaaaaagaagaguggauaaaugcguauucauauuugccuuguacaugcacaaagacacucuggagagagaaaugagaaacuaguacagugacucaggacagaggauccggaauggaguagaagaauguaaggcuuucuacuguauacuuuuaugugaauuaauaauguauuacccauucacacaaaaagcguaucuugaaagguaauuuugaggcuuagagagcauggguguaagccucuaccaguggccagcacccacaguagacacucugauuggaagugagggccagcacgcugcuguugcugcccacagacacugcugccugccugccacucacccugauauugcugagacacagggcgcccccagagaagcacguguuuucccugcugucaagcacaugauugacagagaaaaacaauggguaaggcaagugagaaacccuuaccacaauacagguggauccaaggucgguuuuuuuuuuuuuuggucugcgguugcuuaaacuggugugcucaguccaccauugccagugugucacaguaacauuuaauuaggcccccacagggggauugaaguagauuggcacaggauguuaucuguaaguuacauccaugugucuacuuagggucgucucagugcacuguuuuuuuuuguuguuguuucuuuugagauggagucugacuuugucgcccaggcuggaaugcaaugacgugaucuuggcucacugcacacagccaccgccuccuggguucaagugauucuccugccucagccuccagagcagcugggauuacagguucgcacuaccaugcccagcuaauuuuuguauuuuuaguagagacaggguuucaccauguuggccaggcuggucucgaacuccugaccuaaagugauccacccuccucggccucccaaagugcugggauuacaggcgugagccgccgcgccuggccacagugcagcuucuuaauacgggagugaagguuuuuaauguguuuugucauugcaguaacauuuauuuuuaauggugcuauaaaugcuguucauaccucacuauugcaaagcaauacuguuuuuacuugaucauacuaguuuuugaguucucaugcaguuuuuuguuguguuuuuuaaggcccaaaauaaaauuuacuccuaaccgugcugcuagaaguuuuuauguccugaaauuucuccacacaugguaaauagaguaacaaugaagugauccuagaaaaacugggauuugauuugguucuggugaaauguaaggugcaggaauugggagccacuguaccaaaaucaggacagcagucuggcuucccaggccugaguuagcugguguaggccugccugacaaggccagugauggagcgagcugcagacacccuuaggcccugggcgaucagguacaguuguguuugugggaucaagagugcugggguagucugggcccagugggcacagcaaggucuggcagagcugugaugggggaguggaggccucuuaauccaccguucaccaucccaucauccuugcaccucccuccaccaucaaaaaaaagcccugcucuggccauguaaauuaucucuguaaccccuugcugagaaaauugcacgaaggucuaauggaaauccugccagagcagcgcuggguuuuagguuguuggcauuagugcaggucaggugcuguuuauagguaggucaccaggcaggaggauaaagaggaggugggggaugaaaauacuggcuguguccccaaggcuggcuugccacgugccuauuaauuuaagaggaccagccaugccguuuuacggcaguaagcagugacaccugcugcugaguaacugcccaaugcaugguccccagcccugggcccgcaugcuguguggcguucaggccuccguucuuccugccugggguccuuuguuagcagccuacuuucuagggucuaauguucaugcagugagcuugcauggcucauuaauuucuuucccagccguucuuuuaaaaaucaagucgucuuauuucuguaauucucuguaaagauguagcacacauggcgggcacauggccucaaagccacccuggcagaagucggcauguuucuuggcagauucugccccugugugcccaguaccccucugagacuugagucagggacuccccaccuguuaggugaagcggugguguucaacuuaccuggggcugcugggcuccuaaagggacacuguuacuggggcgauggugcaguggagagcacuuggcaguaggagcuucuagguagaacuugggagucuugggacuucuggauguguucuggugaugcgauuuugcgcucagacgguccagaaagggaccgccccuguggaagguguugcgcuggcauccccaucacaggauugauuggcaagcagggaaagagacuugugccuuugguggggcagguauuuuugcccuucguuauuuggguuuuaaaggcaagacuacugacauacgccuguuaaagaaacaucucggucagggguccaaaguuagcauauggagcagagugaugguaaugagacacacacucccgaaugaaucgucaguguaucucucucaacaccagcagagaggguuucgaggagaugcuuauggagaugcacguggggcggugcaugggagugaggcggccucagugggcccaggcucuguuuuggaguugugugugcugccagccauggacuguggauuucacuccccaccuucgagccgccagagcagaggggcagauggaaccagcccauuaccuacagugacaguaaaggcagaggaacccgugagggugaggcagagcccuccuggcugugaggacucacaggcuucaccugcagguccucguagaggggauaccacaugcagaugcagugacccccagauucagaugcaccuacugucaaggaagaaagaucccagcagggcuguucccuccgcagugaacccugugccuggcaucgugucuggcacuuaguggccccucugcaaauaucuguuggcugccugacucccuccgugaaagccagcagccuaacaccgauuuuagaaaguaauucuaaauuaccccaaaagggccaaaacgcuccuugcuggcuuggcugacugcaggauaaaauguggagggccuggauagacuugccccuucccaucgagaagcacacaaguuuucuugcuggaaaaguagaccuuugagacuucuccguugugcuaacuuguucuccuuugucuucacagagacuaauagacaagucacgaguuaccugugucaaauggguucccgguucggaaagccuuuuccuaguagcccacucgagugggaacauguacuuauauaauguggagcacacuuguggcaccacagccccccacuaccagcuucugaagcagggagagagcuuugccgugcacacuugcaagagcaaauccacgaggaacccucuccuuaaguggacggugggcgagggggcccucaacgaguuugcuuucuccccagauggcaaguucuuagcgugcgugagccaggacggguuucugcggguguucaacuuugacucaguggagcugcacgguacgaugaaaagcuacuuugggggcuugcugugugugugcuggagcccggauggcaaguacaucgugacagguggggaggacgacuuggugacagucugguccuuuguagacugccgaguaauagccagaggccacgggcacaaguccugggucaguguuguagcguuugacccuuauaccacuaguguagaagaaggugacccuauggaguuuaguggcagcgaugaggacuuccaagaccuucuucauuuuggcagagaucgagcaaauaguacacaguccaggcucuccaaacggaacucuacagacagccgccccguaagugucacguaucgguuugguuccgugggccaggacacacagcucuguuuaugggaccuuacagaagauauccuuuucccucaccaaccccucucaagagcaaggacacacacaaaugucaugaaugccacgaguccuccugcuggaagcaaugggaacaguguuacaacacccgggaacucugugccgccuccucugccacgguccaacagccuuccacauucagcagucucaaaugcuggcagcaaaagcagugucauggacggggccauugcuucuggggucagcaaauuugcaacacuuucacuacaugaccggaaggagaggcaccacgagaaagaucacaagcgaaaucauagcaugggacacauuucuagcaagagcagugacaaacugaaucuaguuaccaaaaccaaaacggacccugcuaaaacucugggaacgccccuguguccucgaauggaagauguucccuuguuagagccgcugauauguaaaaagauagcacaugagagacugacuguacuaauauuucuugaagacuguauagucacugcuugucaggagggauuuauuugcacauggggaaggccugguaaagugguaaguuuuaauccuuaaugcugcaccagaucuagaacuugaauagguagugacuuuuuucuuuuucgugggaggggugggguguacaaugaaugugaaugacacuucuuauucuuaauguaaaucucaaugcaucagagccauaauuuuggauacugcaugccauguaauucugaaucauuugauaauuuaccuuagagcauuuaaaaaaauauaaucaaacuaauugccagccaagucagucauccuccugggaguauauagagucccaagguuagcgcuccuguauuagacuauuucaauuuuaggaaaaucaugaccauguggggaaacaaugacuuuaaaaugcugaaauuaaaauuuaugcuuuaacuggaauauuuuuugcuuaacuacucaauuagaauauuguacaccugaucaauguguguucagcacagauggccaugaauugucauuuauaguccaauuuuuuaucuuaaucauaaaauguuuaggaaucuaugaaauuuaacuuuaggaacaaaacguuuagcaggguugauugauauuauuuuuacauuguucuggcaauccacagaaagagaagagccuuaauuuuuaaaacccauuuuagucauuuuaugacaauuaaaguuguuuaauaaacaucuuuuuucaaagaagcaguuuguagcacuuugauugagguucuguguacuaagauacccguaccucacucagagccugacaguucgugggaacugcgggccgaggacgccaacagcauugcagaagugccucuugccacauaagcgaagaccuuuucuucagaugcacuuugcuuguguguuuucccaacaagggaaaaggaguuuuuugguuuuuugccgggggcggggaggugcggugggggagggggauugggucagaaaggcacgugacuccuccgcgcuuuguuucguaaagccugagacuccccgagucuuccgacuucucccugacauggcccucguuugggcuucgucccccgcagaggaagcggaagugcagguuuccccucuccuuguucuuggauggcagcugugguuccgggauuacucuugggaugcugacgcuggccaugugcguaggcuucguccucaguggcucccacccuagcgccucagcccaggaccugguggccuguggcuuccucggcagugggaggcucugcugcucccccggagaccgcagucuuucacccucacucucuacugcugcaccaggagcugcuuuucaaauucugguuuucccagugggugagauggccccuugaacuauguauuccaugucaagauggugguuaucuuacuuguuaacucauuuugggcauuuagguuguacaccuuuguaauuaaauauagagacaacgaucacuuagaccaguuugcguagugaauaugauucagcaaagugaagaccugguggcuuuucuuucucugcaguguaaagacccugguagcugaagcagcagcucccugugcucuuaacgcagcccucccaggaaagccgggccagguucccaggccugcuucccaucugcaaacaugucacgguggcgccauccacccugugcccaucgugggccuuaacgcagugguuucuguugagugugauggcauggccgcgugcugccaccugggaaccacagcagccuucaggugcaucucuccuggcugugccuuucacaucccugagcacugcuccuaggaguauucguguccucucuaccuguggaauacgggccuuuguuccuaaaggugaacugaucuaagguagccaugacagccauccuuguggacaguuuccgcuuuggaggccaaauugggucauguggagagauuagugaugaacgcuccaugugcaacuuuugcaccuacauaguuguaaacguucaguuucaaaugcuucugaggcauugaguaugcaguuucaaaauucaggacuuaguauuuggccuaaauagagaguggccgaucccaaguaaguagcauuuauggugacauuucuggcgaccuugcaguucugaagguguugcccuggacagggaagccgugggggugugugcccgaguaaccaacgugaccgacuggggacucucugauuucucccccuucuuuaaaauucucagucgcaguggcugggaugaaagagggauugcagggguacacugacaggugacuuaggagucauuugcugauaggaaccaggggugggagaggcaagaggaggagguuauguuuccuuugaaaacaacuccgaagugugcugucuaguauggaggccugugugugucuuucuccccccaccuccaguuuuaaacacuaugauauugucaguuuuggauuugaggcuugauaacaaucuuuuucuuccaguuuuugccaaggaguguacuguccuuaaugucugucugguaccuugucuggggccccuucguugugucuacgugcccuccccaaggccccucuugcuggguucagggcccaguggagagcacugugccagccuggggaggggcugccuuugacugcauguccugaccccuggcucagcccaggcuggcccaggcccugcagggcgacaccacucuguguccacucugccccucugacugcugccccuuucuuugacagccggcagagcacuucugcaggcaggaggacaggaugcaagguguucuccaagaccagaacuaaaagugcccaacagcuugagaagagggcacuggagagaggggcagggaagcgcccuucuccucggcugugcuucugaguaauggcucccgcagaccuggggagggccuggggagggguggccgcggugguuccugauaucagguguguaaggugcaaugcgugcugcuaacccuaggagaaauuuggggaaaauauuuguaguuuucucgccaaacuuugagcuuccucauugaaauuuuucagucuuucagccuaaacguuauuaugagcaagaauaucuuuucuaaccuaaucuguggaauaaaacacagcauuuggcaagaagaggcuguuaaauacucagucagcaucacuguuccagcguguaccaaaccacagagaugaaaggcucagacgaaagucaggugcacgcugcguggcuggagaaucccgcucccacccggcaagggggcgagcuggucccugggcggugucagacaccuucugaaggugccaggccagggccaggggagcuucaacucgcccuccuuggguuggccuuuuucaccagaauucaagaagccagauuugugcugugacugcgauggggcaggcuucuaaacacuacugguggcccuggagccuuucucugaggcuuuuuucuuauucagaaggagaauuaaaaauucccccagcggccuggagaagggaaccuuuggaaaagcuugccuucuuuuaaaagcaaaugcaugugcaggaguagacacuuuacaaauaaccaguagccuuggggucgaaauuugcuuaaaucaugguaaaggaucucauuucucuuuugugcugauugaaccuucuagcaguuuggaaguguuuuccugugaacccuuagcuggggacugaggguaaaugccuuaaaaauggaggcauggaaaaucagaaaggagcuaucacaaucauucuuuucucaaaggcguucaggaauucugaggaagaaaugcagugacaggaugggauuuuaggggcaaggacaccguccgggcggggcccagggcucuccacuggcugacuucacccccagggcccagcuggcacguggccaggcagccauuucuccccaguuccuccacuuccugggguucauuuuaaauaauaaauuguaaaguaugaaaugagugcugaaguugccugcauacaagguccucaucaccucucgccugggagggagacguuuucuuucuuuguugagcgagcucaaagugugaggcggagaaaaccuagggguugggggcggcuggagaagggauccacggaaacccaagcgccacaucaugcgugucugacugcccacggaagaacuagaagcaguucaccaguggauuuucuggggaacgauucauggaacacagcgucuggcguccagcuuugugggugagggcauggcgggggauccgguggcccugcccugccuccggugccgguggaugggggagggacuggccucugacugcgggguugcaccauggcggcggucggugugcccuuggcugagguuucguuccuuagcagugagaaccuccacaugcguggguaggggucgggugaccuggagacgccuccuccggucuggucugggugacaaaggugaagguuuauagucuaccacccuggcagcagccugcagggcccccccuugucuggagcacacccuucgccacgggcugauugggacugucggguguugcuuuaaguuaacaaggugcacaucacagcgaccccaagugaugucccaaagggaggagacauuagucuggccgaagugaagucuguggcuuuauauguaaaagcacucguaugcaacuguuaccuuugaaacucagauccuaguuacgaacuauaagaacgugccccuccaguagagggagacugucucacugauguugauuucuuuauucauuuccgcaucuguuacacgaacuucgugucauaaauugcuauccuuucauuugaaaguguaaaaaauuuccugcauuuuuaucauuucuguauacuugaguuuauuagagauuguuauguuaggcgacacuguauaaaauuguauggauauuuugagugaaaaucaaaaguaaaauucacauguauuuccuuuuuuauauuuucauccaauuucuugacaacuugaauaaauuucauaaagagccuuccuaacaugaaauauugguaaauuaaauucuuuacuguugcaauaauuaaugaaacuuuaguaucaguauuguuuuauaauuuuaaggaaaucauguuuguuucacugcuuuguuuuuuuuuuuagcuguugccuugucacugucacagcuaacaagacuuacuacauacuugauauucugaaguacuguggggcuguccucuguauacugacauuaaauaaacgugugugagugaacuguaaauguagauaauuuucaguagucauuuucacaucuaagcuuuaaaaaucccagugaaccaaaaccagaaaaguuuuuaaaugcuguaaaauuaaggaccuuguuaauguuuauagaacagccagccaccggaauugcucccucuuacuaaagcugacuguuucucauaguuggcagcguacucgaugaaauguucugcgucucagauacuguuuuaugugguccuccucugugccaacuccaguccgggagaaggacuguugauuggcguuucggcugagcuguguagaggcuucuguuuaaugagaaugcagacauucugaagucguccugggccacgagcuggcuuuuguuacauggacucacuaucccggaugcuggacauccgacauucuguccagccacccagccagcagcugggagaguggagaagguagcggcugguaggcugcuugcuuuuuuuuauuuugcuguaaguucugggauauaugugcugaacgugcagguuuguuacauagggaugcaugugccacggugguuuguugcgcccaucaacccgucaucuauguuuuaagccccgcaugcauuagguauuuuuccuuaugcucucccuccccuugcccccagguaggcugcuuucaguaggagcucuuuuccuggcuagaguucauugucugccuacuccucaucuugaauaguguuugcuuaaggcuuugugcuggcgugagguuguccugcuguagacaccaggcccgucgucggugcagagcgcuuccuacacagggcagugggggacguuccauuugggaugagaagaacucaugauuuacauugucuuacuaugaaauaccaucccucacucuugacagacgacguagcugaucugagcagcgcccuggcacccgcaggccuaccccccugccugaggugugaugagugagggcgagcuggccucagacacagcccuuccucaggcccuugugcucccauuuaauugucacuucccugcugugucaugagacauccaggucccacucagccgccucugcauguuggcagccggcugagcccugugcucugccuccagcacguucaucggguggggaacucccagaagcuucccacggugcugucucuggagugcggggucagcagagccuccagugcugaacuaucugcacuuuuugucuugagucugggcugucaaagcggagggaacauucagaccuacagcucucaaaagcggccuccuggggccuacgacugccacaagagugcacagggcucuguucuuagcacugaacagggcguuuugguuuguguuuuuugagacagggucucgcucuguugcccgaacauggcucacugaagccuugaccuccugggcucagugauccucccaucuaggccucuugaguaacugggaccauaggcacacaccaccaaacucagcuaauuuuuguguauuuuuauuucuguagguacagggucuugccauguugcccaggcuagcacugaguagauuuuaagcccuaaagacuauuaaguugacagcaaguuuuguuuuuuuaagaaaaccaugacauuuuggucuuuuaaaaauagcuaguuuguaccuucaaaaaaauaaaaauagcuaguucucagcugggcaugguggcucaugccuguaaucccagcacuuugggaggccgaggcggguggaucaccugagcccaggaguuugagaccagcccagccaucauggcaaacccccaucuguacuaaaaauacaaaaauuagccgggcgugguggcgggcgccuguagucccagcuacucggaaggcugaggcaccaugaaaaucacuugaacccaggagguggagguugcaaugagucgagauggcgccacugcacuccagccugggcgacagagcgagacucugucuuaaagaaaaaaaauagccauuucuccauguguggcugccugucagaauuaauggauucugaacccaggggucucuggagacgaauggaccaucuagaggcucucagcucccuaccaccccuuccagggucaguggccuccaaaaccagccuccccuuuuagguggggggcagcauaagcaaaauccucuuugaaguuacucaagcuagaaaggcuuuauggagacuaaguggggucccuucuuccugccccacacaguagagaggauugcagggccaagugggucccaggagcgggagggccuccagugacagcccgggccggugcuggucuccaucagugaacgggaucacgaugaaggcccacugacuugcacacguucucucugaugcuuuucuuccaccuucagaucgcagcggagcccuuagauggucgugcccuucaucugcguggucuuuccccggaagucugaagaguacaauccuuuucucuggguggcuuuucucauuagaugccagguugaguggcaucugggcaaguguggccccucacugucaccugucaguggacagguuaaagcuggcagagguacgugguccacugcccagcuauaacugaggucccaagccaaacugcacggcaagucuggggcagagaugggucccgacgucccugggcugggcccaggguucccggcucuguggcucacgugccgcuugugugauguagagacuggcuucgggugccgugaauaaaccauggcugcuuucuccagguuugcuuugguuccuuucuguuguggucuguguagugagaauggugggagucuugcacgugagcaguuaaggaguguguucagagcuggaagucuugguucugagagcaggcuagccuggucauaguucucaucguuuccgcaccgucucuaaaaaggugucgcuuugcaaauaacauuuaacucguguucuccccagggugagauucugccaggagcaccugccacagaggccagcauuggagccucaggggcuacgugcagggccaaggcuggccuucucccucugggggacgccaguggaggugaccuccacagcacgccggccagcuggcaccaagcuccuggauguuguggcuguguagaaccagauucugucuugugguacuuuguccacgaucucaggagagaagcgcuagucugcccgcccgcgugccugccaugaaacgggucccagggccugugugcgucuuacuuuuguuuggguuggaaagggugaccuuggggguugaaugaccagagaggguauugaacagucccagguggaugagggaugagcuggcgcccagcccacacucucauccacaucccacagcugucuccuugagguucugucuucucugacacucacaggccaggggucgugggggucagaaggggaagcccucccagaacccagagcuaggagaccguccaggccugacagagcuucaggacauguccuuucucugacguggccuguggcccucacaguccuaucuggcugucagaaucuccaguccgagcagcaccugcaggggcaggaacauggccuugcugcuuuauuguaaauuguuuugaaccaaaauauuuuucauauauauucuggugcaacaagguguaauucucuuaacuuaguauuauaaauuagaaucaaacccaaaccaagagcuggaguauuuuuuuaucacuuaauuuugaacugaagucucuagcgggaauaaaacagugacucugcggggagccaagcagcugacuaauauuagagccaaggcuugccccguuccucucacggugugggggcugaugggacgccgugcagauucugccuggggagcuccuuugccugauggcaacugguaaagccuggaauugccagcuguccugcuucuggugcacagcccagcagcucccgcacgcugcugagcacaggugaagcgugggcgggcuccccuugccagguccuccgucggccgggccgggccuugccccuuuucucccaugaaaaggaagcagaaggacaggguaaaaccccacucccucccugaagagcaggcggauuggggcagcagggucccugucaccgggaguuugacacggaugaccauuugggcaguggaucccccacgcugugcucucgagggaagcugcagccgggauccuuccaugggggccuaggugucuguuucucgucuuccucuucuaccaccugauaaucuuuagacugaaucacaggcagauagaaacaaggugacuuuuuucauuugauucucuuuugaauggcgcuuuuuccuccuguugccuccaguguucaccacggcaaagugaguccaucuccagcaagugacaggugccaagaugaaggguccagugacucgcacaaguccucagcggcaugcagggcgccgaggccccuucccugccacccggagugcugugucgcacccccugcuucugggcaugccuggcacugaugccaacgcagggccacagcaggcccagcacacuccagggcuugugccugcaggacugucuccuggggcuugcuggggucacugcuggagaacuggaggccgggcccuuugggccuucgcuucgccuuccgguuaacuccucuuagagaccaccguuuuccccuuugcucugacgggcgggcuccagggagucccuggucaagcacccugggguccucuuggguuuuucaccgguggccaacgugcuuccugagugcugcagcauggggacccugaguuuugaucaugggcacauucucugcauggcgaugcauucuaaaagaacuguuaaccagggcugccaucaaaagggcgaagccugcuaacgggaacccccaguuccguuaugccaguauggacuacagaagacgagaggaggacagguuugagggcgguugauucaagaucucucuggaagcugggcccaguggagagugggacaguggagggcaugaaggugguucuaguuggcuccuagcugccaccacaauuggcaucaaggcguuagccagcagaaacuggagaaugagugugcauuuguuuugugcuaaugggagaauaggaagccugcagcccucgcguugggucgcuuucuaggggugcggcuuuguagggaccagcuggcggaagcagcgugucccucaacaucaggcucuggcagccugguggcugcgccaccucugcgucucagcagccgcccuccccugggagugauggaaagcagccgaguccucuggggccucacacucagugagaggaagucuaaggaagggugcugucccucauggccgucagaagccaccugcagccacuaaguauguaaauuggggccaguccaaccugaaaagugccauaacgugucaaccacacagcacaccucaaaggcuucuuaccaaaaaagucauuaguaauuuuuauauugcugaauauuauaugaaacaucuucaguuaaaauauuaaaauuggccaggugcgguggcucacgccuguaaucccagcacuuugggaggccaaggcagguggaucacgaggucaggaggucuucaagaccauccuaacagugaaaccccaucucuacuaaaacuacaaaaaguuagcugggcgugguggcaggcgccuguaguccaagguacuugggaggcugaggcaggagaaucacuugaacccaggagguggagcuugcagugagccaagaucgugccacugcacuccagccuggacaacaaagugagacuccgucucaaaaaaaaaaaaaaaaaagaaaauauuaaaauuaaugucacuuguuuuuauuaucuaucuuuucauuuuuugagacagggucuugcucuaucccccaggcuggagugcaguggaucgcggcucauugcacccugcaucuccugggcucaagccauccuccugccacacagccuccugaguagcugggaugacagccgugcgccaccacacccggcuaauuuuguauuaguagagauggaguuucaccauguuggccaggcuggucucagacuccugggcucaaguaaucuccccaccucagccucccacagggcuggcugucacuuguuuuuaaguuguuaaacgugcucccgggaagcuaaacuuaacacaggacugguagagacaccaccuuccuguggguggggcugccuccuaccuggagcagcacucaccuccaccuggcacuccgugaaaggggagggagacucuguggcugccagaugaggguggccccucuccgucuguccccaggcugggucaccaccacuuucucccucugccaggaguagaugacuuuucuguugccggggggaagggaggugccuccugguucuggagauuugucacuuccuggacaccacauagcuuguggaaagcacuuucuuagggugcgcguggugaugaaggcagaguguccugugugagaggcuuccuuccuccagacugucugcggcagaaguggggucaggaaccugcugcccagcuuuccuccacaggcuugauguguuugagccagaaguauggggcguuugcgggguccuccacaaguacaaacaggguucugucccuuuucaggggucccagaggaaaagcacuccuauagacucugagcaggggcagcugccacauuccguuugcuuccugagcuugucuaggugaacagauuucagguggaagguaagaaacgggaugaaaugacuugagcgggacagcuugcuuccaggcuuccggcagcagggcgugggcgaggcugaagggcaguuuccgauugucaccuucauuuguguccacacaaguccaauaugugagaagguagcaaugucagcuugaguuaaaggcuugucauuuguaaacaguacucaucagcugaagccuucuuccaugacagcuaaguuguauucccagagcugaaaaugugcaccuuuggggcugcacugucgccaucuuaauguucuucauaaaugaacgccacacuuugauguaauguaauugcugcucaauaguaaaugcaaagaaauggaaguacucuuugcuguguaggagguuaaacccucuuagguuuacccaaggucacaccaguauuguaaaaucugggugagauuccccgcccccgcccccgacagugagccucucagcaggagccgcccuaaagagccagaugccccccaccauucuuccugcuggcccugguggguuggcccccacaucccuucuccacacccagcugcagccucacggcaagacuacuuuguucuggggcucccccgaccucggccugggcccugcugucucuaccuguggggccuacacauguggacagcuacagccagggggugccacggucacaccacccaacaaagcaagaaccccccagcagagaaugcccuuucaaaggugccacugaacucuauccuuggagacaaccccuggcuccgagggacugggugugcgguccagaacugcggugcccugggcucaacccuggcugaaggcgcugaacaccucccacgaggcaccugcaccuuugggucagcaaagcuccaaagaaccuguucucaggugcugagaaaccacugucucccccaagggcaaggccagcccugcccgcccuucucuuggacgguauugaggccacaguauugcacccagcaggguuccaauucucuaggaauggaacgcagugaucuggauaggaauuaaauagaugaaguggaggguuugcucccacacuggcuuccacaucaacagcaccaguuuugaccacguggagcugcuggcggagggcgcgcaugguggcuguugcccguccgguguuuugcuggauuaauguagacugcuuuguuugcagggcucauugucauccccaagccaggccaguucuccagguggaacuguaguguagcgaccucacugcugcgcgcacagucucccgggacuuggacucgagggagugacgaggaggagcuccgagcugcgccugagccgugccagccggcggaccucaggcgguggacgucggcgauagccguguggacggugaccggcucacucugcggcgccgugcucccgcugcucacccaaagaaguuguuuccauuuuaaaccggucuuuuggggcugcaguaaaaaauaagaaauggaguuuucuugcuuuuuacucuaaaauucaauguaauuaaauuucauauauauauaauauauacauauauacauaguguaaaauaaaauguuucuuggacaagaaauccccugaaauucagcuguuauagugcuucacuguuuuugcacugauuuuucuauaccuuagguggucagaagacaaccuugaaugcacucauagagaaaacuguuacuuucugacguaauguaauucaggaagacagacgcugcaaucacagauuuuaaaaaauuguuugcacuuaaaaauaguugaaugcugguggaaaguuacuuugcagauggguguaaggacucauggcccucugaggugcggcgugaagaugcccuuuuuacccguugacguuuauuuuacguaaaauaaacuguuguuuccaaugcaaucaacucuguauuauauguauaaauauuguaauucugcaauuggggaaaauaguuacuucacuaguaauuuucaucauuuaagagugauauuucuaauucacaaaaguuaauauuaaaacuaucuugaauauac

SEQ ID NO: 17165 - RNA, 97779 nt, Homo sapiens
acagcucauggcguucagggccugacgguugcuagggugacagggacacaacauggcggcgggaucucuaacgcucuccuucgagggaccaccacggagauccuagugcgggaccccgccucagggaaguggaaagcagggggacaaccuuccugcuucuuucuuuuccguccagugucggcaagggguugucaccggcuuccgcauccaagaugaagagugaguggggccggggaaaggggcagggacuggagagcgaguggcgggggagggagggacugggggagcuugaggagcuugaggggccuguggggccgggcgucgucgccuucugccguggcucgacaggcccgggaggcuccgcaugugggccccgaaucccccucggcugugagaagccggugccccugggggaagcuugagggguuggggcuagguugggaacuuuggggucucggagagccgacucgaguucccgcucaggcauauuuuggugcaggugcgugguucuuacauuggaguuuagggaguugacugugauucauuuuauuuuauuuuaaaugcuggcuugaaccugacacucuuuuccugaacauucggcagaaaacgggggagcgcuuacagcguggcucccugccuuuucaugauacugguuuagugaccaauugagaggaaagcugggcugugugcuuuauuuuauuuuuugggucaagcaguaguguuuuauaggaaccacuuuuuaauaguaguuuugaagcaaccuuuuaguuaaaagcuguuacuucaaaguugggaaaugagguagucauucuagaaaauguaacggguaaaaaauuuucuuuagugggauuuguggauuauugacaauccaagugcaaccagcuagaaugauguuuuuaaaauuauuauuacuguacagauauaauuguuuaugguugugaaccagaggugcaguaaaaauucagaccuuugcugugaaaauauuauguuaggaguaguuauaauguuaaauuugcauuguauccuaauugucaaugguguacauugcauaacauuuaaaauaauuaaucucauucacccuuuacaaggcauuuuuauuuuuauuuuauuuuguuggauauuguuuaauguuuaccuuuuucauuaaugcacuacaaagcuguaguuagaauccaaggucuacaaaagacuuuacacuuuuacuuacagugcagacuaugauacugcacauauuuuguacuauauucauuuuuuucuucccaucuguuuguuuugaaaauuuucagauguacaggaaaguugcaagagcaguacauugaauauuuauaaacccguccuucacuuagcugcaccauuuugccuuauuuuugugugcucgcuuucgcucugguguuuucucucucccauuuauguauuuauuuucacuggaccuuucaagaguuaguuguagacuacuaauaauucaccacuucuuucagcaguuaucugccaagaacaaggacauucuccuacaucaucacaguacaaauaacacauuuagaaaauuuaacaaugauacaauacucugauacacaguccauauuucaguuuuuccauuuaucccaauaacauguguuauaguuguuuauauuuuuucuauccaaucaagaaucaccaauuguauucuguugucauaucucuuuggucucuuuuaauauggugucccugccuuuugugucuuucaugacaaugauauuuucauuuuuauuuggcuguccucuguaggccaaaugacauuuuuaaagaauccagcccaguguuuugcagaauaucgcucaauuuggauuugucugauuuucgccucaugauuagcuucagcuuaaauguuuuuaccaggaauaugugagaggcaacguugugucucugucaguguggcccuuccagagugccugaugucaguucguugcaguuuugcugaaguuagauuugaucauuugguuuauuuaucuaccuucuuuuucucuuagacucuuuuuuuuuuuggacagggucucucugugucacccuggcuggagugcaguggugcaaucuuggcucacugcaaccucugccucccggguucaagugauucuccuaccucagccucccaaguagcugagauuacaggugugcaccaccacgcccagcuaacuuguauuuuuugguagagacgggguuucaacauguuggccaggcuggucucaaacuccugacgucaagcgauccacccgccucagccucccaaaguguuggaauuacagacgcgagccacugugccuggccuuccucuuagacucuucauaccccacuaccuagaggcaucacuuucaguaauuuacucucucuauauauauuauauauaaauauauaaauguguauuucucccuuuuuaaaagacuaauguuagcacugcauguguauaccuauauagaaauauguacauaugcugccugggcgcaguggcucacaccuguaaugccaacacuuugggaggccgaggcgggcagaucacgaguucaggagaucaauaccaucccagcuaacacggugaaaccccggcucuacuaaaaauacaaaaaauuagccaggcgugguggugggcaccuguagucccagcuacucgggaggcugaggcaggagaauggcguggaccugggaggcagagcuugcagugagcugagaucgggccacuguacugcagccugggcaacaaagcaagagacuccgucucaaaaaaaaagaaaauaaauauguauauaugcguauauauauauaaaauuuacauuugugggccgggugcaguggcucacgccuguaaucccagcacuuugagaggcugagguggguggaucacuugaggucaggaguucgagaccagccuggucaacauggugaaaccccgucucuacuaaaaauacaaaaauuagucaggcgugguggcaggugccuguaaucccagcuacuugggaggcugaggcaggggaaucgcuugaaccugggaggggggcguugcagugagcugagaucgcacuacugcacuccagccugggcaacagagcaaaaaaaaaaaaaaaaguauauguguguauacauauaaaauuuacauuuauggggcgggugcaguggcucacgccuguaaucccagcacuucgggacgccgagguuggcugaucacuugaggucaggaguucgagaccagccuggccaauguggugaaaccccaucucaaccaaaaaauacaagaaaaaaaaaaucaaaacaaaacaaaauacacaaaaaauguacauuuaugauuuacuucuuguaaacuuuuguuuuuaaaguauauuuaguauuguuugguauguucuuuuagauggucauuuugguaguuuucgguuacuugguuuaguggugacaucuuuauucucccuuucuuccuucuaccuuaaaauguacucuaagaauuauuguaaccuuuuaucccccugguuuacauccugaucauuaaauaaaugauuuaaaaauaguuaacaauggagagaauauuccagaacuggaaaucacagagacagaguuauagaaguagaaugaucaggaaaagugaguaauggugaaauuggauccauagcuuggggucagaguggggcugggaaugcuagauuauuacaggggucugucaggauuuucuagguauauuuuuguacuuguuuucuaggugaugcccuguguuuagggguguguuauucuguggaguauuccuguccuucuuuuuauuuggcaucguuugcaacaguagagagcaaagagugacacagugcaguugauaagagcgugggcuuuggaaccgggugggcauggcagcuucaggcauguuacuuuuucuuauacugcuuuucuucauuguuccgguuaucuauugcugcguaacagaucacuucaauuuuguggcuuaaaggaacaacaguccuucuugugguucuucagguugccuggauucaacuaggcaggucuuacuggaagucucucaugcacucagaugguggcuggagcugaagucaucuuaaaaguuuguuuuuuauuuugagauggagucucacucuguuggccaggcuggaaugaguacaguggcacaaucuuggcucacugcaaccucugccuccuggguucaagcgauucuccugucucagccuccugaguagcugggauuuuaggcgcaccaccacaccuggcuaauuuuuauauuuugaguagagacgggguuucaccauguuguucaggcuggucaagaacuccugaccucaggugauccaccugccuuggccuuccaaaaugcugagauuacaggugugagccagugugcccagcccacauucaucuuuaaacagggaugauaauaccaaucacauagcauuguuucaaagauuaagugaaaucaucuauauaaagcucauagcacagugucugauacaugauaaauugugaaugaauuauuauuugcuauuucagcagauggaaggcagggauauaaaaagggaaagaaugaaaacaucagucagauccugacuuggaaaaguuuccccuuaucuagucuaguuaaaguaccacucuuuuuuccugucugaacuuucuuuuuuguuugagauagagucuguugcccaggcuggagugcugugguguagccacagcucacgacagccuccaucuccugggcucaggcaauccucccaccucagccuccugaguaguuaggaccacaggcaugugccuccucgcccagcuaauuuuuuuuuuuuuuugguggagaugggguuuugcuguguugcccagcccaggcuuuuuuuuuuuuuuuuuuuuuuugagauagaguuuugcccuguugccuaggcuggaguccaauggcgcgaucucggcucacugcaaccuccaccucccggguucaagugauucuucugccucagcuucccaaauagcugggauuacaggugccugccaacauaccuggcuaaguuuuguauuuuuaguagagaucggguuucaccaugcuggccaggcuggucucgaacuccugaccucaggcaaucugcccgccuuggccucccaaagugcugggauuauaugcaugagccacugugcccggcuccccggcuuaaguuuuuaauuguuuacuagagaugggggucucccuauauugcccaggccggucuugaacuccuggauuauaggcaugagccacugugccugguccugucucaacuuuuuaaugaauuauucaaaacauaccuauaaaaagagaaaaguggccaggcaugguggcucaugucuguaaacccagcacuucgagaggcugaggcaagagauugcuuaaauccaggagucugagaccagccugggcaacaugacgagacucugucucuacuaaauuuaaaaauuggccaagcauggcagugcaugccuguggucucagguacucgggaggcugagggaggagcauugcuugaacccaggaguuugaggcuguagugagcugggaucacaccacugcucuccagccuggaugucaaaggaagacccuguuucaaaaaaauaaaacaaaaacccagagaaguuacacucugaagacgguaacaguuugcuauuguaucagagagaauuuuucuuuuuuuuuuuguagguagucucacucuguugcccaggcuggagugcagugguaugaucuuggcucgcugcaaccucugccuccaggguucaagcaauucucaugcaucagccucccgaguagcugggauuuauaggugcaaaccaccacaccugguuaauuuuuguaguuuuaguaaagaugggguuucaccauguuggccagguuggucucgaacuccugaccucaggugaucugcccgccucggccucccaaagugcugggauuacaggcgugagccacugcguccggcccagagagaauuuuuaaaaguaucuguuguaauuacaaugagguuuaaacugucuuuuuuuuuuuccgccauggaaagagucaaguaauuugucuuucuuaaaugcugguguguccgcaguugguggguucuuggucucacugacuucaagaacuaaaccucagacccucacggugaguguuacaguucuuaaaagcagugugucuggaguuuguuccuucugaaguucagauguguugagaguuucuuccuucugguggguucguggucucacuggcuucaggagugaagcugcagaccuucgcggugaguguuaucgcucugaaggcggcgcaucuggacuuguucauuccuccugguggguucguggucuugcuggccucaggagagaagcuacagaccuuugcagugaguguugcagcucauaaaagcagccuggacccaaagagugaguagcagcaagauuuauuuuaaagggugaaagaacaaagcuuccacauuguggaaggggacuggagcauguugccacugcuggcuugggcagccugcuuuuauucucuuaucuggcaccacccacauccugcugauugguccauuuuacagagagccaauuggucuguuuuacagagagcugauugguccguuuugacagggugcugauuggugcguuuacaaucccugagcuagacacaaaaguucuccaaguccccgugagaucagcuagacacagagcacugauuggugcauuugcaaaccuugagcuagauacagggugcugauugguguguuuacaaacuuugagcuagauacagagugcugauugguguauuuacaaaccgugagcuagauacagggugcugauugguguguuuacaaacuuugagcuagacacagaguacugauugguguauuuacaaucccuuagcuagacauaaagguucugcaaguccccaccagauuagcuagauacagagugcugauuggugcauuuacaaaccuugagcuagacacagagugcugauugguguauuuacaaucccuuaguuagacauaaagguucucuaaguccccacuagacucaggagcccagcuggcuucaccuaguggaucccacaccagggcugcagguggagcugcccgccagucccacaccaugugccugcaccccucagcccuugggcaguugaugggacugggcacccuggagcagggggcggugcuccucggggaggcuugggcugcgcaggagcccacagcggggguugggaggcucaggcauggcgggaugcaggucugaagcccugccucguggguagcagcugaggcccagaaagaauuugagcacaggcagggccggugggccggcacugcaggguauccggugcacccucagcagcugcuggcccgggugcuaaacccgucacugcccggggccagcagcaccagcuggccgcaccuagugcggggcccgcugagcccacacccacccagaacucaugcuggcccgcaagcaccacgugcagccccgguucccgccugcaccucucccuccacaccucgcggugccucuuccuccacaccuccccgcaagcugagggagccggcucuggccccggccagcccagggaggggcucccacagugcagcggcgagcugaagggcuccucaagcguggccagagugggcaccgaggccgaggaggugccgagagccagcgagggcuucaagggcugccagcacgcuaucaccucucacuaguauuuucauggaaucaaaaaagguaccucaaauaauccuuuucaucuccuucugugagcaucaauuuuuguuuuuauuuuauuuguuuauuuauuuguuauuguuauuauuauuuuugagacggagucuugcaguguggaccaggcuggagugcagugacguaaucuuggcucacugugagcuccgccuccuggguucaugccauucuccugccucagccuccagaguagcugggacuacaggcgcccgccaccacacccugcuaauuuuuuuauacuuuuaguagagaugggguuucaccguguuagccaggauggucuugaucuccugaccucgugaucugcccaccuuggccucccaaagugcugguauuacaggcgugagucaccgugcccagccuauuuauuauuauuuuuugagacagagucucgcuguguugcccaggcuggagugcaguggugugauuucagcucacugcaaccucugccuccuggguucaagguauucucccaccucagccucccaaguagaugggacuacaagugucugccaccacgccuggguaauuuuuguauuuuuaguagagacaggguuucaccauauuggccaggcuugucucgaucuccugaccuugugauccaccugccucagccucccaaagugcugggauuacaggugugagccauuuuauuuuacuuauuuauuauuauuauuuuuuuagagaugagggucucaccauguugccuagacuggucucaaaauccugggaucuggugguccuccugucucggccucccaauauguuggaauuacagcugugccuggccacuuucuguuuuuauaaguagaugcauuaucuagcaacuguuucucuugaaauaaaaacaaaaugagguaaacuuaauacuggcuuugugauaaauccaaaccauagaagguuuugaguuagccucaggaccuuccccuauuugccacaguaaauccugguuaacauugucuuagauggacauucauacauuuucuaugcauauuuuuguguauauacacacaaguuuuauauauugguguguguguauauacauauaaauauaugguuguuccuuacccaaaaucaaaugggauuacauuaaauauguuguauuguagcuuguaggaugaugcaucuaugaagaugcuugaacauaguuuuuuuuuuguaauagaucuugcuauuuuuuuuuuuuuuuuuugagacguacucucagucuguugcccaggcuggagugcaguggcgugauuuuggcucacuguacucuccaccuucuggguucaagcgauucuccugccucagccuuccagguagcugagauuacaggcaggcaccaccacgccuggcuaauuuuuguauuuuuaguagagacucgguuucaccauauuggccaggcuggucuugaacuccugaccucaggugaucgacccgucuuggucucccaaagugcugggauuacaggcaugagccacuaugccuagccagguguugcuauguugaccaggcuggucaugaacuccugaucugaagugauccucccaucuugcacucccaaaguguuaggauuacagaugugagccaucacgcccaguccagaacauagaucuuugaauaauucuucaaguuuauuaacaguggacuuacuggguuaauagguguaauuucaauuuuaaaauuuuaagaauuuuugaauaguuuuguguucuuuucuguuuucacaauguuuaguaauucaggucauaauuuuccucacuauaucaaauaauuaauuguguacagcuccucuucacugaagcuuccugaccuuguuuuaguaauuugguuugaacuguuuaaucucucgaagagaauggaaauuaguaagaagcugaaaucuucuuccucgcauacucuaguuguagucagcaauuaaccucccccaauucuuuuccucccucuacuggugaagccccauagcucugaugccugucacccacccugauuaagaacuuuauaaacagcacaugaauaaaaauguuuggacuugaacgugacaaguuuugcauuucacaaaaagugaauuugaccuucauuuucacuuguuaaauaaggcuuaaauuccacuucaacaaacaagccuugguuuaauaaaugugcauagaaucuuaauacagagguauucauuuaucucccuuguucucccuuuuucauccagcucuguuauuuuaaccccuuuguccuugagucuguuuuucuuuuuguuuuggugcuuguuuacucuauucccaauaauguggggcaugacguucauuuacaguaucauagcucuguucccuucagagcuuuguaucaugcuuugucugcauuucaguguuucuuguuuaauuuugaaggccuaugaaaauacgccagaucuuguuggagagaacaggaacuuuucccaggaauuuuuucauagaggugguuucuuuuuuaaucccugccucuuauccuuguuuuauaccccauacuuucugccuacuagaagagccaugagggaaacaagugaccccuuuaucuaccaacagacaccuccagugcggcaaguuccauuuauugcugguugugaugguuucgagccagccugggacauuggcacacacugaauuugugugcugaaaccacuuuacaguucacaguugaccuauuuuuuuuaaagcaagucugcuuaauuuaucugugaugaaacacaaauuggaauugauuguguaaauucccucuucucuuaaaucugaauuccuuaguccacagcuugacuuugagugauugaccuccaaucccuccuuugauuuucuuuuuuuuuucuuuuugagacaaggucucucgcugucugucacucaggcuggaguacaguggcaccaucauggcucacugcagccuugacuucccgggcucagaggauucuccuaucucagccucccaaguggccggggcuacaggcacgcaucacgaugccuggcuaauuuuuuuuuuuuuuuuuuuugagacggagucucgcucuaucacccuggcuggagugcaguggcgcuaucucggcucacugccagcuccgccucccggguucaugccauuuuccugccucagccucccgaguagcugggacuacacgugcccaccaccacgccuggcuaauuuuuuguauuuuuaguagagacgggguuucaccauguuagccaggaugguguugaucuccugaccucgugauccgcccgccuuggccucccaaagugcugggauuacaggcaugagccaccgcacccggccucaccuggcuaauuuuuuuguauuuuugguagagacaagauuucaccauguuacccaggcuggucucaaacuccugggaucaggugauccgccugccuaagccucccagagugcugggauuacaggcaugagccaccacaccuggccccuucccgugaucuuuaugacugucuuccuuuaaaaggauauuguaguuuuaagacaguucauuuuaaguucauguuuuucguggcacuuagccaacacuuucacugauuucuuaaaauucuugaaauguucaccuuuacacacauuuaaaguaauguguauucauugcgaacauugaguaauguagauaauuauaaugaagaaaauuuaaaucaccuucagucccacucagauacauuaaaaaaauuacauauuuauauucagucuuuuucuuuuuuuucuuuucuuuucuuuuuuuuuuuuuuuuuuuuuuuuugugauggaguuucgcucuuguugcccaggcuggagugcaauggugcuaugaucuuggcucaccgcaaccuccgccuccuggguucaagugauucuccugccucagccucccgaguagcugggauuacaggcaugcaccaccacaccuggcuaauuuuguauuuuuaguagagacaggguuucuccauguuggucaugcuggucucgaacuccugaccucaggugauccgccugccucagccucccaaagugcugggauuacaggcgugagccaccgcacccagcuguauucagucuuucucugugcauguguuguguguaugaucauuaucauccuuuuuuucacuuaacaugaaauuauggcugaacauuuucccaugucaugaaauauuauuugaaagcaucguuaucaaugguuacauaauauuucagucuguggcuauuucauaguuuguuagaacauuuccuugauacuggauauuuaaguuucuggcauucuuacuuuugugacacugugaauaccaucuuuguuuaugaaguuuuuuguuuguucauuuguuuuuuguuuuugagauggaaucuagcucugucacccaggcuggagugcaguggcacaaucuccgcucacugcaaccuccgccucccagguucaagcgauucuuaugccucagccuugcuagcagcugggauugcaggugugcgccacccuccuggcgaauuuuuguauuuuuaguagagaugggguuucauuauguuggccaggcugguuuggaacccuugaccucaggugaucugcccaccucagccucacaaagugcugggauuacaggcaugagcuaccacacccagccucaauguggcuguuaauguacagauucacucauauacaaauugaaugguuuuaauacuaaaauaauauuuaauuccccaagcuuuuuuuuuuuccuguugguuuuuguuucucuaaguguaauggcacaagagagaacagauuguggacuuucuauuuaagagguuuauggcuuuaugaggagaaggugcauaguggagcaugagcaguucuguaacaggaggacaaggugcacacagaaggaagaaagacaucugcuugaaagcuucccaggccgguccuggaagauuggaauccagagcaccauguauuugguauuacacacuauguacuccauaauuaguuguuuuuuuguuuuguuuuguuuuguuuuguuuuuugagauggagucuugcucuguugcccaggcuagagugcaguggugcuaucucggcucacugcaagcuccaccuccuggguucacgccauucuccugccucagccuccugaguagcugggacuacagcugucugccaccaugcccggcuaauuuuucacauuuuuaguagagaugggguuucaccguguuagccaggauggucucgaucuccugaccuugugauccacccgccucagccucccaaagugcuaggauuacaggcaugagccaccgcacccggccuauguacuccauaauuugaccauugauauuuucuaaacaaaaauguuccauuuccucccucccucuuuuauaaggaaaggaccuaaaauuagggguauagggacauacuguaaauucucaagacuagggauuacgucuuaaugauauuugugucuacagugcauggcacagugugugguauauagcuggugcuaagaagucuuuauuauuauuauuguuaguuuuuuuuuuuuugagacagaguuuugcucuguugcccaggcuucaguacaguggcgugaucucggcucacugcaaccuccgccucccagguucagacaguucuucugucucagccucccaaguagcugggauuacaggcacaggccaccaugccuggaaaauuuuuuguauuuuuaguagagaugggguuucaccauguuggccaggcuggucucaaacucccgaucugaggugaucugcccaccuuggccucccaaagugcugggauuacaggugugagccaccgcacuuggcugcaagcagaccuuucuaaggagagaagucccaggccugcugugugagcucuucugcacaaugaagacacugaucuucuuguagagaaauuucugggcuuuccaguuuaauucauuuaagagaagggguaaauuuuggugguguuuuagcaagcaacagcuaucccuugacuaguaugaacagggccugguaggucaguaugagggucugcuugagggcagaagauguuuaggcuguugaauuuucccacaaaguuucaaguuuggaggcuccucaagaaacuugucaaaauuacuuaaugagguuuuaaacuguacaaauuaguggucagggccagggccuguauuuugguccauuucuuuugcagaagcuucuuggagaugcaccaaagaaucuuuauugccugguuuuaggauuuaauggaauuuaauuagguuuccaguuguagagaggcucugggacuuaguuaagcuauaguugucaagcaaguuauggcuuccgguuuuuugucagaagggauaugguaccgugcucuguccugaagccucagcggggcucacuccugccuuacauuagccaguuucucccagaaggcaagugagaacaauaaagcuagcagaauaguucugaaacccugccuugcugggagcuagauuaguuccucuuuuauucagggaaaacuuggauaaaagggauucuaauagcauaguuugaagaucuucgguuuggggaucuagagcggugcugggggauguuaacugguguucucugguuguaucucacaccccucucauauaccccaccuccauuuggagacucaucucauaugcagggaaaggcauugaggaauucugcaaacacauuuugccguauuuaacucuguauuuccuaaauuuauuugcuuauggaacccucuuuuguggaauacccauuaggguucagggauccucguguuuuguaguacucaguuuggaaaaugcuagucuggagauucagcauccucagguuguuuuuccuggaagugguaauggagagcagcccuuccuggugcaguaggccaccuuucuuuugcucauaacacagaccaguugugacacuuggcucugucucaggcugugacuuuuaauauaccgauuuacuuauacacaaauugaaugguuaauguuccauuccccaagccuuuuuuguucauuuuuacuauuuuuuuuguuuguuuguuucucucuuuuuuuuuugagacugaguuuugcucuuguugcccaggcuggagugcaguggcgugaucucggcucaccgcaaccuccuccucuuggguucaagcgauucgccugccucagccuuccugaguagcugggauuagaggcaugcaccaccacacccggcuaauuuuguauuuuuaguagagaugggguuuuuccauguuggucaggcuggucuugaacucccgaccucagaugaucugcccaccucggccuuccaaagugcugggauuauaggcgugagccaccauaccuagucuuuuuuuuuuuuuucucuaaguguaaugcauuuuaucuccugcuucuuguaaguuuccaggaccaaguaauacucaaacccuucccagaggguuuucauuucgaacaaggaagccaccugggaaauaggguggagaccuguuuugagaaaccagaagaggaugucucguucuaaccauggagaaaaagaaucuagucuccuuguuaggaagacuguugaagaaguguucuuuauccuuuaguucuuauuaagagaauuguuuuaguuucaauuguaaggaccaguaaaucuccuuacaccucacaguauggagacauauuauuauaacuguugacaaagaaggagcuugagggcugggugcaguggcucacgccuauaaucccagcacuuugggagggugaggcgggugggaagcugaggcggguggauuaccugagguuaggaguucgagaccagccuggccaacauggugaaaccccaucucuacuaaaaauacaaaaauuagcuugguaugguggcacacaccuguaaucccagcuacuugggaggcugaggcacgagaaucucuugaacuuggaagauggagguuguagugagccgagaucacuugggcaacacagugagacucugucucaaaauaaaauaaaauaaaauaaaaauaaaaaacaggagcuuaaaaauaggaaaacccgagagcaggagggaauuggcccucuuaggaacuagaauaguauugaaagcagauuguuuugcaccuuagcaguagggauuuguagacgugcauauucugccauuaaugagauuucucagucuguguuucuuugugauuuucccuguauauacuuuuacuguguaucauuucuguuccuuauacucucugcuuauuccuaacucuguuuuuuuuuucugauuuuauuuuggaguauaacauaauacagaaaacugcacaaauuggccaagcgcaguggcucgugccuguaaucccagcacuuugggaggccaagacgggcggaucacuugugcugaggaguuugagaccagccugggcaacauggugaaauccugucucuacaaaaaauacaaaacaauuagcugggcaugguggcgggugccuguagucccagcuacucagaaggcugaggugggaugaucgcuugagccuaggagguggagguugcagugagccgagguugcaccacugcucuccagccugggcaacggagugagacccugucucaaaacaaaacaaaacaaaacaaagcugcacuuacauuuaaguauacaaguuggugaagugaacaugccaaugaaaccugcuuccagaucaagaagcagaguguuacugguaucauggguguccccuucagcccauucuggucacuucaccccacaaggguaaccacuuucugauuuccaacaccacagaguugucuguuuuaauggaguuauugaaauauacauacuauaacguucacucauuuaaaguauacugcucagugauuuuaaguauauuuucugaguuguguaacuauaacuauaaucuaauguuaaaauauuuucaucauccccaaaagaaaccuguaccccaaaagaaauaaggagugguuacuccuuuaucccacauuccaccagcccuaggcaauuacaaaucuauuuccugccucuauagauuugcuuauucuggacauuucauauaagugggaucacauaauauguggcauuuugugccugauuucuuucacuuagcauaauguccucaaggcucauccaugcuguagcauguaucaguacuucauuccuuuucauggcugaguaauauuccauuguauggauagaccacauuuuguuuauccguucaucuccugauggacauuuggaugcuuuccaccuuucagauauuaugaauaaugcuacugugaacauucacuuacagguuuuuguuuggacauacguuuuuguuucucuuaggcauauauguaggaguggaauugcugggucauaugguaacucuguuuaacaucucaggccgggugcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguaaucccagcuacucgggaggcugaggcaggagaauggcgugaacccgggaagcggagagcuugcagugagccgagauugcgccacugcaguccgcaguccggccugggcgacagagcaagacuccgucucaaaaaaaaaaaaaaaaaaaaaaaucucaaagaacuggcuaaacuguuuuucauagugucugcaccauuuuccauuccugccagcaauguaugagggucccaauuucuccacauccucaccaacacuuguuauuaucuauguuuuugauucuagugagugugaagugguaucucaucauaguuuuaacuugcuuuucccuaaugacugaugauguugagcaucauuucauagcuuauuggucauuuuuaugucuucuuuggagaaauaucugucaaaucuuuugaucaccuuuuaguuggauugucuuuguauugaguuauaagacuuauuuauauauucuagauauaaguuucuuaucagauauauagcgcugccaugcucagcuaauuuuuauauuuuuaguacgaugggguuucaucaucuuggucaggcuggccuggucuugaacuccugaccucgugaucugcccgucucggccucccaaagugcugggauuacaggcaugugccacugugccuggccaaguuuuguauuuguaguagagauggaguuucgccauguuggccaggcuggucucgaacuccugaccucagguaaucugccugcuucggcuucccaaagugcugggaugacaggcgugagccaccacgcccacugaacccucauaaauccaucaccgaauuucagcagugaucagcauuuuaccauuuuccccaccaccaucuuuucugggggaggaguauuuaguuuuuguuauuuugaaauaaaacagugaaaaucaugcucuuauuucaaaaaacaacauuguggaaaauaucuaacuuagaaaaugagacaccuguaaccucagacagagccaguauuaauucuguguguguguauaguuuuuaaggacauuauuauuauuauuauuauuauuauuauuauuauuuuugagacggagucucacuuuguugcccaggcuggaguggaguggcgcaaucucagcuuacugcaaccuccacuucccugguugaagugauucuccugcgucagccucucaaauaguugggacuacaggcaccugccacccauuauuuuaaauauuuacaguauauuccguuauacagguaaaccauauuaauccaguuuccuaugggggccauuuggguuaucagcuuuacuguauugauuaauggugcaaucauuaaucuuccugucauauguacuugagcaaguuauuuuuuuuucuuuuagacagggucucccucugucgcccaggcuagcguauaguagugcgaucccuacucacugcagccucaaacuccugggcucaagugguucucccacuucagccuccugaguagcugggaugacaggcgugugccauugagucuggcuaauuauuuuuuguagagacggggucuauguugcccaacuuggccuugaacuccugggcucaagugauccucaccuuggccucccaaagugcugggauuacaggcgugagccacugcgcccggccggaggaugcacaucuuuuuuuuuuuuuuuuuuuuuuuuuuugagacggagucucgcucugucgcccaggcuggagugcaguggcgcgaucucggcucacugcaggcuccgccuccuggguucacgccauucuccugccucagccucccgaguagcugggacuacaggcacccgccaccacgcccggcuaauuuuuuguauuuuuaguagagacgggguuucaccguguuagccaggauggucucgaucuucugaccucgugauccgcccgccucggccucccaaagugcugggauuacaggcgugagccaccgcgcccggcccggaugcacaucuuaaagauuuaauagcugcugccaaauugcccuccaaagagacuaugccaguuuauaauuucagcaguagugaaugggaauguacagggguauuguauuuuauuuuauuuuuugagacagaguuuugcucuugucccccaagcuggagugcaguggugcgaucuuggcucacugcaaccucugccuuccggguuugagcaauucuucuaccucagccucccaaguagcugggauuacaggugcgcaccaucacauccagcuaauuuuuguauuuuuaguagagacgugguuucaccauguuguccagacuggucucgaacuccuggccucaagugauccaccgaccugggucucccaaagugcugggauuacaggugugagccggccagggauauuuuaaaguaaauuccaauuauuguaucauuuucaccuggaaauacuucuguauuucuugcuaacagauaaggacauuuuuuguguuuugacauaaccguuaucacuucugaaaaaugaguaccuuuuuaccgaugguuuguucaaaucagaauucagacaaggcauuugaaaugugcauguggaaaggaauacugaagaggaugcccaccuucagcgcugcaguuuugaaaaccugugaauugggugcaguggcucaugcuagccacuugggaggcugagguagaaguuuaggcuugagcccaggaguuugaggccagccugggcaacauagcaagaccccaucugcuuugugcaggugcagguuuggggccugaagugaaggccucuuuuacucuaggcuuguuucugccacaaucuaagugauguuuaaagauuucuggucuguuugcuucuggucaguuccacacccaagguucucuucuagaucuaguucucaagccugcauuuucuuuuuuuuuuuuuuuuuugagaugacaucucacucuguagcccaggcuggagugcaguagugugaucuuggcucacugcaacuuccaccuccuggguucgagggauucuccugccccacccucccaaguggccgggacuacaggugcaugccaccacgccuggcuaauuuuuuguauuuuuaguagagacaggguuuuggcauguuggccaggcuggucuggaacuccugaccucaggugggugaucugccugccucggccuccuaaagugcagggauuacaggcgugagccaccgcgccuggccccaagccugccuuauuucuuuguggccucgcucauaugccucugggucucaauuuguaggagcuuccuugaagcuuucugaaacaaaugcccagagauuguaacagccuuccugugaucucugccgcaaagaugagccauuuguucaauggagaaggcucacagaccguucucugccaauguuguugcagucuuacucuccuauuauuugggcuguagaaacuuuuacaacuggugagacuuuugcucucuagauuuuacuuauuccuuccauuucugcuugaaaagugguauagccauucuugccuguacuuaucuuugucuugaaauagcuuguuaaggcagucaguaguaauuagcguacuccaucauucugacucuucccaccacuuuccuuaggccagcaggcucagcggacacuggguccaugaaaggcagcagugagugcaggcauuccuuuaagugggcgauauuucaucaugauaugccaggcucucuagcauuuugccaccugaccaauaagccaaacuaacauauuuuagacuuuuguucacagcagcaccccacaucaaggugcucauuuguugucagucaggguuuggucaggaaaauggaaacuacccuagguaucaagcaggaaggcauuuaacauagugaucuagaggcuuccaaaaccauuaucagggcuggggugaugugguggcagcacacccagggaaaguugcuguuagcuuucagaaaauuaggaagugcaagaauuguaggaaacuguugcggaucagcugggcccucuauaggaccagggaaggucaauuucaggaggguccuuagaggcugcugcugcaauaugacaucagcccagagccuaagcucaugcccaugcccaccccugcuggaagaaucccacgucugcugcuccucuaucuucugaaucuuguaggguagcugagccucuccucacuggccaggauccagguaaggugguuccugcuauacaagggagggcacagacuggaaggaaaugaugcuuuguuccagcuuccccuaaaguugaggggaccacuaaaucuuacaaagauaggagaaacaauucucaguauauugcuguuuaaauuaucuuauagauuaaaaguuugcugucuggaagugaauacaaguguaugcauaaauaacauuuuauuuuuguaaucauuuuuauuuauagacuauaaagcaauuggcaaaauaggagagggaacguuuucugaaguuaugaagaugcaaagccugagagauggaaacuacuaugcauguaaacaaaugaagcagcgcuuugaaagguaggcuacagagaugcacuugggaccaaacacagauccaaguuucagucaauaacggcaacuuaauauuaggggggagcuuuauuaauuuaauaauauguaagauacaaucagauuucuuugggcagugaggguuauaugcuaauguuauguuuaucauacuggaguuuacucauauccaggcuuacuguaauaucagugaugaaugaccacaaaaaaguuuaaguuucaaaagugugucucaccuuaaacagucuguauguuccuaaaaguuauaaauguguuggauuucuuuuuuuuuuaauuaaaaaaaacagcaaaaaaaugauauaucaaccaauggaacaggauagagagcucggaagugaacccuuuaugauccauuugauuuuaugauccauugauuuuuuuuuuuuuuuuuuuggagacagagucucacucugucucccaggcuggagugcaguggcacaaucuugacucauugcaaccuccgccaccccaguucaagcgauucucgugacuuagccuccuaguagcugcaacugcaggcaugugccaccaagcccggcuaauuauuauuuuuuuuaaguauagaucagguuucaccacguuggccaggcuggucuugaacuccuuggccucaagugauccgcccgccuuggccuuccaaagugcugggauuacaggugugagccacugugccuagcccauugauuuuguuuguuuuuguguuuuguuuuguuugagacagggucucacucugucauccaggcuggagugcaauggcucgaucuuggcucacugcagccuccaccucccaggcuuaagugaucuucccaccucagucuccugaguagcugggaccacaggagcacaccacacgccuggcuaauuuuuguauuuuuuauagagacggggcuucaccacguugcccgugcuggucuugaacuccugaccucaagguaucugccugccuuagccucacaaagggcugggauuacaggcaugagccacugugccuggcuguguguuggacuucuauaaaugcaaccuuagucuaaauguauuagagguccuugcaauuuaacuaacugugaauaaauuaauauauuaauauuauauuaauauaacauaagugacaggcaugagccaccaugcccaaccugagccaucacgcucagccugagccacuacacccagccuucauuuuuuaauuaauuaguuaacuuuuaaaauggagaugggauuucacuguguugcccaagcugaccaugaacucccgggcucaagugauccuucugccucagccucccaaagugcuggaauuauaggugugagccaccacaccuggccaagaacaguaauuucauccucaugacaucuggauaggguaguuauccuuguuucauauaugaggauaggugcuuagagaugugagguaauuugacauuuuuucuagauuacugggugggcagagccagaugugaacccagauucugcuaaggcaaauccuuguucuucacugcccaaugcauacgguaguuuaccuaccacuaggaagacugaagccaccagguguucugcuccuucucuucuagcacuucuuccucucuaugcauucugcauucucuguguuucuuuaucuuuccccgacuccaucuuuacuuguaaaccacugaugagagaggauuugaugcacaguauacugauuaucccguaucuaaagagcagacagcugggugcuguggcucacaccugaaauuccagcuacuugggaggcugaggcaggaggauugcuagagcacaggaguucaagaucagccugggcaacauagcaagaccccaucucuacaaaaauuaaaaaaaaaacacaaaaaaacagacuuccuuaaacagccaccuuugacccaaaguugccaguacaggauuuugaacaguagggugugaugcuuuuuuuuuucuuuuuuuuuuuuuuuuuugagucagggucucauucuguugcccaggcuagagugcaguggugugaucucagcucacuacaaccucugcuuccagggcucaagcgauuauccagccucagccucaugaguaacagggacuacaggugcaagccaccaaaugccuagauaauuuuuguaauuuuuuuuuuuuuuugagacagagucucgcauugucaccuaggcuggagagcaguggcgugaucuuggcucacugcaaccucugccucccagguucaagcaauucuccugccucagccucccgaguaucugggacuacaggcgugcgucacagcacucggcuaauuuuuguauuuuuaguagagaugggguuucaccauguuggccaggcuggucucagacuccugaccucaagugaucugcccaccuuggccucccaaagugcagggauuacaggugugagccaccaugcccagccuaauuuuuguauuuuuguagagacagggucucgccauauugcggcuggucucgaacuccugagcucaaagcgauccacuugccuuggccucccaaagugcuaggauuacaguccuggguccagccucuaucagauaaguuuagaauguucuaaggagcaguucucuagcgggugaagaacgcucaguuuauugaaguucuuucucaugccuccucagccccugggaagauugugugguuacguaacggacaugguuucccggugaugaagcacauccugggucugccaucugccagauuccucacacaccaaaagugccugguccaccagaaucuuggcuuccuugucauagugcuugacgacuaagcaaaggaaugaacagaaagcuaacaaggugggacacauggcaaaugugcaguggaugcuggccuuccuuacuguaugcagaaucauucguuguauuucagaaacaauuuauguucuuugccuuuaacuucaaaagcaguugauuagaacacaucccacagguuggcccagcaugguggcucaugccuuguaaucccagcacguuggaaggccuaggugggagaauugcuugagcccaggaguuugagaccagcccaggcaacaaagagaaacucugccuccaugaaaaaauuuuaaaaaucagccgggcgcgguagugugugccuguggucccaucuacuugggaggcugaagugggaggaucucuugaauccaggaaggugaugcugcaaugaguugugcuugugccacugaacuccagccugggugacagagugagacccugucucacucugccuucuuugacaaggaagccgaaauuccgcuggaccaggcacuuuugguaugcgagggauuuggcagaaagcagauccaggauguaccucaccaccaggaaaccauguccguuagguaaccgcacacacgcaaaaauccguuucugcuugcuuaucauuguguaagugaauccccagagucaccuugcacaguuguguggguggugugaggaaugugaagcauuaguagcagaaagucauacugagucacuugggcagcaugagguugguauuuggagccucugaccccuacccccuccaguauuacuucugcuccuuuccuaugcuuuaauucaaauagaaacggauggcuuuugcaguaaucuuaguuaauaugaaguuaaagaaagguaaaaaaauacacauaauggauuaguacuguggcagggagggcacuuucacuccugagcauuguuugccuuuugagucacucaaggacuuaguuagggauaaggaaguuaguuacuugccugaggccucaacagaacugagucguuuuguaucuuuucugguauauccucagaauuuuccuccaccaauacuugccaaaaguacacaauuaagaauaggcucucuuugggcacagugggucucacaccuauaaucccagcacuuugggaggccaaggugggcagaucaguugagccuggaaguuaaagaccagccugggcaacauggcaaaacccccgcucuaccaaaaaaagaaauaaaaaaguuagcugggcauagugguggugccuguaguccuagcuacucaggagggugaaguggggggauugcuugaguccuggagguugcgguugagguugcagugagccaugauugugccacugcacuccagccugggugacagagcaagacccugucucaaacaacaacaacaacaacaacaacaacgguucucuugcuaugcuuuuagucuauauuuuuccuauagaaauagaagaaauggagugagucucuuaaaaaaaaucccuagucuugguauuuguaggaucucccuuugugccccgaggcagugacauuggcacaagucugcuaaacccgggguucaguguaggguuaccagcucugacucuaaaggucggaaccagcagcuccuccauuuuaguucaugcaaucuuggacaauucccuaauuucuccgugccucuguuucuuucuuuauacaauggggauaaccacaguaucuaccccauaagauuguugugagggucaaauuaaauaaugcagaugaagcacuuagugcagugcuggcacaccguaauaaagcaacuugcuauguaaaucaguuuuuccauaacagauaauacaaguuagcagagcuugaagacuauuuuggagauggacgugagauaauaauaguaagauuaccgcaguuguucacuacauaucuggugucaugaacaguacuaggugaauuauaugcaugugucauugaauccucacugcggcccugggaggaagauccauuguuacaucuuucagacuagggaauugaaauucggagagaucaaguuccccaccuggcccguugcuacccaaccuacacgucguggagcugacucugagcccaggucuguauagguccugagcuggugaucuucccaccguucuucccagcugcagaugcugaugccaacgucaggucuacaugugguacaugguuuuucucaagucacaccucuaagcaguccucaaauuacuuuuacaaaaacaaaaagucugcuguguaagguuauaaauagaaacaaaggcaaggaauuuauuagucucucuaaaagccuuuuuuuuuuuuuuuacuuaaaaguauaauaugaaaaaccucaagcauauacaaaaugaacagcagcccuagguauccagcagccagaaucaacaucccugcuauuuuuauuuaaucuauaccuccacccaguguccuuccucuacuugggcugcuauaacaaauuauacuguauucugucuggcuuaaacagcagacauuuauuucuuacaguucuggagggugauaaguacaagauuaagaugcuggcagacaggucugguaucuggcgagggcuugcuuuaggauuugcagguggcccucuucuugcuuuguccucaaaugacagauagcagagagagagagagaggucgcauguucucuagagucuuucuggcauuucuucuuagagccacuaaugccaugugcucuaauuaccucucaaaagccccaccuccucauaucaucccauuggggguuuaggguuucaacguaugaauuuuagaggacacaaacaugcaaucuauaacguuauacaguuuuuuaaagucaaaauuuguauaucuugaagugcacauuguuuaucuguacaauuuuggcaaauggauauucucguguaaucaagauguagaacauuacuauaacccuagaaaguucuucuuguuccuuuucaguuucccacugccaucccaggcaaucacuaguaugugcucuuguguccaccuccuuuaacucagcaucaugucuuugagauucaucauuacuguuguucaguaguuuaucucuuuuuuuuuuuuuuugagacggagucuugcucuguugcccagccuggagugcaguggcacaaucucagcucacugcaaccucugccucccagguucaagcaguucuccugccucagccucccaaguagcugggacuacaggccugugccaccacacccagcuaauuguuauauuuuuaguagugacgggguuucacuggacaggcucgucuugaacuccugaccucaggugauccacccgcuucagccucccaaagugcugggauuauaggugugagcaacugcaccuggccaguuuaugccucuuuaaugcugagcaacauucauuacaaucugugaguacaacacaauuucuuuauccauuuuccuguuaauggacuuuuugauaguuuccaguuuugggcuaccaugaauaaagcugcuuaugaaauucgacuucuuaggcugggugugguggcuugcuucuguaaucccagcacuuugggaggcugaggcgugaggauugcuugagcccaggaauuugagaccaggcuggaugacauauagccuggucuguaugucguaugaagaaagacuuuuaguaucuuuuuuuuuccucuacaaaaaaaaaaaaaaaaaaagaccagggcauaguggcucacuccuguaguccuagcuacuugagaggcugugaugggagcguugcugagccuaggaaguugaggcugcaaugagccaugaucacaccacugcacuccagccuaggugacagagcaagacccugucucagaaaaacaacaaaagaaauacagaaauucuacuggugcauauuucauuuuuucuuuuucuuuuuuuuuuuuuuugagacggaguuucgcucuuguugcccaggcuggagggcacuggcaugaucucagcucaccacaaccuccgccuccuggguucaagugauucuccugccucagccuccagaguagcugggauuacaggcaugcaccaucacacccggcuaauuuuuuguauguuuucauuuuuucuuaggcaguuaccuagaaacagaaucacugggucaaaggguagguauauguuuaacuuuauaagaaacugacaagccuuuucucaaagugauuguaacuuuuuauuuuuuuauuuaauuuaauuaauuaauuuauuuauuugagacagagugucgcucuaucacccaggcuggcuaucucggcucaaugcaagcucugacuccuggguucacgccauucucuugccucagccucuugaguagcugggacuacaggcgcccgccaccacgcccggcuaauuuuuuuuuuguauuuuuuaguagagaugggguuucaccauguuagccaggauggucuccaucuccugaccuugugauccgcccacuucagccucccaaaguguugggauuacaggcgugagccaccacgcccggccuguagcuuuuuauauuaccaccggcaaagaaugaaaguuccaguugcuccauauucccaccggcauuugauguuguuauucuuuuaaguuuaagccauucugaugauuguguggaauuaucucaugguaguuuuaguuucuacuuccccgaugacuaaugauaaacacuugaucauguacuuauuggccauucauguaucuucauuuaugaauugccuguccaaguuuuugucccuuuaaaaauuuagaccuuaagaaacaagccauccuaagggagaaaaaaagaaaaaauaauuuuaaaaauuaggcuguuugccuuuuuauugaauuuaggaguucuuuauauauucuguauagaagucuuuuauuaaauguguuuugcagguaguuucuccaagucugugguuugccuauccauuuucuuuauggcaucuuuccaugugcugaaguuuuuuaaugucagugaaguccaauuuauggaguucuuuugugguuauuguuuuuuguuuucugucuuagaagaaauuuuugucuacuucuagguugugaauguauucuccuguauuuucuccuaaaaaccuuaucauuuuaacuuuuuacauuuaggucugugauccaucuuuuuuuuuuuuuuuuuuugagauggagucucgcucugucacccaggcuggacugcaguggcgcuaucucugcucacugcaagcuccgccucccagguucacuccauucuccugccucagccucccgaguagcugggaccgcaggcgcccaccaccacgcccggcuaauuuuuuguauuuuuaauagagacgggguuucaccguguuagccaggauggucucgaucuccugaccucacaguccacccaccucggccucccaaagugcugggauuacaggcgugagccgccgugcccggccaauccaucuuaaauuaauuuuugugaauggugagcgguagggaucaagcaucaguuuuuucccccaaaugaauauccaguuguuccagcaucauuuguuaaaaaaagacuuuccuugccuucaguggauuauuuugucaaaagcuaauugacuguaaaaguauaggucuguuuuggacucucuauucuguuucauugcucucuuugacugucauuaugccaauaccauacuguuuugauuaauguagcucaacaguaaguuuugaagucagauacuaaaagucuuucuucuucuuuuuuuuuuuuuuugagacagagucucuuucugucaugcaggcuggagugcaguggugucaucucggcucacugcaaccucugccuccugguuucaagcaauucuccugccucagccuccugaguagcugggauuacaggcacccaccaccaugccuggcuaauuuuuguaucuuuaguugagacaggguuucaccauguuggccaggcugguuucaaacucuugaccucaggugauccgccugccucguccucccaaagugcugggauuacaggcgugaguuaccgugcccggccucuucaucuuuuuaaagacaguuuugccuacuguagguccucuguacauccacauacauuuuagaaucagcucaauuuuuuuuuucugugaggauucuaggaauauagcucaucaauucuauuaaaaaauaaaaccagccgggcacaguuucucacgccuguaaucccagcacuuuaggaggcugaaagugggcugaucacuugagcccaggaguucaagaccagccugaacaacauggugaaaccccaucucgauugaaaauaacaaaaauuagccaaguguagugucacacaccuguagucgcagcugcuugggaggcugaggugggaggauugcuugagccugggagguggaggcuucagugagccaagaucaugcagcugcacuccaaccugggugacagagugagaaccugucucaaaaaaaaaaaaaaaaaugcagguacgguggcucacaccuguaaucccagcacuuugggaggccgaggcgggcagaucaugaggucaggaggucaagaccauccuggcuaaaaccgugaaaccccaucucuacuaaaaauacagaaaauuagccgggugugguggcaggcgccuauagucccagcuacucaggaggcugaggcaggagaauggagugaacccaggagguggagcuugcagugaguggagauugggccacugcacuccagccugggcgacagagugagacucugucucaaaaaagaaaaacaaaacaaaaaaaaacuauugagauuaugaauaggauuguauugagucuaucguucaauuugggagagaaugcauaucuuagcaauauugaacuuugcaauucauaaacaugguauaaccgucucuccauuuauuucaguuugcuuuaguuucagcuauguuuuguuuuuguuuuugagacggaguuuugcucuuguugcccaggcuggagugcaauggcaugaucucagcucacugcaaccucugccuuccggguucacagguucuagagauucuccugccucagccugccaaguagcugggauuacaggcacgugucaccaugcccagcuaauuuuuguauguuuaguagaagacaggguuuugucauguuggccaggcuggucucgaacuccugacuucaggugauccgcccaccuuggccucgcaaagugcucagauuacaggugugagccaccuugccuggacgguuucagcuguuuuguaguuucacugaaaaggucuuacgugucuuuuguuaaauuuauaucuaaguguuuuauguuuuauaacauuauuauaaaaggauauuuuaaacauuuauuucccauuguuagccauaaguauguagaaaugcaauuaauuuuuguuuacuuuguauuuugagaaauuucucaggauucacuuauuuuuuuuuuuuuuuuguucuaguauguuuugguugcuuucuuaggauuuuuuacuuaaagaaauaugucaccugcaaauagagacaguuuuacucuucuuucccaauguugaugacuuuuuuuuuugagacggaguuuugcucuguugcccaugcuggagugcaguggcgcgaucucagcucacugcaaccuccaccucccggguucaagugauucuccugccucagccucccaaguagcugggacuacaggcacccgccaccacgccuggcgaauuuuuguauuuuaaguagagacaggguuuaaccguauuggccaggcuggucucgaacuccugacuuugugaucugcccaccuuggccucccagagugcugggauuacaggcgugagccacugugcccggcccaugacuuuuuuucuagccuuucccauuaguucagauuuccaguacaauauugaaugcaaguagcggggaaguguucagcauuucaacauuagaagcaugauguuugcuguauaugucuuuuaucaaauugacagaguucccuuucaugaauagcuugcugagaauuuuuguccugaauugguaucgaauucugucaaaugacuuuuugguauuauuauuuuuuccuuuuucuuguauugugguggauaacauucauucauuuuugaauaauaacucaaccuugcauucccaguauagcugggauuccccacuuagucauaacauaugaucaguuuuacauguuccuggauuugauaguauuuugucaaguauuuuuguauuuguacucauaagggauacuuuuuuuuuuuucgugauggagucuugcuguguugcacaggcuggagugugguggcgugaucucggcucacugcaaccuccgccucaagcaauucugcuucaggcucccaaguagcugggauuacaggcgcgugccaccaugccuggcuaauuuuuguauuuuuaguagagaugggguuuugccauguuggccaggcugucuugaacuccugaccucaggcaauucgccagacuuggccucccaaagcacuaggauuacaggcgugagcuaccaugcuuggccuauacuuuucuuauuauauaaaagucuuuguuagggaguuaggcguggcgucucauaccuuuaaucccagcacauugggaggcugaggugggaggauggcuuaagcccaggaguuugaggccagccuggacaagaugagaccuuguuucuacaaauaaaaaacagcugggcaugguggcaggcaccuguggucccagccacuugggaggcugagguaggaggauggcuuaagaucaggaggucaaggcugcaguaagcagugauuacacuacugcacuccagccugggccacagagugagacccugucucaaaaaaagaaaaagaaaaaagucuuuauuagguuuugcggcugggugcaguggcucacaccuguauucccagcacuuugagaggcugagguggguggaucacuugaggccaggaguuugagauuagccuggccaacauggcaaaacucuguuucuaccaaaacuacaaaaauuaggugggcgugguagugcaugccuguaaucccaguuacucaggaggcugaggcacaaguauggcuugaacccuggaggcagaguuugcagugagccgagguugcgcucgugcacuccagccugggcaacagagcgagaaucugucuuaaaaaaaaaaguuuuuguuagguuuugguauaaagguuuucaggucuaacagaacaaguugggaaguguucauuccuccauuuuuugcugaaaaaguuuguguaagaguauuucuuuuuuaaauguuugaaauaauucaccagugaaauugucuggucuaggaguuuuccuuguggggaaggucccucccacaaugauguuuauuauaacaucauucguagugauaaaaagaugggaucacgacgaagugguggaacaaggaaugaccucaaggcacaucuguaucaaggaauauuaaagaaaaaaaccagaacuaugccaaauaauuuggaaggauuuccauaugauuuuuuaaaagcuuuauugaaggaugauuuccuuuuguuucuuuugagauggagucucgcucugucauccaggcuggaaugcaguggugcagucuuggcuagcugcaaccucugccuccugaguucaagcaauucuccugccucagccuccugaguaguggggauugcaggcaccugccaccauuaauuuuuguauuuuuaguagagaugggguuucaucauguuggccaggcuggucucaaacuccugaccucagguuauccacccgucucggccucccaaaguguugggauuauaggcgugagccacugugcccagccugaaguauaauuuuccuuucauaaaauucagcuauuguaagugaguuucaggacauuuauacggcugugcaacugucaccacaauuccguuuuagaacacuuucaucaucuguugggagguuuuugauaacaacuaauaagaauaaaauagggcuauuuuauuaaauagggcuguuucaauuuccaguuuuauuuugugucagauuugguaacuguguuuuuugaggaauuuguuuacccuaaauugucauauuuauuggcauacaguuauuuguaauacucucauuauuauuauuuaauuuuuuuuuuuugagauggagucuugcucuugcccaggcuggagugcaauggcacaaucucgccucacugcaaccucugccucccagguccaacugauucuccugccuuagccuccugaggagcuggaauuacaggcacccugccaccacgcuuggcuaauuuuuguauuuuuaguggagacagaguuucacuguguuggccaggcuggucucgaacuccugaccucgugauccacccaccuuggccucccaaagugcugggauuacaggcgugagccccuguacccggccaagggggacauuuagauaauugauuuuaacccuuucuuccuuuaguauuuacacauaaguaucuuucuaaauccuguuuuagcugcaucucauaaauuucuauauguugugcuuuauuugguuugaaauguuuucuaauuucccuugugauuucuucuuuacuguuuaauuuccaaauauuugagacuuuucuagauaacuuacuguacugauuucuaauuuaauccauuguggucugagaacauguuguguaaaguuuucagucuugaaauguauugagacuuaccuuaugguccagcacauuaucuauauggaugaauguuucauauauacuugaaaagaauauuuuauauacaguuguugaauauacuguucuguaaaugucaauuaggacagguaguuaauaaugcuguuaagaucuucuguaucuuuacugauuuuuuugaaagauuguucaaucaauuaugggaguaagguguuaaaaucuucaucucuuucuuuaguauugucaacuuuuccuuuauguauauuaaaauuuucucauuuaggccaggcacaguggcucacgccuguaaucccaguacuuugggaggcugaggcagguggaucacuugagaucaggaguuugaaaccagccuggccaacauggugaaaccuugucucuacugaaaauauaagaaucagccaggcaugguggcaggugccuauaaucccagcuacuugggaggcugaggcaggagaaucacuugaacccaggagauggagauugcagugagccaagaucacuccacugcacucuagccuggucaacagagcaagacuccgucucacaaaaaaaaaaaaaaaaaaagcugguugugguggcucaucacuuugggaggccaaggcggguggaucaccucagguugggggucgagaccagccuggccacugugaugaaaccucaucucuacuaaaaauacaaaaauagccugggauaguggugggcaccuguaaucccagcuacucaggaggcugaggcaggacaauagcuugcaccugggagguggagguugcagugagccuagaucgugccacugcacuccagccugaaugacagagcaagauuuugucucaaaaaaaaaaaaaaauucucuuauuugacacauacacauuuacaauugucauugcuuccuaauguauugacucuuuuuuuaucaucaugaaaucauaaguaguaguaauccuuauuuugcagucuauuuugucuaauauuaauauaaccauuucuuccuccccuuuacuuugaggacuuucuucauauagauuguauugguuagauaaacuuauuuuccauaaaauucauccaauaaaaugaaauguugaaauuucauaguugaucuuuaaauaauuuuuuuuuuuuuuugagacggagucucacacugucgcccaggcuggagugcaguggcgugauuucggcuuacugcaagcuccaccucccagguuuacgccauucuccugccucagccuccagaguagcugggacuacaggcacccgccaccaucccggcuaauuuuuuguauuuuuuaguagagacgggguuucacuguguuagccaggauggucucgaucuccugaccucaugauccacccgccucggccucccaaagugcugggauuacaggcaugagccaccgugcccagccgaucuuuacauuuuuuuuaaaagucugaguccuggugaucauaauuuguuccauuuguagauuccacuuaugguaaaugucaucugguucuuuucggagcaaaggcugccuacauuccucuuacauucaguucugugguauuuuguuuccaacagaacaauaaacaaaaacaaacugaaugucaccugacaacaaaauucaacgcaacuccaaggcaaagaaaaguaguuuacuuccagguuuuuuuagauuuuuuuuuuuucaugauuuuaaaagaggggacagaguugauuugaauuuuauuaagcacuguuauuugaacaguugcuagauccugauaucuagcaauauccaggaaaaugugccuuucuaaauauuugucuuagcucauuauuucucagugaaugccuguggagacaugaaagaauccuaucuacaauaagcaaaauauguuuuggggugugauaacugguuuuccuauuacagaggagaagaauggauauuuguguaaauagcauagcuguuuggcugcccgguucuaaaaacuaaguuuuucagaucggguguucaaaaauuggaacuacugcuagcuuguuagcuucuugcucuuuccaccugaagcaggauuucucuaucucaacacuguuggcauuuuggccuggaauuuuuuuuuuuuuucuguucugugcauuguagaauauugaaugauuuguauucauugguaaauagcugcuguccugacccuucugagucucgccuagcccccuuguucagcacucccuaguucuggccacuuugaggacccagcuccagcauggugggcugugucuuuucugauugguuguggaccuggggugcgaguugcuaacacuuucaauaccaacuuggaugugagggaggaaauacaggauacaaaugaaaaugggggcuagaacuuuuaguccaaaaauauucuuaggcucuucaggcuauucuguuuucaggcucuucuuaaauaucaggcuucuauuuguuggcuaacaugagagugacuuaaaauauucagacauauuuauuuauuuauuuuuugagauggagucucacucuguugcccaggcuggagugcaauggcacaaucuuggcuuacugcagccuccaccuccuggguucaagcgauucuccugccucugccucccaaguggcugggauuacaggcacgugccacugcgcccggcugauuuuuguauuuuuaguagagacgggguuucaccauguuggccaggcuggucuggaacuccugaccucaggugauccaccugccuuggccucccaaagugcugggauuacaggcaugagcgaccacgccuggccucagccauauugauuuuaaacuauaccuauacuacuacuggguacucuucaaauaaccaaacaaauguugaacuuuccaauauauguuaaaaguuuauagaacagaauuugccaguugaaaaaauagucccacaauuaguuccuuuuggagccccugagaugaaaauuucuggugaauugaauuauucaauuaggugugaccccaugggccuaccguggugaaguggcauucucaaaagaggucugucuagagggcagugauagcuagccucaggccuugggccugauugcacuguuuuggcaugauuuguauuggcagagcagucuucauaaagaagagccugcaauaaggcacaccugccaagagaaugcuugucaccaagugaaugaaauggaaaagagggccgggcgugguagcucacaccuguaaugcccgcacuuugggaggccaagguggguggaucaccugaggucaggaguuugagaccagccuggccaacauggugaacuccaucucuacuaaaaauaaaaaaauuagccaggcaugguggcgggugccuauaaucccaccuacuugggaggcugaggcaggagaaucgcuugaacccgggaggcagagguugcagugagccaagaucacaccauugcacuccagccugggcaacaagagagaaacuccguuucaaaaaaacaaaaaaucaaaaagaguauagcaucauuaaagauaagaaagaggccgggcacaguggcucacgcuuguaaucacaguacuuuggguggcugaggcgggccgaucauuugagccugggaguuugagagggcauagugggaugcaccuguggucccagcuacucaggaggcuaaggugggaggaucaccugagccuggaagguugaggcuucagugagacaugauugcaccauugcacuccagccuggaugacagugaggcuuugucucaaaaacaaaaaaaaaaaggaggggugggucuuuucuuggaacuuugaaaugcucauuuucagauaguguaucuauaaacugaagacuaaaucuuaauuauuaaucuuauuaauuaaucauaaguuuuaaugucuacuuuuauguuuguuaauauguaaaauaaacuaccaaguauucuuucaggaucuuagaugggaaaaauuuuaacguauguucuagcuauaagaaccuugauuuuuuaaugcagcaaugagguaugcuuaacuucaguuucuaaugggagaaauaaaaccugauuaacuugcuugaaauauuugugaguuuuaaaauugugauccuggauaauaaguaacucuaauuuugaaguugaccuaaacugugaaugagcuauccauuuuuaccuacacgauaguauugagcaagucaacaaccuacgagagauccaagcacugaggcgccugaauccgcacccaaacauucuuauguugcaugaagugguuuuguaaguauauuuggagcuugaaaaguuaucuaaauuugaugaaaauaaucucuuuuuaagaaagaaaaccaugguagacauuuugaauauuuacuuuguagcucagagaguaaccauuuuuacuucaucuuacaucacauuuuuauuuggaaaaaugugcaucugauucuuuuuuuuauuauuauuuuuugagaaggagucucucucucugucaugcaggcuggagugcagcggcgugaucuuggcucacaacaaacuccgccucccugguucaagccaucuccugccucagccucccgaguagcugggaucacaggcacccacaaccacgcccagcuaauuuuuguauuuuuaguagagaugggguuucaccauguuggccagguugguuucaaacuccugaccucagguuauccacccaccuuggucucccaaaaugcugggauuacaggcaugagccacugugcccggccagcaucugauucuuaauuaauguggaaaugccuucauuuaggugacuccacaucauaaaagcauccgucaugcaaacaguucaucuccuggagcucaguuaggcugcuaaggucuugagugugaauuuugaccuacugggaaagcacuguuuguguuauuucagggauuguacauucucauucugucccugccaguugccauuucugaacagucuccuguagucuuucuuacuguaauugauaacauuucuggggauuuuucauuucuguucuaauuauagaauaguuuccauaaggcuuaucuaucauucaaaaaggcagagcacagcuugucccucggugccugccugagccugggaagccuucuuccugacagcucugugcugugcuuacagaccucacugaaccagggagucaggcuacaggguuuugggaccuucuuugcugugggcuagaauggcacugacacucugagagggugcaccucaguguagaagcuucgcuguggcuccggagggagccuggccuguaagaucggccaaggaacuccaguuaaacuucacugccaguuaaagucugguagauuuuaaucagagaaugaaacaguuuuaaacucaaaaugaaaugucuuguuauaacuguguggguuccuguccuguagcguucuuagaagucaauuugggccagguccagagagugcaguuuguauguaauagucucaacacugcaugcacgucgugcacuucccacgcacuuuacaaaguacucuguccagaaucucacauggaccucggaacaaccgagaccucuuccagccagauuggaggcacccagaguagggucugggaugauacaggcucuugcucaggacucugggaacccuuuaagggccugcuugaacucagaaguugguggcucagccagcagucucugucccuauucugugucagcguugauaucacacacuugugaugugacucguuuuucucuuuuuccccugacugguuuuugguuuuuacucucccauugugauuuaucccaauuacauggaaggaauuuagcuaaauuaaaauuaaauuugcagucauggagcacgaauuaauuuucuuucuuucuuucuuuuuuuuuuuuuuuuuuuugagacagggucucacucuguugcccaggcuggaguacagugguacgaucucggcucacugcaaccuccgccucccggguuuaagcuauucuccuccuucagccucccgagcagcugggacuacaggcacacgccaccacacccagcuuuuguauuuuuaguagagaugggguuucaccauguuggccaggcuggucucaaacuccuaaccugaagugaucgaccaccucgggcucccaaaguguugggauuacaggcgugagccaccacgccuggccucuuuuauuguuuugcuuacccaacuccccaaccuuuuucuucuuucugcugauaauuaauuauguauuuucaagacauaucuguuuucaacuucuagaauuuuguucaaaguuggguuuugcuaguauuuuuaguuaauuuuaucugaaauacugauuuaaaaucaaaaccuuuacuguuucagcaauuacacuguaguauuugaugugggaguaccuaauguuuacuagaaauguuuacaaaugaauuaaauauuggauuauauuuucugauuaaggccagaaaauuuauuuuaaaaacuugcuuucuucuucagugacagaaaaucugguucucuugcacuaauaugugaacuuauggacaugaauauuuaugagcuaauacgagguacguagaauaauuugaaagcuaaccuaagauccucuuuuaaggcuuguaauucauauaugcuuaguuauucucaacaucauuagucaccauagugcuguaguuauauauaauacacaguacagggucacuucauucaccaggaggcauuuuucugacugcucaucuacucagaacauggcugcaaacaagaaaggaagccccaggcccucugggugcccaugugaucugggggagaguggcgggaggcagcaggggcagcucugcugcagagcgccugcagccagccccgccgugggcaugugugugcaggcccgcuggcucaggggccucucugcuccccagaucugcuguugcucgacauucuguuccaugccucuuaaggcagagcuuucccuccaaaauacugcccugcaugugagggaagcuccuaccauuuuccaggaugcucguucauuuccuuuuuucugaacaauaaagcacuguuuaagagagcauguuugccugaggugaccucagucagggcugguuugagauacuuauagagguugccugaggggaacaggagaaaaggagaggcuggcccacacugagccaauuguuccugggggucugacuaaugguuguguuagaugucagaacaaaugaaccuuguauaucucacuaagaaagcaacauagcaaguguuacauuuuacaaaucacauuauaccuagaggacagauaaaaaacaacuguccuacugucacaugagugacuacuuaugacuuggaaaagaauuuuagugacagcaucauagaugauuuagaugguguauuaucuuacaauuugagccaaacugaagaugaugugcuauggaaaauuuuuagauugauaaacuauuuuugugauggaagaagacacugauguugaagauauauaugaagaguucaaauaaaauuguuuuuaugaaguuggauaguggaaaaagcauuauaucaauauuuauuuuauaugugacuuaaaauaugugugugauaguaaauuacuaacaaaacaaauagcauaaguagccaaguuuuucuacauccauaaaaguugauguauauaaagcugggugcaguggcucaugccuauaauccuagcacuuuaggagggacgccagugcggguggaucaguugaggucaggaguucaagaccagccugacuaacaaggugaaacccugucucuacuaaaaaauacacacaaaaaaauuagccgggcauggugguguaugccuguagucccaccuacucaggaagcugaggcaggaaaaucgauugaaccuaggaggcggggguugcagugagcugagauuguuccacugcacuccagccugggcgacagagcgagacucugucucaaaaaauaaaaauaaaggccaggggcugggcgcgguggcucacgccuguaaucucagcacuuugggaggcugaggcaggcggaucacgaggucaggagauugagaccauccuggcuaacacagugaaaccucgucucuauuaaaaauacaaaaaaauuagccgggcgugguggcgggcgccuguagucccagcuacucgggaggcugaggcaggagaaugguguaacaggagguggagcuugcagcgagccaagaucaugccacugcacuccagccugggugacagagcgagacuccgucucaaaaaaaauaauaaaaaauaaaaaaggccgggcgugguggcuuaugccuguaaucccagcacuuugggaggcugaggcagguggaucacuugaggucaggaguucaagaccaaccuggccaauauggcaaaaccuugucucugcuaaaaauacaaaacaaauuagccgggcgugguggcaugugucuguaguccaaacuacuugggaggcugaggcaggagaaucgcuugaaccugggaggcagaaguugcagugagcugagaucgugccacugcacuccagccuggacaucgcagugagacuccaucucaacagaaaauaaaaaaaaaauaaaagucaacaagaagggagaauuuuuggcaaguugcuguguguuuagacgcuugagaaagcuuuguuuagaauauauauauauauauauauauauauauauauauauauauuuuuuuuuuuuuuuuuuuuuuuuuuuuuuuuuugagacguggcgcgaucucagcucacugcaaccucugccucccagguucaagagauucuacugccucagccucccaaguagcugggacuacaggcaugugcuaccacacuuggcuaauuuuuuuuuuuuuuuguaggcagagucucgcucuguugccaggcuggagugcaauggugcaaucagcucacugcaaccucugccucccaggugcaagcgauucuccugcuugugccuccugaguagcugggacugcaggugcaugccaccacgcccagcuauuuuuuuguauuuuuaguacugacaggguuucaccauguuggccaggauggccuugaucucuugacgucgugaucugccugucucggccucccaaagugcuaggauuacaggcaugagccaccgcgcccagccaauuguuuuguauuuuuaguagagacgggguuucaccuuguuagccaggauggucucaaucuccuugaccucgugauccgccuuucucggccucccaaagugcugggauuauaggagugagccacugcgcccagccuuagaauauauguauuuuuaggauacauuuauauuuauuuucaguaguagaggaauuguauaauugaagaaauugaaucuauuucuuucaauaucugucuacagcgauuguagaaaacagaccucgcaguagaccuccauucauuauauaaauauugucuuccauaggccaggcaguguguucagugcaccaacucugagaugcugugagcaacauggagcauccuagguucagagauguuaaaauguaaggagaauggccaacagugcuuguaggguaguaaauauugaaauaugcauccugauuuuagaguugguaaaauuugaaaaaaaagccuguccuagaauugaugaaauauaaugauaaugauaauagcuaacaguucaugaaugguacccauauggccaggcacuguucuuaauacuuuauaggaauuaacucauuuuaaccuuccaacaacccugucaggcagauacgguuauuuuuuauuuuuuuaagauggagucucacucugucgccaggcuggagugcaguggugugauuucugcucacugcaacuuccgccuccuggguucaagcaguucuccugccucagccucccaaguaggugggacuacaggagcacgccaccaugcccagcuaaguuuuuuuuuuuuuuuuuuugagauggaguuuugcucuuuuugcccaggcuggagugcaauggcaugaucucggcucaccacaaccuccgccucccggguucaagcgauucuccugccuuagccucccaaguagcugggauuacaggcaugcgccaccaccccagcuaauuuuguauuuuuaguagagaugggguuuuuccauguuggucaggcuggucuugaacucccgaccucaggugauccgcccaccuuggccucccaaagugcugggauuacaggcgugagccaccgcgccuggcuaaguuuuguauuuuuaguagagacagguuucaccauguuggccaggauggucucgaucucuugaccucgugaucugcccgccuuggccucucaaagugcugggauuacaagcgugagccacuguaccuggcccagauacuguuauuauccucauuugaaacaugaggacauugaggcauggggagauaaguugcuuguccaagguuauauaccuaguaagugguagaacuggggcugaaccuagauaaccugauccuagagugcauguucuuaaccaccacccauaccgccucaugacaacccugugugguuggcacuauuuauuauucccauuuuacagaugaggaaauugagucuugaaggauuaaguaauaauccaaaauuaagcuguuaauaaauggcagaacugggauuugaacucaagccugacucugaaauccuaagcauuaagcucuguugcugcccugggucucuauuucugggcccagcucagugccuuaaaugaacagaggcaccuaauuauuuacgguuauugaugaugaugcuucuuuagugaaaacugaaucaaucacuaaggcuuuagauaccagaauggcaauuuuugugacuuaaauugcugcucucagguuauuagaauauugaggagcacuauuaaagacuaaagaauaagauaauaaugaaauaagggaacgaucacauagccauuauugaauugucuacuuuacagcagugugcaaggucuggcaagaacugggaagauaaagaagcagcaugucagaugcauguuuuuuauauugaaagaguauauagucuuuuuuuuuuuuuuucuugagauggagucucacucuguugcccaggcuggagugcaauggcacgaucucagcucacugcauccuccgucuccuggguucaagcgauucuccugccuuagccucccgaguagcugggauuacaggugcccaccaccacguccggcuaauuuuuuguccuuuuaguagagacgggguuucacuauguuggccaggcugucucaaacuccugaccucgugaucugcccgccucagccucccaaagugcugggauuauaggcgugagccaccgcgcccagccugaaagaguauauaguguaguguccacauaaacuauaugaaagugauaucauaagagaaaaggaauugcugggguagauuucuuuuuguugaacaggugucagaugaggcagagauggugugggcugggaaaauaaggcuuuccuggaggagugguagaauuggacaggugcgggagaggaugucccauuugcagugacaugccaugggcuauuccagaggcagggacaugguggggaacacagcagacacaguucccacccauguggagcucacacuugaugaggagagacaggaaacaaaugaaauuaucaagaauaucagucaaaaugaucaagaauuccagauagggauaagugcugucagugaauaaaacaggccaauguguuagagagugaugaggauagaguacuucaggcagagggacagccagugcaaaggcccugaggccaccgugagggaagaggcccauguggcuggaggacaugaaggagaguugcaggaaacggaguaggcaggcaucgaugaggcugguagggcgaggguaagaauuuucguuacucuaaguucaaugggaagccauuauugggcuuuaaagcaagggagaggugguuuucaauugguguuuagaccaguguuuccaaaacgaucacagaagaccaguuguuuuauuucuaauauauugcagaccagaauuuuuguaaaauauaguaaaaaugaauuaccagaaaagugaucacgugcuuagaugucacagcaugucaaauugcuauaagugguucuaaacagguauucuuuuuuuuuuuuuuuugagacagagucucacucuguuggcaggcuggagugcaguggcgugaucucugcucacugcgaccucugccucccggauucaagcaauucuccugccucaggcucccaaguagcugggacuacaggugcgugccaccacgcccugcuaauuuuuguauuuuuaguagagacgggguuucaccauguuggccaggauggucucgaucucuugaccucgugauccgcccaccucagccucccaaagugcugggauuacaggcgugagccacugcgcccagcccuaaacaguuauucuuaauuuaugucaucuccucuuagaccaguaacagucccugaaccaucaucagcucauggacugugcuuugaguagcaucuuuuuagaaggaauucuccaguugcuguuuaaagaauaaaugugcuguagguggauguguugguucucccuuuuaguugcaaauaacagccuccccuauucucugauuaacucaagagggguuacucugugauauggauagauugccagaauuguugggaggacugaagaagcagacucugggcuuggccuauaggaaguugcuucucacaacucugcucuccaugaucaggcugcuggcccugccgcugacaacgcucugcagaauaaagcugcugcagcuaccaggccuggaaucaugccucuucugccaggaucaggaggcagccgugauccaugccgucagaauagaugccuucccuccucucaucugcccccauaccugggccagaagcaucuuucccaaguguucccauuuaggcagagccuaagucacaucuggaacacucagcugcaaggcagcaugaagaaugucauuuggacguucaggccuggcaugcuagauggggguuugggauaggaccugagcaagccaaucugcgggugugccaugaaggcaagaguggugugggagccuggggaagggauggcgaaggcccuuugcccgccacugucucuggaugaaugucucugaauucuuuggcgugaguuaguaauuggggugaauagagcauggcuacccgccagcgauccuaguuuguguauuugggcgcgugugcuuauggcucugggcucaugccaucugcaguaggaaagccugucuuggaauuuaugaaggaaaaaccguaaaggagguuuaguuucccucauacucugacuauagaggcagcuacucuuuuacaaaauuguaucugauucugcucuuuuuuuuuuuuuuuuaacuguuucaaguuaaauucauagggccaggugcaguggcucacguguguagucccaacacuuugggaggccaaggcgggaggauuauuugagcacaggaguuugagacuagccuaagacucugucuguacaaaaaaacaauuuuuuuuuuuugagacggagucucgcucuguugcccaggcuggagugcaguggcgaucucagcucacugcaagcuccgccucccggguucacgccauucuccugccucagccucccgaguagcugggacuacagacacccgccaccacuaaauuagccuggcuaauuuuuuuuuguauuuuuaguagagacgggguuucaccguguuagccaggauggucucaaucuccugaccucgugauccgccugccucagccucccaaagugcugggauuacagguguaagccaccgugcccagcccaaaaaauuaaaaaaaaaagcauccgggugugguggcacacgccuguagacccaacuacucaggaggcugaggugggaggauggcuugagcccaggaggucgaggcugcaaugagcugauuguaccacugcacuccagccugggcaacagagugagacccugucucaaaaaaaaaaaauaauaauaacucauuugccuuaaugaauggcuaguucguaguucucuccacccucgcuggaggggcgugugcuggggaugccgucauucugcaggcuacaguggcagcuguauuccuucaguuagugcugagucacagugaaugccuugguuuaucacuguguucacuuaaguuuuuaaaauuauuaguaucauauaugacauuccuucuuaaugagaauauuugguaaaaauuaacuuguaaaaauuaccuuggucaggauagcuagagcagaugagggaaaugcuuuuggggccugcuggaauucacuaaggggcauauaagaaacuucugaguaacucguuaauuguacucuauuuuacuuguuucaaacuguuugaaaacaagaaucugaugggaaccagauagucuugggcccggaaaguuuguucuggagaagcuuauggagaguggcuaggcagugcuuuccuuugcaaggguguggucuccagcacuucagacuacugggcccacacuguugcucugauaccucaugccagcaguaacacccccaacuacuggcccgggaccaggacggcucccuaccccuagggcugugaauagggaguuuccaggaggagacccagggaggcaaggaagggugggcaccugaagaggacucuuaccugggacugaaggcaucugagaagcacagauuccuggcccgcaugcccguuuguggcuccauuaggucuagguucaggccuugaaaucugcuuuuuuuuuaaauuuuauuuuauuguuuuuugagacagagucucacugugucacccaggcuggaguacaguggcacgaucucagcucacugcaagcuccgccucccagguucacaccauucuccugccucagccucccaaguagcugggauugaaggcgccugccgccacgccuggcuaauuuuuuguauuuuuauagagacggggcuucaccguguuagccaggauggucucgaucuccggaccucgugauccgccugccucagccucccaaagugcugggauuacaggcuuuuuaaucagcuuuuuaaaagacuucuaggugauuaugaagauuggauagauuagacuuuuccuaaaagauuccacguuucccaaguucaaguucagaugacucuaaugacaauuuuaugauacgaguaagauuuaaauguguggacauggcugggaagggcguuccuggaauggaacaucaugaauauagguacuaagcaggcgagcuuugggagcaaccagagaagaguccaugagggaauucaccugagcauucgauaaacaagaagggggugguggggcaugguucucgaagcgaggacccaagacuaguagcugcaccuggggcucuaguuaggcgacuguggggccccauugcagaccuucugaaucagacauguggguggagauggggagggacaguaugugucuuagcaacccacucgugggagucugagaacccuuuugguggagaggaauugguugaagggggucuugagugccgggguaagucgggagcagugagacuggguuugaucacaggacccaggagcaccugaugagaugaaauuccagcagcuucauucugcugcgugugugaaggcaaauggaaaguugcuuucuuuuuaucuguuauagauauuaauuuaauaagauuccagaauuaucagcuugggaaagcugauaaaggucuuacuuuugauucuuuugauuuuaauucuggaaaauugaugauaaaucaugugaaacaauaaaaagaugauaguaugacacaaaaaaguuaauugcggccaggcgcaguggcucaagccuguaaucccagcacuucgggaggccgaggcgggcggaucucgaggucaggaguucaagaccagccuggucaacauagugaaaccccgucucuacugaaaauacaaaaaaauuaucaggguguagugguggcgggugccuguaauuccaacuacucgagaggcugaggcaggagaauugcuugaaccugggagguggagguugcagugggcggagaucguaccaaugcauuccagccugggcgacagugcuacacuucgucccaaaaaaaaaaagaaaaagcuaauugcaccuagacauuuuacaauuuaaauuacuuucuauuauuuauauauucuuguuaaguagagaaaaagaauaauuuuaauuuuucaaaagaaauuguaaacuuaggaccaaaagugucaaaugguauaugugcucauggagggaggaaguggauuuccaaacuguuaggugaacauggucauugugcagauuuaaaacuuaauaacuuaaaacacacacuuugaaaauuaaaaucaaguaaaauugacaucuucuggaacagggguaaacugugaugcugggcaugugguaugacgucuucaagcacgguagaaagcugcgggcaccaaggcacagccagcccaggugcugaguacagggcagcugcaggggacugugccagccacgcuaaacggccucuccugugaaagaagacauguggacugugacugaaagcaguugaacugcuucuugaacugugaucugucccccuuuaaaguggacaucuccacauaaacaggaaagccuaguggaacacuggguugacgagugacuccuaacauuuucauaaucaguguaggcugaaggacagcguccuggaaggccuccgaggccggcugaggcugucagaccaugcuacuugugugacgauugcucagugcuguucccacugaaaccauagcacaugcgcucugaauguucacagagcugacgcaugugcuaauugccccgauuucauccuuacacauuguauguauggaucaaaauaacacucucugggucccauuaguagguacaauuacuacauuuccacuaaaaaggaaaaaaauuaucaacaauucugucauucuucaguaacguuuauuguuuauuaauuuuuuaauuggcaguuucccaaaccugcuucaccuguuucaaaacucagaaaaaccacgugugcuagagcagcagcagagucacuaugcagcugauagagcugacucgcccggggcuuccaaaacaggcccuugcggugucuccaccauguuuauagauuuuguuaaauuugcaaaaauaagauauuucaaccacaaaguuaagacugccaucucuucuauuuuaaccucuccuaugucauauuuccccucuuagcguaaccgugaaauagccguggacaugucuggaaucuuguuaaggguuggcugggauacauuuauaugcuuugcagucucuuccauauauuaauaguuacauuauugcuggccaucucauuugggaugucuucuaggaauacucugaauauggucaauucaaagauuaaagagcauucacuccauagaaaacuugaaauaugaaaucuuauagcucagauaugaaggaaacuuagcaguuuccccagauuugacaauucuaaaaauuacauggugcuacuaauacauaguugaggauguaaaagaagccucuauaaacugccaaaaagaaaaauaaaaagggauuuuccauuaaaaauguaugugcuauguaauuuuaaaugagaucaugccauuauauagauuuuuuuuuuuuggacggaguuuugcuccuguugcccaggcuggaguguaauggugccaucucggcuugcugcaaccuccaccuccuggguucaagcgauucuccagccucagccucccaaguagcugagauuacaggcacccgccaccacacccggcaaauuuuuguauuuuuaguagauaugggguuucaccauuuuggccaggcuggucucaaacuccugauccacccaccucagccucccaaagugcugggauuacaggugugagccaccgccccuggccaguauauggaauuuuaaaugguauguuuuguaggcacacuacauauuuccuaagacuacuucagauuauuuuuuacaggggaacuuagauuuucacacauuguuaaauaaaaauagauuauuuuuauuucaaaaaagaggauauguaccaucaguaaccguauuugccuauuuccuugauuguacagggagaagauacccauuaucagaaaaaaaaauuaugcacuauauguaccaguuauguaagucccuggaucauauucacagguaugcucucggagauuugacagcucugaaauuaauaaaauguguuaacauucagauucaagaauuugaauaaaugaaguguaauucuauuuuuccuuuauacugaaugcagaaauggaauauuucacagagauguaaaaccagaaaauauacuaauaaagguaagagcuuuuacaugaaagcuggguaucagaauaaaagcugaauagaaaaucuuucccgaaagguuuucuccuccuaccagaggaacuuucaguccaugcggcuagacagccuguuuguuacaguaauuuuuuucccucucagguuguaaaaaaugguuuauuuaauaaaugccaucaacauaacugacugcaccuggaagaaaauaauugaaagcaccauuuucacaccgcagacaaaaaugaacccuauucagacggccguucaaaccuucuagagggaaauguggcagaggcaggauuugagcucagguccgucucacucccaagccacuaaacuaccuguguuuaaaccguacaauuugcuguuucccagcaccugucacuggcugucagcagaguccucugaggcuguguggcuaaaagagcccuugcugggcaagcuggcagcaugaccggacagacgacuaguguguguuguucauuuguagaagcgccaauggguuaaccaguuuccaaaccuguaggcauuuuggaaauauaugugaaacagccagaauauuuguaaaccuguuccacugaauagacaucacuuccucaucugcuggaggcacuuugaggugcucagaaagccaguaauuuguauuuuacagacuacuuuagaugcuaguaauuuuccugcuggugcauaaauauuuggagugguuuguauuaugauagccacauaaugggauguuacuuguccuugcuucuuuccccuuccagcaggauguccugaaauuaggggacuuuggcuccugccggagugucuauuccaagcagccguacacggaauacaucuccacccgcugguaccgggccccggagugucuccucacugauggguucuacacguacaagauggaccuguggagcgccggcuguguguucuacgagaucgccagguagcaccaggccaggcuccugccugguuccugcggcggagcggugcagcagccaggcucgugcuccuuccuuuacaauccagaugucauggucauucugguuuuucuuucuguuuuacuguuuuuaauuuaacagaaaauugacuaggcuuucauuuuacuuguuguacauauuuggccuugccugcccuucccagagaagagcaccagcccucaguuguucucccuccugcacacccugguggugugggcagcugccuccuugggguugcugugaggugcuugauggggcugcuguggggaggggugagccaaaccuccccugagaggugcagucauauuagguagggugcccuggccacaggugugaggaugaggcaccuucuggcacaguuggacucuagaaagccccaaucccaccccucccugcuccauccuccaaaccccccacucccccccagccuuuggcaaggagcaguggcccagggacgaggagaugggggccggucccacuccgaggugaaugguguugaguugaagacgcgcacagggguggagagcugcaccucuugcucccagugggccuccaggcagguggcagugagguuaaggucugggggugcaucugaggggucaaagucuggucccgccugcucaacagacugcuacagaaaugcacuucaggacauacucuccuuugauccagaugguucauacugguaacuuuucauuuuggaaagcugaauggcaauuucacugcagccagaagugucaaccaagagucccuucccaugagcccagguccugugaguucaucuggagggggcagaugucaggagcacaaggccaccuguaucucaccagcgcacaagacggcccacggugcaccagccaccaaacugggcugaggcacucaucuccccacuuggagcuguuuccugcucacccgcauuuccuccucucuccuuuagucacaagagccugccauuuucuggaauagaagcuaggccuacuaccagagcuguauuuuuaaauauuauuuguggcauguaauaugaauugaauuuauuuauacagguuuaaaaucuguauuuauuuuuuugagauggaguuuugcucuuguugccuaggcuggagugcaauggugcgaucuuggcucaccgcagccuccgccucccggguucuagcgauucuccugccucagccccccaaguagcugggauuacaggcaugcaccaccacgcccggcuaauuuuguauuuuuaguagagacgggguuucuccauguuggucaggcuggucuugaacuccugacuucagguaauccgccugccucagccucccaaagugcugggauuacaggcaugagccaccgcgcccagcacagguuuaaaaucuuguucccacaauuccaaaaucuauaaaagcucuggaaaccaaaagguuucuugggacucauuuguugacaaaaccugaccugucucacccugaauuugucagcaaaacuccccuuggccgaugggaggcucacugugggguuauuuaucacgguuacugugaauuagucacauuucaccacagacaucaugcugaacagaugacggaauguggaucugucuuuugccucuuagaaaacacaugucggaccuauugguaaaguggaaacaaaaggucaagcacaagggagaguggagccucccagcagcuaaggucgcugcacacgccaggcugaguuccucguguuccguguggugagggucgcugcacacgccaggcugaguuccucgcguuccgugugagcgagucugccuggucgaggggacuaggcagaauggagagacccauggccauguccugacuguagggucagcugagagaaaggaaaaauagacccaaagucaggcaagcaagucagacagucagaggaagcagccccaagcuuauagaaugagggauuuauauuggggaggggaauuugagggaguucuuugguauggccgcauccugggguugguuuuuuuuuuuuuuuuuuuugagacggagucuugcucugucgcccagacuggagugcaguggcgcgaucugggcucacugcaagcuccgccucccagguucacaccauucuccugccucagacucccgaguagcugggacuacaggcacccgccagcacgcccggcuaauuuuuuguauuuuuaguagagacaggguuucauuguguuagccaggauggucuugaucuccugaccucgugauccgcccgccucagccucccaaagugcugggaucacaggcgugagccacugccccggccaucccaggguuguuugcugguuaauuuugccacauaucaccuugugauguuugugguagcaacuagaugaagagcaggaacuuacagaaggguguagggaaaguuuguuuaugcuucccacgaccuccugcugugaguucuggaugguuuguaauugggguuugcuuaucacagcaaggucugacaggugaagucugcuggcuuuaccguggcgccuagauaaaggcuuagaaauguaaagaggcuugagggaagggugaaccgcacggagaaggguugcagagcauuagggggaggggugggcagcaccaagaagcuuuuuuggggcaguuugucucuaacauuccagcccuuuaauagguaauagaagaggggcgccguuggcgucuggccacuucuugcugggaaggggugaugguuaugggggaaggcuggacaguagggacugccguucuuggagcuguugguauucuuggagcagcaucauaucuuguauuguauugaaggcuccgauacgguccuguaaaaacugagugagaaggcguaggagacaagggcugaaugcuagaaaaagaagaaugguuauggcugggccuaagaggggcauuagccauggaaaccagguacuaaaggaccaggagggccacgcuggccaucgggggacauuuucuuuaauuuuuugugcucgguccuuuaguguuuuuacaaaaucucguacuaagccagauugguuacgauaaaagcaacacuguucaucuagaaagaggcagaguccucccuuuuuggcugugagucggucuacgccucugugauuuugaagaagcgcugcugcuaaagaaucuauuugugauuggagaguugugauggauuuggcuaucucuuccaagcuaucugugaggucuuuggagagggauugguaauaggaaacagaggugguuaaucccgcagucucaguuccaccuccuguaguuauucuggggacugcuaauagagguaugaguugcauagcacggcagugucggaugcggguauuaacugggauugguagggguuggucuccuggagcaacauugauuuuuggagugaggaaaaccagggugcagguaggugccuguccaguuagaggggaggcaaauauaaguugagguacugcauaggaaaaguaugccuuggcuugguagacagaacugguuguguaugcuaaaaagauguacuguuuuguuguccucaugcauccauacuccuagggccccagcuagagcugcugcucugagugguuguaaaggguguuugcuuuaggcugggggcuuuggguucuuuuuucccagcguaagaggaagcauuuuguguccacuaagauccaugugggaguguugcugaauguugggauaaggacacagucgcagguggcgggugcagggauggugcauggagaggggagccaagggaagagggauaaaugggggugucggccguugcaguacucugaguuuuuguuaaggaggugggaggugucaagggcuggggggcuagauaaacgaagccugucuuuauuguugguggcuuugagaguagucuguucgguggaggguuugaguugugcgguguaaguugcacaguuuggaauuuagguggcugaggggaaugcuugaggguggaugucgcuggcgcacaguggugcuggauaggauaagauuguguggguuguuacgguuccuacuaauaggcauucaucacagcugugguagggccagguugcguaaguaggcauguaagguuguaacaccuggaccgaacucgcuagcuaacugggggagauuuuuguuaaugccuguaugucgaguuugaggggcaguuaaugaggauuucaggaugguagcuuacuuggguggaaguccaguuauaggcugagcagggguugcauuguauguuguggagaggagggauacgcagagccagcagucucuugccagagaggaauuggaguuuuuuaguaaggagugugugagauuaaguguucuguauagguguucagggguuguagguauugguuggacugaacgaaggguugggguauugauuaugagaaggguuagaaaggcagauagugagcagaaaaauaaauaguucgguuccacccagaguaaagccacagagagagccuuggaagaaaaggucgauuauccacuugaaaaaggccuccagggugucguuccguggguggaaccaggaaauaucuugugagagggcgugaaggaagagagugaagcggcaggauagacaaaagcagggcaucuagggaggaugugggaauguuugauagugauugugauuccugcuguaaggguaacgauuaggcagacggcuaaagugagggagacuuuuggcugguauuccaauuggaaggaguuacacuauauaaucccacugcaaacaauaggguaaguauuauaaugccugcaguuaggguguaauagaguguuuccauuaaaggaggcuaguuguaauaguacuuuaaaccuguuugagauggauggauuuacugaugugaaguuucuucugggauggaugugaggcggagucagguuggcccaaggagugugcuggaauaccaguuagaaguuggugaggugcugguuggaggaucggaggugggagcucucuuuaaccuggaaaggugauacuaggggguauguccugagaguuuggcugcaguagggguuguaagugucacacacguccaugugaaaagaccaccaaacaggcuuugugugagcaacaaggcuauuuauuucaccugggugcaggcgggcugaguccgaaaagagaaucaucgaagggagauagggguggggccguuguagaggauuuggguagguaguggaaaauuacagucaaaggggguuguucuccggugggcaggggcaggcggagggggucacaaggugcucaguuggggagcuucugagaaaaggaauuucacaaggaaauaucaguuaaggcagggaccggccauuuucacuucuuuugugauucuucacuugcuucaggccaucuggauguauaugugcaggcuugggcuuagaggccugacauuccugucuucuuauauuaauaagaaaaauaacauaaaauaguauugaaguguuggggcagugaaaauuuuugggggggugguaugaagagauaaugggcgauguuucucagggcugcuucgagugggauuagggguggcgugggaaccuggagugggagagauucagcugaaggaagauuuugggguaaugggugguauugugggguucuuagaaggagcauuugucauauagaaugauuggugauggccuggauguguuuuuuuaugaauugagagcuaaacggaagacacaagguccaaauaagagaaggagaaaaacagguauuaaaggacuaagaauugggaggacccaggacuuccaauuagggagugcccaaggggguucagcguaauuacuugcuugguuggugaguuuuugggcucuauccuugacagagcccuccuuuuuaaguuggaggcugaguuuggugagguguguuuuuaaaagaccauuagucuguuccauucuaccuuuccugaagauugaggaugguaagcgguaugaagguuccacugaauaccaagagccugagaaacugcuugggugauuugacuaauaaaggccaguccguuauuggaccguauagaggugggaaggccaaaccgaggaauuaugucugacagaagggaagaaaugaccacgguggccuuuuuuugaccuugugggaaaggccucuacccauccagugaaagugucuaucuagaccgagacguauuuuaguuuccugacucagggcaugugaguaaagucaauuugccaguccugggcaggggcaaauccccgagcuugauguguagggaagggagggggccugaacaaucccugaggaguaguagaauagcagauggaacacugagaagugauuuccuugaggauagauuuccaugauggaaaggaaaugagagguucuaagaggcagacuagcagcuuguaaucuacguggaagagguuaugaaaugacgacagaauagaaugggccugugaggcuggaaggagauauguuccuuaguccaagaacuauuugccuugugugggaagagauugauagguggaaguuucagugguggaguaggugggagugaccgaugagaaggagaaaaacugccaugagggauagaaguuggaaugcuagcugcuucuuuagcuaccuuaucagcauaagcguugccccgagcaguggggucugaugccuuuugauggcccuugcagugaaugacuccagcuuccuuuggaaguaaagcgaccuugagaaguauuuuuauuaaagaggcauuaaugauggaggacccuuguguagugaggaaaccucuuucagcccauauaacagcaugguggggcaggauauggaaggcauguuuagagucaguauaaauauugaugcguaguuccuuugcaagagugagggcuugaguuaaagcaaugaguuuggcuugcugagagguaguggagggggcagagcaguagccucaaugauagauguggaagauacuauagcauagccugccuuugcugguaagcggugauuaggccugguggaacugccauggauaaaccaagugugaucagggugaggaacaggaaagaaggaaauauggggaaauggagugaaugucagguggaucagagagauacagucaugggggucaggugugguaucuggaauaaugugggaggccggauugaagucugggccaggaacacugguaauugugggagacucaacaaagagugaguacagcugaaggagccagggagcagaaaguauaugcaucaggugugaggaagaaaauagauuuuggaaguuaugagggcuguagagagugaguugagcauaguuugugauuuugagggccucuaaaaguguuagggugacggcagcugccacacagagacaugauggccagccuaaaacaguaagaucaaguuguuuggacaaaaaggauacagggcacggucccggcucuuguguaagaauuucaacugcacagcccugcacuuuggcucuguguaaugaaaaaggguugggaugaguuagggagagcuagugugggagcagcuuccagggcuguuuuuaaggaacggaaagaggaauggggaaaggauuuaggaucuauguggucagcuagguuuucuuuuguguuuauguaaugguuuuguuaggauggcaaaaccagguauuuaaaggugaaaguauuuaaccaugcccaggaaggaaaggaguuguuuuguagaagggguugggguuugggagauuagccagacaugauuagcagggagggcauguguguuuugaugaagaauuaugccaagauagguaacagaugaggaagaaauuuggguuugacugaaguaaugggggcuguccaugaagccuugcagcaguacagcccagguaauuugcugagccugaugggugucagggucaguccaagugaaagcaaagaguggcugggaugaagcgugcaaaggaauaguaaagaaagcauguuugagacccagaacagaauaauggguuguggagggguuguggagggagguauugaggauaggagaguauauggguuuagcacuacaggguggauaggcaaaacaauuugguugauaagaugcagauccugaacuaacuuguaagacuuguccgguuuuuggacagggaaaaugggggaauuguaaggagaguuuauaggcuuuaaaaggccaugcuguaacaggugagugauaacaggcuuuaauccuuuuaaaguguacugugggaugggauauuggcguugaguggguuaagggugauuagguuuuaaugggauaguaaggggugugugaucaguugccaggggagaguagaggugucccauacuuguggauuaagguggggagauacaaggggaagaugugaaggaggcuuugaacugaggaaaagggcagcaaugagguguggcuauagucuaggaauagucagggaagcagauaauuuaguuaaaaugucuccaccuaauaagggagcugggcaggugaggauaacuaaaaaggagugcacagaagaauguuguccaaguuggcaccagaguuggggaguuuuaaaagguuuagaagccuggccgucaauacccacaauuguggaggcaagggaaaagaagguaauguggaguggguaagcuccguauugauuaagaaggggauggacuuacccuccacuguaagaguuacccaaagcgucugugaugguccaggaggcuuccgaggcaaucagguagcauuagucuucagccgcuaaagccaagaagaucugggaaggagucagucagagagccuugggccagaguuccagggacucugggaguggcugcugggcgaguuggacaguccgauuuccagugggguccugcacagaugggacauggcuuaggaggaauucugggcugugggcauuucuuggcccaguggccagauuuccggcgcuagaaguaagauccuuggggaggcaguucuggaggaacgccuggccacugcgguucagacguuuggaaguucuuguguccuggagauguggcugggguuugucucacaguggaggcaggaauugcaauucagaaauucauugcuacuuggcugccucuacucuauuauuguacaccuugaaggugagguuaauuaaguccuguugugggguuugagggccggaaucuaauuuuuggagcuuuuucuaaugucaggagcagauuggguaauaaaaugccuauugagaauaagauggccuucuggccccucugggucuagggcgguaaagcaucuaaggguuguugccaaacgggccaugaacuggguugaguuuuuauauuugaugaaaaagagccuaaacacugauuugggagaggucagauaaagaaaaaggagcauuaaccuuggcuaagccuucggcuccagccaccuccuuaagaggaaauuguugagcaggugcgggagggcuagucuccccacgugaaacuguaagcuggacccugugugaggaugggaggugauuaaaggauuauagggugggggaguggaggcugaggaagaauugagaccuggcucagccuggcgaggauuagccuggggaggaagggaggggucagaugggucuguagaaaaggauucaaaggacucagagcuuggaguggagacugaaggaauagacaggagagaaagaagaaagauuugggaugaguugcauugggagcagagacuagggagggaccgauguguaaaagaaugccuggacgucaggcaccucagaccauuugcccauuuuucgacaaaaaucauccaggucuuguaaaauggagaaaucaaaagugccauuuucuggcuguuuagaaccauuaucgaguuuguauuggggccaagugguguuggcgaagacacuuagguuuuaggucaggcaagaguugaagagguuuuaaguuuuugagaauacagccuaaggaagaagaagggggaauggaggguggaagguugcccauagugaagcaggcaagcccagagaaaagagaggguagagacacagauaaggaggguggugagcagcccugggcugcaaugugggugagcagccaaagcaggcauccccgcaguugacuugccaccaagggaaugugggugaaugaccaaggcaggcauccucgcggugaucagacaccaauggagugugggugaauaaucaggcaggcauccccgcagugauuaaacaccaagagaagacuauuccugagucugugacuggugcuggaguuuugaguccacagauaaaaugugucuccuucgucucuacuagagaggaaaaagaacuggaauuggaagaacagggagacugaaggguagcaagagaggcuggagaagagagugaaaagaccgcuuaccugauuugaaauuggugagauguuccuugggcugguuggucugaggacccgagguuguagguagaucuccucacggagugagggcaaggacaggggacuggucucccgaaggaguccuccugucccggguuucggcaccaaaugucacgcgcgucccugugaagagaccaccaaacgggcuuugugugagcaacaaggcuguuuauuucaccugggugcaggcgggcugaguccgaaaacagagucagcaaagggagauaggggugggucguuuuauaggauuuggguagguaguggaaaauuacagucaaaggggguuguucucuggcgggcaggggcuaggggaucacaaggugcucaguguggaagcuucugagccaggagaaggaauuucacaagguaaugucaucaguuaaggcagggcuggccauuuucacuucuuuugugauucuucacuugcuucgggccaucuggauguauacugcaggcuugggcucagaggccugacaguaaggaugaccuggaaagggccuucccauuuugguuuaaggcugguuggguuaaggguuuuuuuuuguuugauuuuuguuuuuuguuuugagacagaguccugcccugucgccaggcuggagugcagggcacaaucucagcucacugcaaccuuugccucccagguucaagugauucuccugccucagccucccgaguagcugggacuacaggugccugccaccaugcccggcuaauuuuuguauuuuuaguagagaagggguuucaccauguuggccaggauggucucaaucucuugaccuugugauucaccaggcuuggccucccacuguacugggauuacaggcgugagccacugugcccagccggguuaaggguuuuuagaaaaacauguucuccugguaggagggucuggucagugaggccuuuaugugguauugggagggccuggugugccuguuugcagaggagauggcggaugagggagagugcugggagguacucuccuaauugagaaucagaaggaggccuguuuuguaagaggaaagggucucagaaggaggccuguuuuguaagaggaaagggcauccauacauuaauucaaaugggcugaggaaggagggugccuuugggcuggcucugacgcuggcuagagcuauggguaggagggaaguccagggccucuggacuucuagagugaguuugaucaacugaguguuaagguuuccauuugcccuuucgacuuuuccugaugauuggggucgauaugggauauggaggugccacuggaugcugagggacugggagagcuguugggugauuugggaaaugaagccagggccauugucugauugauuggagcgagggagaccaaagcuagggaugauuucucuuguggggaucugggagacuacugcagcuuuuucugaagagguaggaaaugccuccacccacccagagaagaugucuauaagagugagaaguagucuuguguuuuugacgggaggcaugugggugaagucuauuugccagucuuccccugggaguguuccucuuagcugguguguaggaauagauggggaauggagggcuccuugagaggaggugacagagcauauaugacauuuugaaguuauacuuuuuagugagguaaauaggugaggggagaagaaauaugggcggaggaggagauauaggggacaugcaccaauauggaaggauugguggagagaugucaggauuuugucgguuuggcccuggggaaggucuagcuucugguccuuaucuauccagucccccuggaggaaggcuccuuguuauaguaaugaggcuuuuucagugggggguacugagguuggacugcagggguaaugaggaggagggaggcaggagcggaagaaagggaggcuucuuuugcugccccauuggucuuucuguugccucuugagauuuuaucuguuccugugugauguccccaacaguguauaacuccugccucaguugggagaugugcggcuugaaggaguugguaaauaagggggugguuagugauagggucacuuuggcaguaaggaaucuccucucuugccagaugguggcgugggaaugaagaaugugauauacaucuuuggagucuguguaaguguugacucguuugccuuuggaaaggguuagggcucuggugagagcuaugaauucugcuuuuugagaggagguuccuggagguaggggcuuagcuucaauuacucggucaagggaaacaacugcauacccagcaauuuugggggagccagugggcccagaaggggggccaucuauaaauagcuggucaucgggguuggugagaggcucggaggaaauguuaggaaaguguggcugcaggugaucuaggacgucagugcaagaaugaguaggaagggaagaagauacagggaguaaggaugcuggguugaagggagcacuuuuggcaagaccgaauucaggauuuuugauagagggcauggaguaauugaauccggaaaggagggagccucaugcucgggaggagaggagauccuguagauuaugaggacuguagguggugguauuuugacucaauguuaguuuccugcuuacagcuaaaguggccgcugcugcuagcauucuaagacagguuggccauccucugacuguguugucuaacuguuuagagagguaggcuacaggggcaaaggaaggagggucuccuuucuguugcccuaagacaccgagggcuauuccucaucuuuuggcaguauagagugugagagguugggagauaccagguaaggacagagcuggugcagugacaagagcgguuugaaguuugcagaaguuggggaguauguuacgugagggauuuagaggcucacugagagggccuuuggcugcuucauagagugggugagcuaggagggcaaaguugggaauccauauucuaaaaaagccugcuaguucuaggaaggaaagaacuucgcuuuuggaggagggcgagggcagauuaucuauuagugcugcuagggcaggggucauagcccgggucccaggggaaaguugaacuccuagguaaguuacuauggagguggaaaguugagcuucggagggggagacucuauacccuuugauggagagaaaguuuuaagagaguaacugugugaguuugagagucuucuagagaggggcugcaaaggagaagauuguccacguauugaaggagacggcuagggaaaagguuuaaggaagugagaucuugagcuaaagcuuguccaaagaagugaggguuaucucugaagccuugagggaggacaguccagguuaguuguugugacuggagggugucaaggucgguccaggugaaagcaaagagguuuugggaaucagggugcaggggaauaguaaaaaaagucaucuuuuaggucaauagcaguguagcaggugguguuggagggaaugagacagagaaguguagagggguuagggacuaugggaugaauaggaaagacagccugacugauggcucggaggucuugcaggagucgguaugagccgucugauuuuuuaaccaggaggauggugguguuauaugaagaacguguuggccuaagaagacggcgugaacagagcuuguuugugaugggcuguaagccuuuuugguggguuagggagauaggguuuuuggggaugcugggaaauuuagagaggucuuuuaacuggauuuugauggggucguggugaguagcuagggaaggggugguggugucccacccuguuggguuuacaaaagaggugggaaguggguacuggggagaggggucaggggcuggacucgcauagaggaguaggagggacuccgguugagggagggagaaaaaggugauagaagcuuugaauuuggccaaaauuugaauuugaauuuggcuuugaauuuggccuaggauggggguagggcaacgaggcaugauaaggaaagagugugggaaaacaguaucaaacagagagcaaguaaggggucugguggcgcguggacgcaagaugaguccaucagcccccacaacugagaccugagagggaugaguggguccugaaaauucaggcaaagcugaguagguggccccgcuaucaauuuaaaaagagaucggcuuaccugcuacucgcagaguuacccugggcuccaaugcagugauggcagauggggccgggggcccugggcccggucaguccucagcggcuaggcugaggagcugcgggaaugcaagcgguucuucacuuuuugucuuguuaaaggggugguggcucugaggagcaggcuugucugucuguugagaggacagucggacuuccaguggccugucugcuggcacacuggacaaggacucuuuggcacucaaggguuaggauacacccaugcccaguggccuucuuugccacacuuaaaacaaggcccggaggguugcugcuaucgggucuuuugugcccuugggugauacggcuggguugauggacagccgcugcuagaagcugguauuuagcacgaucucuuugggcuuuaucuaauuuauuuugcucaucccuguuauuaaagacuuugaaagccaaguuaaggaggucucguuguggggucugaggggcaucuucagccuuuuuaaguuugcgccagaugucgggggcagauugggaaauaaaauggauguaaagaacaauaguuccuucccgggaggcgggaucgacacgcguguauuuuuggagagucucuguaaggcgagaaaggaauugggcaggguuuucauuggccuuuugggagauuccuuugaguuuuucgaaauuuacagccuuaugggcaguuuuguuaaggccugcagugaggcaaguaaucauaugauuacaggaggucuggcaggggccuguggguugauacgcccagguacgcucuucucagggaacugcagcggccccuacuggccuaguaggaucuugccgauggaggucaucggcaugggccugggcugcaagccacacucuuuccuuuucuuccggaaggaggguagaagacaaaauaauauagagaucaugccaaguaaguucauaagacugggugagauauuuaaauuauuugauguaagugucgggaucggagaagaaccuggacguuucucaauuugggaaacauuagagagggaaaaugggacguggacacggaccaucccuucggcccaugccacuucccggagaagaagcaagggagcaggcugcugggcguguugggcucgagaacgaguaagggguggagauggggaggacucagagucggagguggggugguuggagagaaggggagagagagguagagccggagcggaggcauacgguggggggucaugcuguuccgguggaggauuaggauguugucgaggaggggagaaaucggugggaucaaagaaggagaagucguccgcuggggcuauugggaugaggggagcaggaggugagucggguuuggagcaggcgaggagaauuugaaaaguacagcaggacuggcagagggagggacgacuacagagaguaaagaaagccugaacaugaggaaucucagaccacuucccacugcgguggcaaaaguugucuaagucucugagcaugucggaaucgaaagugccauuuucaggccauugggagccauggucugauuuguauugaggccaugugguguuacaguaaaagauaagccuuuuagggcagauuucugaacggaggccaagaguauacagauuguguaggaggcacccaagggggguaguuuuaggaggaauagacugagaggcucccauagugaauggaagggagggggguagaggaagaagagacugccggugacguccccuuucccgcggaacuugucaggaauagaggagguaaccaccgugucaggcgucccugaaacggaggaaccagaggccuggaggcuggaggaagcccuuggcccagcgcugggucuuucggaaaugggagauggacggucaagaguucagggaauggcaacagucucuuuuuacucacccuggcggaggcuuugaugguggaugaagucaccagcaaugggagagucuaggagauugucugggucuuuggcagguucggggaaggggagauuggccaggagaggggugauaggggagggagggagagagagagaaaaagagagagagagagagauugauagugagcgaguccuggccagagucuaucccccuucccggguuucggcaccagaauguuaggucauccgagagaaaggaaaaauugaccuaaagucaggcaagcaaguuuuuauuaaccugccaccggccgcuuaacagucagaggaagcagccccaagcuuacagauugagggguuuauauuggggaagggaguuugagggaguucuucgguauggucacaucccgggguuguuugcugguuaauuuugccacauaucaccuugugauguuuacgguagcagcuagaugaacagcaggaacuuacagaaggguguagguaaaguuuguuuaugcuucccacgaucuccccuugugcgguccagaugguuuguaauuggugaggucuguuggcucugcccuaacacugaccacagugccccuucugcccuuccagucugcagccccucuuuccuggaguaaaugaacuggaccaaaucucaaaaauccacgaugucaucggcacacccgcucagaagauccucaccaaguucaaacaguaaguauuguguucugagaguggauguggacccacuccccugcuaggaccugcagcagggcaagccccucccugugccucccucaaaccccucucaggagcuccuuuggcugacuacagggguucaaguucacuugagggccagugaguggcugcucagacagagcccaucacuuuaaguggucucaaaggugagcucuuccuugagcaucacagaaagauuugucacaggcuuucugagggcuggggagucaggcuguguucccugaguaauuuaaacaggacuuagaagccuuuggguggaaacguuccccaagcacagagcauagguggugagggcuuucugcagcccuccacagcccugcuggcgggaccgacgccuggaagagguguucccggacucuuagggucauucuggugaagcugaggcugggaguugggacuucccagggagggccugugggcugaggggcaaguagcacccagcggcccccacaucccagggagggagaagguggcaaccauuuuggacucuucuuuuuuuguuaaauuuuauuucauucuucucaugugggaaggugauauuaaucuuuuauaggaaagguaguuuucuuacauuuuuagcauaacagaucccccccuuuauaauagacuauuuuuaaauagauuuuuuuaagagcaguuuuagguuuccauagagcccuguccccaugugcacacagccuccccugucgucagcaccugccucgagugguguguuuauuauggucgaugaaccguggauaucucauuacuacacagagcccaucauuuacaucaggggucccucuugguggugcacguucugugggcugggacagguguagacucugcagucauaaaccauuccccaccacacagggcccuuaguugugacaguggaccaccggugcgcucagugacagcaugaccauuuauuaucauuggguuuuuaauacaggucgagagcuaugaauuuugauuuuccuuuuaaaaagggaucaggaauaccucuacuaacaaccaauuuguccccacaaugccucucccuccugcacgcaaugguggccuaugaucccgaugagagaaucgccgcccaccaggcccugcagcaccccuacuuccaagaacagagguaggcacucucguggguucgguggggcagaugcaggaccuggcaaaugagacccaugggcacaugguggggcaagguacugcccccuggagggucccugguucuugggaaucgcgcucucuauccugaagaguggucagggccucuuggggcccacaccgugcugccuucugguguauccuccccaaaaugaggauguuagcagcuccacggcaggagaaagaggggcuggcuguccacuuugcgguugaugccaaggcuacagguaguaauccuucuagaagagccuggugugcggcccuuguaaauggugugaacaggaugcauucugagaugguagagcacuguggaugucaccuggcgcuggaaguaccugcugaaugugaaucuaagaccugucugcccugaggucaccuaauuccggaccucuggacacuccuguuugccuaacuguggaggugacaguuugaucugaaacugcgagucccuggguaggcagcgcuucugauucauggagccagcucuguuccuggcccagagacugucaggcugagacagaaaagaaaaaaaaaggcuccugauuacagcucaggcagaaaagaagagcuagugacaacucacacaguagacaaauuggagacaaagaagccaguaggccgugugcucugcgggcucucaguggagcugcuccauucucuucuccuuccccguaggaaaacagagaagcgggcucugggcagccacagaaaagcuggcuuuccggagcacccuguggcaccggaaccacucaguaacagcugccagauuuccaaggagggcagaaagcagguacuaagcgaaaucggagccggagacugccuagcucagccgggacuggaugcccucggguggccugugucucucucaggaggacgccaccuguggaggcuguggcagaccacauugucagucgaggccugaacagcaugcgaguugauggcuccauguguugggacaucagggaccccaguucuauuugcucaagcccuuucugccccaguagcuaagaauugaugacgaauaucccaugugagcaggcccagagaggggauguuugcaugaacuuuugugucuguccugaugaccauaugcaggugccagguucuaugccaaagcaccgugcagacaucgccccucagaacggcccuggagggaggcgccaagaagaugcaaugcuggcccaagucacccacccagccagugacaggucucaagucacugucucugccuggcuccagaugagcacuucgucccaucagcagagguugugcacauuuucgguugagaaaugccagcuuugccccucagugccuucaccuucccaccuaccguguggcauccuagccuggugcagcccugugucaccugcuggcagggucacaccagucucccaguucugggcuggcaccccaacagugugacagugugcccuuccaucauucgucuguucggucguccguacgucacucgcuccucccagccuuuaccgagugcucccugaccgcuugggagcugggaacccagagcugcagucaggcugcucuccagaaagccaggcuccugugucccauuggucccugauuugacagcuccacuugaauguccgaaagacagacuugcugaaaccccuucuccugaucuuuccccaaacgugcuuuuucccuguggcuucccauggccuucccuccgagggaggcaacuccgucaacugcccaggccccccguggacccuuccuucaucccacaggggcuucgccuucuugccuccuacauccuccucaccuugccuaagucaccacagauggccuccucacuacugucccugcucugccuccgcucccuccuggacagagggucugcuucaaacccuugaugucacuccuggccggcauucacccaaguccccacccucagucacauccgaggucggcauauuuuucucuaagggucugauaggaaauauuuuaggccccguggccgugggguguucguuacacucccugcuuugcugcagugugaaaggagcuggaggcaacacaugaaccacauaggggcugcguuccaguagaacuggggacacuaaaauuugaauuucacauaauuuucacaugccaugaaacauuuuuuuuucagucauuaaaaauaaaaaccaggugggugcgguggcucacaccuguaaacccagugcuuagggaggccaggguaggaucacuugaggccaggaguuugagaccagccugggcaacguaggcaagaccacugccccaccaccccaucuguuuuaaaaauuagcuggguguggugcgugccuuuggucccagcuacuugggaggcugaggcaggaggaucgccugagccuaggaagcugaggcuacagugagccaagauugcaccacugcacuccagucugugcuacagagcaacaaacaccgugucucaaaacaaacaaacaaacaaaaaaccccaaauguaaaaccauccuuagcucacaagccacccaaaaccaggcgacaggcagaucagggugugagaccuuggagcuagagcaggaggcaggaggcgugggcaccacagcccgcgagcccuuugccgcccgcacugcucagcuugcagucggcauucuucagguucccccugaagguuuggccucccccgugggacucuagugggcagccacucccuuggggugucugggaccugguggaugugucccagucacaucuuauggucaagaaauuguauuaggcaaaagcaguacaaaagagccucuuucguuuuuccuaauuuccauaaagcagaaagcguuuuauguccaacuggccucuguucuguuucaagaaacagucccuaaagcaagaggaggaccgucccaagagacgaggaccggccuaugucauggaacugcccaaacuaaagcuuucgggaguggucagacugucgucuuacuccagccccacgcugcaguccgugcuuggaucuggaacaaauggaagagugccggugcugagacccuugaagugcaucccugcgagcaagaagguagcgcggaaccagcuucucugacggcgcugcucuucgacccagcccaggccgccacugaauuuugugucuguaauuuuucuuugacagacagauccgcagaaggaccuuaagccugccccgcagcagugucgccugcccaccauagugcggaaaggcggaagauaacugagcagcaccgucgucucgacuucggaggcaacaccaagcccgaccgggccaggccugggugaucugcugcugagacgccacggagggcuggggaugcgccugcguccguuucgcgcuggccggggcucugggugcugcccugcgcccugccgcacccgcggcccgcgcagcugccuaggauguucugggcuaauauacuuguaaaaccaccgcauucuaggguuuucuuucauuuucguuaagaauuuggggcaggaaauacuuuguaacuuuguauaugaaucaaaacaaacgagcaggcauuucugugauguguugggcgugguuggaagguggguucugcgugucccuucccagcgcugcuggucagucguggagcgccaucaugucuuaccagugacgcugcugacaccccugacuuuuauuaaagaauaagcugucguuacaguauugcauuuuaauguuuuccgaguccaacauguguccuuaccagccauuccuuuauuuuagcuuuugugggcacacgaggggaauugauuuuguugggaagacuuugguguggcuuaauuuuuuuuuuuuuuuuuuuuugagacggaguuucguucauugcccagguuggagugcaauggcgcaaucuuggcucacugcaaccuccaccucccggguucaagggauucucccgccucagccucuaaguagcugggauuacgugcaugcaccaccacgcccggcugauuuuuuuguauuuuuaguagagacgggguuucuccauguuggucaggcuggucucaaaacucccgacuucaggugauccucccgccucggccucccaaagugcugggauuacaggcaugagccaccgcgccuggccugguguggcuuaauuuucauuugaagaaccauucagaaaggaacacacacaggcguguccucggagcccugugugcuccucagugaccagccuggcgagguggugcggggcacagggcaggccugaagggucucuucugagcauaggcuucaaggugaccacguugucauuuuagcuccuggugcucagcugucucuggggaguauggagcccugccccuggccugucagugggugcuuugagcuguuugcugagugccaacaauaaguugggcaccuuguguccuagaaagagaaaccuguuuccccauggggaugggaaugggaacauugcaaagaaaccguggcacuggccgggcugcugggcacaagaaaaguccuaguaaguccucuuguuuaucugggaaaguaacuuaguaauugggucuucuuucuuuuuugucaucuucccaaacuuaaagagauauuuuugaaaaaggcuaaauuucccaggcuaguaguguuuaagccuccuugcuccccuguugagacaaaucugugacacccuuccuucacgugcucuccagugguccuggccccagccccaggccaccugacacgacagcggggccgcaggagauggaccgcgggccacgcggagggagggcaggcuggaggaggaggcaagggcggggagcguggggcagcgaguccgugggcacaggugcccacucugcaccacaugggggcaaaggaacccaagaagaagggcagauuccaguccggaagugaggcuugccguaauguucagaccggaagugaggcuugccguaauuuucagaccggaagggaggcuugccauaauguuccagagcagggugcagugcaggccuuuccccgggcuccuuuuaaacccauuugagacccuggugcagccuugagggcugcccuugcuguaggggaggugucugagcagggggguggugccguucugccucuacagagggccugggagucccaggggagucggacgucaaggccgugggcagagcccagcagcagggagggcugggggacagaaggcuggggagauggcuguagggggggcggcgcgcaggucacaagagagggaccuguggguaggggagugguggcuaggagggccaugcccugucccccggccuggcuucagggucaggcauguuaacggauugaguguguacuugggaaacguguuacucucuuuaugucuauaaaauaugaagggaaagucuuuacaguucuucugcaggcuuuuuugagaaagcaaauguggucugcagaugccggugcccaggacaccagcugcccuguccugacugucacacuccucguggugggggcagcggggcugggggcccucuggaggcaagaaacagucccuaaagcaagaggaggaccaucccaagguccaccacuugaggcccuccugguuuaguuagacucgggcguaaacgcucugaagcagugucgagcccggcacgccagggcccagggcagcugggccuccaggcuggaggugagcaggggaccagagcccagcuccacaggcccccuccauggaggagcggcgggguuuguggcgcacagcaggguucccacaucagcuucccaaguccaaggguggagauuccgagggugaugauuuccuacagauuuggagaaaagggaaauccugccagccacccuuggacuucccgcccugcacuuggcccuugcaccugccugcucuuggcaggaggcgucaggguccccaggccgcuucagcugcgugugguucccuguguccgucugggcccugugaugggggccagggcugagggcagaggggccaggcuggcucagcccauaggaggccaccuugcccugcugccggggccccggcggggccucugccaccccaaacuggaaagcucgugaacccuggcuggccggauuauuuccauucuucugugcaaugcaauugaagcgcuugaauuauccccacagaacccagaacggaagcgaggaugaggccucagccguccuccuccccauucaaacacguucaucccucaacccucugcugagcaccugcaugcugcccggccgcagugucacccuucuugugugagccuacccucauccacccaccucacccuccugaccuuaaagaagacaccgggcagaagcacaggggagcccagucacaccccacacuggcgggggcaggccuugcagggagaagcaguaagcagccaucuccaucagccauuuccaucuggcacucagacgugcacgucuucgugugacaggcggcagcagugcgaccgugaccucccaucugcucugcuguccccacaccugcggugcagccagccugccacaaggcagcuagaguccagcuagacccaccccuggcacggccgaccucuuccuggcuucuucugggccuaauccccgugcauucuccaacgccagaaguguaagaaagugcaaggcaacaagugagaagagcaaacccaaaucguaccagggaagcuagucuuuccagggcaccugagugagggcaugaccagccuugacgcugccucgcuaccaucugcccagggccugcugaaugcuugaguccauggugacaguggugggaacaguuacgaggcaguuagauuuuggaagucauguuggcccacuuggcuacagagcagucuuaggaacagcaccauaaaaauaaagacuuauuccugacacacaugcaucuagaguaaacuggggcguaucugacagcguuaguacagugauggccaaaugcaaacugcauuccagaaccagcgaagggugacagacugggcugaggcagagcuaggacuaaccaucucgagugaugccaucucggggccaacaaaaguuuuggacacggcuggaucaucugaccaaacugcucaaaucuuuacacaauuauuguccugguauuaaacuuucaccugccacuuccaacaaacaggagacagaauaaggagaugaccaggaagauggcuggauuaagaauucuagacuuggccgggugcgguggcucacaccuguaauccuagcaucuugggaggcugaggcaggaggaucgcuugagcccaggaguuugagaccagccuaggcaacauaaggagaccccaucucuacaaaauaucaaaaaauuacccagguaugguggcacacacgugugauuccagcuacucgggaggcugagaugggaggaucacuugaacccaggagguuggggcuacaaugagcuaugaucgcaccacuucauuccagccuggaugacagguaagacucugucuuaaacagaaaauaauucuagauuuauuuucaaaaguaguuccuucugccuuccaaauacacccgcaguucacuguagcuguuuugggcccuccuggguuuggcuuccuguauaacugacagcaccuagcaaucaacacuuuaagaugacagaaauaccaaaguaccuaaaacaugcuaauaucuuauuuuaauacagaggucacucugcaugugucuaauucauccauucugauucuuucauuuagaacagcaagucuuagugucuuuuauuauuucucuuucuagaagacucacuccauaguucauggccccgugauccagagucccugcuggcgccuucgaguggggcaggcugagaacucaagcuguaacuaaugucuccuccgaagaaaacuaaaccgagggcugagcugaugugaaguuuuccguggcugcauucauacaaauggugaaaauguagcauaccuccccucaaaagccugaaaguaaagacaugcccccaauuuaaugugaugaauuagagaaauagguuucagacacuucaugguuuaaagucucacaaaauaaagcuuucgaaggauccaguuguauaugauuuuuuaaaaaaauaaauaaacauucuucugcuugguagcugcacauucuguugggauuccaguaacucgcugagcaggugugggaugcccuaaacucagaugcucacgagcugguuucaaccaaguaagaaaaaucucagguaaggccgggcgcaguggcucacgccuguaaucccagcacuuugggaggccaaggcaggcggaucacgaggucaggagaucgagaccauccuggcuaacauggugaaaccccaucucuacuaaaaauacaaaaauuagccgggcgugguggcgggcgccuguagucccagcuacucgggaggcugaggcgggagaauggcgugaacccgggaggcggagcuugcagugagccgagauugcgccacugcacuccagccuggacaacagagggagacuccaucucaaaaaaaaaaaaaaaaaaaaaaucucagguaaacagugugauuagcuaguucaugucccauguucauacucacuguagaaacuguguuauguguggucacaggcuuucaaugacgaaaggaggacucggaguuguauggaaacgugauccugaagcccugugcagacgugcagcugcccacaguggccacagacagcugaggcugugaggcgaccacagagcccacgcccuccugagccauauucuugaacagcccaucucaagugugacuggugagggggcuucaaguaacauggggugaaaaagacaaaacaauuccauaccaaccaguucaacccaaauguacaggacaaacuaagccaauuuaacagaagauaaacaagcgguauauucaagauaguuuuaauauuaacuuuugugaauuagaaauaucacucuuaaaugaugaaaauuacuagugaaguaacuauuuuccccaauugcagaauuacaauauuuauacauauaauacagaguugauugcauuggaaacaacaguuuauuuuacguaaaauaaacgucaacggguaaaaagggcaucuucacgccgcaccucagagggccaugaguccuuacacccaucugcaaaguaacuuuccaccagcauucaacuauuuuuaagugcaaacaauuuuuuaaaaucugugauugcagcgucugucuuccugaauuacauuacgucagaaaguaacaguuuucucuaugagugcauucaagguugucuucugaccaccuaagguauagaaaaaucagugcaaaaacagugaagcacuauaacagcugaauuucaggggauuucuuguccaagaaacauuuuauuuuacacuauguauauauguauauauuauauauauaugaaauuuaauuacauugaauuuuagaguaaaaagcaagaaaacuccauuucuuauuuuuuacugcagccccaaaagaccgguuuaaaauggaaacaacuucuuugggugagcagcgggagcacggcgccgcagagugagccggucaccguccacacggcuaucgccgacguccaccgccugagguccgccggcuggcacggcucaggcgcagcucggagcuccuccucgucacucccucgaguccaagucccgggagacugugcgcgcagcagugaggucgcuacacuacaguuccaccuggagaacuggccuggcuuggggaugacaaugagcccugcaaacaaagcagucuacauuaauccagcaaaacaccggacgggcaacagccaccaugcgcgcccuccgccagcagcuccacguggucaaaacuggugcuguugauguggaagccagugugggagcaaacccuccacuucaucuauuuaauuccuauccagaucacugcguuccauuccuagagaauuggaacccugcugggugcaauacuguggccucaauaccguccaagagaagggcgggcagggcuggccuugcccuugggggagacagugguuucucagcaccugagaacagguucuuuggagcuuugcugacccaaaggugcaggugccucgugggagguguucagcgccuucagccaggguugagcccagggcaccgcaguucuggaccgcacacccagucccucggagccagggguugucuccaaggauagaguucaguggcaccuuugaaagggcauucucugcugggggguucuugcuuuguuggguggugugaccguggcacccccuggcuguagcuguccacauguguaggccccacagguagagacagcagggcccaggccgaggucgggggagccccagaacaaaguagucuugccgugaggcugcagcuggguguggagaagggaugugggggccaacccaccagggccagcaggaagaaugguggggggcaucuggcucuuuagggcggcuccugcugagaggcucacugucgggggcgggggcggggaaucucacccagauuuuacaauacuggugugaccuuggguaaaccuaagaggguuuaaccuccuacacagcaaagaguacuuccauuucuuugcauuuacuauugagcagcaauuacauuacaucaaaguguggcguucauuuaugaagaacauuaagauggcgacagugcagccccaaaggugcacauuuucagcucugggaauacaacuuagcugucauggaagaaggcuucagcugaugaguacuguuuacaaaugacaagccuuuaacucaagcugacauugcuaccuucucacauauuggacuuguguggacacaaaugaaggugacaaucggaaacugcccuucagccucgcccacgcccugcugccggaagccuggaagcaagcugucccgcucaagucauuucaucccguuucuuaccuuccaccugaaaucuguucaccuagacaagcucaggaagcaaacggaauguggcagcugccccugcucagagucuauaggagugcuuuuccucugggaccccugaaaagggacagaacccuguuuguacuuguggaggaccccgcaaacgccccauacuucuggcucaaacacaucaagccuguggaggaaagcugggcagcagguuccugaccccacuucugccgcagacagucuggaggaaggaagccucucacacaggacacucugccuucaucaccacgcgcacccuaagaaagugcuuuccacaagcuaugugguguccaggaagugacaaaucuccagaaccaggaggcaccucccuuccccccggcaacagaaaagucaucuacuccuggcagagggagaaagugguggugacccagccuggggacagacggagaggggccacccucaucuggcagccacagagucucccuccccuuucacggagugccagguggaggugagugcugcuccagguaggaggcagccccacccacaggaagguggugucucuaccaguccuguguuaaguuuagcuucccgggagcacguuuaacaacuuaaaaacaagugacagccagcccugugggaggcugagguggggagauuacuugagcccaggagucugagaccagccuggccaacauggugaaacuccaucucuacuaauacaaaauuagccgggugugguggcgcacggcugucaucccagcuacucaggaggcuguguggcaggaggauggcuugagcccaggagaugcagggugcaaugagccgcgauccacugcacuccagccugggggauagagcaagacccugucucaaaaaaugaaaagauagauaauaaaaacaagugacauuaauuuuaauauuuucuuuuuuuuuuuuuuuuuugagacggagucucacuuuguuguccaggcuggagugcaguggcacgaucuuggcucacugcaagcuccaccuccuggguucaagugauucuccugccucagccucccaaguaccuuggacuacaggcgccugccaccacgcccagcuaacuuuuuguaguuuuaguagagaugggguuucacuguuaggauggucuugaagaccuccugaccucgugauccaccugccuuggccucccaaagugcugggauuacaggcgugagccaccgcaccuggccaauuuuaauauuuuaacugaagauguuucauauaauauucagcaauauaaaaauuacuaaugacuuuuuugguaagaagccuuugaggugugcugugugguugacacguuauggcacuuuucagguuggacuggccccaauuuacauacuuaguggcugcagguggcuucugacggccaugagggacagcacccuuccuuagacuuccucucacugagugugaggccccagaggacucggcugcuuuccaucacucccaggggagggcggcugcugagacgcagagguggcgcagccaccaggcugccagagccugauguugagggacacgcugcuuccgccagcuggucccuacaaagccgcaccccuagaaagcgacccaacgcgagggcugcaggcuuccuauucucccauuagcacaaaacaaaugcacacucauucuccaguuucugcuggcuaacgccuugaugccaauugugguggcagcuaggagccaacuagaaccaccuucaugcccuccacugucccacucuccacugggcccagcuuccagagagaucuugaaucaaccgcccucaaaccuguccuccucucgucuucuguaguccauacuggcauaacggaacuggggguucccguuagcaggcuucgcccuuuugauggcagcccugguuaacaguucuuuuagaaugcaucgccaugcagagaaugugcccaugaucaaaacucaggguccccaugcugcagcacucaggaagcacguuggccaccggugaaaaacccaagaggaccccagggugcuugaccagggacucccuggagcccgcccgucagagcaaaggggaaaacgguggucucuaagaggaguuaaccggaaggcgaagcgaaggcccaaagggcccggccuccaguucuccagcagugaccccagcaagccccaggagacaguccugcaggcacaagcccuggagugugcugggccugcuguggcccugcguuggcaucagugccaggcaugcccagaagcagggggugcgacacagcacuccggguggcagggaaggggccucggcgcccugcaugccgcugaggacuugugcgagucacuggacccuucaucuuggcaccugucacuugcuggagauggacucacuuugccguggugaacacuggaggcaacaggaggaaaaagcgccauucaaaagagaaucaaaugaaaaaagucaccuuguuucuaucugccugugauucagucuaaagauuaucaggugguagaagaggaagacgagaaacagacaccuaggcccccauggaaggaucccggcugcagcuucccucgagagcacagcgugggggauccacugcccaaauggucauccgugucaaacucccggugacagggacccugcugccccaauccgccugcucuucagggagggagugggguuuuacccuguccuucugcuuccuuuucaugggagaaaaggggcaaggcccggcccggccgacggaggaccuggcaaggggagcccgcccacgcuucaccugugcucagcagcgugcgggagcugcugggcugugcaccagaagcaggacagcuggcaauuccaggcuuuaccaguugccaucaggcaaaggagcuccccaggcagaaucugcacggcgucccaucagcccccacaccgugagaggaacggggcaagccuuggcucuaauauuagucagcugcuuggcuccccgcagagucacuguuuuauucccgcuagagacuucaguucaaaauuaagugauaaaaaaauacuccagcucuugguuuggguuugauucuaauuuauaauacuaaguuaagagaauuacaccuuguugcaccagaauauauaugaaaaauauuuugguucaaaacaauuuacaauaaagcagcaaggccauguuccugccccugcaggugcugcucggacuggagauucugacagccagauaggacugugagggccacaggccacgucagagaaaggacauguccugaagcucugucaggccuggacggucuccuagcucuggguucugggagggcuuccccuucugacccccacgaccccuggccugugagugucagagaagacagaaccucaaggagacagcugugggauguggaugagagugugggcugggcgccagcucaucccucauccaccugggacuguucaauacccucucuggucauucaacccccaaggucacccuuuccaacccaaacaaaaguaagacgcacacaggcccugggacccguuucauggcaggcacgcgggcgggcagacuagcgcuucucuccugagaucguggacaaaguaccacaagacagaaucugguucuacacagccacaacauccaggagcuuggugccagcuggccggcgugcuguggaggucaccuccacuggcgucccccagagggagaaggccagccuuggcccugcacguagccccugaggcuccaaugcuggccucuguggcaggugcuccuggcagaaucucacccuggggagaacacgaguuaaauguuauuugcaaagcgacaccuuuuuagagacggugcggaaacgaugagaacuaugaccaggcuagccugcucucagaaccaagacuuccagcucugaacacacuccuuaacugcucacgugcaagacucccaccauucucacuacacagaccacaacagaaaggaaccaaagcaaaccuggagaaagcagccaugguuuauucacggcacccgaagccagucucuacaucacacaagcggcacgugagccacagagccgggaacccugggcccagcccagggacgucgggacccaucucugccccagacuugccgugcaguuuggcuugggaccucaguuauagcugggcaguggaccacguaccucugccagcuuuaaccuguccacugacaggugacagugaggggccacacuugcccagaugccacucaaccuggcaucuaaugagaaaagccacccagagaaaaggauuguacucuucagacuuccggggaaagaccacgcagaugaagggcacgaccaucuaagggcuccgcugcgaucugaagguggaagaaaagcaucagagagaacgugugcaagucagugggccuucaucgugaucccguucacugauggagaccagcaccggcccgggcugucacuggaggcccucccgcuccugggacccacuuggcccugcaauccucucuacuguguggggcaggaagaagggaccccacuuagucuccauaaagccuuucuagcuugaguaacuucaaagaggauuuugcuuaugcugccccccaccuaaaaggggaggcugguuuuggaggccacugacccuggaaggggugguagggagcugagagccucuagaugguccauucgucuccagagaccccuggguucagaauccauuaauucugacaggcagccacacauggagaaauggcuauuuuuuuucuuuaagacagagucucgcucugucgcccaggcuggagugcaguggcgccaucucgacucauugcaaccuccaccuccuggguucaagugauuuucauggugccucagccuuccgaguagcugggacuacaggcgcccgccaccacgcccggcuaauuuuuguauuuuuaguacagauggggguuugccaugauggcugggcuggucucaaacuccugggcucaggugauccacccgccucggccucccaaagugcugggauuacaggcaugagccaccaugcccagcugagaacuagcuauuuuuauuuuuuugaagguacaaacuagcuauuuuuaaaagaccaaaaugucaugguuuucuuaaaaaaacaaaacuugcugucaacuuaauagucuuuagggcuuaaaaucuacucagugcuagccugggcaacauggcaagacccuguaccuacagaaauaaaaauacacaaaaauuagcugaguuugguggugugugccuauggucccaguuacucaagaggccuagaugggaggaucacugagcccaggaggucaaggcuucagugagccauguucgggcaacagagcgagacccugucucaaaaaacacaaaccaaaacgcccuguucagugcuaagaacagagcccugugcacucuuguggcagucguaggccccaggaggccgcuuuugagagcuguaggucugaauguucccuccgcuuugacagcccagacucaagacaaaaagugcagauaguucagcacuggaggcucugcugaccccgcacuccagagacagcaccgugggaagcuucugggaguuccccacccgaugaacgugcuggaggcagagcacagggcucagccggcugccaacaugcagaggcggcugagugggaccuggaugucucaugacacagcagggaagugacaauuaaaugggagcacaagggccugaggaagggcugugucugaggccagcucgcccucacucaucacaccucaggcagggggguaggccugcgggugccagggcgcugcucagaucagcuacgucgucugucaagagugagggaugguauuucauaguaagacaauguaaaucaugaguucuucucaucccaaauggaacgucccccacugcccuguguaggaagcgcucugcaccgacgacgggccuggugucuacagcaggacaaccucacgccagcacaaagccuuaagcaaacacuauucaagaugaggaguaggcagacaaugaacucuagccaggaaaagagcuccuacugaaagcagccuaccugggggcaaggggagggagagcauaaggaaaaauaccuaaugcaugcggggcuuaaaacauagaugacggguugaugggcgcaacaaaccaccguggcacaugcaucccuauguaacaaaccugcacguucagcacauauaucccagaacuuacagcaaaauaaaaaaaagcaagcagccuaccagccgcuaccuucuccacucucccagcugcuggcuggguggcuggacagaaugucggauguccagcauccgggauagugaguccauguaacaaaagccagcucguggcccaggacgacuucagaaugucugcauucucauuaaacagaagccucuacacagcucagccgaaacgccaaucaacaguccuucucccggacuggaguuggcacagaggaggaccacauaaaacaguaucugagacgcagaacauuucaucgaguacgcugccaacuaugagaaacagucagcuuuaguaagagggagcaauuccgguggcuggcuguucuauaaacauuaacaagguccuuaauuuuacagcauuuaaaaacuuuucugguuuugguucacugggauuuuuaaagcuuagaugugaaaaugacuacugaaaauuaucuacauuuacaguucacucacacacguuuauuuaaugucaguauacagaggacagccccacaguacuucagaauaucaaguauguaguaagucuuguuagcugugacagugacaaggcaacagcuaaaaaaaaaaacaaagcagugaaacaaacaugauuuccuuaaaauuauaaaacaauacugauacuaaaguuucauuaauuauugcaacaguaaagaauuuaauuuaccaauauuucauguuaggaaggcucuuuaugaaauuuauucaaguugucaagaaauuggaugaaaauauaaaaaaggaaauacaugugaauuuuacuuuugauuuucacucaaaauauccauacaauuuuauacagugucgccuaacauaacaaucucuaauaaacucaaguauacagaaaugauaaaaaugcaggaaauuuuuuacacuuucaaaugaaaggauagcaauuuaugacacgaaguucguguaacagaugcggaaaugaauaaagaaaucaacaucagugagacagucucccucuacuggaggggcacguucuuauaguucguaacuaggaucugaguuucaaagguaacaguugcauacgagugcuuuuacauauaaagccacagacuucacuucggccagacuaaugucuccucccuuugggacaucacuuggggucgcugugaugugcaccuuguuaacuuaaagcaacacccgacagucccaaucagcccguggcgaagggugugcuccagacaagggggggcccugcaggcugcugccagggugguagacuauaaaccuucaccuuugucacccagaccagaccggaggaggcgucuccaggucacccgaccccuacccacgcauguggagguucucacugcuaaggaacgaaaccucagccaagggcacaccgaccgccgccauggugcaaccccgcagucagaggccagucccucccccauccaccggcaccggaggcagggcagggccaccggaucccccgccaugcccucacccacaaagcuggacgccagacgcuguguuccaugaaucguuccccagaaaauccacuggugaacugcuucuaguucuuccgugggcagucagacacgcaugauguggcgcuuggguuuccguggaucccuucuccagccgcccccaaccccuagguuuucuccgccucacacuuugagcucgcucaacaaagaaagaaaacgucucccucccaggcgagaggugaugaggaccuuguaugcaggcaacuucagcacucauuucauacuuuacaauuuauuauuuaaaaugaaccccaggaaguggaggaacuggggagaaauggcugccuggccacgugccagcugggcccugggggugaagucagccaguggagagcccugggccccgcccggacgguguccuugccccuaaaaucccauccugucacugcauuucuuccucagaauuccugaacgccuuugagaaaagaaugauugugauagcuccuuucugauuuuccaugccuccauuuuuaaggcauuuacccucaguccccagcuaaggguucacaggaaaacacuuccaaacugcuagaagguucaaucagcacaaaagagaaaugagauccuuuaccaugauuuaagcaaauuucgaccccaaggcuacugguuauuuguaaagugucuacuccugcacaugcauuugcuuuuaaaagaaggcaagcuuuuccaaagguucccuucuccaggccgcugggggaauuuuuaauucuccuucugaauaagaaaaaagccucagagaaaggcuccagggccaccaguaguguuuagaagccugccccaucgcagucacagcacaaaucuggcuucuugaauucuggugaaaaaggccaacccaaggagggcgaguugaagcuccccuggcccuggccuggcaccuucagaaggugucugacaccgcccagggaccagcucgcccccuugccgggugggagcgggauucuccagccacgcagcgugcaccugacuuucgucugagccuuucaucucugugguuugguacacgcuggaacagugaugcugacugaguauuuaacagccucuucuugccaaaugcuguguuuuauuccacagauuagguuagaaaagauauucuugcucauaauaacguuuaggcugaaagacugaaaaauuucaaugaggaagcucaaaguuuggcgagaaaacuacaaauauuuuccccaaauuucuccuaggguuagcagcacgcauugcaccuuacacaccugauaucaggaaccaccgcggccaccccuccccaggcccuccccaggucugcgggagccauuacucagaagcacagccgaggagaagggcgcuucccugccccucucuccagugcccucuucucaagcuguugggcacuuuuaguucuggucuuggagaacaccuugcauccuguccuccugccugcagaagugcucugccggcugucaaagaaaggggcagcagucagaggggcagaguggacacagaguggugucgcccugcagggccugggccagccugggcugagccaggggucaggacaugcagucaaaggcagccccuccccaggcuggcacagugcucuccacugggcccugaacccagcaagaggggccuuggggagggcacguagacacaacgaaggggccccagacaagguaccagacagacauuaaggacaguacacuccuuggcaaaaacuggaagaaaaagauuguuaucaagccucaaauccaaaacugacaauaucauaguguuuaaaacuggagguggggggagaaagacacacacaggccuccauacuagacagcacacuucggaguuguuuucaaaggaaacauaaccuccuccucuugccucucccaccccugguuccuaucagcaaaugacuccuaagucaccugucaguguaccccugcaaucccucuuucaucccagccacugcgacugagaauuuuaaagaagggggagaaaucagagaguccccagucggucacguugguuacucgggcacacacccccacggcuucccuguccagggcaacaccuucagaacugcaaggucgccagaaaugucaccauaaaugcuacuuacuugggaucggccacucucuauuuaggccaaauacuaaguccugaauuuugaaacugcauacucaaugccucagaagcauuugaaacugaacguuuacaacuauguaggugcaaaaguugcacauggagcguucaucacuaaucucuccacaugacccaauuuggccuccaaagcggaaacuguccacaaggauggcugucauggcuaccuuagaucaguucaccuuuaggaacaaaggcccguauuccacagguagagaggacacgaauacuccuaggagcagugcucagggaugugaaaggcacagccaggagagaugcaccugaaggcugcugugguucccagguggcagcacgcggccaugccaucacacucaacagaaaccacugcguuaaggcccacgaugggcacaggguggauggcgccaccgugacauguuugcagaugggaagcaggccugggaaccuggcccggcuuuccugggagggcugcguuaagagcacagggagcugcugcuucagcuaccagggucuuuacacugcagagaaagaaaagccaccaggucuucacuuugcugaaucauauucacuacgcaaacuggucuaagugaucguugucucuauauuuaauuacaaagguguacaaccuaaaugcccaaaaugaguuaacaaguaagauaaccaccaucuugacauggaauacauaguucaaggggccaucucacccacugggaaaaccagaauuugaaaagcagcuccuggugcagcaguagagagugagggugaaagacugcggucuccgggggagcagcagagccucccacugccgaggaagccacaggccaccagguccugggcugaggcgcuagggugggagccacugaggacgaagccuacgcacauggccagcgucagcaucccaagaguaaucccggaaccacagcugccauccaagaacaaggagaggggaaaccugcacuuccgcuuccucugcgggggacgaagcccaaacgagggccaugucagggagaagucggaagacucggggagucucaggcuuuacgaaacaaagcgcggaggagucacgugccuuucugacccaaucccccucccccaccgcaccuccccgcccccggcaaaaaaccaaaaaacuccuuuucccuuguugggaaaacacacaagcaaagugcaucugaagaaaaggucuucgcuuauguggcaagaggcacuucugcaaugcuguuggcguccucggcccgcaguucccacgaacugucaggcucugagugagguacggguaucuuaguacacagaaccucaaucaaagugcuacaaacugcuucuuugaaaaaagauguuuauuaaacaacuuuaauugucauaaaaugacuaaaauggguuuuaaaaauuaaggcucuucucuuucuguggauugccagaacaauguaaaaauaauaucaaucaacccugcuaaacguuuuguuccuaaaguuaaauuucauagauuccuaaacauuuuaugauuaagauaaaaaauuggacuauaaaugacaauucauggccaucugugcugaacacacauugaucagguguacaauauucuaauugaguaguuaagcaaaaaauauuccaguuaaagcauaaauuuuaauuucagcauuuuaaagucauuguuuccccacauggucaugauuuuccuaaaauugaaauagucuaauacaggagcgcuaaccuugggacucuauauacucccaggaggaugacugacuuggcuggcaauuaguuugauuauauuuuuuuaaaugcucuaagguaaauuaucaaaugauucagaauuacauggcaugcaguauccaaaauuauggcucugaugcauugagauuuacauuaagaauaagaagugucauucacauucauuguacaccccaccccucccacgaaaaagaaaaaagucacuaccuauucaaguucuagaucuggugcagcauuaaggauuaaaacuuaccacuuuaccaggccuuccccaugugcaaauaaaucccuccugacaagcagugacuauacagucuucaagaaauauuaguacagucagucucucaugugcuaucuuuuuacauaucagcggcucuaacaagggaacaucuuccauucgaggacacaggggcguucccagaguuuuagcaggguccguuuugguuuugguaacuagauucaguuugucacugcucuugcuagaaaugugucccaugcuaugauuucgcuugugaucuuucucguggugccucuccuuccggucauguagugaaaguguugcaaauuugcugaccccagaagcaauggccccguccaugacacugcuuuugcugccagcauuugagacugcugaauguggaaggcuguuggaccguggcagaggaggcggcacagaguucccggguguuguaacacuguucccauugcuuccagcaggaggacucguggcauucaugacauuuguguguguccuugcucuugagagggguuggugagggaaaaggauaucuucuguaaggucccauaaacagagcuguguguccuggcccacggaaccaaaccgauacgugacacuuacggggcggcugucuguagaguuccguuuggagagccuggacuguguacuauuugcucgaucucugccaaaaugaagaaggucuuggaaguccucaucgcugccacuaaacuccauagggucaccuucuucuacacuagugguauaagggucaaacgcuacaacacugacccaggacuugugcccguggccucuggcuauuacucggcagucuacaaaggaccagacugucaccaagucguccuccccaccugucacgauguacuugccauccgggcuccagcacacacacagcaagcccccaaaguagcuuuucaucguaccgugcagcuccacugagucaaaguugaacacccgcagaaacccguccuggcucacgcacgcuaagaacuugccaucuggggagaaagcaaacucguugagggcccccucgcccaccguccacuuaaggagaggguuccucguggauuugcucuugcaagugugcacggcaaagcucucucccugcuucagaagcugguaguggggggcuguggugccacaagugugcuccacauuauauaaguacauguucccacucgagugggcuacuaggaaaaggcuuuccgaaccgggaacccauuugacacagguaacucgugacuugucuauuagucucugugaagacaaaggagaacaaguuagcacaacggagaagucucaaaggucuacuuuuccagcaagaaaacuugugugcuucucgaugggaaggggcaagucuauccaggcccuccacauuuuauccugcagucagccaagccagcaaggagcguuuuggcccuuuugggguaauuuagaauuacuuucuaaaaucgguguuaggcugcuggcuuucacggagggagucaggcagccaacagauauuugcagaggggccacuaagugccagacacgaugccaggcacaggguucacugcggagggaacagcccugcugggaucuuucuuccuugacaguaggugcaucugaaucugggggucacugcaucugcaugugguauccccucuacgaggaccugcaggugaagccugugaguccucacagccaggagggcucugccucacccucacggguuccucugccuuuacugucacuguagguaaugggcugguuccaucugccccucugcucuggcggcucgaagguggggagugaaauccacaguccauggcuggcagcacacacaacuccaaaacagagccugggcccacugaggccgccucacucccaugcaccgccccacgugcaucuccauaagcaucuccucgaaacccucucugcugguguugagagagauacacugacgauucauucgggagugugugucucauuaccaucacucugcuccauaugcuaacuuuggaccccugaccgagauguuucuuuaacaggcguaugucaguagucuugccuuuaaaacccaaauaacgaagggcaaaaauaccugccccaccaaaggcacaagucucuuucccugcuugccaaucaauccugugauggggaugccagcgcaacaccuuccacaggggcggucccuuucuggaccgucugagcgcaaaaucgcaucaccagaacacauccagaagucccaagacucccaaguucuaccuagaagcuccuacugccaagugcucuccacugcaccaucgccccaguaacagugucccuuuaggagcccagcagccccagguaaguugaacaccaccgcuucaccuaacagguggggagucccugacucaagucucagagggguacugggcacacaggggcagaaucugccaagaaacaugccgacuucugccaggguggcuuugaggcc

SEQ ID NO: 17166 - RNA, 4267 nt, Homo sapiens
uaggcccaccuaacacaccacacacuucccagaaacaggagucacauccuuuucagggcugguaggguggcugaagauggcccaaaaccuccugaauggaaaaaccuugauggggagacugagggccaaggcagagguuuguccaaggucacccccagaguggcggauccaggacccugggcaagaucuuccuacuguccaggccucucccccaccucucuuguguggcccagcacccuggacuccuccaugcccaggugugcuccccccaggcacgcugggggcagggugggcagcaggugccccccaccaggauagugguucuuccuccugcagaccuucagcccucugcuccuggcaggacacuguggcccuccugcccacguuggugcggguugaauuugacggcccagcagaauucccaggcagggcagccuggcuauccucccuggugucucggcucugagagcggagacccagccucccagccuggaguuguggugaauucgcaaacaagucuccaucuccagaaccuuccugaagaaaacagcucuccaggcuggggcaagaagccugucccuacagugauacaaccaccccucaauaaccccgggcaccaccuggcacccacugggggccaccagggagcccaccaagcccacuccgggcuuggacagagggcaggccuggaggaaggcacauccaaccccacugaccggcaugcaccuggggccaggggccugcugccacugcagaggugagaagcaggagcagcaagaccuggugcccauuagucaugggggaaaagcaaaagggggagacagggacaaauccaggccugggugggcugccugucagggggagugauauccaaggaggaacugguggucagaguggggugggggauacccgguacaauuuguucaugccucaacaccagccaccgcgggccugccagcccugugugcccucccuggcccggaguccacagggugcaaaaggcugaccgcacaggaccucccgugagaacccuacgcugcagagcucguucucuuggcuuccaggccuuuuuauacgcuguccugcugcuuggacaugccaguccccaccccugcaccuaccgagcuccugcggcacucagcugucacccaucugggacgcacaccuguccgaggcucuagaucaaggugggagguuaguccucacucccuucaggggcuggacagcgagcugaaggcccgagcccagcugcacccagaaaaccugccacuuggaacucaccugaccauccaagcccagcccccagugcaugcgacagaugaggcagagauugugccguacagagaucaauauauauaaagugccgguacaacgcucugaaaaauaguuuugucccaaaauccagcgccuagggugcuccgggccuagccuuugccagugagguccaacggcugcaggaaugggggcagcggcagcucguccagggccucggggaagcggccuggagagauggcggugaccagcaccugcauggcgcgcgcgaagagcgagggcggcgccaggcccgccagccacuggaacuuguccucacccagcagccgcugccagcgcggccggucgcccagcagcuccuggcgggccgagccggcggcacccacggggguguacagcgccaggagguccagcagcagcaggcggcgcuggcgcggcuccccgggagcugaggcgggggcuccggcggcggagggaguggccccggcgucgcggcccagcuggcgcagcagcagcucgagaggcgugaggccgccgccgucccgcagaccgggcgaggcgccguggcccagcagcaggaagaggcacucggggcgcgccagcucacaggccacgugcagcgacgugccaccgcccuccacgcggcugcagccacgccgguccagcacgcgcgcccgcuccucggccgggaagucgcgcaaggugcgcaggaugcggcgcagaaugcccacgcgguuguagcgcacugccagcgccacgugcggcccgggagccgcgcagcagcggaagccggcacugggcggugcgagcgcgcgccgcgggaacguggccagcagguaaugcgcguacgcuugguggucgugcacgagcgcguagagcagcgccucagagggcgaguaggcggcggcgcgcccgcgcucgucccaguggaaggccucgcuggcgcgcauauccuccagcagccacacggguagcaggucgcgcaccgccugguagaaggcgaacgacgacuugcggcacugcuucugcgcucgcgagcgcgccgcgcccgaggccucgggcccgccguccgcgccacccccaggccgccgcgcgucccacggcaugcuggcggcggggcguuccugggccucaaggcauggaucccgcgaaggcacaccugcggggaaaggaagaggccacggugaggcgcggggaaacuggggaggcccggggacuccccucugccccucacacagccccuccgguccuggcccaccaggccuguaccuaccuccagccucggccaggcccuuccagucacccuacagcuccaucucuccgacgcccagaaccaccgccuccauccuugaucuagcuguaccuguucucccuccuugaaacugacuugcucucuggcaccucugcuggaaaugcccuugcugcccaugcccucaaaucuccccuccccucuccaacccagggacccacuggaagagcuucuguucccaccuaagccagguucauacgaccccaaauaaagaaaaggccagggaggggaugagaaagcuugggcccacaucucaagcugaggcaaauccacucuccagcccaagcgcaacccugacccugaucuccgaccccagaccacuuggaggccccuggagccucuuccugggcuguucagaggcaugauccagacucagaccuaccugguuccugcaccgcgaucaccuaguuccggggauguggguauaucacagucccuggccgagccucagcuuuaucuguaagaaaggggagggguggacgacggcugugcgggcggggugagccuggggcguggcaccagcccucuauccaaacauguuugcuuacacguuagcuccugggaggagauaggagggugaaaacaaccuggagaccggugugcaccgcacugcacagucugccauccucuucaggucccauaccucucuugaucuccccgacuacuagaugaagcggguacugccaucccacuuuccagcagggcacaagcuucuccaauucuccaaggucagcaagccacggcagagccaggccuagaacucagguccccugcgucucaguuugggcucauuccagaauugguggggacccccaacccacaggcaaucgagcuuaggcccugacccugcccucugaguccccagccccgaccugagccuaggcgucugaccucuggcuccgucccaaccucccuacugccuucuuucaaggguaagcccuuggucacaaggggccugggacagaaggcaggccgcguccacacacacugacugggucacuaucacuggcaguaacugaguuaaagagagcggcgcggugcggguaggcuguggcccgugggcaacaccgugacuggagccccuuccccaagccugggccuccgggccccagauaugcccugugccggcacgcguggggcgccgggcggguuacguaaaguucggccuccccacgucaccgggcagagucacggccgcggcucgugaauaaggggguugggccaucgaaggcagcgccgcgcccggggccacccgccaccuccuacccguccccucccggccugcacggccagacgucgggcggcggagggucgcggggccgagcggggcguccgcgcgcagguggccggcgcagcgagggcugcaccugcgugcgcgugugccggaggaggagggggcggcggccgcgggcgcggcgcgggggacggggacucaccauggggggcgcgggggccacaggccgggcguccccgccccugccgcggaccggagcgcgcgcugucccccgcgggcgagcgggcaaaggucccacgacggacgcacgggagggagccaccgccgcccgcgcccgccgcagccgcgcucugagccgccgcggccggaucgcagggcggcggugccgucgccggcggcgggcggcgggcggcgggcggcgggcggcgcagugcggccccggccaggcagga

SEQ ID NO: 17167 - RNA, 4267 nt, Homo sapiens
uccugccuggccggggccgcacugcgccgcccgccgcccgccgcccgccgcccgccgccggcgacggcaccgccgcccugcgauccggccgcggcggcucagagcgcggcugcggcgggcgcgggcggcgguggcucccucccgugcguccgucgugggaccuuugcccgcucgcccgcgggggacagcgcgcgcuccgguccgcggcaggggcggggacgcccggccuguggcccccgcgccccccauggugaguccccgucccccgcgccgcgcccgcggccgccgcccccuccuccuccggcacacgcgcacgcaggugcagcccucgcugcgccggccaccugcgcgcggacgccccgcucggccccgcgacccuccgccgcccgacgucuggccgugcaggccgggaggggacggguaggagguggcggguggccccgggcgcggcgcugccuucgauggcccaacccccuuauucacgagccgcggccgugacucugcccggugacguggggaggccgaacuuuacguaacccgcccggcgccccacgcgugccggcacagggcauaucuggggcccggaggcccaggcuuggggaaggggcuccagucacgguguugcccacgggccacagccuacccgcaccgcgccgcucucuuuaacucaguuacugccagugauagugacccagucaguguguguggacgcggccugccuucugucccaggccccuugugaccaagggcuuacccuugaaagaaggcaguagggagguugggacggagccagaggucagacgccuaggcucaggucggggcuggggacucagagggcagggucagggccuaagcucgauugccuguggguuggggguccccaccaauucuggaaugagcccaaacugagacgcaggggaccugaguucuaggccuggcucugccguggcuugcugaccuuggagaauuggagaagcuugugcccugcuggaaagugggauggcaguacccgcuucaucuaguagucggggagaucaagagagguaugggaccugaagaggauggcagacugugcagugcggugcacaccggucuccagguuguuuucacccuccuaucuccucccaggagcuaacguguaagcaaacauguuuggauagagggcuggugccacgccccaggcucaccccgcccgcacagccgucguccaccccuccccuuucuuacagauaaagcugaggcucggccagggacugugauauacccacauccccggaacuaggugaucgcggugcaggaaccagguaggucugagucuggaucaugccucugaacagcccaggaagaggcuccaggggccuccaaguggucuggggucggagaucagggucaggguugcgcuugggcuggagaguggauuugccucagcuugagaugugggcccaagcuuucucauccccucccuggccuuuucuuuauuuggggucguaugaaccuggcuuaggugggaacagaagcucuuccagugggucccuggguuggagaggggaggggagauuugagggcaugggcagcaagggcauuuccagcagaggugccagagagcaagucaguuucaaggagggagaacagguacagcuagaucaaggauggaggcggugguucugggcgucggagagauggagcuguagggugacuggaagggccuggccgaggcuggagguagguacaggccuggugggccaggaccggaggggcugugugaggggcagaggggaguccccgggccuccccaguuuccccgcgccucaccguggccucuuccuuuccccgcaggugugccuucgcgggauccaugccuugaggcccaggaacgccccgccgccagcaugccgugggacgcgcggcggccuggggguggcgcggacggcgggcccgaggccucgggcgcggcgcgcucgcgagcgcagaagcagugccgcaagucgucguucgccuucuaccaggcggugcgcgaccugcuacccguguggcugcuggaggauaugcgcgccagcgaggccuuccacugggacgagcgcgggcgcgccgccgccuacucgcccucugaggcgcugcucuacgcgcucgugcacgaccaccaagcguacgcgcauuaccugcuggccacguucccgcggcgcgcgcucgcaccgcccagugccggcuuccgcugcugcgcggcucccgggccgcacguggcgcuggcagugcgcuacaaccgcgugggcauucugcgccgcauccugcgcaccuugcgcgacuucccggccgaggagcgggcgcgcgugcuggaccggcguggcugcagccgcguggagggcgguggcacgucgcugcacguggccugugagcuggcgcgccccgagugccucuuccugcugcugggccacggcgccucgcccggucugcgggacggcggcggccucacgccucucgagcugcugcugcgccagcugggccgcgacgccggggccacucccuccgccgccggagcccccgccucagcucccggggagccgcgccagcgccgccugcugcugcuggaccuccuggcgcuguacacccccgugggugccgccggcucggcccgccaggagcugcugggcgaccggccgcgcuggcagcggcugcugggugaggacaaguuccaguggcuggcgggccuggcgccgcccucgcucuucgcgcgcgccaugcaggugcuggucaccgccaucucuccaggccgcuuccccgaggcccuggacgagcugccgcugcccccauuccugcagccguuggaccucacuggcaaaggcuaggcccggagcacccuaggcgcuggauuuugggacaaaacuauuuuucagagcguuguaccggcacuuuauauauauugaucucuguacggcacaaucucugccucaucugucgcaugcacugggggcugggcuuggauggucaggugaguuccaaguggcagguuuucugggugcagcugggcucgggccuucagcucgcuguccagccccugaagggagugaggacuaaccucccaccuugaucuagagccucggacaggugugcgucccagaugggugacagcugagugccgcaggagcucgguaggugcagggguggggacuggcauguccaagcagcaggacagcguauaaaaaggccuggaagccaagagaacgagcucugcagcguaggguucucacgggagguccugugcggucagccuuuugcacccuguggacuccgggccagggagggcacacagggcuggcaggcccgcgguggcugguguugaggcaugaacaaauuguaccggguaucccccaccccacucugaccaccaguuccuccuuggauaucacucccccugacaggcagcccacccaggccuggauuugucccugucucccccuuuugcuuuucccccaugacuaaugggcaccaggucuugcugcuccugcuucucaccucugcaguggcagcaggccccuggccccaggugcaugccggucagugggguuggaugugccuuccuccaggccugcccucuguccaagcccggagugggcuuggugggcucccugguggcccccagugggugccagguggugcccgggguuauugaggggugguuguaucacuguagggacaggcuucuugccccagccuggagagcuguuuucuucaggaagguucuggagauggagacuuguuugcgaauucaccacaacuccaggcugggaggcugggucuccgcucucagagccgagacaccagggaggauagccaggcugcccugccugggaauucugcugggccgucaaauucaacccgcaccaacgugggcaggagggccacaguguccugccaggagcagagggcugaaggucugcaggaggaagaaccacuauccugguggggggcaccugcugcccacccugcccccagcgugccuggggggagcacaccugggcauggaggaguccagggugcugggccacacaagagaggugggggagaggccuggacaguaggaagaucuugcccaggguccuggauccgccacucugggggugaccuuggacaaaccucugccuuggcccucagucuccccaucaagguuuuuccauucaggagguuuugggccaucuucagccacccuaccagcccugaaaaggaugugacuccuguuucugggaagugugugguguguuaggugggccua

SEQ ID NO: 17168 - RNA, 28127 nt, Homo sapiens
cagagggaacagcaggugccagggcugugaggagcgaaucagcgugggugcacuaagacuuccuggaggccagugugcuggagcaggugaucgaggggaagcacagggccugaggugaccaucacgguccccauggcucuuccggggacuccaccacugcgagcagcucagccaaagcugcccuuugggaacagcagugacguggccagagccaccuuggcacacagaccaugcuccgugagugccacgugccguuuucucuccacugguuccgaaguggaguuuuuaaaaaaggacuagagauguuucuauggcauuuggaauugacauugaacaaaccuaauauguauccauuuaaaaacuagaucagcacuuugagaggccgacgcaggcggaucacuggggucaggagcucgagaccagccuggccagcauggugaaaccccgucucuauuaaaaauacaaaaauuagccaggcgugguggcaggcaucuguaaucccagcuacuugggaggcugaggcaggagaaucacuugaacccaggagguggaggcugcaguaagccaagaucacaccacugcacuccagccugggugacagagggagacuccgucuaaacaacaacaacaucaagccaggcacaguggcucacaccuguaauucuagcacuuugggaggcagaggcgggcagaucauuugaagccaggaguucgagaucacccugaccaccauggcaaaaucccccaucucuacuaaaaaaaaaaaaaaauaggugugguggcgcacaugggagguggagguugcagugagccaagaucgugccacugcacuccagccugggaaacagagugagacccugucucaaauaaacaaaccagaucaauaggcccugccuauugggcacccaccaucacuucuguggcagccaccagaugaagggcgaugccccaucgcccccuugcucugccucaggggcggaggcaccuaaugguuuccaguguuugguguuauuccucuugaagagucccagauguggggucacuggguugagagggauucgccucuguuuugagcacucaggacgcuuguguuaucaguugcuguccacagcugcgugccgauuuucacucccccagcucccacuugcuggaaccgagagucaacuguggucuguucaugacacaagauaaugucccauggugguucaaauuugccugauguucaacagauguuuauuggcuggaagaaagugaagaucaaauaugagguaguuuugauagaauacaagcugucaaucaaacuuuacagugggugccccaucucagacuaaaguccugucaggacccaaaaggccauggauguccggcuccccaugccccuaccccacccucgugucuauccuucacgccucucucccugcgcaugggcugcaggcacauuggccucgcggagugcucaccgacuacggggccucuggccgggccguucccucugccugggugcucuccccgcugguccuguggguccgccuccuucucucgggucuacauucacaggacaccuccucugccgccuucccuggccucucccuccaagccuccgcucucccuccccugccacuacuuucucuguagcucucauagauucacguguggugaucuguucuaucuccacccacgagaaaguaagcuccgaaaggccaggcaugcaguugguuuugugcugguggacagcugggggguggggcaugcccagcaagcagcucuggacugaauaagcacggggaaggugggaggggucgcuuccgucccgcagccugugacccugcagacuuguccucagccucgggggaugagggaggguaccgcaucugccccuguucauggugggaugcauagugcaauguugacaaauuagauaauuucuguacuuuucaaacauuuuguuucauuaauccaagacuuaauuuggacccaauaauuuccccccuccuaauuuccagugugcagggaggaccagggcucacuuccuuggcuguugccacaugcgacgaguugggcccuccaagggcccaccaaccacuggcuuugcuggcugaguggagcaggcugcugagggcuggggcugaguugcucgggauuagguugggguugggggccacagaggggccauucugagccugcaggucggggacagugaugagacagagcggugcggccucugagugggauuuuaaggaaggcaugagguguucacagugggcuucgugaguuuugcuucaucccgauccucuucccggucucccaugaugccuucagcagaagaugcuuuuucuuaggaguaugauggaguuggaucuauuuugagaaggcauuaaaggucgaggugggccaggugcgguggcucacgccuguaaucccagcacuuuggcaggccgaggugaguggaucaccugaggugaggaguuugagaccagccugaccaacauggugaauccccgucucuacuaaaaaaauacaaaaauuagccaggcgugguggcgggcaccuguaaucccagcuacucaagaggcugaggcaggagaauggccugaaccugggaggcugagguugcagugagccgagaucaugccauugcacuccaguccgggcaacagagcgagacuccgucucaaaaauaaaggaaagaaagaaaggagggaaggaaaggaaggaaggaaggaaggaaagaaggaaggaaggaaggaaggucggucgagaugggcgugaggcuccaggcaaagcugccuguaggaugccagccacguccaagauucauguucucccaaaagauuucgggaaaaugccagagaugugugugugugugcgugugcgugcauacaaaucccagaauggguucccuaaaaugaggauggcugggggcaguggcucacgccuguaaucccagcacuuugggaggcugagaaaugaggaucauuugagcccaagaauuccagaccagccugggcaauguagagggaccgucucuacaaaaaaaaaaaguaguugggcauauggugacacacauggugacacacacuuguguuuucagcuauucaggagggugaagagggaggacugccugagccugggaggucaagucuacagugagcuaugauugcaccacugcacuccaaccugagugacagagugagacccugucccagaaaaaaaaaaaaaggguaucuucaucuccccgagugguccacggagaaaaucagagcugguuuucuucuaauugauuguuauuauuauuauuuuugagacagagucuggcucugucacccaggcuggagugugguggcacaaucuuggcccacugcaaccuccgccucccauguucaagcgauucuccugccgcagccucccaaguagcugggauuacaggcgcgggccaccacgcccagcucauuuuuuguauuuuuaguagagacgagguuucaccauguuagucaggcugguuuugaacuccugaccucaagugaacugcccgccugggccucgcaaagugcuaggauuacaggcaugagcuacagugcccggccucugauuaauuauuuuuauuuugauuuuuuuguagagacgagaucucaucguguugcccaggcuggucucaaacuccuggccucaagcgauccuccugccucagccucccaaagugcagggauuacaggugugagccagcuagcccgcuagaacuguuuuucuguggccggggaccccagccucucaccuucccugucaucacugcccucuccuccccucucgaauaucccgcgugagggguuugcacacccacgcccaucucgaccuuccuuccuucuuuccuuccuucccuccuuuccuuccuucccuccuuucuuucuuuccuuuauuuuugagacggagucucacucuguugcccaggcuggagugcaauggcgugaucucggcucacuacaaccucagccucccagguucaggccauucuccugccucagccucuugaguagcugggauuacaggugcccgccaccaugccuggcuugcucugccuccccacccccauuuccucugcauuuguuuacaagcaucccuggcccgagaagggcaccagcagcuugcuucuuugcuggcgaccucugcugucagccagggucuacuucaaggacaggaugggcuucccagcccagcugccccacugugcacucacgacagagcggggugcuuuggcgccacgaccaccccagcucccugaacccccuucgacaucuucagcagcucuuucagucuaaaaugguguuuucaaacuucaggucaugaaucaaaaguaagcuuaaaggguaauggccaccauuaaaaaauaaacagaacggaaaauaucggagugcgccgcagguuugagaugaucuguuguuacguguguguacacacacagguuaugaacaacuggguuaccauguaaaauguauucaaagguucagaagccacuuguuggaacaauuaguaaaacugugauucugccgugcaucaggguccgccccccgaggcugggcaccauggcucacaccuguaaucccagcacuuugggagguugaggugggcggaucaccugaggugaggaguucaagaccagccuggcuaacauggugaaacccuguuucuuuuuuuuuuuuuuuuugagagggagucucgcucuuucacccaggccggacucuuuugcccaggcuggacugcaguggcgcuaucucuaucucugcucacugcaagcuccgccucccggguucaggccauucuccucccucagccucccgaguagcuaggaccacaggcgcccgccaccgcaccuggcuaauuuuuuguauuuuuagaagagacgggguuucacuguguuagccaggauggucucgaucuccugaccucgugauucgcccgccucggccucccaaagugcugggaugacaggcgugagccaccgcgccuggcugugaaaccccguuucuacuaaaaauacaaaaaauuagccaggcaugguggugugugccuguaauuccagcuacucaggaggcugaagcaggagaauggcuugaaccugggaggugcagguugcagugagcugagaucgcgccauugcaugccagcuuggacaacaagagugaaacuccgucucaaaauaaaauaaaacaaaacaaaucaaaaccaagguccccaccccccacccccaggccacguguagcauguuugagugagagaaguugccagcacccuucagcccaaguugacccacaggggccagugguuuuugugugggaaggcgccaccugaggcacagaccaucacauucagggagaguuauaagaaaaccccuuuccuagccccaaagccccuggcacucugccacgaauaccuuuuccuucucacugaaagacaaacaggauggccuucugagcuguugcaugucugugagucacuugaguaucugcaugcacuucuccaaaaaugcagcaagcagaacauguaaugcuacaucaacuccugugagaaaugcguccaaagauggugucgguuuguuguuggacguugccauagggaacagagaucugccuuugaaguacagcgaggagagagcucuccuuccugcccaucacugcugcccuguggcucuaacugcaggggcgagaacacccgccaccaacccccaaagcaguugcccugcuuggggcaaacuucuuuguccugucccccuucaauuccccacagcagaggaucuucagaacugcucaauuggagaagaaaaaggaggaggaggggagggagagaaagggagggaauaggucucaccagcagagggcucagccugguugugccugacuucauucucaauguugcuuucuaaugcuaggcuggagcaugaaaagagccgcagaaaacccucucaugggucuuuggaccuucugccuugcuucuucuuuucuuuucuuuaauuauuuauuuauuuuuauuuuuuugagacagggucucgcucuguugcccagacuggaguccaguggugccaucauggcucacagcagcuucaaccucauggacucaagcgauccucccgccucagccucccaaagugcugggaccacaggcauaagccaccauccuacuuuuuuuuuuuuuuuccagacagagucucacucugucgcccagauaggaguacaauggcacaaucucagcucacuguaaccuccgccuccuggguucaagugauucucuugccucaaccuccuggguagcugggauuacaggcacacuccaccacgcccggcugauuuuuguguuuuuaguagagacgugguuucaccauguuggccaggcuggucucgaacuccugaccucaggugacuugccugcccgcggccucccaaagugcugcaauuacaggugugagccaccaugcccgguccauguccugcuucuuuuaaaacaaccaaaaauaguccagccuaggaaagggagucuuuccugauuuuggcaaaguuaaaccaggccauagguaacacacagcauaaggcaggcguugggagugggccccagucgacagggugccaggacugugggcuaagcagggcuggggacaugggaggccucagugccugggcuaugggaagugguugggacccugagccugaggucaguaacaucccaacuccugacaggcaagaaagggcaccugaggcucccaaggggaguccaccaugggggugggggagaccgcuggaguccauaggucccugugagggacggcgaaggcgggccugucaccucuaaaagagcugugccuguggcgcagacgggggugccacuguggccuggugaguguggcuguagaacaagcaucuguugggcuaauggagccagagacaugguccaaugucucugauguccagauagacuuccagcagccaggucggacuaucugggguucuggaacguuccaugggugaagcuguaggaggagaugcuggacuuccugccuccacucacaugagucacuggagcaauacaagaaggcagacuggccuuggcuacucacacuggucucagcucugggguagggcucuuuauaagccuucuugagaagugaaaaaugcaaaguccuuucuguccccucaccacugacuugcaaacuccagcgaaggccucaccccucagcuggcccagagccucccagaagcccucccuucgcuucccaccucgccaggcccagccaggcugggugcugccuuggugggccuaggugaaucacugacacaccacugaugccuuuggggcagaaggcagaggccucgggagaaaugcgcaggccccagcggccugguggagggugcagggggcgcaggggcagccaggaccgccgaggacgcugggggcacguggcaaacuggcuacccuguccacccgugagcaagacaccacuccgggggcgugggaggguccaagggagggagaaaggaaagugccaccaaacuaauguggagcccugcccucugcaugcgaaaaggggcuccacggccugagucacccucagccccaccugcgugugcgcgagggugcguggccugguacgcgugcgcacgguguuggugagcgugugugugcguguccgcuugaggggaaugugaccgucguguaugcguccgcgacagugcggggggccgcauaucggacccgugcgugugcguaggggucgcguguggccaugggcacacgggcgugcacgcacgggggcugcguaugcuaugcuggcguggggggugcgggcgagguggccgcggggaggagcggcgccagcaccucucggcccccacgcggccugcguggcuuuuugacccggaaaggcggggacgcggggacgcgcggcggcgggggcgcggcgggggcggcgcagagcgaggaggcccgcggggcgcgcggcggggacgggagggaggcggggggcgcccggggccguccccgccccgcgccgcggcgccgccguugcuaaggccgggcgggcggccgccgggcgcuagggcccuuagcaacgggucgcgggcgcgcgcggggggccggcgggcgcguggggccggcggcgcucgcgggcuccugccgcucccacgcgcgcgggcggcgggggcggggcggcgggcgcgccggggauuuccagcgcgcgagaggaagugccugcgcggggcugcgugagggagcgagggagcgagggagcgcggcgcggccgccgcgugcgcgagccgggguugcagcccagccgggacuuuccagccggcggcagccgcggcggccgccggcucuuccccgccccccgccauggggcagcccggggagcagaacgcugcggaccgcggcggaggacgcgcccggcgccccugagccggccgagcggcgacggaccgcgagguaaggggccgcggcgggcgggcgggccuccggcgcgcggccgggcgccuccauccccgucgccuccaucccgcgcccugggcggcggggcccgggggccucggggcugcccggcgcgggcccggcgcggcgcaggcccggcccgucccagcggcgacggcggggcgcggcuucagccuggccccgcgccccagccgggcugccucccgccuccggacgccucaacuucggcaaacuuugucccggaggccgggcucggggcccgagggggccggggcgcccgcaccuuuucaggaaacggggcgcgcaggccucgcuacggccgugacccccgcuggcguugaggacccggcaccccgcggggccgcggguuucacgcggggggacgggcggcucaggggcugcguggccgagcgcgcugcccgggccggccgggggggcccgggcguuauuggaaaguugguccugagucauuccgccucagaggcgccuccgaccgcuuggcgggcggcgcggggguccggguaugggcagagggcgcgaaucccccucgcgcggccgccgagggccggcgacucccggggcaccgggcggcuccuggccgcgggcucugcgucuuccccgcgggcgccaggcggcucucggcgggcuggccgguuccacgccgccagccagccccguguggggacuucggucuaguauuuggacccgaggagauaauucuguguggaaaauucucucccuucgguuggaaacaguaacaaacuggaaacggaugagguguuauggacgugcuuggaaaugcaagaaaccuucagauuacgagcuguugacgggaccaguuguauuucacguuuuucgaauuaagcucagaaucaguuuucagaaugacaugugaugcguggugcguggugugugugccuguguguguguauggauauaauucauucauuuuuguggcgucagaaagguuaugucgagcguuguagcggcuucuuaauuuacauucacggcauacaacugaagaggagccauuauuuauuuuuuuuccuagcauuugcugcgacuacacacugccggagcguuuggaaauguuguuugcuguuacccuguauuugucuauaaaauucuuacuguagggaauggccaaguggaccaucaguucguccugagaucuucucaugucucucacgucuuugaaaauggccugugaacagacugcaucauauguaggaugucuggcaaaauaguguacagcguucuuuucucaaaugagaggaaauguguaccuuuucgccgcguugugacaauguaaauguuaagaauuagucuaaagaugaaaauucuuuggccaaaacaagauaagccuuaucgauaugaaaacuggaaaacaucacaugggacuggaaauccugugagugggugcucaugacggaaacccugacagaccuuggauuccagcaucgcuggugaaaaucagaccuuaucauggauaaggguuaagauguaaggugucucacccagacgccaucuguuccagcugucaaugcagaagccaggaaaggagagagagcuggccagggagaauuccagcuuuuuuuuuuuuuuuuuuuuuuuuuuuuugagacauucaugugaauuucucugcgaggggaaagaagaccaauuauuuuccuuggaugcugucccuucuuuuggaauuaauaagauggcuucacucagugagaggcuguaaagacauuucacuggaaacaggcaguaacaguggccaguuguuucuguuaauaccaucaaaauaucccuacucuuguuugugccuugaagaaaguccuucauuuaacugagacaucugagccugcguugcggauucugauucucuaaauacuccugcaagaaucccuuuaauuuuucacugugcaacucaagaaggaccuuucuaggguauugucaggauacguaugcuaaugauauugucagguuaggugagaaugauugaucacucccuuaaaauccuuuuuuaugauguuaaagcuguacuuuaagaaagauaaaacugccacuguggcguugcaagucugagcuagcucaagcaaacaaaggaaauugcguuaaauuugcccaacucuauuuucucaucuucauauagcaagacucuccaaacagcaagugaucuaaccuaucaaguauuaugcaauagcugaauuuccuugcaauggucaguuuaaagaacuguuaacuuagcagaggcgacgucucguggccaaggcccuuaggguccacuccauggaaucaggaccccuugcugcugcuuugcgaguguucauggaggaagaaaaaucacuugguguucuuuuuuugcauggaagagucauaauaacugacuucagauacagagaaagugggaagagugagaaagaaggaggugaggccagaggauuuggaaggcuaccagagagaagcagccgaggccugauuguggaaaugaugcuuagacuugcuuucagcaggagugaugaagccagaaugagggaggcccagacgcccgggagagguacaggggauaggugccaugugguuugcaccaccgcagcaggcuuugggucccaaagacgcgaauggaaauagaagaaaaugcaguuuuaaauagaaaagaaaaaaaaaaccgagaaaauguuaugugugcuuguguaaaauuuauuauucauaauuaaaauacaaaauggcuuucucauuugagaaagccuuuauugacuaaguucugcacaacacuauuccaggaaaggggguggggagacagaccacccuagggagaaggcagaguuuuuuacuauuaagcauaauaccuuuuuuuuuuuucuuucggugaagcuuauugucggccuguacagaugacuuggaguaggcuggcagguagugggaugucauaaauguugaugccuguugguuucuaucaacuuuaggaaucagguuggaaucgaugcugcauucuguauuccucgagauaaguggauuguuaauugggacuugggagucuuuuucucauuuaauuaauauucaguuaaugugcccugaguucucauaauguucugguuaccgugcugggaagagugagacacagcacccaucugcuagggugugauuugcagggauauaggccaucuuggccccugugcacagugaagggacaugccagaaaccagcagauacuugacugagacagaccaggacaggagcuuguggcaggaaggauaaggaaaaaugcaaaucuaccauccugcccucagggugcuaacccuucgggggagaauacuuucucccaccaggaagaaaccagaaaguaaaaauguaggaugaaaugaauuaguggauuguguagaauucuggaagcguggugggaauccaccauaagggaaagagaaagucuucugggaagcggcguugaguugaggcccagugucaggaaagcucugguauaguggggccaucuggucccucuuacagggcccccucccacuuuguuuugguaagaugggaucugacggcuugccauccugucacuccuugccaguagaugcagugcuggccaugcugcuggucauuggguuuccaguugggaaguugcaugugcuggccuuuggcucuugccaggcagggccuuuugugacugggagcucaugugggucaugcauacuguacugugaagggcauggucuguggaggggaacagagcagcaggcccuaaccuggguggcaccacuuugcugucccuaccauuuuucauugcagguugaaagucuccaaaguggcaggggaagggguguaaauguuaaacagccccuuccuagccuggcaugcgcaccuguggucccaguuacuccagaggaugaagugggaggaucauucuagucuggguaacacagugagaucccuggcucuaaaauaaauuuauuuauuuauuuuauuuuauuugaaacaggggcucacucuguugcccacgcuggagugcaguggcccgaucucggcuugcugcaaccuccgccuccuggguucaaaugagucuccuaccucagccucccgaguagcugggauuacaggcgccugccaccacgcuuggcuauuuuuuuuuuuuuuuuuugagacagagucucacucugucacccagacugaagugcaguggcgcgaucucagcucacugcaaccuccaccuccuggauucaggugauucuccugccucagccuccugaguagcuggggaccacaggugugugccaacauaccuggcuaauuuuuguauuuuuaguagagaugggguuucaccaucuuggccaggcuggucucaaacuccagacgucaagugauccaccugccucggccucccaaagugcugggauuacaggugugagccacugugcccagccuucccagcugauuuuuguauuuuuuaguagagacaggguuucgccauguuggccagacuggucuugaacuccugaccucaggugauccaccucagccucccaaagugcugggacuacagguguguagucccaccacacucggccuauuuguuuuuuuugagauggagucuugcucuguugcccaggcuggagugcaguggugcaaucuuggcucacugcagccucugccuccugggcucaagcaaugcuccugccuuagccuccuaaguagcugggacuacaggugcuugcccccauucccagcuaauuuuguauuuuuaguagagagcggguuucacccuguuggccaagcuggucucaaacuccugaccucaagugauccacccaucucagccucccaaagugcugggauuacaggcgugagccaccgcacccugucuuggcucuaaaauuuaaaaaaaguccuuuccccaaccuacuccucugucauccauguuuaaaugaccuaagucuccuuaauucucaagaacugaaaaauugggggcccuacauuucauuucacaauuuacuuuuuuacuacgauuuguuccaugcugauuucgagcauuaaaaaaaaaaaaaaauuaaauggaggcuauuuggugguaacuucucaugaggccauucuaccaagaaagauauggcgaccugcugcuuggacauucugauuuccuuuccagcugaaacacugauucuguggcagaacccaaaagcguauuuauuggaaacuugauuucuuuaaguggaaagaaaagcuaaauugauuaaccaagugggguaauauaaucuguaaggcaacaguagcaucaaaguggugaaaugugaaucuccaggagucaugagaauuguaaugaagguuuccugagauuaauuuuguguucuggaagguuaaugcccguuaggaggccugcguacacaagguaaugaggugcucguuaggccuucccuccuuccaccaagggccaggcacaugguaagcucugggucaguguuuguguccagauucugcaagccggggagacaggagggaugugccagaugcccacagugguuccauguguuuggaaugugugucggcacuugggugugccuuguagcugccuccuuuaacgguguguuccuggaggucaggcuuccauccucccguucugauaaugcuuagcuccaggauuuguugcauuauggggguucuuugauggaaaguuuuauuugacaauguaauuuucuuggaugcuuuuaaugacuuaaaagcuggaagaacaggaaaacuaguucucuugagcucuuucauguccaguaauucccagaaauuauaacuuuaugcuggaaauuaaaccugcuauuugaaaccuuauuacagggugaauuaagaguuuagguuucagaggcuuuucugugugacuuuccccuuagugggaggggguuugguaugcccauuaaguuuuaucuuaaaauuuaaugugaauuuuacauuguacucaguaacguggcugauuguuuuaauauaaacuuacuucguucccuaaaucuuucaaaacuguugauucuccaaaagauguauuguguuucuggaaucccacuguguaucccuggagcuguccaccccacagcuggagaaguguggcaugguggaggguaccaacuuugaggaucugaauuccagucugcccucuguauuuagugguagaaugaccuugggcaggcugcuuggccccgcugaauugaugucccuaucuauaaaauggggcuacuagcaccagggacaucacuugcuuauuaugaguaagauggaugggaaagcauugugcaaauguuaauuuucauaguauuaggggauugagauguaacagaguaagaauguuaagaucuuacaauguaaauaucagaucuuguuaguuagggaccacagaaguuuucuaguugaggucucuuauuuuaugugggaggcagcugaggcucucaguguuuagguaaguaauucucccaaggcaaauaaugacaaagcaagggcucuucacgcaggauagguuuuucccugcauuuuuccuguucccaacguuugcuccugggaagaugcuuggccuuuuuuuuuuuuuuuuuuuuuuuuuuugagguggaguuuugcucuugcccaggcuggagugcaguggcacgaucucgacucacugcaaccuccgcccccuggguucaagcuauucuccugccccagccuccugaguagcugggauuacaggcacccgccaccucgccuggcuaauuuuuguauuuuuaguagaaacaggguuucaccacguuggccaggcuggucuugaacuccugacuucaggugaucugcccgccucggccucccaaagugcugggauuacaggcgugagguacugggccccucugaugcuuggcuucugauuccagcuagggucaauugagaauuauugaaucacccacacuuucuuugagaacuuucuaagugcuaggggcuaugcucguugcuaaagcuaaaaagucagauaggaugccgucugaucucuguuuucaaggagcuuccaugugaugaaugagccagaagaauaauuucauuauggcaccauguaguaggugccacaacaguggaacagaggcucuggugcauuguggaggcgcugugcaguuucaaccuggguuaggaggaggcguuucccaaggagguaacucuuagggaagcuagcagcaggaguggggaagccugggcuggcagggagucgccuggcagagggcccgugagucggaagggguucuccuguggcuguccuucaggggagaggguacaggaaaaggcacccggccacuucugggugcugccuuugugacagccuaacuucugaggcaggaauucuccccauuuugcagaugaggaaaaggaagagcaacaggccuguuggaccccagaguucaugguuucaccacagcugaauuacagugcaguuuuagauuuucuucagauucuaaacuucuuaguuuugcuuucagaguagacuuaguuuugcugcuguagagugcuuuuuaaacaaauuguguauuuuucaugcagccuuucccuuccauccaacaucuguuuugccuauauggcugauacucuaggccgcacuccguuccaucucuggcguaaguuccuuucuuacagcagccuccucggauucacucuccuuugacacauuuggaugggagguucuuuacgcaguggcucagaugcuucuuacagcuugcugaguaacagucccuaaccugauuugcuaauguguuuucuuucuccuuucucucuuaauuuacauuuaaacugguagucuaguaauaaugauaguauuuagucauugugucuuacaggguuuuacaaacauuagcuuguuagugaugaacaaguccccaaggccuggucacucugcagagagcauaaugguugcaggcuaguaccuauucaucuugaauuuaauuauaacugcagauugccuguggaaauaugaguuaaaggcauggaagcccuuaccacuguuagcagggaaaugauguuuggcuauuuuggagaauacuuuagcucuucugugagaaccacugucaagguuuugaacgugcaaccaggaggggucagugguggcugagcagagauguaggggcuuguuucauggccauuuguaccugcuccaggaagggcugugaauaacggaaugcagccagacacugaggccacuaggucagguccuugggaugacagaggguagauuucuuuguucuuagaccuaaguuggcccuuguuggguggaggugguggcgugagagccuucccugccuucuccagguugaaggauauuucugugcaucugggauaggucucuaggguugagacgacaagcuucucaaggguuggcucacuucauucuuucuauuucugcagucuggucuaugauguacacaguaaaaaggagaucaguuuauguauggaaggaauuagaccugcuuugaauucuggucuguccuucagcuaacuaugcuguuaaauuacucuuccuuucuaagccucaguuuucucaucuaugcaaagguaacuguagaguucacagucacguggaaaagccucugaaaccuaaauucucccucuggagauggaugguggugauggucgcacaacauuaugaauguauuuaauaccacuggacuauacacuuaaaaugauuacaaugauaaauuuuauguguaauuuaccauaauaaaaaaguaauugugagacuuaaaagugagccugggcugggugcggagguucaugcuuguaaucccagcacauugggaagccgagguggguggaucaccugaggucaugaguucgagaccagccugaacagcauagugaaaacccaucucaccuaaaaauacaaaauuagccgggcgugguggcacaugccuguaauuccagcuacuugggauguugaagcaggauaauugcuugaacccgggaggcagagguugcagugagccaagaucgugccauugcacuccacccugggcaacaagaguaaaacugucuaaaaaaaaaacgagccugugccaggugcaguggcucauaccuauagucccagcacuuugagaggaugaggcggggggaucgcuugaauccaggaguucucaaccaaccugggcaacauaguguuauaagaccuugucucuacaaaaaauuuaaaaauuagcugggucugguggcgugcuccuguagucccaucuaacuacucaggaggcugaugcgggaggagugcuugagcccaggaggucgaggcuacagugagguguuacugugucaccauacuuccgcacuuuagccugggugacucagugagauccugucucaaaacaagaacaagaaaaaucagagcaugugagagaauauaagaaccuaauauuucagaagugaucauuucucuuccccuuuccuuuccugagugguuugauaaagggaaugacuuauuagcaauguggaugacaggcugucuuggaaguauggccugucccuggaagaaauaccggugggaguagaaggacauuauuggacugcaaauaaauuauuuauaaaaaggguaaaaugucuagaaacugaaaucacaguauauuugcacaaaaggaacaucuauagauaucucccuuuuuaaaaagcaauuuuaacauaugaauuuuuauauauuuaaauucguauuuuagcacuuuuuuuucuguuauuuagcaauaauaauauucuucaauuugggcugggcgugguggcucacgccuguaaucccaacacuuuggguggcugaggugggcgaaucacuugaggucaggaguucgagaccagccuggccaacaugguaaaaccccaucucuacuaaaccaaaaaaaaaaaaaaaaaauuagcugggugugguggcacaugccuguagucccagcaaccugggaggcugaggcaggagaaucgcuugaauucgggagguggagguugcagugagccgagauggcgcuacugcacugcagccugggugacagugagacugucucaaacaacaacaaaaacaacaacaacacuucgauuuauucaggccucuguucacauuuuaccucuucaaaggggucuucugaacacccuaauuaaacagcccaugcuguugcuguggucacuugccuugcuuuuuuuuuuuuuccauagcagaaaaugguuuuccuuuccuuuuucuuuuuuuuuuuuuugagauggagucucccagucacccaggcuggagugcaguggugugaucuuggcucacugcaaccuaugcgucccagguucaagccauucucaugccucagccucccgaguagcugggauuacagguaugcaccaccccaccuggcuaauuuuuguauuuuuuuaguagagacaggguuucaccauuguugaccaggcuggucucgaacuccugugcucaagggaucugcccgccucagccucccaaagugcugggauuacaggugugagcccccacacccggccugcagagaauguauuucuauuaccuuaaccuguguacuaggagugugccuggcauaugguagguucucaaguauuugcauaaaugaaccaguauauuauagcccaauguuuuauugaggcaaaauucacauaacauacaauuaagcauuuuaagugugcagcucagccguauuuaguguauucacaauguucugcaaccaccagcucucucuaguuuaaaaaucaggccaggcaugguagcccgcaccuguaauuucagcauuuugggaggcuggggugggaggaucacuugaguccaguaguuugagaccagccugggcaacagaggaagacuccaucucaacaaaaauaaagaauuagcuugguuggguguggugucucacgccuguaaucccagcacuuugggaggcugaggcgggcggaucaugaggucaagagaucaagaccauccuggccaacauggugaaaccccgucucuacuaaaaauagaaaaauuagcugggcgugguggcgcaugccucuagucccagcuacucaggaggcugaggcaggagaaucacuugagcccaggaggcaaaaguugcagugagcugagaucacgccacugcacuccagucugggagacagagcaagacuccaucucaaaacaaaacaaaacaaaacaaaacugggcacaguggcuugagccuguauguagucccaccuacuccagaggcugaggcaggaggaucgcuugagcccaggaauucgaggcugcagugaccuaugaucacaccacugcacuccagccugaaggacagauggagaaccuaucucuuaaaaaagaaaaacaacuuuucaucccccuuuacccauuaaguaaucacucccauuccccaauccucccaucccuugauaaccucuaaucugcuuuuggucucuguggauuugccuauuuuagauauagcaucuaggaaucauauaacuuguuuuuuguaucuggcugcuuucacuuagcaugauguuuuugagguacauccaaauuguagcaugugccaguauuuguuccuuuuuauugcugaaucauaauccauuguauguacauacaugccacaaucugucuauucauuuguucaugggcauuuggauuauuuucacugacuauuaagaauaaugcugcuauaaacauuuguguacaaguuucuguguagguauguuuuuauuucacuuggguauauaccuaggaguggaauugcuggucauacgguaauaucguguuuaacuuauucccaccagcaguguuccaauuucaggacaucuuugcuaaauuuauuuuuuuuguuuuguuucuuuuucaugucauauggguaaugugccgacgucauaacaagguuucagaguggcaccucucacaccuucauuugaauacccaaucacacuuaugaacuacaaaaggauauaugugugugugugugugugugugugugugugguauguguauauguauguauauauuuuuguuuaaagcuauucuaguuaaagugguaucucgugguuuggguuuguauuuucuugaugagcaaagauauugaaugucuuuucaugugacucuuggccauuuguguauuuuuggagggaagacaauguuuguugaguucuuuauauauucugaauguuaaacuuuuuuuuuuucuucuuuuuuuugagaccgagucuccuucuguugcccaggcuggagugcaguggugcaguggcaugaucuuggcucacugcaaucuccgccuccuggguuccagcaauucucaugccucagucuccugaguaacugggacuacaggcacacgccaccaugccuggcuaauuuuuguauuuuuaguagagaugggguuuugccauguugcacaggcuggucuagaaccccuggccucaagugauccacccaccucagccucccaaaguguugggauuauaggugugagccacugcacucagccucuucugaguuuuauuguuuuaguuuuuaccuuuagguuuuugauccauuucaguuaauucuuguauauggaaugagauaggagucccaauucauucuuuguauguucuuauuuaguuuucccagcaccauuuauugaaaacacuauucuuucccuauugaaucgucuuggcacccuuguuaaaaauaaauuggccauagauguuugcauuuauuucuggacucucaguucuauucuguugcucuguaagucuguuacaucaguaccacacuauauuagucuguucucaugcugcuaauaaagacauaccugagacaggguaauuuauaaagaaaaagagguuuaauggacucauuguuucacauggcuggggaggccucacaaucauggugaaaggcaaagaaggaggaaagguaugucucacauggcagcaggcaagagagucugugcaggggaacugugcuuuauaaaaccaucagaucuugugagacuuacuaucaugagaacagcacccccacgauucaguuaccucccccuggguuccuucccauaacauguggggauuauaugagcuacaauucaauaugagauuuggauggggacacagccaaaccauaucacacacuguuuugauuacugaagcuuuguaguaaguuuugaaguaguaaguuugggaaguaugagucucccaacuuuuucauuuucuauauuguuuugacuauuuggggccaguugcaacuuuauaugaauuugaauaucaccuuuuucauuucugcaaaaaaggucauuggaauuuuaauagggaggggauugauucuguagauugcuuugggggguugcaaucuuaacaguauuguccuccaauccaugaacgugagaugucuuuucuuuucuuuuuuuuuuuuuuuucgagagggagucucgcucuguuccccaggcuggaguguaguggcacagucucggcucacugcaaccuccgccucccggguucaugccauucuccugccucagccucccgaguagcugggacuacaggcaccugccaccaugccuggcuaauuuuuuguauuuuuuguagagacgggguuuaacuguguuagccaggaugguuucaaucuccugaucucgugauccacccaccucggccucccaaagugcugggauuacagguaugagccaccgcgcccagcugaacuugggaugucuuuucauucaauuaugucuccuuuaauuucuuuaagcaauauuuuguaguguuaguguacaaaucauucaucucuuuggauaaauuuauuucugggugcuuuauuuuuguggguucuauuguaaaugaaauuauuuucuuaccuuucuuuuuguauugcucauugcugguauauagaaacaacugauuuuuguauguuggucuuaugcccuacaaccuuguugaauuuauuaccucuaguaguuauuuuguggguucugugggauuucuuuauacagaaucaugucaccugcauauauaauuuaccucuucuuucuaauuugaaugccuuuuauuucuuuuucuugccuaauugcucuggcuaagacauuuaguaaaauuuugaauaggagugaugaaagugagcauccucauauuguuccugaucuuaggggaagcuuuucaccauugauuaugaaguuagcuguguuuucuuucuuuccuuuuuuuuuuuguuuuugacacagggucuugcucugucacccaugcuggagugcaguagugcaaucauggcugacuucaaccucugccucccaggcucaagcgauccucucaccucagccuccugaguaggugggaccaaaggcacaugccacaaugcccugcuguuuuuuuuuauuuuuuauuuuugguagagauggguuucgccauguugcccaggcuagucccaaacuccugagcagucagcccaccuuggccucccaaagugcugggauuacaggugcgagccacugugccuggacuuuuuuuuuuuuuuuuuuuuuuuuuuuaucagaccaggucucacucuuuugcccaggcuggaguacagugaugugaucauagcucacugcagucuugaacucccaggcucaagcagugcuccuucuuuagccuccccgguagcugggacuacuauaggugcaagcugccacacccugcuaauuuuuuaauuuuuguggagacagggucuugcuguguugcccagguuggucucaaauuccucaccuugagcaguucuccugccuuagccucccagguagcugggauuacaggugugcaccaauaugcccaguuaauugauuuuuuuuuuuuuuuuuuuuuuagugauggggucuugcuguguugccuaggcugaucucaaacuccuggccucaagcagaccuccugccucagacucccaaaaugcugggauuacaggugugaaccacugugccuggccacugacuuuuuuuuuuuaauggaagguuguugaguuuugucaaaugcuuuuugugcaucuucugagaugaucauauuuuuuucauuguucuaguaauguaguguauuguauugauuuuguuuuguauguugaaucacccuugcauuccugggauaaaucucacuuugucaugguauauaauccuuuuaauguguuguuagauugaguuugcuacuauuuuguugaagauuuuugugucuauguucauuaggaauauuagucuguaguuuucuuuuuuuuuucauuuuugagacaaagucuuccuuugucacccaggcuggagugcaguggugcgaucucgggucacugcaaccucagccuccccaguagcugggauuacaggcaugcaccaucaugccuggcuaauuuuuguauuuuuaguagcgacaggguuuugccauguuggccaggcuggucucgaacacguggucucaugugauccaccugccuuggccucccaaaaugcugggauuuacaggcaugagccacugcacccugccuguaguuuucuuuccuugugauauuuuugacuucgguaucugggaaccaaucuuuuuuugagacagggucuuacucuguugcccagguuggaguguagugguacgaucuuggcucacugcagccuuggccuccugugcucaagugguccucccacccagcugccugaguagcugguacuacaggcacuugccaccacacccagcaaguuuuguucauuuuuuuuguacagaugaggucucacuguguugcccaggcuggucuucgacuccaggccucaagugauccucuugccucagccucccaaagugcugggauuacaggugugagccacugcucccagcccccaguuguauuuugacugugcaucauguuucuucagaauuuugaaaccugcccucuccuaauugagaaaauucuaagaggguuuccaagcagacaacccuaacaucucuggcugggaugaugaugauuguaccauguacuuccccucuucucaacacagacacauucauguuguagugccagcuguaagcauaggaguugcacuuaauggcuuacagcuggggaaaaucauggcugauagcacaccaccagugcaggaucagggaagggaacucuauuccugaugccaggacaggaaagagaugugcuuccuucauuucaugaaaaagccacagauuguuccggauaaugguugcugaauaagaaaccacccuaaacaucagugauuuaaaacaguaaucuacuacuacaucucaugguucugugggcugaucaagcagggcucagcugggugauucuucugcuccauguggccuugauggagguaauuuauugguauucaucuguuggcugguccagucaugaggguccaagagggccguacacacaugcuuggaugguuggaaggccaggcucaggggauccucccucuccuugugcucucagguccucugcagauggccuuucuccuaaggugguugugcuucuuacaugacaacucagaacucuuagagugaguguucuaggagaggaaguggaagcugccagucucucucucucuuucuucuuuuuuuucuuuugagauagagucucacucuuuugcccaggcugaguacagugguaccaucauagcucacugcagccucaaacgccugggcagaagugauccucccagcccagccucccaagcagcugggacuacaggugcaugccaccuugcauggcuaauuucuuaguuuuuaacuuuuuguagagacaaggucuuaacuacguugcccaggcuggucuugaacuccuggguucaaacgauccucccaccuuggccucccaaaguguugggauuacaggcgugagcuacugugcccagucuggagcugccaguaucuuaagccugggcuuggauaucaguguagcauuauuccugccauguucuaaaaagacacagaguccuccuauauuugaggagaggggacauggacccuaacucuugaugaaaggagggucgaagaauuugugacuguccuugaucugguauacgcaugguggcuagauuccauagugcucucaguaauauauguuagauacccauuugaaaacuguuguggauuaaaauggaaaugccaacuguuguguguuacucauuuucagugaguacauucuguguucugaaucaauaauuucuaaaaaacuuuuggaguauaccuauucauaaaauaauuaccucuauaaaauguaugucuuaucagcagccauccuugaucauguguuugucaaguuuuucaaguacagcuuuggguccauacguuuuuucuuccuauuacuaguucauuuuaaaaauuuguugaaaccuucccuuuuauuuuaaauaauauugugggguuuuaauauuucucucuguucuuaaaaaaagcuucauugagaaaauauaaguaagccuauauauccuaaaguuccuuuccuuuacucuagaucauucuaguaaauccccuagagacaguucuggcuguuuauauauaaaagugugguauaauuugacagugugugcagagguguguauggaugugcucucacauagaaacccugccuccccagccugucucagcugauuguugcaacacugagccgagcaaacaugaugaggucacagagaagugagggagugguuuuaaauaaugaaacaggaaaucucugucuuuggcuccaguggugccccaguguuuugggauuaaugagggaagagcuaugucugccuguguuccaugagugccccuugcuuguaccucuauggagaaccccaacaacccuggcuggaaagccaccuaauccuguguuucccaagcauaaccucccuuuguucccaaguaagucuuuccuagacaccugaacuucugugcaacauaggcaugaaugaggagagugagcuacugugguguuauauauauacacacacauauauacaugauauguaugcaugauauguauauaugugugugugugugugugugugcauaguuuucauccauuguuucugacucauaagucccauagcccuuguuacagucuuuuguuguaauguugggugucuugccuccuuucagcugcccaaggcaggacucuaaucugacugugagucagaagacccuuauuccagagagggcccugccucauucccuagaggcaggaaugcugcacagagaggccaagauaaguccgaacagacaggccuugcuggguuuagaucaugguuuuuuguccagaaacauuucuagaugauuguaagucaugccuguguaaugaagccaccauaaaaacucaaggacaggccgggcaugguugcucacgccuguaaucccagcacuuugggaggcugaggcgggcggaucaccugaggucaggaguuugagaccagccuggucaacauggugaaaccccaucucuacuaaaaauacaaaaauuagccggguguggugucgggugccuguaaucccagcuacuugggaggcugaggcaggagaauugcuugaacccgggagguggagguugcagugagccgaguugcaccauugcauucccaccugggugacacagcaagacugucucaaaaacaaacaaacaaacacucaaggacagcguucaagagcuuccaaauggcggaacacguggagguuucugaggauggcccgagggagggcauggaggcucccgccuggccucauaccucgcccuuugcgucccuucaucugugucuucugcaguauccucuacgauauaccgguaacuguaaguacauauuucccugaguccugugagccacucuggcaaauuaaucgaauccaaagagggcuugugggaaccccaacuugaagcuggugggucagaaguucuagaggccuggacuugcgacuagugucugaaguggggaugggggguggacagccuuggcgacugaaccgccaacagcuuuguucacgcaauucuucugcauuggcgauuguugucagguugugagagcaggggaaaaacacagguugagagaguuuuuccccaaacagccccuggucgaugccccggaaugacuggcugcugcauggaauugcagaggccugagugccucugcuucuaccgugauuccugaggccaagaccucuggucugcauggucugaagucucuuacgaagguaaaauguuauguauauauuuugaauaaggguaccuguuccucauucuguccuuuugaauuccaaaaguguguuggccugugagauagcauaagggacagaaucauugcucucgugagccuuugggcuugcuuccuuaggcacuacguacuuucucauuccccauugccuucaggauucuuucugucagaauguaguggcuguggccugggggugaccagcauaggggccaaagaaggguaaugagucuugaggccuacagaggguaguaggcaaggcgggagggcaagggccagggggcagcaucauucacacaguugaaaacgugcccuuggccugucuccucucuguguucugcaucuuagaaaauagauauugucuuguguuaagaugaaucaauauaguuaccccuuuuuauauugucuuaagcuucuuaggaacugcuuuguauuuuagucacucaggcuuggagugaaacauguaauguguaguucaaccugaaaaaauuggucugagaggcgucuucauagaguccccaauucuauauauga

SEQ ID NO: 17169 - RNA, 5880 nt, Homo sapiens
cgagaaggagagcgagccgggagagcgcggagccagcggagcgcggaggccccagcgccagcacccgcgcgggcggugagcgugaguguggcgcagggucgccccuccccagccuggccccggcagugcgggccccgggagcgcccugacggcuaggugcggggugguugggagcgggaggagcauggggggggauuugggaguuuugagucgagcuccuuggggaacgggacggcguggguucgcggggucagcccggcuguggaacgccaugccuccgcgcgcuuguguccccggggcugugcccagcaagaccugggaucccgcggcgcuggggguggugggugcccucgauguguggugccccggcuggcacuggacccuggcgccgggcagggcaaggcagcccuugggcacuuguucccugcuugccugcccccgccuggcucaagcugacagcucuaucaucugccucugucaucccucucucucugggccaagugucaucugugggucuguuucugucucucucucucucucucuucuccucugucuccagcucagucaccucucgccuggucucuguggcaguauuuuucuugccucucccucugccuccuucccaaggcuggcugggucucuguccuggcugcccuggacucuaaccugaguucugggguccugggaugggauccagaagaggcuugauggagggccggaccugggagcaguggggcacugagacaucccugggcuuugggguugggcagaggagccagagguuguggcuucacugcccgcugccccgagaggccuccugcagugugugccccuccuagcccucccugggccucagugggaccccagcugaccugagugggguguuuggugaaagaaaccucauuucucagaauagcagcccucugcuuugcuggcggccacaggaccacccucacccaccccagcaggacgucacaggcauuccauccugcuggucucugcucucccacugccuuguccccuuccugcagggcugcccccgcccguggcccccuacugccugcaugccagccacugccacaccccacccccauuucuaccucugaccagggcguagccccaagagcccacacggcccgagcgcaggugaagggucuggcuggugccaacuccugccaggggcucucuucccagagcccuugcugccagggcuccaguggggcucccccugcuguggccagccugagugggugcggccaagugcaggggcaggacuucauuucccccugggcugugggugcugagggccuggcccggggugugcagggugcaugcucucgaggaggaaaugggcaccuuggccucuggcugacuugaacccagucccuacuacucccagccucccgucucaggaacguuuaggucccuaggacacuccguguccuuccugcacuauuccugucucagaaugugcuucuguccucccagcuggccuagcuaccuccugcucaccucucaggccucagaucagcagacuucuuccaggaagccuucccaggucuccccuccugccugugcccucuugcaggcacacugugcggccaggguccagugcccccucuggcggcgggcucaggcagggagcagugcaauauagguccagcuggagccaugggcacugggccugggcugggguggaguggggugggcuuagcaccugaagccuucgggggaguguggauccagcaucaggccaacagcagacaccccauuucugcucccaguccucgugcagcuuaguggcgcaguggcggcagcagcaugagcaccccccggccugcuccaccacagccaggcgcugcugagggggcuggaggcccagaagggaagguaugcgcucgggacccugggggggucgggagggagcaagccucaaacucugucccaugacuuggggcaugccuugccuugcugcuggccucaguuuacccaucugggugggggagaucauugcuuauuuauuuauuuauuuauuuuugacacagagucuugcucuguugcccaggcuggaguguaauggcgugaucuuggcucacugcagccuccgccuccgggguucaagcaauucuccugccucagccucuggaguagcugggauuacaggugcccaccacuaugcccaguuaauuuuuguauuuuuaguagacucggguuucaccauguuggccaggcugguuuccaacuccugaccucaggugauccaccugccuuggccucccaaagugcugggauuacaggcgugagccacugugcccggcuuguugcucuuuuauaaagguauaauggauaaaaaaaauugaaggccagcauuccuggcuuacuuagcacuccuuccugaccugaggaccccagggauuguccccaaggcacgcuuugcucucugcugagugaggaaaugccaggguucccugccccuagugucaccuuuuggcaggggauggggaggugcugaugaaacuaaaaaaaaaaaaacaagcucccuacacagggucgcagccuuaguauucugagugcuagagcccagcuagagcccagccauucuccuuguuggggagcaguggggcuagagagggggaccagccuggagucauauagggaccagucuggaacuugggguugcagacacagccucccaggcaggguggacagaggugagcaccaggacuccgagcugcaaacgcugcuggccuggaccucguucaccccagugggcagacuuggagaggagcacccuugguugggggcaggaaggagaauggcacguggggagggagagcaggcugggggaugagccccccuggcuggcaaugccagcaugaggguggccccugggaggauccagccuuugggguagggauggggucccugcucugcuguccucugacagcuccuucauuccacagacaucccaguccagugacaccuguucucacacuugagggucacauaugguccgugguuaaaagagagucugggcuggagcucaggaaugugcacuguucagggaucuugcugcaguggccgagggccauucagcuaaguccccccugcugcguggcuguccuuccucgaggcccuugugcucuuuugggaagguggacccagcagcuucccuucuagguggagaaaugggagacagggagcuccaggcagggccaucugcccgagcacaggcgugggggugggacagggcaggcaagucagggccaccggggcgcugagggacagaguucugcacguagcacugcagccucaaagaccuugaacgggagguggagaugcugagggcaccgggaaggccuggggacgcagcccccgcaggcuccugugggcacugaacaaugagccaagagcaagcccagagccagccguuuggguugccauggcaacugcuucccagcuccucugagccuggaggaggccaagggcccagcagggaagaccccaggaagggacuggcaggagucugggugcaggaggcagcugggggugcgcagaagccugggcucauuccuggugaccuuggccucuccggccucaggcucuggcugugcaaugggcuucuggagcugagcacagcugcguccuauggugccuccugagagcugugaccccaggggcugagcacccuacccccaggguugggacuggguagggccugggaccugucucagggauguuccugugugaauacacaugugcccaucccugcccuggggacugggugggaagggucucugaucucccuaguggggcagugugcaggacagggguaggggggaauaggagugccaggccuggcauggccaugauccugcccauccuccuugcaggcuguggcaggugccugggagaagggcccucggcugggccagcggcugcccucaaucgugguggagcccagcgaggcggacccuguggaaaguggggagcugcgcuggccccuggagagugcccagaggggccccucucagagccgggcugcugcugguaagugagggugccugugggggugcugagaggaggaaguggccacugccagggucagaagcggggcgugcuuccugcggcuccagcaagcaaggccuucccgccuccugccuguucacacuccauccuccgcccgccuuggagucucugccugagacucuaggugcugccuggccuuaaccccccucccuagcaccguccucccucccaccugcaaaugaggucccucauccacucucagccgcaggccugggcacgggaggugcacggugcauaauuguugaaugagugaugccacauucucgccccuccuuauccagugcacccucgucaucaccucuggagcaagugugccuugcucacuagggccugggaggcugugagccuacaggugcuugugguggggggaugggcuggccuguuggcaggcuccaucccgcugcaggugcccuguuuaaaggcugaaagcaggccaggcgcgguggcucaugccuauaaucccagcacuuugggaggcugaggcagguggaucaguugaggucaggaguucgagacuagccuggccaacauggugaaaccccaucucuacuaaaaauacaaaaauuagccaggcaugguggcgggcgccuguaaucccagcuacucugaaggcugaggcaggagaaucgcuugaacccuggaggcagagguugcagugagcugagaucgugccacugcacuccagccugggcgauagagugagacuccaucucaaaauaaaagcugaaacuucugggaggauugugugagcaggagggggcagccggcgccaggcccaaggaacaggagaggcagcaggcugggcugugggggccuugugaauggcucugagggccacugggggcugggcaaggggcaugaggugugcccugugcccugggagauguuguccccuggagaccccugggagucuauucccugaggaggaagugaauucagccgcagcuggggccgcucagcaccuugccugcccucuucccauccccagaccucagccuguacuggccagaaaacccccuuuucauuguggccagagggguuaucugucuggacccauaacccccaccucugcccaaagccucuugucaguuucugcccagggcccaggacagcaucagggaccaccacucggguaaccccugggacuugggcucuggggauauccuugagucugcccuggacuucccuucccucugccaccccaucaucugguggaugugggagcugccccugcucgcagagcccagccucauucugccucccuggccgagcaccccucccgcuucucaucacccgaggggaccuccuggccugccccagcccaguugccugccaaacgcucauuucgggccccugggauccucucaggcugcacuccccccgccgaccaacacggccgccuuuauguuucugcagcccccucgccgagucugcccggagaaccagggaaagcugcagauaacgcuggcagcgagugugccugcuccgaggacccagcagccccggcccggggauaggacaaggacguggcugggcucugcugucugacugcugagggccucugccccaggguggccgggcugaugcacaggagggccgggccugcccagccuggaaagcccagaggcugcuuccugugucacagggucuggaccgcagcccugcccucuucugcccauggcccaggucuggaucacaccccgcuuuguuccgugguuugaagcagaaauaaaggcacuuccugguggccaguaggcacacuugauggggaugcaagggacugaggacagu

SEQ ID NO: 17170 - RNA, 4456 nt, Homo sapiens
caguaacuugacaacuuccacugcugagaagucccuccuacaucuaacccaaauucuucaagcugcagaaccagccuuauccucuuuuuguucccaggaagccccgagucugcuuuggcugggacaaggcugaccaggcacaaggccaguggauccgggccguggugggggcagccacaggcaugggccuucccugcucuggaccugccucagucuucccguggcuuccacaggcaugagagggccacccaccaaauagugucaccagacagccuccggccuggcccuucagcacaccgggacccaggucucccauccccugcccacuccuuagggaggcaccauuuuaauucacauuuauuuuuuaaauaaauacucugcucuucacuuucagacuggagggugaagcuggacagucgggcgggaggcccccccccgcccgauaggcagcauugagagcucugcggccccaaaacacuccccucaacgaugccugaaaugccuccugcacggcugcuccuucuggccugacagcugcgcuuggcugcugacgacaaaaauucccuaacugcagugucagaguugggggcagggcccagagugacucccugggcuccuggcugacccccacugaccacagcucccugccagcggccggcccccccucgagccagagagaacuagacgcaggugaucagcacagccauggcacugggcaccuugaucuccucgaagagcacgcggccccgaggggccuccgcacccgccgccccggccgcagcucucagcaggucuugagugugcugcaagagaugcugguuccgcuggcggcccagucggcgcagcgccagaauggccaguauguggucccgccugcagagacaugcgggcacucacugcagaccuacaccuccgcaacacccccagccccagcaugaggcgaacccacgggcuugggaguuaguaugagucacucugcauuccaggauggucagggaggucagauugacugaggccaggaagagcugugcugggggagggggcagggcgugggccugggggacaccauagcugggcuugaaggggcacaggagaggggugugcagagugggaaagagcccacgcaaaggcguggagggagaccuggggaccggguggagagacccaggcuggagagagagggagacccagggacaggguggagagggagggagggagggagacaugggggcaggguggagagggagggaggagggagacaugggggcaggguggagagggagggaggagggagacaugggggcaggguggagagggagggaggagggagacaugggggcaggguggagagggagggagggagggagacauggggacaggguggagagggagggaggagggagacaugggggcaggguggagagggagggaggagggagacaugggggcaggguggagagggagggaggagggagacaugggggcaggguggagagggagggaggagggagacaugggggcaggguggagagggagggaggagggagacaugggggcaggguggagagggagggaggagggagacaugggggcaggguggagagggagggagggagggagacauggggacaggguggagagggagggagggagggagacacggggacaggguggagagggagggagggagggagacauggggacaggguggcgagggagagagggagaccgggggacaggugguggagagggagggagggggugaugcagcugcgggugacggggccaacgggguuggggaguaguuggaggggaacucccagggugauguaagggccacucucucugagccacagccuggaagacaggccugcuggggauggggaauccuuccccaccccauggcaggguggccuggggaaggggaugaaccaggggcuuucugugagcuccacaucccagaaucuccaaaagaauggacuuggagagauucgagcugggauuuccaaaggcuuggaugacucaccgaccccccagcacaacccgggaucaaaaccuccuuccuccugaccaggucucagaauccccuggcuuucagagagggcuuucuccccaggggugggggguccgccucccccucagauuccaggacuggaggcgugcccaccccugguggggcugauggaggauggccaagagcagauuaggagaaggggcucucuccauucccccuccagccuugagggucugaggguccaaggccuaccuccugccucuggucuucaggccccugggcagucaggucugggcugggguugcuccaauaccagcccccuuggcccugaagcucugguaggaagcuaguggaagcaggugggguacacaccugaugucgggguagcuccggauaagagucuccaggugccgcuggaugucaucuuuguaggucucgcccaggaucucagccacgcacuggauggcuugguccaaccauguggccucggaacccugcgagacagagccaccgccugccccaacagcccucuccccaccgcugcuccaacuccugcaagagcgcgaggucagugcgaggucagcccucccgcagcgucagcccuccuguagucacucuggcucggugccgggacugccucccccaaaacagaacgggagcgugccugggcaccgagggcucaugggcuggcuacacagccuucaucuccccuccgaucccauccugcuuggacaggaaaaccgaggccagccugaaagcacugcuagggggcagacgaggggugugcaggggcgcuggugccuccacucugagggcucuggccugaggugggggacaccucccaaaggcccugaccgugagauggggcugugacccucgccccuuccccgcaccccugcaaacuguaugcaaauguaugcaaagugccgcccucccaccugguucccuccaccccccagccccacaggcgccccagucccuguuccaccugauccagaguggggagaaccacuccugccaaaagcccucccggcgcuaaggcccuagucacugccaccacuccccacacagaggcgagcaccgaagggcagucaugccgccccuaccaggcccuggaaggugucgcugauggccugggcauccaggcucaucuucugggagccaugcaugcgcuccaugccccggaaccgcucccguggccucagcgcccgcgccagguacucgcggaccacgaaccggugcaccuccugcagagucuccugggcggcccagggucagggucagggucagggucaacagccccaauccugggcacagcccugccagggcccucccccuugugguaccugugcccgcggccgggccacacgcuggagaugaccggcgaaggucaccaccuuguccaugaggggaugcagccaguccugcgucagccagucccuggugcacacaacccugaagagcggcuggggacagaggggcugggagucugcaaaugugcacuacgcccgcaacguaaccccucccucgaagcccagugugccacuccugaccccuucccuccuggguuuggggugccauucccucuccuagccacagguuaugucacgagcccuuucccagaaugccucucccaggccccaagcucuaggggcaggguuugagucugugcagucagaucugcucagggcaugcccuggagaagccuugagggacugggugaggacccugggccuggauccguggacccaccaucccaggcuucgggggugaccacuaagagcuggagacugaagugagaaggcaggcgucucccagccgccccugcucagcugggaccucaccuggguccccugcccacuacccuacacacacacccaugagcucacccuggaauaaaugaaugcugugaccugggcccccaggcucuaggaaauagggggugccugcugggcaugggaaguagggagagagggccuaucacagucaccugcaacucacgcugcaagcccugaagcaagugcuucuggaagcugcagguggccgucaccaggggcuucuccagcuccucuuggguuccugggaaccuggagagaagacugguccuggggaggggccaggaccagcgaugaggugggcaagggagaccaggcuggggaauagagccgggcacacagcuccacucacuuagacuacaaugugaagggcagcccguggggcuccccauuguagcugucugcgagcagagucaagugggggacagcacagaagcccagggagccagucacaaaggggugggucagggguggcugacccguuccccucuggcagcucugggacagaccuuccaucccucuuggugauaaacagugcggcauagccaugccuggaacauacccuacccugagccuuauaacugcccccugaaggugaccauguccc

SEQ ID NO: 17171 - RNA, 3215 nt, Homo sapiens
ucagacgcaggcaggccaaaacccuaguuuauuucagcaucagcaguaucuuagccaucaaaaaaauaaacucuaccaagggugacggaagucucuacagcaaggcuaagggcucgccagacggcgaacaucaggggugcauggugggcacugcccaggcaauaaguuaggaagcagcagggcuggugucgggugugggccgggcuucauuucugggcaggcaugaggucgucgauggccuggcccugcuccagccgcugcuccaucucgaugagcagcuucacuccguccaccaccaucugcaccagcuccaccucugagaagcccaggcggucagcguuggagacgucgaagaccccgcccaccgcagccguguccacaccgccuggggagacagcaagucagggcggaggaaacagggcugcccaaaggccacgggaagccgcagcaccugcccugcucaccugugccucgcuucugaagucgcagccgcuuaagcaccuccgagaacuucucaugcuugcccagguugggcagcuugauaugcacaccugcccgcagcccggugcccagguuggaugggcaggugaggauguagcccaggugaggguuccacaugaacucauaguccuuagacuugaagagaguuucaaucugcagacggagaagaggguaugagggagaaggccugccugaaaccccuacaggcccugagacuccccagugccggaaaucccccggggggacugaugcuggggcacccacaucccugcuggggcccuggggucugggccugccccgucccuggcaccugggugaggccggugcagaagcgggugaacaccuccuucauguugccccccuucugcauggagaugacccgcaggugguccuccucguugacccacaccaggaaggucuuauugucauugugccugcgggagggcuggucucagggcauacccagaaaaaagccccaggccgcccccagaccaaaggaacuucccaagucccugaggugcugcucccugccaugcccaggaguggaggcugcugccaagacuccacccgccaacacggggcgggcgggggaaccgggacgccucacagcaggagaaccccagcugccaucaugcgcuguggccugagguggggcggggccagggaccgccaggacagcccgacccgccccccacaguggggguaggagcccugccccuggagaagcuuuggcgucaccagccccugguagaaucccagcggcggaggagugagaaaagaaaacaaagagcuccagcucccagggccgucggggagaggcgccagagagccccgcccccaccucacgucucgggguggggagguguugcugaguccugagcccccacgggccggggcccagucccuuaacgcaccugcucggccaaggucaccggcgcaggaggaggcgcggcacggaacccagacccggagcgcggccggccccucccuccuccuccuccuccuccucgccgcgaggggccccacccccgcgaggggggcgagagggaaagcggagguagcggggagggaggacgccgcgagagggcgcagagggacacgcaccagauaccgcgggcgucgggccagucgcgggccaugcccgaggccagcagcaggggcgacacgggcuugucgaagaggaaguggucgucgaugagcugcugcugcuccgccuccgucaugcucuugagcgcguaguaucggcccgccaggucgccguccaggcuggacagggcugcgaggggugcgcucaggacgcucggcucccgcgcccgccccuccagcccgcagcgcggacccgcccgcccccgugccccaccucgggggacgucagagggccccacccgcccggaucugcgggcguccaguccucacggcccgggcgacggucccaggcggugaccccgcgccaggacccgcccucccugggccccaggccgcugugggcgcggggcugggccuccgucccucggucccuccgggaaacugaacccgggcgcgcgcagauaagagcgcgacggcggcugccgcucccgggcgacguaaacaaaagcgggcggggaccgcgccgggagggggacgcggccgccgccgccccucggcccgcccggccccuaccuuccaccgcgagcuucucgauggcgcggcgcuccccgcggcugcagugcggggggaggcagaagccacggaugcugcggcccgugcgcacccgcgagcucagcacguaguugggguccaggucgucgccgcccugggaggcgagacgggagugagcgcccgaagaccccggccccgcccgcccggcccgcccgcagccccgcaccugcagguugucgggguugaggucggucuugugcucaucgcugggcuuguagccgccgugccgguccucgaugauggggucgaagagauccuugaacacuucguaggacuccucgucgcccgccacgcagcccacggucaugauguacggguggccugggggagggggcgcgggacggggacagugacgucacugccgggcccgagcgcgcugcugaggacccugcggcugcgcggggggagggggggccgggaccccggccccgaggggucgcguacccggguuguccacgccugucuggaugacgucguccagcgugaagccgcucggcgugcucuuggcgcgcagcuccgcguacagcucgggggucagcaccuuggccaugugguuguugugggcgcucaggucggggaacucguccucggccgggaagcgcagcuucagugcguuguggcuguuggagaagggcauggcggcggcgggcugcggggagacgcggggucagaggggaccggcacgccgggguucccgggcucccgcguaccacucaggcccccgccgccgggccccccggcgccccccgggacgcggccaaggucagcgggguccgcagcgcgcgcggggagcgccaucaucgccggggacccccggccgguccggcgcgcgcuccaggcgacgcgcccccuuugcacgcagcgccccuagcccgggcgcggacgcccccggcccccgggcccacucaccgggcggccgggcgggggcgggggcgcuccguccgucggcagcucccggagcgacgcaggcgaacagcggccgcuccgcgcucccgcggcucuuaaggggcacaacg

SEQ ID NO: 17172 - RNA, 27262 nt, Homo sapiens
aaaaauuugaaaagcaacuuuuauugaagaauuuggagggaagguuccauauuauauuauaauaguaaaaauacuaaaguugaauguuguaaaaaaacgccguggugcagcggcagcggcagcgucuggccaggaggcguggaggggcccagggauggccacccccacagggagucagggagggccuggggcgacagcggaaagguuaagcgucgaaaaggucaagugcuaccguggagagaucaucugagggggaggcucccggugggacagucaccaagaacugugacacagaaggggaagggggagggcuuuccugucacaaagauuaaaaacccccaaaaugcauuugaacaacauaauacacaauaacaaauuuaaaccuugcuccucugucccacuggguaaacccuggcccaucccccaucccuggucccaucccaggggcccagccuccgaugacguccucagagacacggccuuagugcuggggggcugcugugugccugccacccccaggagagggugcuggccagcauaccauagugagguugcaucuggugccaccagguugaacugaggcccagggccccagagagaugacagauagcuggugacagacagcccagggcggcuggcugacagagugaggggacacaugggcaggaccugcccggccccccaaugccacauugcgcauagcugcagaaguccuuaacauuucccuacgugaaucggauuguucugagggcugaggccacacccggagaacaaacuggaugaaauaaauuaaaacccgcaggauaguuuucuucccuaccccgcugcgggggagggugcugcccacagcacaaaaacgucuuuccaucugggcucgagaggacagcguggcuucucucaaaugcacccgagaaauaaaaaccauuaaauacagaucauggcacgaggccgccucuccaucccuccaagcuaucguccagcgcaguccaccgccgccucaggccgugccgcuggccgaguaggagaacugggggaaguggggccugcgcucgcuguccacacacuccaugcugucaucuguggguguagacagcucagaccccggugccccaccucccugccaccuccacccacccacagcuccaguaggaagccaaccucuuaaagcacggccagcacgcugccauacugccaggaaacugagacagggccccacagauugacacagggaccugggcccucagagcacugccucccacccugaucauuggcacucuccaaaaggaaccuuuuuaaauauuuagauuuuaaaacaucugaagccaaaaaagcugaacacugcaggccucucugaguguggagagaaaagggagugggcgggggcaggcaguggccccucaccuuggucagguggugugauggugaucaucugggccgugaacuccucaucaaaauaccuggugucagucuccgacgugaccuggggcuugaagggugggcugagcugcagaggugggcagacgggacagucaugagcuucgcuccccacucccagcacacccucaagugugcucaagaccuucaaagcaccuggaucuccaaggggucuccaggcaggacugaugucagagagcagcaagccaccagccccccacagaggcagcucugggagggagggacaugaggggugcaggagcacggagacaacccucaacagcugagacgcaaagcugcccucacagcagccccagcaggcgacaggagguagugcagcccagcucugagagacccucccugcuaccaggaggugauaacuuuauuuuuccuuuuucuuucuuguuuucuuauuuuucuuauuggucuucuuguaaauugggaaagagggagacuguggaacaaggugcacaggaugagcccacccugccuccauggcucagggacuacaggaccacagccugcuggcaucuggcugcagacaggacucucaaugacccaggaugaagggugacuauaaggugaugugcacacgugaggagcugccagagagccccucaggucccacagucaaggacccccucaagcacugccccaccccagagucugggcugggcaccagcauuguccauugucaauuagcaaggucucuggucaaggcugggcagagguugagcacugcccaggccccccauacccuuggagggcagggcaggaggguggcaggccucaaggcaggaacggggaccaggaccagggcacccuguguuaaugggagaacaggugcccagcugggucccagggcugcccagcccgaccagcugcacacagccuaggacaggcauucaggggaggggcaggcugggaacggggcagaagcacaccuggugacagggcacccagcaucucagagugcaggcuuccgaacccagcuggcagaccccaucagcuggggugauggccagggcuccuagggucccugaaagaugagcacccaggauggcgacucaugcagaaagagcugccucccuccagggcggacucccccaugugccagaaaaguaggugcugucccugucccugcacagccagaaauagggcugggcucuccuugcggcagaagggauugaggucaaacaggaggaacucguggaggccaaggggcagcaccccugguccaccaccagccagccuucacugcacagcgucagggaagggaaccccaaggcuggcacucagagugugacacaccuccgaggggaggaggaaacucagagugugacacaccuccgaggggaggaggaaaugaggaccaggccaguuuccugguggaacccggcagugccagagccucugagcaccaggcgcugagguuggugcagcaaggcccuccuuguaccaggacugcagcaggcuccugaggugagggcgagugugugggaaaucuggcgagcgugccacgugcaugcgugaguguggauauguggggagcaugcgugcgcgugaauaugcggggagcagccgcaccuucuucucguacacgugcugccacacgauaccggcaaagaagcgaugcugcaugaucuccuuggcguccucggagcccccgccaagccugcaggcaggaaacaaggccacagugucgguaccgccaccugcccaggcccuggguucaggccccuuccuccugugauguagggcccgccagacaggacguuccggggccagggaggggagccgguggugcagcgucccugagcagcuguggguagcaaagcaccacagagcucacggcagggcaggggcuuccugagugggugggugcaggcugcaggguuggggacagaggcccaacugaccccggccugcccgccacucugcuugggccugaggcuuuggagaucagcccuggccaaggacaucaagcuuuggcuaucaguguagucugggaggugccaggaccgccuggcgcaggggcaggugcagccuggggaugaggggauggagguguagccuguagcugggaugggcggcccucaccucugcuugggguccuucuugagcagcccugaaagcaaggacuuggccucgggaccaagcgugcgcgggaagcggaucuccuccaugaggaugagcucaaaaagcuucucaugguccugguuguagaagggcaggcgaccgcacaucaucucguacaugaccacgcccagcccccaccaguccacugcacggccguagucauuguccuccagcaccugcacggguggcagaugggcaggacucggcaucaagggguguccgggacacugccgggggaggugugacgugcuuggggcacagagaggacacagcauugcgugugcucaggacguggggacgcagcaacgcguaugcacgcagguggggcgcacaccucgggggccagguacucaggugugccgcaaaaggucuucaugguggcaccguccuugauccccuccuugcacagcccgaagucugugaucuuaaugugcccguccuuguccagcaugagguucuccagcuaggggaaagguggccucaggucagugccgccaggcccccagggcccugccccccugccugcccgccagcgcaccuugaggucccgguacaccacguucuucuccgagugcagguaguccagggcugacacaaucucagcgccauagaagcgggcccgguccucggagaacacacgcucccgggacagguggaagaacagcugcgggaggcgcaaccugaggcacagccguggcucgggccucugcccccauggccugcagggcugggguuucucagaccgggucucggcauugcacagggaagggaccagccaccagagggcacgggggccuggaaagucucagaagcccuaacucagcaggaacaagucaccccacagcaggcagcugccugggcaggcaucacaccacccacccagcagggagcaccgucuggugccauggagaguagccgaggcuccgggaaggaccggccccaccaugggcggcccacaggccgcgaaguccaucccccgcagccccagccccuaccucgcccccguuggcguacuccaugacaaagcagaggcggucgugggucuggaaagaguacuucagggccugcaaggaaggggagcuggaacugcggccccacaggcaggacggcagccccgcaccacgcugcccgacaccacgcugcuugauaccacgucgccugauaccacaccgcccguagccccacaccacacugcccgacaccacgcugccugauaccacaccgcccgauaccacacugccccacaccacacaccccaucacacugccccacaccauacacccccacaucacacugcccccaugccacgcugccccacaccacacugccccacaccacacugccucaugccacgccaccaucaggcugggccccggcagccccugaggugccaaggaguguuugaaaggugagcaagguggccugggcucagguccuccagggugaguugggaccucagcaggggacagugcucccagcaccagggccuucgcaaagggaggacacacccucccaggcgagacccacccucccgccuuccaccacaggcgacugugcuuuuaaagcaaaggccccaucugcaggagaaucguccccaaacacagugaccuggaacuaaccaaguggcuggacccuggcccccuucacaguaaauaccuccugggccaaguccccagaacagguucugcaggacagagcccgggccucaacaaaagccuggcaggcagggcugcagggcauggggagcuggggccuccuggagccucggcagagugcaaggaagaccagggccaccugccccacccaccugcccgcacacgggagcagcgagcacagccccuagcccacacugggcaccuccacagccugacccuccagggcaggccugucucaccagcggcggaguccacgguguguaaagcccucacgugcccaagaagacaggacaucguccccuagagacagccccaggagucgcuaccuggccccagcccuucagccccaucugggcucccacucacugugaggaaggggugccuggaguucugcaggacgcgguucucggugagugugugggccaccucguccuguaaagcagggcugggugagcugccaccccgcacccucaucuccacccugccccaccgccccggccccaccuuggccacgaugacuuccuucuugaggaucuucauggcguaguagcggccuguggccuucuccuucaccaggaucaccuugccgaaagugcccuugcccagcagcuucagguacucaaacucguucauggucuaugggcaggcaccagggucagcaagcggcgcugccaacagugcccagcuggucggcaugcgugggguggcaugaggggccccagagucggaggcagagccaggagaggcguccacuucacaccugguggccuacugggcucagcggggaguccaggcuuacagggaacacauggcugcggccccagcucagagcaugggguucagggaagggugggguaacauugcccaagccuggcagggcucagcaaccccaguuuuccucugacauggggaagaggacccaccugggaagcagcugcgcccuacauggaaaaccggccuagguggagaugccguggagugcugagugucuccugggccgagcugggaccccaugacccacccagcccuccacaguccaaggcagccccaggcacaggcagaaguggggacaggccucaccacgcggugcuugggcuuggccagggacaccuccaucucuucagccccugaguugucacugggugagcccgaccggaaguccaucuccuccuccuccugcuucuugaggccgucagccacagucuggauggcgguuguccacuccucccugcaggaggucaggugaggcugcaggccuguaccagaucaggagcuccaccccacgucuuucacccacccgccagccucacaagcgugguuccacagcugucgggguucccagagacagcccugaggaggccaccacuugaccuggucuggccacauacacucagggucacgaagcccucuuggacgugggggacacccaggcuuagccccccagcaggacucuguccccacaaccggacuccaacccccagcaggacuccgccccccagcaggacuccgccccccccaagcaggacuccgccucccaagcaggacuccgccccccaaggaggacuggcccucuccaccggguuuuucuuuuuuugagacggagucuugcucuaucgcccuggcuggagugcagugguaaaaucucggcuccugcagccucugccucucggguucaagcgauucuugugccucagccucccaaguagccgggauuacaggugugcaccaccacacccagcuaaguuuuauauuuuuaguagagacggggguuucaccauguuggcaggcuagucucaaacuccuggucucaagugaucugcgcaccucggccucccaaagugccgagauuauagacgugagccacugcacccggucccuagccaguuuuuaucuccagccucaguuuccccacccaaaccccacaggcaggacugggccaguuuccaaacugggcucugaggagggccugggagcacuggggagugaggauggcuacaggcagaggugccagcaccccgccauccccgugucccuccuaagcgcuggggcugcccaagugccuggccuggccgccacagcccacguaccgcuccucaggagucuccacauggaaggugcguucgaugacagugguccacugcaggcagcggaugaugaagguguugggccggggccgcuccgucuucaucagcuggcacucugcgggcaggcagagccucugucugcgugcaucccccugccccucccagggcccucaccacagcccccgcugcaccagccagcuccccuugcauaccacccaccagguccugggaagccccaucucuuccucucuccaagccucaguuucucgccucacagaguggggcuaggaccccuguuccagcucagacacucuacuccaggcugaggcagccacacagggcaucuggcccggcgucaggucaaacccccaccaucguccacuccuacaguccuuccuucagucucugagccccgccgugcgccaggccucagaggaugagggguauggagaucccacagaggggcuggcaugaggggggcaccccagaaaccugcuugucccaccuaguguagaaauguccugcuuuuuucccaaccucacccugaguaccugggaaauacagccaccuggagcacacccacaccuggggcacacccacaccuggggcacaggcacaccuggggcacagccacaccuggggcacaggcacaccuggggcacagccacaccuggggcacacauacaucuggggcacacacacacuggaggcaaagccacaccuggggcacacgcacaccugaggcacacaccuggggcacacgcacaccugggacacagccacacuggaauacacagacaucuagaacacaucuagacaccuagccacaucuggggcacacgaacaccuggggcacacgcacaccuggggcacagccacaccuggggcacaagcacaccuggggaacacauaccuggggcacagccacaccuacagcacguacacccugagggcugugggaacgugcggggcccugagaggugugagugaguggaguguguagccgcuggggcuccguggcaggcucuggcccagccugugcaaagcaggaggaggcugaggggccaguggggggccucugacauuccagcaucgaggcccuggcaaccacaagggggccuggccaggcagcaaggaagcugucuuccaggccugggggccaggagggggcucgggaccagccugguggggaggguggccugugucaacacaggccagagaaguggaaaccggugugaagccccggcacacccaccucccacucgcuccuggaugguccgaucugccccaguaugcaauccccagggccagagucucgagcccacugccccggaaccguuccccggagaaaagccccggacagaggcccagcacagccccuggccccugcccagcucugcuccuuggccaggcgcuccaggccacucaccuauggccuaaucugaaggccccagccuugccagcugcucaggcaacaccuccagcugguacccacccgugugccucuccagagagcuccccaccucguuccuucccaaugccucggccuggcgagcacacccacagcacccacccccagcaaggcccugucccaggugccaccaggcacgcugcuggcacccagccucucccugaucccugaagcccccagccccaaccgaggagacacuggggagggugugggacaagucacagugagucuccugcaugguuacgaggcugucaggagacaggggugucugccuuccuggucuccccucaccccuggggugcccuacucuaucaggcugcccugcuacugcuggcuugaggcuggaagagccagggaaggagaccucggcuuacaggaaccagguccugguaaaccccaccccaaccccagccccucagccuggggcuuugcagggcaaggccucugccccucccaacuagaagcuucagggcacgguuugcuggccacagaccaccuagcagccagggugccagacugaccccaccuccccuuauacgugcaggcaccaagggugggaguccuucccugcccagccuggggacggauucccugcauuuaaccuccucccagacccuggaccagaaccuggggguccagcaaguucaagggagucggaggaccgcaggccucaaagaaaggagggcagagcuacuuggaggggaggggccgaugcagcacauggggauggaaccuaaggccagccccuggugggcaccucgcucugcaccacagaccugccugagacagaucccagaggccugcaguuacccagcccugccacauacagauggcccacaacugggcccuaauuagccacucagucacaccugcaugcccaacccgugucucuggcugccacaggcagagcugggcuccaggacagggacacagaaaauggggaccaugcugggaggcccacguguccccagccucccaccuagcagggcgccugggucuccaugccaggguucccgucugacauggguagggucgcaccugcccccgcuacagguaaggaauaaagccacagcagggcggagcagggagcgucacaugucucucaucucugugggaugcuccggccaaggucccccgcuggccuuucugcaccugccccuccaugggcaaggaggcagccucacagaggggaagcaaaggcucugccauggggucuggaggcugagagccugugcagggagaggcacgagcucuuccucgagugauggaggcuucagagcuggagaccccaauggacucuugcccccucacccaagggguuucccaaggagaggcccugaugggcucuaucuaacccccuuggaggaggggcccccggggcagcuguccacccugagacugggcucugcugccacuuguccggacccuccagcuuccagagcaugggcaccagggaacugcuccagggucagccagccuugggacucggcccagagacccccgcccagccagccucggccucaggacucugcccagaaaccccugcccagccggccucggccucgggacucagcccagagaccccggcccagccagccucggccucgggacucggaccagagacccccgcccagccagccucaggacucagcucggagaccccugcccagccagccucggccucgggacuuggaccagagaccccugcccagccagccucggccuuaggacucagccuggagacucccacccagccagccucagcuuugggacucagcccggagaccccugcccagccagccucgggacucggcccagagacccccacccagccagugcuuguugcuugccagcccaggacuuggaggcuccaggggacccccaucguggggccuggugggcaaagagggcuccagccaaccccccaaaucugaaucccgagaggccaaggggauacuuacgcgccacagagaaguuguugaggggagccucacguugguccacauccugcggccgcuccuuguagccaaugaaggugccaucauucuugaggaggaaguagcguggccgccaggucuugauguacuccccuacagacgugcggguggugagagccacgcacacucuacccgucagacccucgccaggcagccaggcaggaacugggugugccaggacagaugugccugggaugccugagucccagggggcaggcgcgguacgggagcuguuucuuagggccagcgacagaaacggcccugggucaacgggaaggcagacucgccccaccacagcgccccucucagaagagccaccccgagcugugucugaaaacgggcugggccagcuggacgcaggggauggaguaccauggacaggaggcugggaagaggucugggccagucugcacagccuuccuggaggaggcagcccuaaaccagccaguccccagcaggcaccagcagcagcucgggccccagcuauggccacaggggcugcggggcugacagcauuccccaaucaaccagggucggccagguggcgacagcaggugacaguggcuugugugggcugcccagcauggccgccccccccgccccgccgccacccaccaggaggauggagcauggcguccacaguuagaggucagcaccacucagacugagggccgggcucgcgggacaggacugcccacugccgugggaucgcacucccugucuaggggccuggagcaccgucuuggggacugccgaugaagccagacacggagguggcccagccagcugggcaggggccccagggcacagagggugccaaguccccaggcugagacccacacucaggcccugccgccgucggcccugccgcgucccacccgugggucauucagguacacgggaacauucucccucaaguuuugcagcaucagccguacgcaggcguucacacuucagaaucagagcagcuguccucggugauagcccagcaaguaccauuuuucauacugacacucggaaaaaaauguuccacuuacauuuugccaagcaaggaguuugaacaacagggaacuuacuaauuaggcaacugcuucaucugaggggucacugggcagggguuagggagggggccaggguaagggguuggggucccugagcucuggggccuggguuuucaugccacacugagccccagacagggacaccuggagggaugugggggacaagcaauugucccaucaccagaccacccaccacccaguccugcugggucuucguggugagcccagacgcguccagcccucccuggugcacagggaagucccagcagggcagcagccccaggggagcucagaggacaugggucaugggcaucccagcaggcauucuacuuuccagggagccacgggggaguucuuuaauagaggugagccaccaaggcucgacacauggccaccccccggccaggugaccucucccuccuaccccggccccagcugcccaaugcccuucccaccagcaccacggggcguggucuccacaagaccagcccucucucugcccaagccagggcugcuggggggaugcugguggaggguggggacaccccacccagcagggccugagugugggaagaggcuguugucaggucugggguggaccaggaaggggacagccacagcccacucauagcugccugacaccucuggaggacggccaacacccaguugcagggaggaugauccagggcccagaaucugccccugugcccaagagcacucaucaggagaccccacccacuccgcaagcccuccaugccccugccagugggcugccgagcaggcgugguccugccacccuugggugccggcuccugucccugaccugggaucucgcacacccccgagugugcacauacacgcacauacgugccacgcagcuccaccccgccucccacguccccucccccagccacagggccccugcaggugcagcgggcaggcaggggcgcucagugagagcagagcaggcucagggggcugcaugcagcccaccccacccgucccccauccugggccaccccgcugcucacgcccacccgccugcaugccagucuggagcugucggccccugauggagugccucccauccugccagcugccacuccccgggacgcuaacugagcgggaagacugaugagcgcccaggcccggcaccccugaaacccaucuuauccaccaacugcugccagcccccaccgugcccagcauggccccgugcugcccccgagcacgcagcucccgugcccaaccccagccuugccccugacccugcugccacaagcccagccccagguucugugagcugcaucugggggguucugggagcuggaucugggggugcgggaggggcaggcccaggggcggcgcuuaccaggcguggggggugggagaggacaggugcccagccccgagcauuccuggggaguccugggaugggcagaggcccaaaugggcccugggcuuucagugccuuccccucgccuggccccacagacccagggaacagacggcgaucagggccuaccccaggagacgggugugagugaaggggccucacguggccuuugucuucggcaucccagcccagcacacagaccccuccaggggaggagcaggauccccagggacccgggguaagggguccagagacacacaguucucuuucuucaucucucgccuagagggucagcuagaggaucacuugggggggugccagcugcagccagggccguggcgcgcaucuuaacgaguucagcccagacaggaugcugggugggcggccagccccgacagcagaugcggcagggccccacuacucccugauccaggacuggggugacacaggacggggcagguggaggagacagccacccggggcccagcaucacuguccucauggccacaggacgccugcaggccugcaccugccuacuccgggucccucaggagggugggagcacagacacaucagccagggcugcccucccagaccccucacacaaagagaccaacccacauggagucuucuccuucacuauccugaggguccccaggggaacuggaaccugucauccaggacuuaacuugaguuccccacccuguugugguccucagaugccccccacucgaggcaggaguacaguccacuugaagaguggccucucaaucccugacaccccaggaaaagugcccugcauugcugggggaacuggaaccaggcaguagggaccucguccuccacaccgaccaugggaagcacccgccacagaggggccuuccaucuccccaccaucagccagcuggcauccccccaccccaccccagucacccccccaacaccaccccacccaccugccugcacagcugagggcaccaaacacagagugggcacagacccccagguugccacgccaggcccucacuccagacggguacaggcaggcaacaaauggggaggccagggcacgccccaccccacacacagccagagucaucuccugccagcagccacucccaagggcaauggagaccgcccagcauucaggcccagggggccucuucagucccuaacucucacacccccaugcugggcucaagaacccccaaguccccacccgcugcacauguuucagacccgggaccuggagcaggcagggucccagugcaaccccggccugggccucagggucuggcagggaagacggcuaggugccccuucagaaaugucagcaaguccggaugggggaccccacaccacugccagaagaccugaguggggggccgaguggaggacggcacuggggacuggucccaccuuccugccccauggcugguccccugggcaagggggaagcagcagcuccggucccacccuccugccccauggccgguucccucggcagcggggaagcagcaguuccagucucacccuccugcuggcccccugggcagugggaggcagcagcuccggucccacccuucaggguucucucaaggccagcccugggccaggugggagccacccugacccuuaacccugugacacugcaccuauccaagaccagguccugugaagccacaagggcaggggcuccugugccugaugaaacccguaacccuccccaccagccagcacauccauggcccagggcuccaggcaugggagguggcugcccucggugggggguaggcaguuggccagacuccugucccugcccggggggacagcggagaccaggcucccucgacuccuccugcaccuccugggccccacacaaccccagcccuggucccucuggcaucccgaugucccggguggcccuccggcaggagugaccuuccauccccaaccccgcucauccccaggaaggggcuggagcacccccagggaaagaggguuccuucccagaaguccuccuggaccaaauaccgggguucugagaggaagcugcuccugccuggccucccccaacccaccccaccaccaccacggggaccacauggacagucacaggcagcccacccucuccacgccucacacacgugucccaggccacacugugggucaggccccccaaagcggcacccacuuagacaugggggccaggacccacgcgccaugggcaggacugggugggccccugagggccagcugguggcccuccacgucccgggacugaccaccuccugagccaccaggugugucagccccccuaggccaccacguccucagcucccugaacauucucucaaaguccccaguucucaggaaacugcuggauaaacacuucgcagagacggugguggcagcggcuggcagggugccaggcggcaccgagcugcuucuccacagcaaagugagcccagcaggcccugggagcgggcgccagcugacagcggccaccgugguccccacugccgacacauccaucgccccgacagcugccgggggcccauuuaccuucuccagcacauugagcagacggcuccgcugacggcagcccaugaggggcccgcaacccacccuccccgccugccaggagaccgcacagcucaccgcgaagggcccggccugccaggccucugcccgggcccgggaguacacaccccuuuaccagcagcccucgaacccuguaaacaaccaggcuggggugggggcaggggaggggccacacaacggaggccagcugaccccacuuggcuggagcccccaggucugugggugaaauacauccacugcuccucccggcacaagcccuucugagggggcacaaguggccagucugcacaaggagaggugucuguucccgccaggcagaggacuggcgcuccaccugccugggccucgcccagcccaggacccauucugcucucccagaaagcccaccaggcaggcagggcgggcagggcucaucaugcccaucagcucccugggaaaacggagacuuaggggaggugacccucagaggcagaucaugaccagagagaccccagguccugccgccaaggcagggguuguaacuugacacaaacugcaaauucuucaccuccuuccgcuccaccauggagcaggccucagcccgacacacacaccccgggaggaacauggugcgggcaggcggcaccaccaugaccccguccaccucgcugaggcacagccggaggcgcuggggccucucuuccugccacuccagggaagcaccugggucucagcuuuccauucuccuggggcucuacugggugggguacugggccucccuggugcugccccugacagaccaccugggccuggauguccucccccacaggcacugcccgucacccaccccucgggccggcaaaggcaccccaccugccacacacccauccaucgcagagcccagcacaucccaagacccugucccugucccugucccccaccucauuuuuggucugccccaaacaagccccacccaugucauggcccacccugccuacucaggaccccugcagaugaggcugcagccccucccuggcgccuccuacucugcccccgcccacucuccccauaacuugcagcaggcuuugccaagugcccuccacccaguggguucccagggcccucacccucgcucccugcgugggaggaagcugggcauggggacagcacacagugccugcugcgagggagggcuggccacagugucccacguguagacacugcccucgggaaaggaagugggcacgggcacaggcuccuuccggggcucggccgggggcacgcagccaugcccacagccccucccuccucccgucucucuugggcagggccccuggcgguugaagggcuccagugcuggccucucaaucccugacaccccaggaaaagugcccugcauugcugggggaacuggaaccaggcaguagggaccucguccuccacaccgaccaugggaagcacccgccacagaggggccuuccaucuccccaccaucuuguuucugccccaacuuggagccacgccuggggcaggagggcccccagagcacggccagcuguggagggugcuccuucugaucccccggccugcugggacauuguggcccugacccccguggccucaccccacaccucaccaagcuugugcagcucagcgucuccgcgcccuacaccuggcugcugugccccuggccccagucuguggggaggccagccagacccuggccagccgaagggccucucugcauucuccaggcccagggagcagccaccuccccgccaggccugcccagggggugucuccaccccugagcuggacaaccagcugagggccugggcaggugggcccgccagguuacaggguauggguggggucugcagucaccgggcccgccuggggggugugugagcccaaacacagcgccccaaggaucccaccccaaagcccgcaacauuggcagcagagucacccaugaacucccaacccccucaauuccaacguuucugaaauccaaaccuaucauuccuuaagguucaaggaaaacacaccuaaaggcggcauggcagggaagggaacucccguuggagaugaggaaguaaggggccuaggguucgccuaacagccccauccuggccuggagccccagggcccucugccaaccugcccggggccccagcgcugggcugggggaaccuucuccugaggccaugggacuaggcacaaugguccaagcagacagaagcagcaggcagcugcccacccaggguggccuggggagcaggcccagagccacagccacagccaccagucucagcuaugggagggcccgagggcagggugcuggccccaagccgggccgggugugcccaggcagaggggacgccagcgggggccgcgccaguucccuccgcucagccucgugcaggacuucuaggaacccggccugaugcaacccggccaggcuucuccugagaguggaagguguacgggggucuaggccccagcacaggaaucauuccacccacauucuguccacucuccugggccucaguuucccuucccggaguccagccccccacagggcaucccugcccagagagggccagugaccaagaaacacacaggaagaagagcuguccacucaggagccaccaggcgugggggcuaagguccagggcuggggccagcagugaccccucacccccacucaaggccaccucggcuuccucuuuuguuguuuuugaagugagaacucaacaagcucccaaaacaggaaccucccugaugcuggcggccuccaccacagccaugccaugaccuccaccagccugugccuccugccccucucccggguaggcccagggcuguugggacccccacucucugcccagcccucccaccaggagccagcacacuugccuccccaucucugucccuggccugcccacgggggccguuccagacccucaacgcucccccaggggaggcagagcuuggcacuaaccagcccagggcccgcgggucucacacugaagccaccuagacgcagccugggguugacccucaccugacagccugggaaaaacugaggcccaggaggcacaggcagcccuggccuggagcccaaagguucccacaggcugaggggagagucugcgggcucccucccucaggguccugcugggccccucauccuggcgggguaaugagcagccuccaucugcacacaaacaauuagcccugcggggcccuccgcagcagcugcucucuggagugggcucagagucccccacagaccucuucucaaggguguuuacucagcaaagccaaggccuccuccaggaugaaggggaguggccuguacccucugaggucccccaccucacgcagggaccccaggaccagcuggauggcugagcagcagcuggggaugcagugagguucuaugucgcucaccaaagcgaaguaacacacugggguaggaaccacucucucccugccucagugcccccccgcagggacagccagugccaggacuucaaggcggggagagggggugggaaggaggcccagccuaggcaccugcuuggggucagagaccagccuccauacuccccaccgggacgccuggggcuaacucagcaggaguggugagggggcugcccugaggccuggacuggggggucuaugccaggcaugggcccgggguagggcauggcaaggacucagauguccggagacuggacccuccgugagccgcauggacacacggucccgugucacccgggcccggccaggcacccagauccguggcuuggacacgcugcccacacacucaggagcgucugccgcguaacccacgcgccccaggcagcuucccucgacccccgcccacucggccuuggccugcugggucacagccugccgaaggcagccaggccugcagcucuuccccggccccucucggacagcgaccagccugagggaguccagguggugccccugcggccggcacccacuccuggccuaggcccagcccuuucucgagagcccagagcaccucauccugggucccagcaucccggccacccgccucggcccucuccugacccacuugguccagccauguggacggggggacgcucaggaagacagccgcgaguggacaaaaacaggcuccaggccggggcugcaccagggcagcucuccacggggcuaggcugcagccaggcuggugcacggccccaggaguacuggggcaagcgggcaaggugagcaagcuguuuggggaaaguaccucaaaagagccacacagccucuggccaaagccuggcacggagcuaucaaaggaaggaaaacugcaggcuggaggccgaguucagccagaccugcgcccuggcccaggauugauuuuuuaaaauugucagccuucaaaaaucaggagacuucacacaacagaacaaaucuuugaaaaugcaaacgucugagcaacacugagcccaccagaccaccaauggccagagcugagcugggcugcuuauccagugagacagccgaaacaggaggggacaucuggcccccugucccuauaggccccaccagccuccucacuagcuccugcccuuaacagccuaagcucacccuccaggaaccaucucccuguuagaugugcagacccagaggccucgccuggguccagccacagguccacacaggccugcagccggaacuccuguguccccaugcccggucccuucugucccugaagcuccucugacucagagcacacacaucagaacaacagaaagcagccugggccacuucccagagaugacgcucaccucccaaggagcaggagaaggagccugcagacacugccaccccaccccucacacacagggcauacccguccccucucaucucaaugaccacaucaccccugaaggcaccaucacgccacguguggccagcccaaguagccguggugggacugucaccuggggauucagcugagaaccaaagugccccaggccacggucguggggagucccggcaaaggggacaggugcgggccagccucugagacaagcacccugaccugcaggagcaaggcugggggggaguggaacagggcgucugcaaggggcugcggccgggccuggaggacagucacugcgucccucccucccuccccacccccagccaggccugagcacugugaagcacggguggggucagcccagcacagcccugcuagggacaggaaggcagcuaguaccucuaaccaguguugcggguggggcuggcccugccaggaggguggcacagcacaucugcaagacacacaggggaccccagggacgggaguggcgaaaugcggcaggccccggaggacaggcuuuccuccgcaaggagcggccggccaugcggguggacgccaccugcucucggcaacaagaggggcuaugccugccaagggcauaugucauauccacgccaccucccauccucagcgcccacuacacuggggauggaggaggaagagccggggguagagguacaggacccucucuccuggccugaggcuaggggccagaugacagagcccagaggcugcugaggcuggccggaccccaacucagggccgcccacaagccauucuccacuccaccaggucucucucccaccaccgcucccugguguagauggggaaacugaggcccaaggagcucaaugaccuugcucuuggaaagggucauggcgauagaguggcuaaccaggguucaaacucagcucucuggacgccccacugggccugauguccugucccugccaggccccuccugaaggcacgacaucagcagcagccugaaaaucaccuggccucgggggagcacuccugccuaggcccagcuggcugaugggugccccaguaacuggggccugggccccugggcagucaaggcccuggcaucuccugggucagcccgagauccaacagucuaucaacaaacacacauuugccaaggauaaagaagcagcggccccaggcagcagacuaugugacacagagaggaacagggccagggucggggcagggggucccugacaccaaagagggcugugaggugaggagaggaccuccaggcacagguggcaggacuccuggggaacaagcaggggacagcacacggggaggggauggagaaggcaggaugcggcaggaggccuuggggggaagcagagccagaagcuccccaaggaccacaggcgucugcagccuccuugucuucaucucgaggccccgcgugccaucacugguagcugcccacucaaacacuccaaacacacagccagccacaccccugauucccccagcaucucaucucggucacuccuucaccccacccccaggcuccuguggcuccuuaggccugcucuucugugagcuccuauacaucccacaaugccccaucuugugacaccuacuuuugccacaccucccugucugcuccagcuguguuuggggucuccccacuaccagaugugaaacccaucugcuagaggguguacguaaagccggggggcugcuggcaugagaucacuagaacuuaggagggaacaagucuggaaaaagaagucaggagagggcggaccgauuccgccuggggcagaagagagugacuuggccagaggaccuggaccugaacaggaagcccacccuagcaggacagaggagcaaaacagccacccagacuccaccgcaccccgcugagcaacggagggugggugaggcagaagggccugcacaggguuggaagggguggggcuauguccccagcucccaucccacccagcugcuggccaggccccucgggcagcaccuccuccauaggcugcaaggccaaaugagugaggagggggacacaggggcugggggacuuggcucagccagcucugcagcuccaaggcaaacaugcccugugcccaggcgguacggauuccccccacccccaaagcucaggccugaagcaggcaccaggccaagccaagcagcccugcccugcccucaggagcccuugggcagugcccugggccgccagcgugccagacccuggaacagcccaguguccucgcugccuuccaggaaagccaggagagaggcuggcagcagcucccccgccugccagggcccacaccaggaagccacucagauggccggcccugcacagggccucauccuccuggccuccccgaggccgugcccuccaugccaugggaagacauggggcccaggacacucacccuaggccagcccaggagccccaggggaggcagccccucccacccagcagggcacaggcacucacagacccuggggcuacuacccccaucucucccuccccaggcccagcccuggcagcggguacuaaccucguuugugcagccaacccuccuucacaauagccacgucgcucauggugcccgaggcucccgcgacgcucacgcgcuccucucaggcuggcgcuccccgagcccagcuggccuggccacagccucugggagaagcaaaggaagcugaaugugaggccacgccuggcuaagggcagcuccucgcccugggugagccagagacccacugcacgugccugggggcuccacccgcaccugccuucccaggugggcugccaucccucuaagcucucugacccccaucugcccgccugccuucccucuccccaaaacacucagggcugccaagugucaaauccauguaauugaacacaguucccuggaccugggccucuccuuauucuaggcuuagagccuccagccccugccaccaccacccgcaacagccaggcccugagagcugcugccuugcucaccuccccauucccaccucccccagccguuggacaaaucacccccauccccaaaaggccuucccagccucccuaaccugaugcaccagcugacaggcugccuccuccaggcagccccuuugacuucuuugacccaggcuggcucggccuucccuaagccccuggugacagauggccccguuugcucucccuguccaugguguuccuacccauggauccugggacagggcacagggcuccucccugcuccccagacuaggaaagcaaagaaauucaaacaugaggaagacaggaccaggaugcaggccacuggcgcaaacgggaguccagagcccuccagcgcaagcccaaaaaccuccugggagaaaccccaggccccuccuaaaccacagcgccccugccggucugaaucugguucauucauuuggccaacauguaccgggcgucucagguuuugccaggcccagugcugggcgcuggagacaaagagagguucagacaaguccgucagugaggagcacccaguccagggugguuacagacccauaauuacagcagucgggaggcagcaaguaagugggggagcacuggacaggcccccgcccugcagcggcccaccagccaacccucaccugagcacacuuuauccauugauccugcauggcuuccucauuuccccucugauggaugaacuccuaggcaucccucaaaacccaguucccacaucaccaacuacaggcauccccagaaagagcacuucgcaugcucuuccugugagcaguccucugcuacccuuccagaugggccuuccugaggggaggaggguccucucugggaccuccaggccaggcagagaccccugacgaccucuguggaauggaucccaacaugggucuuuccacagccagcuuagacgcucuccccccaggccaccuuucuggccucccgaggcaagggcuggacacccacaaaggguugcuuugcacugauugucuuaagcuacacuuagaauggcaggaaggcccacugccuugugucuaaugccaggacagggaagaccacaccuuacccaaagagggaaaugccccaaguacuuagcaggauggaaagcaggccagacucgaggaaggcaccgcaggacuccgagggcagggcuccgagccgcgcacgccucaggcacagggggcucugacgacacugagugggcguggccuggaggcagagggcuggacucaaagaccucuggauguccccccacccccacacgggccugagccccuccaaggccugcugcugacagagucagacagcuguccagagccauguguaaaaauacaucugugcucacacagggugguguacgucugcacagaaacguauacaccaggccagcacagggcugccugugggggcggagggaccccgacuucccacagccuccguaccugccgccugccuuuaccauaagcacauauucuugcuacuauuauuaagucacaacuuaaaaaaaaauacucuguuuucgaaagggcuccuccaucugccuccagaacccugguguaugagaagucuacacagcucccgggagaggcaaccggacccccaccaacggacuccguccgcccuucgcucggaugagggacucaaagcagucaagaaguggccaccuggagcaaggccgagagacccaggagugaauguggggcggccucuggcugcagagcaggggcccaagcucacccgcugaccaaggcagcacucagaggccgucccgacaggaccaagcucgcuagcgccccaggauacucaaucuaaggggcaagccccagcugcccuccaagccuuggccucugggaugggcgggcaggaccuccagggcccacccaagacaggaagcaguuccggggcccaggagggucacaguccuuuguggcuagccuggguaccccgccaccacguacaacuuuucguccgugggaaacgaagucuccuuccggggcccucccacaaacuugaaggccggccgcggcgagucuuucuccaaccccggggcaccuccgccggcugccucgcuggcccagcgcccggggagccccacggcccgcaggggcaccccgagccccagcuccaggcccggcggcgucccuucucucgggucccggccucgcccggcggagcggccuccccaaggucaugagggaggcuggggccggcagccugcacccccggcgcccggcguggggccgcccucccuuggccgggcccgcgcgccccgcgcccuccccgcccaggcccgcucggccacuuccugcucccgcuccuccauucuggcggcgccgcggcucgcgccccggcccgaccggccgcgaacaaagcggcccggcccgcggggaggaaauccaggcccgggcggccacggcgggcggggacucaccgggccgccgcguccgggcgcgagcgcgggccuagccgggccgcggccuccggcgcccgccgcuccgcauccccgcgggccggcgcugggcggggccgggcuggaggccgcggcgggcgggggcgcugcucggggccgggccucgcgugccgccgccgcucggugcccggugcccagcgcucggugcucggccgccugcucccgucuucgggccgcgcugcgugcgcugggccagccgccugccgcgcucgguccugccgccgccgccggcccgcccucuccccgccccgcgcccgccccgcgcccggagccgcccgcccacauccgccuccgccgcccggggcguccccaccgcgcggccggcggcgagggcggagcgcgcucggggagcgcgcggccgggcugaggggcagcucccgacgaccuggggccugggcugggccgcuaacggagcccggccaccagccagcccgucccggggccacgcccucucuggccucaguuuccccgucuguaaagugacccggcgcuucugggcucgcucugccgugacccuagcagaaggggcccgagacaggucagggacgaaucccggacuucugccuccgcgcgcggggcggggguggcuuagguugacuuucaggcugccccacucuggggggcguggagggggcggccaagagugaccuaaaaggcccaaucccaagaccuugugccucugggggaagugcgggaggaugccaggacaggaggucaguuggaggugggccuccaaggagcaggaaggcuccgaggggagucaaccauucaccuagguacuggcagcuacacucacaaaagggggacuuugcuggggagugggagaagaggggcacaccuugccuggcucccaccuugagcugggagcagacaccagacagaggaggagcggugucuagggugggcugugacagcugacagcccagagcccucccugcuggguggacuuggucagcccggacacccaguccgaaguccacugggaggcagauggcccggguauggaaugaguaagugggacacagaccccuuucuccuggacacucacaggagagugcaggugacugccaccccgaccccuuc

SEQ ID NO: 17173 - RNA, 3851 nt, Homo sapiens
cagcaugggaugcagcacuuucuuuauugcccauccagggaacagccaagccagcuccaucugcauucuggcugcagcguguacauuaggggacucaggggccacagugugggaccgugcacacuggcaaggcacuggcggaugcuggcaggccaguggacauggauagaugagaaugacaacucacagauguccuagcuucugcuggcccagcugccagccacuggccaucacccuuuugcccagcaugugugcauugucacccaaaacaucuugaaacuugccauuagugaggcauucaacaaagaaguaagcuaagugaguaggaaacaguguuuccuggaauauaccgcacucugccugaaauaggaaaacuauguuugccgggaagcagcagcagcaggaaagaaguuauaccaaaaacgacuuguacaccacagacauuauaacccuuuccucaaagaaacagucauguucuguuggguauuauggacaggucucuggaaauuuaucuaauaaagaccaacaaacuuccccagcagugccucugaguaccgugugaauucuggugucuuguggaagucagggugccuucuuugcauccaaagcuuugagggagcugggaagcuuugguuccauuuuaggagggcugugugauggugacaaagguguucuggucauuucugcucuguucuccguucugugaagugagguggauguaaugugcugugggauggggugcuccauauguguguguagccuuuacuuuccaacuuaguuuuuugcaucucucuuguacugaugagccauaccucucagccuucauuuggucccaggccugacccuuugcuuucaucgucagcuuuucuguccugcucgggcaggauuaacucuguucuugccgcggaugucaccaucacucuggaguccagcccagugcccacaggcccgaucaguucacccucuuccuucucuucaggggagaaacuuucucgggcaucaaaaaacgugauuguuucuucuugaaguuuuuguucuuccagcucugccccaucuucggugcuuuugcuuuucuugguaggagaugaggagaacccuaauuugggaaaucggaaccagccugccuucuccuguuuuuuaggcaguucugccucuggucgugccucaggcuguguuugaaugggagcagaucucuggacgucauuuuuggaaucaacaccugucucaucaacagaagaggaaaacccaauguuuggaagccaaaaccagagcagaccagauuuuuuacuuucugguuugucuuuuggagcccugccuucaucugccaguggugugguugccucuuggcuaucaucagggggaaacucaagaauuucugcuggcuccucaucugaacagcugucugcaagcugguggccagaaggaacuucaaaugugaguguuugcugucccaguacauugacgcuggaagagaucaucucaaaugguucuccagugucaggcuggagaucuccagaaauggagucuacuccugggguggcuuguaugggagccucuucugugcccuccugaguccuagaguguugagucauuguuguguacacucuagccugcguguggggcucugggauuuucacuuuuaauaaggaaaauccguacgaagguguuugaaucucugacguggggaucucugauucccgcacaaucugaguggaaaaaguccuggguacugagagaucuacaaacucuggugucacuaugcuguguauagugaccucuugacuuucaaccugagcacccugaauaugcacucugaccuuugaaauugggggagcuuccaaaggcagguuaagguccacaggcugcuccccagggaccccagcaccugccuucaggaugcuggcuccccagagccccggacuuuccuuacaaagggcuguaucaauauuggccucuggacacugcacuucccucacaguggggaugaacacaucauccucugagcugggggcagggaaggagaaccuugguaccauuaauuuggggaauuugacaguuaggacagaaucuucccacaguugauccacauuaaccacagaaaucugggauggcauaucaguacuugaagcuuucaauuuaaguggaccuucaggcugggaagaccauuucucuguuuuauccuccaugcuggcaaggucauguccuggcuuggaaagaggagucucaucuauuucuccuggaagaaccuggguuucuggaagccucaugccaggcaucugaaaagggagagguccuuuggauggauggauccugaccucagaaguggaaagcucauccccagucaucccagcaguggagaggugcagcuucaagccugugcugucaagaucacaccuuagaauaucuguggaugauuugcucucagaagcugucacuucugcaucugccucugggagcuguagggacauagcugccuccacguuugacccagaaacaaggaacucuuugacuuuagcugcugcuucacccccuguugcugccggugccugugucugagccacuuccagcuuuccagccccgccucugucccugaaagagcgccuaaggcugggcaugcggaacuugggcauuuuaaaccagcuuuccugcgaguacuuggucauggcuuccuccucugggcuuuccacugugaggacuucagcaucugguuuucuacaggauggcuggaggggaucuucaggugugggggcuauccccuccccacaaggcuggcucacugggacauccccgagcccacauccucugcugucaccuucgguagacagaucauguuugggaagaggcaggucagcuucaggcuggcucaccuccaccuuggccuuggaggaucugagaucagguuuggcaaagcccaaacugggaauguggaccuguggccgguggagguucacacccucacuuccuguggcacuugcuguugcaccaaguccuccccuaccaccgucacugcuggccuuuucugugucuugaaagcuacccccugcuguggcacuagaaagggaaggauccacgucucucuguggcaggcugaccccacucuuagaagccuucauuuugggaagugcaaguuuuggcauggcaaagccaggcuuugugcuccuccccuucucuccaucccucucaggaggcagauccauguggauggcagacugcggggccacuucauccuugucuaaaaccaggcugaguuuugaguccuccacgcugcauucuggguccaccuuuggcccuguuuccuucuucggggaccaccuaaaugauggaagcuuaaucuuaggcauuuucaagggacucccuuucccuucguggucagcaucuucagaaggggcuucuccaggggccacuacugaugucugcaaggaggccacaagcucuucugggcccugagacacacaggugccuggggauggcagcugggugcuuggcaaggggcacugcacucuuucuccagggcuaagaggagacaugacuggggcacccacugcugcauguaggucucccucaggaacugccauuugggggacugaaaacacaaacuuugguuuauagaauuuaggaaaagauaccugaccaagagaaacaggaaucauggaauucagugggccagagugacucucagcuugagauguuggaacucccucuggaggcugcaggucaguggagcacucugucuugggaagaggaauaucagccugagacccagaaggaauuuccagagcaagcucaggggccaaggcagcucugggaacagucaccugguauuuuguaaguguaacauccucacagggaga

SEQ ID NO: 17174 - RNA, 43295 nt, Homo sapiens
aaggagcugcggggaggcuccaccccucccucgcaggccgcauggagugcuccccuccuuugucaccagccagacccgggcagagcagggcugacggacagccccucuccagccacuggacgaccaaggagcuaggcuggccucuggcagcuccccuccgggcuuccaggccuucugccaucugcccucacccccagacucaaggagucaaccuugacuccaucuccucccuggccuucccagacuggcccccaucacugccuccucuggguaaggggagggccuggcccuggugaagcccugaaccaugccaccuacuguccacccccuaucuaccucaggcucgcauuucucccacccuggggccuggggcccugccuggacucuguccuugcuugaaucaccccuucccucccugguccuucucagccaagcuacagaacaauuuaauuuuacaaaugacaagaugagaucauucucugcaccuuagacccagccuccuguccccgcuccuuccugaggggcagagcagccgggccaugcaguauggaagcucuucggucagacugcccaggacuggaucuuggcuuggccaccccagcaccgcagugacccuaaggauggugaucaggagcuggcuggguuuguagaccaggccugggccugucuugccagcuuaagggcaguguccguucccacugcugccccucauccacugcacguccuugccguccuugaggcccagggagcugggaggggggcaggaggaguguuguccuuguguacagguggggaaacugaggccccaccccaaaggccugcgugagaagcagagcugggacaggagcugcucuccucguucucugcaauuccccacccccgucugggccucagcuuccacgugaagagcguggggagcacaguacucccagggugguuggaggauagaaaugacccauauggguugaagagcugguguggcaguugaacagccccacagagauguccacauccuaaccccuggaaccuguggcuaugugaccuuacagggucaaagacacuuuauagaugggcuuaaauuaaggcucuugagaggaggaguggagccuggaugaggcauguaaucacaaagguccugagaaggaagcaggaaggucagagucagagaggagacgcaaagauggaagcagagccggagugauacgagacugcagaugccucuggaggcugaagggaccagaaaacagaucuccccugaagccuccagaaggcacaccauccugcccacaccuagaacuggaguugauaaaugcgcacaugcuguuuucaaccacugugucggggguauuuuguuauggcagcagcagggaacuaauaugccugagugaccccuugugacccacugagaagugcugcgucggggaagccaaggugcagaggaaauggcagcggcaaccuugacaucaggugcccaacccugguugcaggaggaggugggggcagcccagguggcugcuaggccgcugcuggcuucuugggccagcuucugggcagaccauccugcuucauggcacagccugaaaggcacgagcugaggauaaggcuuccagguuggcgauuggagcaggcacugcucaaauugaacuggcccagcugcuaggggagacugggccggagaggguggguucccauuaaagccugggugugggggacauuagccaugacucccgaggggcauggagggggcagguggaguguggucgggacgaggagcccauguggcccucccaggaccucuccagccaccucgguccacccugagccccagcccugcucaauggcuguguggggagcaccuucccuucugcagaggagccaagcuucccuacccuagucucaggaggaaggggccagccuggguucuggggcaagugccaccuaugcacagagccccacagucaucuugggaucucccagcaucaccugaugagcaaggacuggcuggggagggguccccagaagcacccaggcauccugguccucugggauccucagccccaagucccuagggcaaguuggggcgugugccuguccucaccucuggcagcaggagugccagggcuugcaggcggcagcaugggaaccugcugcugcucggaucccaggcuagcccacacggacugcugagccagagagcccgaugaagacauggguugaagaaacccauccgaguggaacgauggcagcacccugacaugccccaccacugccacauuuccugaucccagcugugugggugcagaggaaguggaccuggggacaauacccaggccugaaacgggcacccagcuuugggggagagugaggcgguuagaggucaggagucaguguggucaggcaagagugggaggcuggguggacaagugucccccaccuggucaggggguccucccccaucaucuccguauaaaagacugaggaggggcaggcaguggcugagacaguccuagaugcucccaccucaccucacaccccuccaucugggcacgaggcugggcuggaugcaaggcuguggcuggggcggggcagggaccacagcagagcuauuuuugcuuauguugcugcagcugccgcagcaagaaucaaucauugaugcugugggcaucccugccugcagaggguggaggcaagcagcgccagucaggccaugggggcagggcagcggcucugcugaugaucagggccuggggagccucggcuccucacccaggccccggcacccagccucaggaaggcugugggcaaccagugggcugggccaguguccccaucucagugguccagggaagagguggaggcugugugcacaggagagagcaugcgaugcccucucccuggggugacaccuacagcagguguggggccuuguaugugccaggggcggcugugaguugggcuuguguccagcgaugcugugggugggggcaugaauuccugagcccaggcaugcuucugugguccucccuagcugggcaucuguccucagaggggcacauggggaggaaacuggagcugggcgugacgacaggagcgcaggcuucagcuggcgggcagggcccgggaugggggcuggcagccccucucaucuucuccccugcucccacagcugugacccuggaccccuguuucagcugcugaggcccuggugggcgggaggagggauucuggcuggccccuggggagccaguccucaacugcacauagccgcagccugccuguuuguggggguacacugcccaaguugcaggcccucccagaggcaucuggagugagauagagcucucaggaccccagguuccuugagguggggaagcucucuggacagacaccccaaggugucuuacucaugacacugucagcuuaacccucaagcuaggagaagacccccagaaggagggugggaggggcaguccccagcuccccgacagucacaaccagacuguggccccagcacucagggcagcgcagagccagaggccacugcagagagacaccagcccucugucucagagugggcaggagaagggagggacggccuccggguggagcaggcccugcccagaccccauccugaauucuggggccacaggggagcauggcgcagcugcgugugugugucugugcccaccuuggaagugggcagccccgugcagggcagaggcaaaguuccuggaccugggcagcugugguugguucugggaccauuucuuagccaggggaggacaggcccaguggacacagcuaggggaagaucucagccaccccaggcugaggggcaggaccagggcaaaguccucccaagugugggguccccacacucccgugacgccacgcugaacuugcgcucucacucggcccccaccaagauggccuggaggguucucucaucuugcugaaggaaaacagaggcaggggcagcagguaguagcccagggacagggacaugucgggggcaaccucggcuuccccacccagggcuccauccucacccaucccgcaaagccaaggggaguccccguagcccugcgcagaucacgccagacaaucaggagaggggccacuucauuuggauggggacccaggaggccacaugacuuugucaagggcacacaccuaaaggggcugaggacacaaaggugggugagugcccugagcggccccucguucccaggcccugcagccagacucagacacagaggacuagcgggcgaaaccccagcagaccaggcagaggcauagacacauccagggacacacacagagguguaugcacccaggcacccuaguggcucucucccuguguccagggagugacugacuccaggugaccagagcagggugggcuccuggggagggagguaagugcagggccucuggaccccaggcaacacugcucagccccgaaaaaaggacacugcgagggggugggguaagaccugcgccagguccccacacgagggagaagguugugcccaucaugccugggcucacuggcaggaggcugccagggccucuucccagcaguggcucuggcguccaucugaccugcugcuggauggcugcccgguggcugcagcgcggcuaacgggaacugucuagggugagucaucgugcccggguggcucaccugggcccgcuagcugugcguggucuccaaaugagcccaggaaugcgugugccccuguguguauguauacacgugcaugggucuguauccugguguggguguucaugcaugcaggccugaguguaucaaauaucucagguggccugugucugugucuuggugaguuugugaucuuaucuaugagugugugugucugccuggcccuuccgguacagccuggccucuucccaccccaggaaaagguguccguguguguguguguguguguguguguaugacagagcauguguguuugugucucuauguguaugugucugugugucucugugugugugucugugugugugugagugugccucuauguguaccuguguaucucugugucugugucucuguccaugugugucugugugucucugugugugucugugugugccucugugugugugucuguauguguaccuguguaucugugugucugugucucuguccgugugugucugugugucucugugucuuuaucucuguauguauguauguguguguguauccguauguguguccgugugugugugugucccugcaucugacccacaccccuggacauugccaggcagcuccucauggagguggcgguccucuccugggucucuuccagcccugccuuccccgacaaucccugcagaacuccacuccuucugggguaugcccgguuugggucuacaccaggccaggcgucaccaaacucuuagaacucccuugggccccugcccucccuguccacacccccaggugugcugccucuguguggugcccaagcuagaucccagggaggcucccacccucugcacucugauccucaccaaguccccucugccugcauauccuuucacucccucccauaccauggccgugguuccacugcuccuguuuccagcugugccccaugccaacaccccuagccaccugcgcagucuuuccucagcucucaccacgcucagagacccugcuuggagccuuaaguggcaccuccuaccgacaggagcccccucagccuccuugcugcccugcccccgcccacugggccugacuuucaaccccagcccuuuugcccccauucucugcacacacgcuacucuguccccucucuccagaacgcuuccuacacugccuggcacaugucucaccccuaaggucccagcuuacacugccaggagcccuccaggaccuccguucccccgcccccagggcagugccgcccugcagaacgccucauccuuacaggcuugcuugugucuacgccagaccuggagccccuggggcagggccaguggggugcugguugccgcuguguccuaggcccuaggcucuugacaagaaucagcagaaaggaugacucugggcgggguucuggcuccaggacugcccccagcgcugggcgcucccgcacgcggcgcccaccccgcagcccugcccggggcgcccuguucccgcugcacgcucucagccgcguccucguaucugccacccaccagccccugcagaauucuaucuuguccuuaugcugccagaucaccuccugcggugcccgcgaccccuguuguccccgcaggcugccccccaccccagcuucugacuaaagugucugucucccccggaaugggaggugaagacagcggcaaguccaggagccucggugcggggauccagaggucgcucccuggcgggaguccaaaguuaauucugcggacgcgacaggcgggccgggggcgcgggguggggcggggccuggcugggaggggcggggccgcggcgacggcagccaaugggcugaaugaggccgacggcaccgcccgcgagcgcgcuccgcaguggcccggcagggcugggcggagccgggcgggguccuagcugagcggcuggguagccuggcgcgcgguguccgcaguccgaggucggccgcccgcggcagcgcagggcagcggggcagagcgcggcucccgcccgcccgccccgugcgccggagccgggaccagcgacuggacgcgacgggccgccaggcccgcaccgccuggccgccgcgaugugcgacugcuuccacauggugcugcccaccuggcccggaacccccggcagcggugcgccccuccccgccugcagcccgcuccccuggggcgggugggcuacgcgcgagggcgcgcgccggggcguguccaggggcgcgcagugcgggccuugggggcgggggacucggagacgccugcgggacucgcgcgugguucugggccuucccggccgcuggagucucuucucccaugccucgcguucuaccuguccguggcuguagguuccugcuccucucccggccucugagacugucucugucgcucacuuuguuucucgguggcugacucgucucugucgcucacucccucugucacucgcggucccugucugucucuccuucucgcuccugccccgcuccugggacgcugucuggucgagaggcggccuccugggaggugcuaccgcacucuggagcagggcuggugucugcaaggggcgugaaagccggggccgccgggacccggggcaccugcaccaggcuugcccucucaccugcuuugcgggagagcagccaggcugguccaggagucugggcucuccacuuugguccggggcuuccaggcagggcugggcugcgucuacuguguggcugugugguggggucgcuggcuagguggaggcuguggcagggcuaggccugaggucuggggccuggugaggggccugaauggggucaaagucaggccacagggucccgcagugcugggcaagggaaagugggugcuaccuacuggcaugcccccagggauggucaguagccucccucugagccgcaggcuacggcauguguaccugcugcucuuugugugucugucccugcacugggccugguuccggggccugggugucucagcaucuuggagggcagggcugaggggggcagggcagucccuugggcgcugggucuaugcugcugcagcugaccacacccagggcauuggcagccacuggccaggggguugggcuggccggcacuggugcaggcuggaccccacuccuuggggaaaacaggucaaugcuaauggugccgacaaugcugcaggugagaggggugccccuggccugggcaugccccccagcugcagcaggcacuaccaaggccccuccuguggccugucugucuggugcgcacuuagggugggaggcuugucuggggggcuccagagcagggaggccccuacagcaccugcuucacggugucgcagaugggagcccaagguguuugggcacagcagcgggaggaugauggcuccggugggcuggaggccccuggcccccuccucuuucacuaugacuggcccugcccacauggcugcaggucgaccuccucagagggagaagggcagggcccccaggcaugggaccacuacccugcccccagcuucccugcacagccuuucugcucugcuuccuccucacucacgggcacccagagacucccaagcugcaggguccaggaccaucucauccacccccugccuccacagaggcuugugcuggcuucaugguucccagcccgucuggggcagucccucccuguguccagccuacggaaccauccgcucuuagggaauaaggucaguggcucucgcuggagcuuugguaggagacuugcaagaucagagaccuugggaguucuguccagcacaccgguucccagacccuccccaacccugcggcccaggaacgugcauuccugacaagcacccugccaacuacugccuuucccagccuggauuugguccaggccuuuuccaccugcaguuuccucucagcaggcuggagaugggcggacucuccccugcucucgucuuccuguccaguccaaaccugcccucugcccgacacaccaggcaccagcccagcagggagccaucuccugggcggcuuuugugccgaggcugcccccugguggccaugcugggaccaccccacgcagcgcugccgacuguaacaccagccaguucacucccagugggcucugggugucacacucuugccuacuccaggggcagguugccucuuucccaggggcagagcugggccccugauaacuggggagacagggaaccccuccccggccccggcccccacccugcaccugcugccccgguguggccugagcaccucccacgaccccccaagaaagcaccaccguguugggaaggccccagguggugauaccaugcgaagauguguggguggucucuucucugcggugggggucaugagauggcugggcccuuucccaagaagggugcaaagcaaggcagcuguggagguggucucgcuguucugugccucgcuggugcccucuucagggccucaggcugcaaaugugggucaggaccucacauucggggucaggagugauugcagcugccugugcugcuagcuccacgcagccagggaugccgagugacagcgcgggcgggucugucaccacccuggugucucccugacugggucaucuacacugggggagggcuguauucccauucugcagacaaggacacugaggcuggggacagugacgcagugacucccugggcucuuaggggccagagcagaaugucgcacgcuuuggucggugacaugcuguucugacaggugcuggcucugcccugccccaccaggcagggugaccgcaggcaaaggagccccucuguagccgcuaguggcaggaaugggccuugaggaggaggcagcagagggcauccuggagugcccuccagugagguggccucucagaagccaccgacagugaugcuguaaguguguuccuaacaaccccagcucuuucccugguggggaaacagaagcuggaccaccagggagggaggcugggcugccugcuggccucuggcuccugccccaagccucaggcagugcccaccuggugcagcucagggaagggggugaggcucagaaguggacaggagggucaagcccgcagagccuccaguuccaaugccccaggagcccgcucccucccggccuucuccaugcccaggaagcugagugcccacucccauccgggcucgucguggcugggccuacaacaggaaugcccucauugccuucucuccauuuggccaagcucuucuguccugggcugggcuaggagcugccucuucugggaaguccccuggguugcugggcccacucccagcucucccuuagacucuggcccgcucuguguccuuccucuugugacaccuaugcggaaggccucuguguuucaggcucagcuaggggcuggcuuggccagguguggagaaguauaggugcuggggaggaaaggcccccaagccccagcaaguggggggcacuggccaucugggggucccugccacccacuucaggaguaaaaugccacacucucccagcuuggucuuccggcuggcagagacggacccugcgcucagggauggugugaguugugggggugcuuccccgucugucuggcggccuguucacccauccuucugggucucaaagccaccccgggaacccugggaccugggaggucauagcucagcagaggaaggauccacccauuguucagucaacaaaugugaaucccauuuuuguggccagugcagccuuagggggcacagaagggccagagagggcucccuggaggacaacuggcccaauggagaccgggacuggucaugaaaaagaagcggaggcaaagcagcaggagccugcagaggcugagggcgaagucagggaccugcaaguuguucaacccagugcaucugggacgggguggggugaggauggagagguggcagcgucagcugcuggagggagggcuuuguccugagggcaccggggagccccauaggucuuagggcaguuuuggugggaaggaagcugcuccgugggggauguggaggccagguuagcuaagggagcuuagcggaggcuuaacuggacacacaaggaggacggggcaugcuccucugcuccccuccacccgcucuaagggugacgggauccccagccacgcugcgagcuugagggugucuccaccaggccccaccugcacucagccugggccuccagauuucccuuuauuuuucuuuuuuuggaagucaucggcuggccgggagucaaggccuuccuugcucggauaaauauuuaauagucagaagcacuuucuaaaauggaaacauggagcugagcccaggaggcaggggauggggaggggcuggggcgggaggcgguacucccccauccccgcaccccacagaggccaggcagagguuuuugcagccaccgcccuccccuccccuccggcugcgggucccugcccugccagcucugcugcgcacucggaccugcugacccaaugugugcuugugagggugggaguggcaucggggccuccucucugcagagcucuugggagggacuccuuccugcagggguggcgguggugggaggcuaggcaauugcccaggcuguuccaggcaggaguccggaaagggaucucaagccacaccccugccuggacgcugcugaggguauagccaagcaggggcagcuggggguacccgggauguggcaggggcaggacacuugggggacccuuacugggcuauguccgugugagcccugccggcuggaggggcugucaggugauggcgccugggugggcaggaggccccaugacucacccccaccagguggaauuaaggccccuuuguuuagggccacagccuucgguccucgcccugcuccugcugcuuggcaggccuggcuccugggugagccagcaccgcgggcuccuuggugacacacgcccugagaaugccgagcuucacgccuuggccuccucccggcugauucaccauccgcugcccucagcccucccuggcccccgccagcagccgaguucccauggcgacuccuagcugguccuggguccuagcagcucugagccaggacuagcuguucagugcgcaucacgggacaugccggauggccuaggucucagggucugugaugugguggcuuagcagagccccugcuugccgucccuccagcugaucagacaccugccugaccacugagucccaccacguggugccagggguccgguagguggggcccccgggaacugaggcaggugagcaaggcccugcccagcacccgccugcugguggucaagugugccucucuugggacuggguagcaacaggggcaggugugaagcauggcucuccagcucuuacccuucccaguaaguggcccccugagccagagcccagggccuccagccugaccccaucccuugcugugugucugcaccgugcugugggcacccaccgccaggggcucuggagccgagggcucgguucugagugccuggcgggggagcaaguccaggaucugagcugggagggugccccaggcagagccaguggcacgugcuuagagucuggagagggccuggggcaggguguggugcguucccauggcuguccgcguuggggagggugcaccaggaggagaucuccgucauguguuccagggcuuggcggaccacacuggccgcacugcagcgagggucugggaagggcuugcguggccagcgcuguggccagcugugcagggcaccucccucuggcugcugugaggugggcguagcuggggugggggccccagcaaaggcucuugcgggggucagugcugugucuggcaugacggccccgcucugugccagcgucuccuuccugucccacuccagcaggcugggccucuggguacggcgcugacucagccagcccugcccugccuggcugagugugggugucaggugguaaacaguaaacagcguucccaggugagagcugucugggagugucccuggagcagacguggccagcuuuccugccuccguguaaauagagucguuuucuaucuuugugaccguuagguuuuugugucagccuuuuuaggguauugcaauggggggaggcccagaaggggccuggaaucagguccccaccuuucaggccugaggagccccugaggccucucccaccccauuugccggcaagugccccugcccuggggcugggacagagccuucccugcccuugaaguccucuggccuacuugaggaccccuucucugugugcccaccucaggccacccuggcaucccguggcgggggcagcccucucagcugcaccuucccaccucuucccaugccguuggggccuggugcaggugcaagccguuccaucgcugaccucccaggcugggucugaccccucgcugccccuaaggccugggcugggccucggcugugugggccugcuccagacugccuguuggaggcacguccacacccaggcuaugggcacagggcuggcacacugggaucccaggggggcuacacguagcacagcugguugaguccugcuggagccuccuggcugcccagagcaaagaggagugggggcuaagggcccagggugcagcagggugaggugaccaggaggugggccaggcagcuggagcucuggauagugggggacuuggggucaugggacucagguguuucucagccaccacuuguauugaaaugacggggaaggaugggaggcuuguuaaaaaaaaaagcuaggccagugcggaggcucacaccuguaaucccagcaguuugggaggcugaggcagaaggaucacuugagccuaggaguuugagacuagccagggcaacacagggagaccuugucucuacaaaaaauuuaaaaauuagccaggcgugcuggugugugccugcagccccagccacuugggaggccaaggcgggaggaucaccugagcccaugcguaugagaucagccuggacaauaugguaggauccuaucucuacaaaaaauuuuuaaaauuagccaggugugguggcgucaccuggagccccagccacuugagaggcugacacgggaggaugguuugaguccaggaguuugaggcugcagugagccaugaucgcaccacugcacuccaaccugggugagagagagacccuguuucaaaaaaugcugcuuccugagccccaccgcacccugcuuaccagauacccuggugcuucgaggugugguggccgcugugaguuugggcugagcgggcugaagggaggccagggucggcugcccugggggcucaggcagguggcagaugaccaggccccaaggucacuggcccagugaccaugggggcaggcccuuaggcuaugccucuccucccuucugggccagccucuguccuggcccccauagggaaacugagacacaggguuugugcagagccugccuaggagggaccugccucaggccugugucuguccacacagcaggaccuggcgcacacuaaggcacucaccagacugggcuggcugugugacucagagcggucuguuccucugcagucagcugcucaggcugggggugggcacucagggugggguccccagcuccaagaagcugagugaguguugggggcuggccaggcuccuggcccaucaggggacccgcccacucccucuggugggauguggggguccuggcaggguccagagccagcccuaggagcaggcagaggcgggacaauggggggaggagcuguggagggaagaaccgggcguggcagggggagguggccaguugggaucuucgcuucugggccaguugggagagcgucuguagcuuccuugguaaguggcuccuguguccauguccggacaccugcuugccucacucuuccgcgggucugugggggccagcaggccaccagcaaggggggcuggaggaacagagcugggcuaggcaucccccgaccugcagcugacagacgggcagggguguuaguucaccguggcuccagccagggccagcgggcugggcagggaugucagggagaaagccccggagccccuucuccuggguccuggucccuggggugccggcggagcccaggccauacaagguguguggcaggacaccaagcugugggcccugggcagguaggggacaguggcucuuguuuccaaggagccuggguguggggggaggugaaugccaagagcacccacauucagggcagccgcaggucugcaaguccccaaggugggcguggggccuggagaaggguccucagaugaccgugugcuugcuuggugcacaggggcccuggguggcuguggagggugguugcuuccaaaggccagguuuacucuccugggggugcccgaggugggcugugggggccuggggcgauggguagcuccaucacagggucacacugcccuggacgucuguggggccggccuuucagcccagggaaacuggcucaggcuagcccgccugggauggaugggagcauggggcuguuccuuuuggcugccaaaucccuuggagagguggcacaugugcuacccugugccucaguuucuccaggagcagaaggagaugaacugggcccaccugcugcccucccauccccaucaacuggcucccacccucaggcuuaccaggcuuuuccaggagaucugacaagcuccuuccuuuuucccaugcacugccugcacuagcauuuauuaugcaccuacugugugccaggcucugagugcuuggugagcaaaguguucuggggaccagggagccggcaguguccagaagccauggcaggguggccaagcucagucugugaauuugcccagcagagaagacagccugggaaagcccagagagagagcgccuguggcccaggcaggcacagugagggcuggagaggcuggggaugucggcuagggcuagagcaggcacggagaggcugccaggccagucugaccgauggauggcaccagggagcuacgaaagguuguuucgggagagggugaugugaauagccucacgggugcagcugggcugcaguggggaauggcugcuggaugggcaaggagcccagcucccaggucuaggggacugagucuggcuuccccagcccuccugcagccuuggaggcagacacagaggcaggagcaagagccugagcucaucccgagagaguuaucucaagaagcaucggggaggggcgggggauguugcucagggaagucugaaggucucaugacagucagcccgcuuggcaccuucuucaugaaguuccacgacugggugaggcccaagugcggccggcugugugugccugugucugggugggcaccagguuuccagcccgagggcagugacucccacagggcucccgccuccauggccucacucugggcuguccauggguguucagagggaggagcccaggccagacacacaagugcacacacgcccuagcaccugagcacguacauccugugagcacacacgugugcacacacaccugcaaaccuggagugggccauucguuccucccacccaggauggacuuuuccggccacuggagagccagucuccucccugccagcccccagggcccuggggacuugcaaaugcacccaaccaugcccucccaccuggaggccagagauggggcccuggggcugccaguuuagaggcaaacuuggauuuuguuuaagcaaaauccaccuccuccccccacggaccuguucuggacccuccaagaacucucauuuagcugguggcuggugggaguccucaaucuggacccagcuguggagcagggguguuggugagccucugccacacuccccgccuguguuccuucuccccucccgcucggccccuccccgccucccggccaggaucugcucgucccccagacacacugccugaggccccgccugcucaggcccugcgccaggauaguccaguucucggggaggcagcuuuucugggccaggguggguguccucugcggcuuucacugugguaccacccccaccugcccuggcaugcaagggacugaccugggucccggggucccuccacaagguucaaguuuucacccgcaggaauguuaaugguaguguugaggccagggcgcuggggggcccggggagugggggaagggcauuggggaaggaaccaggugccaacggccugaccagcugggccuggcucaggcgagucaccuccacauucuccucugugaaguggggcuuuggugaccgucaacaaacagugucaugauucaggugauggggccacuugcagagccugucugggagaaccggaggccgggcgggcaaaggcggccuccccugcgcucugcggccgaggcggggcuuccucaggagcucgggccugggaggcggugcucuuggcgggggacugggauacugggggccuuccucucucucccgacuggcgcggguccgaggccgguagccuggcugcgcagccuuaucccgaggcgggcaggauuucccccuuccuguuuguguuccugggccaggcuccugccagcccagugacuggagggguccccacugcgcagcucuguggccagaggcaggucugccgcucgcugagccucugcacuccauccccacuacaggcaguguaggaacagccgcucccagugcgguggcugaggguggggcuggggacugucccgcgugggccaguggcaggaccaggcacgagggccagcaggagcagggcuggucacgucuccuccuccuucccccaugcagguucccagcacagggugugcccagggcuugcugucgacacccucccucaccggccccaacacccacaagacuacccuggagagauuugggagugcagccggcugugcccagcucaggggcccuugaccguggugcccacccccagcccagcagaccuguguuucccugccuggcgagucccuucuccgaggaguugcccuccugacccuuucuugggccucacagcagcugccccccacccccaacccauccaggcuccugccagcuggguggggcuuuuuggcuggggaggcugcggagggacggggaggcggcuggguuucugggcagccucagaacaccugccccacccugagugcuaggcagggccugggacacccggucuccgaggcaguggagccccuccccacucaugaccccagcugcaccugcugccaggggagcagcugugggccaagugacccagggacccuccucugcccccagcccugcuagguaguugccccagcuccacaccuacuggcuggguccccuuggguaaguggcuccccucccccagccucaguuuucacauauguuacccaccuuggggauugagcggcagggucugggcagagcaggaagggaaacugaggccagagaguggcuuaccugccauugcccuuggcuuagcggugggcaggcucuggccagauuccugucccuuuccuuggcaccaccccgucccacgaauuuguugugggucugguguggcuggagcuccaggcagcuccagaggggcugggguggccccagcugguggucccucaggguuguggggugcacuggggagcccuggcagggccacguggagggagugggagggggcaggugggcaaggaguggaggguuuggcagccaucugggaggcagagcgguggggcuggccaaguucugucugugcagguugggggugcguccaggugggagcagcaggggcccugucaggugguggggcagugucugaaugcaaaggugagugagaugggcccagguggccaggacagagcugugcagaagggagacagggucuugccccuucacugccugguuagggagaaggggccuguggaggagaucguguugugggguugccagggguacaauucuugggcugacaccgugggcaaggcugguuuggcaggugggggaaacggagguuguggcucugcugggggguuauggaggccaggggucugggccuggcccccggagcaguaggaagguggcggggccgggaugacgugggggugaguguugaugccuccuggcacugacccagcccugccugcccucaccuccugcccuucucuuccuucgcuugagagaaccuccuccaggagacaccauccuccagcccugccaggccugagagcagagccagaggggaccugggcugugagccaucuugcagaagggcaaggaaaggcccgugaagcggugagggaguggcaggggcccgcgcaggcagaggugcucuugggaugagcaggcauggcccugggggugccucugcgggagcagugucuguagcccagcaacccacagucagggcaggcagggugguccacauauccaugagggaaugaaagcucagagaggggaugagcuugcucagggccacacagcacacuggccagaggagcagccagaccuagaccacugccgggacugggccuccccaucugucuucgugggacaguccccaaggccaggacaccuaccgcaggggacagggagcagcugguccccgaggccagcacaccaccccaaaggauagggacaugcuccuucccaaucaguguccuaccagcaacugggucuggggcagggaugggggccuuaguucugagacccuccuugucacugcaggagggaggcccuggagcccaggccagggcgccagaguuggcguaagauugguacuguuucuucuuggaauauuuagaguauaauucagagugggguugagacuggaguccuuuuugugggacgguuuuaaauaagggauuugauuuuuucuuuucuuuucuuuucuuuuuuuuuuuuuuuuuuuugagacagaguuuugcuuuuguugcugaggcuggagugcaauggcaugaucuuggcucacugcaaccucugccuucuggguucaagugauucuccugccucagucuuccuaguagcugggauuacaggcgccugccaccaugcccagcuaauuuuuguauuuuuaguagagaugggguuucaccauguugauuuuuaaaucguuacaaaaauacuuggauuauccaucggggcguccguccuaucuuuuggcuucccugggcuacauuggaagaagaagaauugucuugggucacacauaaacuacacuaaugauagcugaugagcuaaaagaaacaauugcaaaagaguguaauaaaguuuuaggaaguuuaugaauuuguguuaagccguauucaaagcuguucugggccacaugcggccugugggccguggguuggacaaguuugguucuucuuguggguuuucuaggaauauauccaaucaaucgaaauuuucagauuuauuaguguaaaguuuauaauuguguuugauuuuauauagaauucuaaaauuuuuuauggagaaaggguacaaaccauggcacacccaaguaauuaguccucuccaggagacccugucugccugcucccccuggugacuucagcccuagguggccugagccugacugugagcuggaugugacgggcucccccgguacgagcgcuuuuuauaucuagcuucugugucucaaccuuguguuugugaacuucauccacguugcacauaggcauaguuuauaccauauacuguuccauuggacaaauaccucgcauuuuuuuuuauucuacuguugauggacauuugaaucucugguuucugggugcugcagauuauacugagauggauguuccugcauccaucuuuugagggacauaugugcgcauauuucuuggcucugccccuggcuaugaguugcugggccacaggguaaggcucuaccaggcuguuuccaagugguugcgccagcugacccccaacccacaccaggauggaguuccagcugcccuaggccuugucuccagguggucugccucgacuuuuccauuucagccauucuccugggagcauauggcaccucgugguuuuguuagcauugcccagaugacuagaaaugcuggccaucuuuccauauacuaaucggcugguugaauauccucuucuaugagcuaccuuuccaguguuuucuugcccauauuucuaucggguuguuugucuuuugguuugcaagaauucuuugugcauucuggguuggaggccuuugcuugguaaauguauugcagguaucuuugcccaaucuguguuuugggcaaagauagcugcaauuuaucgauuucauuuccuuuggauauauacccaguagugggacugcuggaucaaaugguaguucuauuuuuaauuuuuugaggaaccauccauaguguuuucuaucauggcuauacuaauuuacauuucaugcccuuagugguguuuuuugaugaacagaagcucuuaauucuuuucucucucucucuuuuuuuuuucuuuuuuuuuuuuagacggagucucgcuguguggcccaggcuggagugcaguggcgcaaucucagcucacugcaagcuccgccucccggguucacgccauucuccugccucagccucccgaguagcugggacuacaggcacccgccaccacacccggcuaauuuuuuguauuuuuagaagagacaggguuucaccguguuagccaggauggucucgaucuccugaccucgugauccgcccgccucggccucccaaaguguugggauuacaggcgugagccaccgcgccuggccagaagcucuuaauuuuaauauagaccaauaucugucauuuuuuguguguucuguuuaagaauuuuuccccuacuccaaaaguaauuucuauuuauuuucuagaaauuuuauuguuaagccuuuaauuuuggaucuguaauccacaugaaauuaauuuucucuggcugagguggggcgaagauuaauguuuuuccauauggauaucccauggaucccaggccauguguugaacagaucaucacagcuuuguguacgugugucuguuucugggaucucuguucuguuccauuggucuugauuugcauuuuccugaugacugaaaauguugagcaucuuuccuuguacuuauugaacacucguacaucuucuuuugugaaaugucuguucaaaucugcugccuauuuuuagcugagcuuuuucucuuccguugaguuguacacaggcuccaugcaaguccuuugccagauacauucacugccuuuucguuuucugaggaaaaugaaagcucuuaaggccaguguuuuaaauuaugagaacuuaaauuuaucaguuuucguucuaugauccuuaccuucuguauccuaagaaaacuuugcugcccucgagguguuaaagaaguucuccuauauuuucuucuagaaguuuuauaguuuuugguuuuacauuccccucuaugauucauuucaaauucauuuucaugagugaugggauggaaggguccagguuuauugguuucccaguaaauacccagcuguuccaggaccauucggugaaaagacuuugcuuucuguuggaauaacugggcugcuuugacaagaauuuggccgggcaugguggcucacgccuguacuuugggaggccaaggcagguggaucacuugaggccaggaguucaagaccagccugggcaacauggugaaaccccaucucuacuaaaaguaccaaaaaaaaaaaaaauuagugaggcaugauggcgcaugccuguaaucccagcuacuugggaggaugaggcaccagaaacgcuugaacccaggaggcagaaguugcugugagcugagauugugccacugcauuccagccugagcgacagagugagacccugucucaaaacaaaaccaaccaaccaacaaacaagaaugaauuggccauguaaguguggggcuguucuggacuuuguuuucuguucacugauuuguguuucugccgcacugucuugauuccacugggggucagagaagagaacucggaugacugaaguuauuuuaaauucgucaagacagguuucugagccagcauggggccugucucagugacuguccccugugcaccugagagcagcaugcaccggcugcugucaggaguguucucccagugccaguuuggucucguugguugauggguacuucaaguguuuuguaucuuccccuauucuacuuuguaagguuaucauuuccuaagaguguuagaaucuccuauuguauaauaauuguggauuuauuucuccuuucaguuuugccaguuuuuacugcaguguuucaaaaaggagaucuagguguuuuuugguuuguuuguuuuuugagacagggucuugcuuugcugccccggcuggagugcaguggcaugagcuuggcucacugcagcuuuaaccuccugggcucaagugauccucccaccucagccucccgaguagcugggaauacagaugugcgccaccaugcauggcuaauuuuuaaauauuuucuaaagaugaggucucacuguguugcccaggcuagucucaaacuccuggccucaaguguuccuccugccucggucuccuaaagugcugggauuacggcacaagccacugugcccagccuagcauuccauuuugguuccacuauuggcuuauuaccuauacaucuuuuuauuuuuuuaaugguugcauuaugcuuuauacccugaauauuuaacuuauuacaguauaauuucaaguaagauuguccuacuuuaaguauaauguaagaucuucacaacagcaacuuuuuuuuuuuuuuuaagauggggucucgcugucacccaggcuggagugcagugacgcgaucucggcucacugcaggcuccgccccccgggguucacgccauucuccugccucagccucccgaguagcugggacuacaggcgcccgccaccucgcccggcuauuuuuuuguauuuuuaguagagacgggguuucacuguguuagccaggaugguuuugaucuccugaccucgugauccgcccgccucggccucccaaagugcugggauuacaggcgugagccaccgugcccggcccacaacagcaacuuuugcacuccauccccauccugucauaugcuuuacuucuauauuuguaaaauucuaagauacauuuuauuuuauuuguuuuuuuuuuuggagacagagucuuggucuguuaccaaggcuggagugcaguggaacaaucucagcucacugcaaccuccaccuccuggguucaagugauucuccugccucugcuucuugaguagcugggauuacagacgugcaccacccugcccagcuaauguuuguauuuuuaguagagagggguuucaccauguuggccaggcuggucucaaacuccuggccucaagugaucugcccuccuuggccucccaaagugcugggauuacaggugugagccaccgugcugacuuauuuuuguuuuauacaguuaauuaccuuuuucuuuuacaguuucauugagguacaguuuauaaaccauagaacucacccauuguaaauguacaauucaaucauuuuacuaaccuuauagaguugugcaaacauuaccacaauccaguucuggaagaccuccaucaccuuccaaauuuucucaaccccauuuacaaucaaucucccuucccacucccagccccaggcaaugccagcuuaauucugguaaauuauagaaacuuugguccaggguacacuugugccucagcauccaugagggauugcuucuaggaccucccucagauaccaaaauucauggaugcucaagucccuucuauaaagcaauguaguauuugcaaauaaccuacauacaucuucccuccccuauacuuuaaaucaucucuagauuacuuauaauaccuaaugcaauguaaaugcuauguaaauagcugguauacuauauuguuuagggaauaaugacaagaaaaaaagucuacacguguucaguacaggugcaauuuuugggagaacauuuuugacccaaguuucauugaacucaggauacagaaaccacugauaugagaggcugacuguauacccucuccuccuacuccuuuuugcuauuauugucacguauauacuguaucuauauauguuauaauccuaacaauaugguguuagaauuguugccuuauauaagugguucacagaugauugucugucuucuaaauccagccuccuuuuuguuuuacaaguaaaguuuuguugaaacaguuuugcucauuuauuuacauauuaucuauaaucuauagcugcuuuuguacuauggcugcagaguugcaacagagaucauguggccugguaagcuuaaaauauccacuauauugccuuuuucaagaaaaguuugucaauccuugcuuuauacaauccucuguuuuugaaagaaguuaagaaauaaaaugaggacaauauauauucauagagucuuuuauauuugccugcauaguuaccauuuucugcauucuccauuucuuccugugcauuugacuuagugucugguauuaguuccuuucaguccgaaggacuucuuuaguauaucuuguaaggcagauuugcuagcaaugacauuuccaagucuuuguucauuugggaaugccuuuauuuuuccuuuuuuuaaaauuuaaauuuuuauuuuuuugagacagagucuugcucugccugacuagagugaaguggugcaaucacagcucacugcagccucaaccucucaggcuuaagcuauccucccgccucagccuccugagcagcugggacuauaggcaugcaccaccaugccccgcuaauuuuuaaaaaaauuuuugggccggacacggcagcucaugccuguaaucccagcacuuugggaggcugaggcaggcggaucacgaggucaagaguucaagaccagccuggccgacauggugaaacccgucucuccuaaacguacgaaaauuagcugggcaugguagcgcgugucuguagucccagcuacucgggaggcugaggcagaagaaucacuugaaccugggaggcggagguugcagugaaccaagaucgugccacugcacuucauccugggugacagagugagacuccgucucaaaaaaaaaauuuuuuuuuguagagaugagaucuuacuauauugcucaggcuggccuugaguuucugggcucaagcaauccucgcacuucagccucccaaagugcugggauuacaggcauaagccagcaugcccagacuauuuugccuuuauuuuuggaaggauagguugcuugauaucaaauucuucguugacaacaguuucuuucagcccuuugaauauauuguuccacuuucucguagcuucuaugguuuugaugugauucagguguuaguuguauuuuugugcccuuauuaugugauggggcccuuucucuuaagcauuuugacugugacguuucuagguguggaucucuguguuucuccugcuuaggucuggucgcgcuucuuggauucugcagauuguuuucagcuaucacuucuucaacucucucuucugccucuuuaucuuaugguuaaugcucugagacucuguuuuucuucaaacaaucuucccccugaccccguucuucaaauugguuaauuuauauuaaucuacaaguugauaauucuucugguaucucaaaucuguuggugaaccccaguaguaaauuuucaacuccagaauuuuugcuugcuuuuaaaaaauaaguuuuauuucuuuaugagauucucucuucauugagccauuguuaacauauuuuccauuaauuuuuuaaacaugauuuguuuuuguguuuugaacaaacuuuuuuuuuucuuuuugagacggaguuucacucuuguugcccaggcuggaguacaauggcacaaucucggcucaccacaaccuccgccucccagguucaagugauucuccuaccucagccuccugaguagcugggauuacaggcaugugccaccaugccuggcuaauuuuguauuuuuaguagagaugggguuucuccauguuggugaggcuggucucgaacucccaaccucaggugauccacccgccucagccucccaaaguccugggauuacaggcaugagccaccgugcccggccugaacaaacuuuuaauaguuucuuugaagucuguauuaaacccagcauuaguagacauuuagagacacuuuccauucacugcuuuguuucucaguauggaccauacauucuuguuucuucgcguaacuuguaauuuuuugguggcugcuggacauuuuagauaauauauucuggcagcucuggauucugauccucccagggugugguuauacaauaacaaacgccuuguguuuguuuagucacuuucuuggacuaaaucuguuccaacuuggaauaaguccagucucaauucacugcuaccugacgugaugccucagccucuccagcccauuggcuauagaucuucccccagccccugaguuugcucuccgauccaguguccaggaaaggacuaugacaccuccacaguguacauacaguccuggcucccucccccgggccccgaucugcucccccagccugcuugucuccacugacagccacucucucugcaguguccggccgucagcugcagcccggggagccaggugcagaaacggaagaugaccacucuguaagugagagcaggaggaaguguguccuccucauacccugcccccauucucccugggcccugggagaaccgaguggcaaaaauaacuggauucucucccgucaggugacugaagggccugcggaugagggcauucgaccacggccgcaggggucuucaccugucuacgaauacacgacugaggcugccgacuuuggacuccaggugagccugcugggcagagccccacaggcacccaggucuccuccugcaucgcccugugugggcaacucacgcaugucuguucaaccuugcugcccugccccgcugcccacugggcagugcccacucagauguccucucagacuccucugugcccuugggucccucccuguggccggccagggcacagugggauggaggugcccugcagcucuugugagcaugcguaugggcugauggggacaggccucauguuacuguguuuguguuucaggggcacagggugugugcaucccugcaccuguguaacacacucaugcugucuuuggggacagggccccauggcuaccucuggagacaaggacucggggaagggaucagaggaggcaugucuaugaaaggauucauuuuuguacaauuugaauuucuuaucucccuccauacaaaacuccaguugcuguggggcuucccuaugggcgcugugggcuguagggugggugcugugggcuguaggcugggcccugucgggaagcaggaaggccgagaguugccuuuucucuguggaugugccuggaggaacucggcugccucugcacacagcuguguguuggaaguucugggccccucugaagggagggcuccuggucuggcaccagccuaccugugccccucccugucccugagcuggggcaggugccuaacucccaacacuuguggcugcaggaagacgcccccggcaggcaagguucugcugggagacggagauccugguggaagcgagauucaggggacucacggacauuuuucaggaugagucguccagagguggguacagcaggagcugagggucacagaggugugucgguccucaagggauccagccagagaguccgaggucagagcaggcaggggaggagcaaagaggcuggcagugugccccgugcccuggggaggagggguguucuugucccccuugucaggccuggggaagggcaggggcuccagaaggcuacaucugguccuggcccucuccaccccucccugggguggagucugaugcauagccaagcuccuggccagguagaccuggcuguacagaccucgauuuucuccuccgugcaauggggcagugcuggugucuguugcauauucaagcuguggggcugaaaaggccagucagcacccaggccauggaacuauggaaggugcuagacucugcuagcacccaaugaugagggcacucugccucuuaagcaacuaguuuuuuuccuuggaggccccagcaguccaagagcucugcaggacacaggccccauccugucccaggucucgcaggcugcacccaaugucccguauuuuccuuggcauugcugugcuuccuugucuugagcaucaggugccuugcacacaacuggugcuucacgcguuugugaagaaugcaugaaggagcugaaaaagagaaacuggccacagggaaagcagaauccguucugcgcugcuccuggugcccugcugggccugguggcauggacaggcugugccuaaguccuggcagguugggguggggacaagaguucuggcagguuccagcuggcuuccuccagagcucagagacagcuaccugagcccaccugguggguacccuacucugcucuguguugucugggcugauggaaaggaugguggggugcccauccucuggagacacaggccccagcagggaugcuuauggugggacuggcacaugcucaccauggcccugaugugcuucugcuccaggcuguccaggaggcaacagaggugacgcugaagacagagguggaggcaggagccaguggcuacagugucacaggugguggggaccaggggaucuucgucaagcaagugcugaaggacuccucagccgccaagcuuuuuaacuugagagaaggugccauggcaguuccaucccuggggucaccauucuccccaccaggaugggagggaccuggagggggguauugagggguaagaaccacaccuggagcuuaggaugaccuccucacgccucugcucaacagcuugaggcugggaucacccacugcaucuaguaaaaugggggaccccauccaccuugccugugccugaggcacucagugggggacugguggggcagacucagugggauucccccuauucauguccccgggacccuccucgccagccaaggcaagacagcagaccccgucucauucacacacccggcccuggggcugcucuuucuuggucuaggggaucagcugcucaguacaaccguguucuuugaaaacauaaaauaugaagaugcucucaaaauccuucaauauucagagccguacaagguucaguucaaaaucagacggcagcucccugccccacaggaugaagagugggcuuccagcgaugcccagcacggcccacagggcaaggagaaggaggugagaccacuaugcccggggggcagggccccagcuggcuucacuacccugcuggcugagccugggaggggauagcacucccacuccaucugucccugggccagggccccaggcuucuuggacuggcaccaacagauucccucucccuauguuucaggacacggauguugcugaugggugcagagagacccccacgaaaacucuggaaggagauggggaccaagagagacucaucuccaaaccaaggguggggagaggcaggcagagccagagggagaggcucucuuggccaaaauuucaauccauaaagagcaagcgggggccgggaccccagaggucacacagcucgucagaggccuacgaaccuagggacgcacaugacguguccccuacaagcacagacacagaggcccagcucacgguggagcgccaagagcagaaggcagggccgggcagccagaggaggcggaaguuccucaaccucagauucaggacaggcucgggacagggcccuucaucgacaggacagccaggcaggggguuccagaguggggugggccgugcugggguccuggaagaguuggggcccuggggugauagccucgaggagacuggggcugccacaggcagcaggagagaggagagggcagaacaggaucgagaagugaugccugcucagagcaugccauugcccacagagcucggugacccuagacuuugcgagggaaccccucaggaagggggacucagggcagccaggcuccauggaaagacccuggaggggcaggcacaggagacagcaguggcccagaggaagcccagggcccagccaacuccuggaaugagccgggagggugaaggcgagggacugcagagccuggaaaucgggaucgccagacuguccuugagagacacaaccgaaggaggcacacagauuggcccaccagaaauuagggugcgaguacacgauuuaaagacaccaaaauuugcauuuuccacagaaaaagagccagaaagagaaaggcgccuuaguaccccacagcgagggaagagacaggaugcguccucaaaagcggguacuggccugaagggugaggagguggaaggagccggguggaugccgggcagggaaccaaccacacaugcagaagcacagggggaugaaggagauggagaggaaggacuacagaggacaaggaucacugaggaacaggacaagggcagggaagacacagaaggacagauaagaaugcccaaguucaagauacccuccuuaggauggucgccaagcaagcacacaaagacaggcagagaaaaagccacagaagacacagagcagggaagggaaggagaggccacagcaacagcugauagaagagaacagagacgcacagaggaaggauuaaaagacaaagaagacagugacucaaugacaaacacaacaaaaauacaacuaauacacgaugaaaaacgcuuaaaaaaggaacaaauucugacagaaaaggaaguggccaccaaagacagcaaguucaaaaugcccaaguucaagaugccauuguucggggcgucagccccaggcaaguccauggaggccucgguggaugugucugcgccgaagguggaggccgacgugagccuccucuccaugcagggggaccucaagaccacugaccucagcguccagaccccuuccgcugaccuggagguccaggauggccaaguggaugugaaacuuccggagggcccccugcccgagggagccagccucaaagggcaccugcccaaggugcagaggcccaguuugaagaugcccaaaguggaccucaagggccccaagcuggaccugaaaggccccaaggcggaagugacagcccccgaugugaagaugucucuguccagcauggagguggacguccaggccccgagagcaaagcuggauggugcgcggcuggagggggaccugucccuggccgacaaggaggugacugccaaagacagcaaguucaaaaugcccaaguucaagaugccaucauucggggugucggccccaggcaaguccauggaggacucgguggaugugucugcgccgaagguggaggccgacgugagccucuccuccaugcagggggaccucaaggccacugaccucagcauucagcccccuuccgcugaccuggagguccaggcuggccaaguggaugugaaacuuccggagggcccugugcccgagggagccggccccaaagugcaccugcccaaaguggagaugcccaguuucaagaugcccaaaguggaccucaagggcccccagauagauguuaagggccccaagcuggaccugaaaggccccaaggcggaagugacagcccccgauggcgaggugucucugcccagcauggagguggauguccaggcccagaaggccaagcuggauggugcguggcuggagggggaccugucccuggccgacaaggacgugacugccaaagacagcaaguucaaaaugcccaaguucaagaugccgucguucgggguaucggccccagggaaguccaucaaggccuugguggaugugucugcacccaagguggaggccgaccugagucuccccuccaugcagggggaccugaagaccacugaccucagcauucagccugcuucuacugaccugaagguccaggcugaccagguggaugugaagcucccggagggccaccugcccgagggagcuggccuuaaagggcacuugcccaagguggagaugcccaguuucaagaugcccaaaguggcccucaagggcccccagguggacgucaagggccccaagcuggaccugaaaagccccaaggcggaagucacagccccugauguggaggugucucugcccagcguggagguggacgucgaggccccgggagccaagcuggacagugcgcggcuggagggggaacugucccuggccgacaaggaugugacugccaaagacagcagguucaaaaugcccaaguucaagaugccaucguucggggcgucagccccaggcaaguccaucgaggccucgguggaugugucugcacccaaaguggaggccgacgugagucuccccuccaugcagggggaccucaagaccacugaccucagcauucagcccccuuccgcugaccuggagguccacgcuggccagguggacgugaagcuccuggagggccacgugccugagggagccggcuucaaagggcaccugcccaaggugcagaugccuaguuugaagaugcccaaaguggaccucaagggcccccagguggaagucaggggccccaagcuggaccugaaaggucauaaggcagaggugacggcccacgaaguggcugugucucugcccaguguggagguggacaugcaggccccgggagccaaguuggauggcgcacagcuggacggggaccugucccuggcugacaaggacgugacugccaaagacagcaaguucaaaaugcccaaguucaagaugccgucguucggggugucugccccaggcaaguccauugaggccuccguggaccugucugcacccaagguggaggccgacaugagccuccccuccaugcagggggaccucaagaccacugaccucagcauucagcccccuuccacugaccuggagcuccaggcuggccaauuggacgugaaacucccagagggccccgugcccgagggagccggccucaaagggcaccugcccaagcugcagaugcccaguuucaaggugcccaaaguggaccucaagggcccugaaauagacaucaagggccccaagcuggaccuaaaagaccccaagguggaagugacagccccugauguggagguuucucugcccagcguggagguggaugucgaggccccaggagccaagcuggaugguggacggcuggaggaggacaugucccuggccgacaaggacuugacuaccaaagacagcaaguucaaaaugcccaaguucaagaugccgucguucggggugucugccccaggcaaguccaucgaggccucaguggaugugucugcgccgaagguggaggccgacgugagccuccccuccaugcagggggaccucaaggccacugaccugagcauacagcccccuucugcugaccuggagguccaggcuggccaaguggacgugaaacucccagagggcccuguguccgagggagccggccucaaagggcaccugcccaaagugcagaugcccaguuucaagaugcccaaaguggaccucaaggggccccagauagauguuaagggccccaagcuggaccugaaaggccccaagguggaagugacagcccccgaugugaagaugucucuguccagcauggagguggacguccaggccccgagagcaaagcuggauggugcgcagcuggagggggaccugucccuggccgacaaggcggugacugccaaagacagcaaguucaaaaugcccaaguucaagaugccaucauuuggggugucggccccaggcaaguccaucgaggccucgguggaugugucugagccgaagguggaagcugaugugagccuccccuccaugcagggggaccugaagaccacugaccucagcauucaguccccuuccgccgaccuggagguccaggcuggccaagugaacgugaaacucccggagggcccccuucccgagggagccggcuucaaagggcaccuccccaaggugcagaugcccaguuugaagaugcccaaaguggcccucaagggcccccagauggacgucaagggccccaagcuggaccugaaaggccccaaggcggaggugauggcccccgacguggaggugucucugcccagcguggagguggacgucgaggcuccaggagccaagcuggacagugugcggcuggagggugaccugucccuggccgacaaggaugugacugccaaagacagcaaguucaaaaugcccaaguucaagaugccgucguucggggugucugccccaggcaaguccaucgaggccucgguggaugugucugcgccgaagguggaggccgaagugagccuccccuccaugcagggggaccucaagaccacggaccucugcauuccgcucccuucugcagaccuggugguccaggcuggccaaguggacaugaagcucccggagggccaggugcccgagggagccggccucaaagggcacuugcccaagguggauaugcccaguuucaagaugcccaaaguggaccucaagggcccccagacagauguuaagggcgccaagcuggaccugaaaggccccaaggcggaagugacagcccccgaugucgaggugucucugcccagcauggagguggauguccaggcccagaaggcuaagcuggauggugcgcggcuggagggagaccugucccuggccgacaaggacaugacugccaaagacagcaaguucaaaaugcccaaauucaagaugccgucguucgggguaucggccccagggagguccaucgaggccucgguggaugugccugcacccaagguggaggccgacgugagucuccccuccaugcagggggaccugaagaccacugaccucagcauucagcccccuucugccgaccugaagguccagacuggccagguggaugugaagcucccggagggccacgugcccgagggagcuggccucaaagggcaccugcccaagguggagaugcccaguuugaagaugcccaaaguggaccucaagggcccccagguggacaucaagggccccaaacuggaccuaaaagaccccaagguggaaaugagaguccccgaugucgaggugucucugcccagcauggagguggacguccaggccccaagagccaagcuggauagugcgcaucugcagggggaccugacccuggccaacaaggaccugacuaccaaagacagcaaguucaaaaugcccaaguucaagaugccgucguuuggggugucugccccaggcaaguccaucgaggccucgguggaugugucuccacccaagguggaggccgacaugagucuccccuccaugcagggggaccucaagaccacugaccucagcauucagccccuuuccgccgacgugaagguccaggcuggccagguggacgugaaacuccuggagggcccugugcccgaggaagucggccucaaagggcaccugcccaagcugcagaugcccaguuucaaggugcccaaaguggaccucaagggccccgaaauagacaucaagggccccaagcuggaccuaaaagaccccaagguggaagugacagccccugauguggaggugucucugcccagcguggagguggacgucaaggccccaggagccaagcuggauggugcgcggcuggagggggacaugucccuggccgacaaggacgugacugccaaagacagcaaguucaaaaugcccaaguucaagaugcugucguuuggggugucugcccuuggcaaguccaucgaggccucagcggaugugucugcguugaagguggaggccgacgugagccuccccuccaugcagggggaccucaagaccacugaccucagcguucagcccccuuccgcugaccuggagguccaggcuggccaaguggaugugaaacucccagagggccccgugccggagggagccggccucaaagggcaccugcccaagcugcagaugcccaguuucaagaugcccaaaguagaucucaagggcccccagauagaugucaagggccccaagcuggaccugaaaggccccaagacggacgugauggcccccgacguggaggugucucagcccagcguggagguggaugucgaggccccgggagccaagcuggauggugcguggcuggagggggaccugucuguggcggacaaggaugugacuaccaaagacagcagguucaaaauucccaaguucaagaugccgucauucggggugucugccccaggcaaguccaucgaggccucgguggaugugucugcgccgaagguggaggccgacgggagccucuccuccaugcagggggaccucaaggccacugaccucagcauucagcccccuuccgcugaccuggagguccaggcuggccaaguggacgugaaacucccagagggcccugugccggagggagccggccucaaagggcaccugcccaaggugcagaugcccaguuucaagaugccugaaauggaccucaagggcccccagcuagaugucaagggccccaagcuggaccugaaaggccccaaggcggaagugacagcccccgauguggagaugucucuguccagcauggagguggacguccaggccccgagagcaaagcuggauggugcgcggcuggagggggaccugucccuggccgacaagggugugacagccaaagauagcaaguucaaaaugcccaaguucaagaugccaucauucagggugucggccccaggcgaguccaucgaggcguugguggaugugucugagcugaagguggaagccgacaugagccuccccuccaugcaaggggaccuuaagaccacugacaucagcauucagccccccucugcccaacuggagguccaggcuggccagguggaugugaaacucccagagggccacguucccgagggagccggccucaaagggcaccugcccaagcugcagaugcccaguuucaagaugccugaaguggaccucaagggcccccagauagauguuaagggccccaacguggaccugaaaggccccaaggcggaagugacagcccccgaugugaagaugucucuguccagcauggagguggacguccaggccccgagagcaaagcuggauggugcgcggcuggagggggaccugucccuggccgacaagggcaugacagccaaagacagcaaguucaaaaugcccaaguucaagaugccgucauucggggugucggccccaggcaaguccaucgaggccucgguggaugugucugagcugaagguggaagcugacgggagcuuccccuccaugcaaggggaucuuaagaccacugacauccgcauucagccccccuccgcccaacuggagguccaggcuggccagguggacgugaaacucccagagggccacguucccgagggagccggccucaaagggcaccugcccaaggugcagaugcccaguuucaagaugcccaaaguggaucucaagggcccccagauagacgucaagggccccaagcuggaccugaaaggccccaaggcggaggugacggcccccgacguggaggugucucugcccagcguggagguggacgucgaggccccgagagcaaagcuggauggugcacggcuggagggugaccugucccuggccgacaaggaugugacugccaaagacagcaaguucaaaaugcccaaguucaagaugccgucguucggggugucugccccaggcaaguccauugaggucucgguggaugugucugcgccgaagguggaggccgaagugagccuccccuccaugcagggggaccugaagaccacugacaucagcauugagccccccucugcccaacuggagguccaggcuggccagguggaccugaagcucccagagggccacguucccgagggagcuggccucaaagggcaccugcccaaguugcagaugcccaguuucaagaugcccaaaguagaucgcaagggaccccagauagaugucaagggccccaagcuggaccugaaaggcccgaagacggacgugacggcccccgacguggaggugucucagcccggcauggagguggaugucgaggccccaggagccaaguuggauggugcacggcuggagggggaccugucccuggccgacaaggaugugacugccaaagacagcaaguucaaaaugcccaaguucaagaugccgucguucggggugucugccccaggcaaguccauugaggucuugguggaugugucugcgccaaagguggaggccgaccugagccuccccuccaugcagggggaccugaagaacacugacaucagcauugagccccccucugcccaacuggagguccaggcuggccagguggacgugaagcucccagagggccacguucucgagggagcuggccucaaagggcaccugcccaaguugcagaugcccaguuucaagaugcccaaaguagaucgcaagggcccccagauagacaucaagggccccaagcuggaccugaaaggcccgaagauggaugugacggcccccgacguggaggugucucagcccagcauggagguggacgucgaggccccaggagccaaguuggauggugcacggcuggagggggaccugucccuggccgacaaggaugugacugccaaagacagcaaguucaaaaugcccaaauucaagaugccgucguacagggcgucugccccaggcaaguccauccaggccucgguggaugugucugcgccgaaggcggaggccgacgugagccuccccuccaugcagggggaccucaagaccacugaccucagcauucagcucccuucuguggaccuggagguccaggcuggccagguggacgugaagcucccggagggccacgugcccgagggagcuggccucaaagggcaccugcccaagguggagaugcccaguuucaagaugcccaaaguggaccucaagagcccccagguggacaucaagggccccaagcuggaccuaaaaguccccaaggcggaagugacagucccugauguggaggugucucugcccagcguggagguggacguccaggccccgagagccaagcuggauggugcgcggcuggagggggaccugucccuggcugaaaaggaugugacugccaaagacagcaaguucaaaaugcccaaguucaagaugcccuccuucggggugucggccccaggcagguccaucgaggccucgcuggaugugucugcgccgaagguggaggccgacgugagccucuccuccaugcagggggaccucaaggccacugaccucagcauucagcccccuuccgcugaccuggagguccaggcuguccaaguggauguggaacuccuggagggccccgugcccgagggagccggccucaaagggcaccugcccaaaguggagaugcccaguuuaaagacgcccaaaguggaccucaagggcccccagauagauguuaagggccccaagcuggaccugaaaggccccaaggcagaagugagaguccccgaugucgaggugucucugcccagcguggagguggauguccaggccccgaaggccaagcuggaugcugggcggcuggagggagaccugucccuggcugacaaggacgugacugccaaagacagcaaguucaaaaugcccaaauucaagaugccgucauucaggguaucggccccagggaaguccauggaggccucgguggaugugucugcacccaagguggaagccgaugugagucuccccuccaugcagggggaccugaagaccacugaccucagcauucagcccccuucugccgaccugaagguccaggcuggccagauggaugugaagcucccggagggccaggugcccgagggagccggccucaaagagcaccugcccaagguggagaugcccaguuugaagaugcccaaaguggaccucaagggcccccagguggacaucaagggccccaagcuggaccuaaaagucuccaaggcggaagucacagccccugauguggaggugucucugcccagcguggagguggacguccaggccccaagagccaaacuggauagugcacagcuggagggggaccugucccuggccgacaaggaugugacugccaaagacagcaaauucaaaaugcccaaguucaagaugccgucauuuggggugucugccccaggcaaguccauugaggccucggugcacgugucugcacccaagguggaggccgaugugagucuccccuccaugcagggggaccucaagaccacugaccucagcauucagccccauucugccgaccugacgguccaagcucgccagguggacaugaaacuccuggagggccacgugcccgaggaagccggccucaaaggacaccugcccaaggugcagaugcccaguuucaagaugcccaaagucgaccucaagggcccugaaauagacaucaagggccccaagcuggaccuaaaagaccccaagguggaagugacagccccugauguggagguuucucugcccagcguggagguggacgucgaggccccaggagccaagcuggauggugcgcggcuggagggggaccugucccuggccgacaaggacaugacggccaaagacagcaaguucaaaaugcccaaguucaagaugccgucguucggggugucugccccaggcaaguccauggaggcaucaguggaugugaccgcgccaaagguggaggccgacgugagccucccuuccaugcagggggaccucaaggccacugaccucagcguucagcccccuuccgcugaccuggagguccaggcuggccaaguggacgugaaacucccagagggccccgugcccgagggagccagccucaaagggcaccugcccaaggugcagaugcccaguuucaagaugcccaaaguggaccucaagggcccccagauagauguuaagggccccaagcuggaccugaaaggccccaaggcggaagugacagccccugaugugaagaugucucuguccagcauggagguggacguccaggccccgagagcaaagcuggauggugugcagcuggagggggaccugucccuggccgacaaggaugugacugccaaagacagcaaguucaaaaugcccaaguucaagaugccaucauucggggugucggccccaggcaaguccauggaggcguccguggaugugucugagcugaaggcgaaagccgacgugagccuccccuccaugcagggggaccucaagaccacugaccucagcauucaguccccuuccgccgaccuggagguccaggcuggccaaguggacgugaaacucccggagggcccccugcccaagggagccggccucaaagggcaccuccccaaggugcagaugcccuguuugaagaugcccaaaguggcccucaagggcccccagguggaugucaagggccccaagcuggaccugaaaggccccaaggcggaugugaugacccccgucguggaggugucucugcccagcauggagguggacgucgaggccccgggagccaagcuggacagugugcggcuggagggugaccugucccuagccgacaaggacaugacugccaaagacagcaaguucaaaaugcccaaguucaagaugccgucguucggggugucugccccaggcaaguccaucgaggccucguuggaugugucugcgcugaagguggaggcugacgugagccuccccuccaugcagggggaccugaagaccacucaccucagcauucagcccccuuccgcugaucuggagguccaggcuggccaagaggaugugaaacucccagagggcccugugcaugagggagccggccucaaagggcaccugccgaagcugcagaugcccaguuucaagguacccaaaguggaccucaaggguccccagauagacguuaauguccccaagcuggaccugaaaggccccaagguggaggugacgucccccaaccuggacgugucucugcccagcauggagguggacauccaagccccaggagccaagcuggacaguacgcggcuggagggggaccugucccuggcugacaaggacgugacugccaaagacagcaaguucaaaaugcccaaguucaagaugccauccuuugggauguuguccccaggcaaguccaucgaggucucgguggaugugucugcgccaaagauggaggccgacaugagcauucccuccaugcagggggaccucaagaccacugaccuccgcauucaggccccuuccgccgaccuggagguccaggcuggccagguggacuugaaacuuccagaaggccacaugcccgagguagccggccucaaagggcaccugcccaagguggagaugcccaguuucaagaugcccaaaguggaccucaagggcccccagguggacgucaagggccccaagcuggaccugaaaggcccaaagg

SEQ ID NO: 17175 - RNA, 2659 nt, Homo sapiens
gguuuucuccucgggaugggagggagcuguucuguugcaugagaaagagaauaccccacuguacaacugcuguagucauuuacugacacguggguguuauuuuaggcaaccuuuauuacagaaguccacuauuuuaagugacuuuuugccaauuuuagauuugaagggaaggucucaaguuaagcuuggaaccacuuagaauccaagaggguagcaggaagauccaaccccucaaagcagguggcaugggugccacugggaggggaucuggggccugucuugagccguaaaucuuccuccaccugagacgugcaccccacuguaccagagaugccuaagacuccaaucccuggguucuggcuguguggaaaaugucucuacacagucaagcuucagcugacuacaugucaaagagagacaaaguuaagagcagccuuucauggugucaagaagcaguuagcaucuugacuuccccuccacucacucgcugaccugcugcagccuccccgggcaccucaggcauagaaaaugagcucagggaucugcccacccuggaccccagucccguuggugcuguccgaggagcacuggaacuggaaggccaccuuuccacacugcacuuccgucauccccuccugcccaaaguagcugaguucgcugccguccaggacggcacuggccguguagaaggugucuuguucaaccuggaccggguguucaaaccagaccgggaagguguuacuggauccgucugacaugaacuuggucaaguucugagccagaaccaccccgagccgcuugagcucaaucuucacgcuguacucagccuucccagagcuggagccauacaggcccagcccugcaauaaauacccuucuguccacugcaaacuggaugcugucgcagcgcccgcgguaccgccacugguugcugcgguaggcagaagacuggaaucgguggcaccucugcggggcgaggcccuuccucuuggucaggggaaaguccaggcggggcuuguugguggccguguaccacaggaagaugcugugggucuccuccagagucaggaugucugacugggcagcgccguuggcaaacuccucuagggucaugguuggaauucggaccagauagagggcucgccccagaacaugccucuuguuucguggggugauuggcagccccugccucuugcacuccgccucggcccaguucaggacggccucgaagaccaccgccucuuugguguugagggccucccgagugacaaugaucuccagcgucugccggucuaucucacagaagccuucggaccguagggccaucucggccugugcgucaaugaccucccagcagcgcugcgucagcucgggcuccucaaacagccggcucugggacagcaggacgcaggcguucuuggcuuccaaacuugucuccagaaaguugacacaggcuuuugccaaugcugggacgauguacuucuuagcagcguacagaguggccagcaccgugucggcuuccagaucgaucucaucacuguacauguaccuaggcgaggcagggcccgcgucaggggcuggcucccaagcacccaucgcggggcugggccugggagaggaguccaucagcuccugugugcuucccuucagaagccuccggaggccgccuaaaacggacccacccgucccuccccaguagaguggacuuacuuuaagaggaucagaaaggcugcgggcuccacgucuggaaugugaauuucagauuugacuuccgccaggucuccguagaacauggcauagaagacggagcugccgacagccaagacguacugggaggagaaagcgccgccgugagccuggcucucccgcaggcugcgugucagccacacggcggacggggcggacggggcacgcguuccgagaggggccgccgcuacccaccuugugggcgggcaccguccuggucgcccccgggggccccacgacgaagugcacgucggccaugagcucguuguugaacaugagcgcguuccugcaaagguagaggcacgggcugggggcgugggcgcgcgcgggcgcgggggccgcggggcacgggcucaccucucgcgcagcguggggcggcagcaccgccagccggggcucuccuggugguuguugccgagugugggcggcgcgggcgcgggcggcggcggcgcuggcgcgggggcgcugggcgggcugcgcggcccggccuuccugcccacggcggcgccggcguugcuguuggcuagguccgcggccgcggcgcuggcgggagcguagaguuccgccgccaucuucgcgggcggggcggcgggggcagccucggcgccuguggacgccgcgccccgcgcccucgcgccgcgccggggccucgggagcggcucugcaagcaaaagcaaggaggucaggcacugagcgacgcggccgugcaggcaggcuaggggcagcagcaugggcggcggcggcgcugugacccgcggggcugccacccgcuccccugccacccccgccccugcgacccugcccgagcccagccuagcgcagcccggccaggcccggccgcggggggcgccgucccgcccgcccgcccgcccgagcccguacccgccgcggcgccggugcgucacgcugcguca

SEQ ID NO: 17176 - RNA, 4570 nt, Homo sapiens
agagcccugcaaaucucaugaagaccuuuaguaacauaaugaauacauuauuguaacaacuucagcuaacacauuuccagacucacaccagauauagacauagcaaagcgaggguuuggcccaggguggcggagguaggauguuaggcagcaagagaaguacgcuggcccacugacagaagacuccaaagacucuagguuuuagguaguaagcaggggcuacaagguguuuggacagagaaccuuguacagcaagguccuaaaggcauaguuguguuacaacuuuguaaaauaauguguucauaacacugacugaaucaaagaauuuaugcuacucugucaaauaagacaguaaggaauugucaaaggauguuuucuauccaaaguaaagauacacuucaauuaccugaaaaauucgcauuagaaagcaucaggaugauaucguauaaaaggggauaaugcaggccaggcgagguggcucacgccuguaaccccggagcuuugggaggcugagguggguggaucacgaggucaggaguucaagaccagccuggccaacauggugaaaccccaucucuacuaaaaauacaaaaauuagccgggcgugguggcgugcgccuguagucccagcuacucgggaggcugaggcagaauugcuugaacccaggagguggaguuugcagugagcugagaucacgccacugcacuccagccucggcaacagagcgagucucuugucucaaaaaaaaggauaaugcaauuagaaaaugucauuguguuuuucaauuuuuaauauaguuugcuucuuguacuucuagaaauuucagccacaugaaaaagacaauaauaaagaaaaagggauaaaucaccuugaaaauugacaaaagcuguugguguaguaaguuaggaaagcugaagcagugcuaaaagcaauacuaauagggugugguuuacaaugccauugguaaugacaacuugaaaauagaaaaauauacaguauuguuuauuuuuuaauuaaaaguucagaugcuuaauuucaggggugcagagacuucaagugucacagcaaacuugaaauacuuuauuccuuugugaaacugaauaauauauugcuauauuuacugccugaacaguaaugucugcuuaauauacacacaaccaacuuguaauucgguagcaggacuuuuaaggcauguauuuuccauucuuuuaagauuggcugauuagcauaaaccuugggcucuguuccucuuaguaacagguggcaaugaaauaauuuauuuuuggauaccugagaguaaugucaagcagaaauaguggaaggaaggaagagagaaaggaaaggaaaaggagcauaaaggccuauuuauaaugcaguggguugaucucccugguuaauagcuaagcaccgugccaaaagagaucaacggagagucugaggauuucaggcuggauuccugguucagccacuuaguaggcacacaaccgugggcaaguuauugaacuuuuaagcacuuauuuuuuucuacuucauagaauaaaagagcaaugcuuauuaauguuaagcauuaugaauaauacauaggucuguuaagaucaaacaagaaaacuauauugaguaacacauaguuguguuuaauacguuauuauuguuaauuauaaguuaacccaaaaggcagacgggugucuuaguccauucgggcugcuauaacaagauaaacuagacuagguagcuuauaaacaacagaaauuuauuucucacuucggagcuaggaaguccaaggucaagauucuggcagauucaguguucauuuacugguucauagauggugacuucuagcugugucuucacauggugaaagggacaagacaacuuucuggggccucuuuuguaaugacgcuaaucccauucaugagagcucuacugucaugaucuaaucauuuuucaaagguuccaccucuuaauaucacugguaauauuauugguaauuggguuucaacaugaauuuuuggggggcacaacugcucagaccauagcagggggcauggaauaguucccaccuggaccaaugcugaaaugucuugaaaaugggcaacaauacaucaaaaaguuaauucucaaaucccauuuuaaaaaugaaauuucagugggaauuuccaaauucaaacauauuuuucucaaacugugagcuacuuugccauacucuaccucaaaauuuuaugacagucuuuuuccaauucuaagaaaaauaaaagguuuaaaucuuaguuacuuucuuccccccccccccuugagccaaggucucacucugucacccaggcacacaccaccaugcccagcugguccugggcucaagcgauccgccugccuccaccucccaaagugcuggaauuacgagcaugagccacugcgccuggccuaauuccuaauuuuuaaauguuaauuacaauuacuguuugccuaccucaaagugauaacagacaagcacaccggugaacaagaagcaaaccaauuacugaaaaacagaaacagcugcucauguguuguucacuaacuuuuguggguuuauguguggaugauuuucuauauuuaaaagcauucucuauauuuagaaauauauguguuaaauaaacccaggcauacagggcaaauguaccccucuuuucagcuaccuaccaaauugcagccaaaaaaagaaaacauggaauguggaguucaaaaguuucuuagacaacuuccucucagacuugguucagaaaaggauaauaggaugcucuacuuuuacuuugcuuuuuagauucuuugugaaauaagauaggauauagaauaaaugucuaaacuuauaaugcccugcaaggcugaggcaucucugcuggcuguagcuucaguuguccaguuacagccuucuugcccauuuaacucuuaccuuugcuucagauccuguucuuaacucugaguugcucugcucauucccaagcuuaccuuuguuggagaugcuuuuuccaauuaauacauuuauggagcacuuacugugugucagauucaggcacaagggaugcuguuuuucuuuucuaugcuaacucugccuucuugcaucccaaccucagcuggauuucuggagcuccuugagauccauuuacccuaugccuaggaaugggcaggccagcaguugcagagauacuggagucuauugagaccauaucuacggggaggagccgaggcucagguaaucugaagcaaguuaacagguuucaagucagggucagagacuuaagaaaucagauguggguguuaagaucagacaaaagcaaauuauagggaacaggagaaaauuaaacgagcaguugucauaaacgccaguuugucuuugaaucaugucuuucuaggugguuggcuugguucaaauuuuguuauuuauuauccugcuaugaauugugguuucauaaauauuuuauuuauaguaguaguauuuuuuagauguuuagauguggaaacauaauaacguuauauuuucugcugguaaaauuguuccuugcuuguauaauguuaugcuggaauuaaauacaucaguaaaucauggugcugugugaagggcauuauggcuuccaaguauuuggucaccuuaacaagucugaaaaucacuguugaggaaaauaaucuaauggcaaagaauaagcuaacugaaaaaagauuccaacccaauucaguaauacuguaaacaguuaccacuuuaauguauuuuauguuuuugcagcccuuuacauuagcuuauucuuugucagguucauauauguacacaugaaauguauguguguacauguuagguggagcaucauauauguuuauaguuuauaaggcagaauuaaauuuauguuacuaugguuuggcauuauaguugcuuauucucuguccuuaauuauguggacagacauaaaauuguuagaaaauuaagcccuauucugauuaucacuuacaaccuuguuuaaauuuucuuuucuuuucuuuuuucuuuuuuuuuuuuuuuuuuuuugagauggagucucacucuguugcccaggcuggagugcaguggcaugaucucggcucacggcaaccuccgccucccgaguucaagugauucuucugccuuagccucccauguagccgggacuacaggcgccuggauaauuuuuguauuuuuaguaaagacaggguuuuaccauauuggccaggcuggucuagaacuccugaccucccacguagcugggacuacaggcacccugauaauuuuuguauuuuuaguagagacaggguuuuaccauauuggccaggcuggucuagaacuccugaccucaugaucugcccgccucggccucccaaagugcugggauuacaggugugagccaccgugcucagccuguauuuucguuucuauggagcaaguuaugacuagaacagaguuuuggguucuguagaaaaaaacucauuucuccuuguuuugcucugcuuuucacgauauuguggaugccaauuuguacuaaaagucuguguaaauauguccaccaauuugauaaguagcuggaaguacuuu

SEQ ID NO: 17177 - RNA, 2452 nt, Homo sapiens
uagaguggccuccagcagcuucauccgugugucuucuuuuggcacauuuuuaauuggcaugcuuugucuuuugaaugagucacacaccucuguuuugauuaacuuugaucaaauuuggggauuucauaucccuuguagcuagguagagaauuagccauuuagauaucaguaaaaggaauuuuaaugagugaaauaacauguagauuuuccuuggcaauccccaggagaaaauuaauccauaauagaguuuaacuaaagauuugagaaaguuuucacaacuucccaugccgaccucaccaagguauagcaaaauguccauaaaacuuucauuccaucugauacucaugaaacacauaggcauauuuuuaauaaugugauuuugaauaaaauuaugaaagaauggauggguuaaaaauagauaaaggaagaaaaauaaaaauaugagucuuucauaauaaaagaggcugaaaaaucuguaagguaagaguggauuaaacacuguugcuuuauuacuauuacacugacauuuaugugacugagaguuccugcaguuugugcaguguuucguaagacauaauccuugcuauuaaugugguacuuuaaauuuaauuuuauagcacagcaagcuaaauuguugccauuucucagccauuaccuuugcuuggggaccuagacaagcacauguauuguuccagaccacugauggaccaguuaauguaucaaagggcauacugguauuaguacuuccagaccauuuucagggauucucaaacuuaagccccaaucagaagcaccuggagggcauguuaaaccacagauugcgggggcccaacugcagacuuucuuacucagcugugauaggugaaaguuugcacuucuaacuaguugguugguguugugauacugguccaggaaccacacuuugaggacuaccgagcuagggcauagaguuucuugaggggugugaggcuuucacgugggagaauuccuaaguacuaggaagagaagggaauuaaguugccacuaacuuccuuuaauguugucuucucuuuucucuuuuaauguagacaauauccaacuuuaguuuucagaauauauuuuuaaauguuaaauagaaaugcaaauuauuuuuccaugaagaagaauauaauaucuaggacauaauaaauccuuaauaaguauuuguuaacuguguuuaguucucaggcuaaagaaaauaucaccuaaugcuucugauauacagaauugugugcugcaaaugguugaaaagauuuuaguuucaacaccuaauucccaucauucuguggcaaaauauaucuugaguucugaugggcgccagaacaacaucugaagauugaaugaaacuucuaaaggugaggugagcaaagagaauaaaguugaggguggcuuguggagaaaagcagaaaucccuggacuucaauuuccaauuacaaucauuucagcaacauuuaaaaagcuuuuauuaugugccaggucuugaguuagggauugaaggaauagugagaugagcuucccaccuucaggggacuauauaaucuuauuuauuuucuggaccugcuuaaacuaagcaagaacuagcccuggauaaaaacuagagccacauggguccuaggccucugccauuaaguccugggauaaucuugggccaaucaucaaaccuuuuugagccuuguuuacuccucugcaaugacuauuuaucacauaguuuuuuucaugcuuuaaacuaugaccuaucaaaugauguuauuaauacuuaauuuucauagagaggaauguagacauuauccccauuucacaguuguaaucauuuuucuaaaacagugauaacaaggcccguccuguacuucacagaagacuucugagggucaaagagaagauuuauagguaagggcuuuacaaacuaucaaauacuaugcaaaugugaggaaucauuguucacuacacacaaacacgcuugcaggaagauucuucucuaugccuguuaccuucagacauuccugugaaagaaaacuaaaagcauuuuucucuauggggugaaagcugcaggacccccucaucuuuucccuagguuacuguguauggacacuuuuuaaaucaagugccccuaagaaacgauggccugaauucugugcuugggccugagcuucuggccugguuacacaguggccaagcagaguguuccuguugcagguaccaccauccacucuuguguagacacacagcugaacacagcagcagguggugagggcccucagcuuccagcaggaccuaaugaggcaucauugcgaggagaaaaaacucgaguuuggcaugccucaacuggaaucuugaguuagccacaugcauuuguguggguuuggaaauaugacucuuaacuucuuugaaccucaguuuccucacugguaagaugagguaaaaauuguauaucuaa

SEQ ID NO: 17178 - RNA, 2825 nt, Homo sapiens
gcaggaugucggaggugcggcugccaccgcuacgcgcccuggacgacuuuguucuggggucggcgcgucuggcggcuccggauccaugcgacccgcagcgauggugccaccgcgucaucaacaaccuccucuacuaccaaaccaacuaccuucucugcuucggcaucggccucgcucucgccgggugagggagggaggcgccgguuggccagggacgucugcagagcguggggguagacccacaggucuuugaggaccaggacggggaaccugagggaggugcaaggccgggaagggcgaagucaguagagauggacggccugaggggcuuggaaggggggccuugaaggagguggagccuaguuauaaggagggccucagggagauggagccuggcugaugaggagggccugcgggggaugggggucugcaaggaagauauggggaggauggagacaagugugggacugaaggggaaagugggcuggaaggugaaccggaaaaaaaggagggcccgaaagggggacaugagaguacuugaggggcguagggggggugugaugugaaugauggggccagauugaggccgacccuggaguacuuagggcagagaccgggaaauagacgguaaaguuggaggguuuggaagauguauuuauuggggauccggucuuggaggggagccuggcuaugauuggaaggcgccaggggcagguaccuguuggggaacuugggcccaggaggaggauccaugguuggaaagccugagaccagagagggauggagaaucuggaggaaggacuugagcagugcugaaaguucagaguggggcugacgaccuggaagagguccuagcaaugauggagggaggaaucuauagggaaaugggagccuggagggcgguucuauaaggacccuaggccuggggagaggggaacgugugaagacagaaggccugaaagagggauuugcaggggcugguguuaaagggggagcuugcgggcaggcugaugaggggcccuacgggggcagagucggaaggaaaguccagggaaguguugggagcccggggguguggggagugucuagcaggaugggagggccugaagcggggaccugaggaagacaggacaguggaauugacaaggaggaaaggaggggucuacaagggugagucgggagcccuggcagaugggccugcuggagauagggcuggugggaggaugugccaggcuggaguguccggagacgggagacccuggcucuuggggcccaggguggguggugguccggaggccgucucuccgcccggccggcuagcuugguucccuuguacccgcagguacgugcggccacuucauacgcuccugagcgcgcugguaguggcgguggcccucggcgugcuggugugggcagcugagacccgcgcagcugugcgccgcugccgccgcagccacccugcagccugccuggccgcagugcuugccgucggccuccuggugcucugggucgcgggcggcgcuugcaccuuccuguucagcaucgccgggccggugcuucgugagucuccacuaccccgagauagccaggaaagcagccagagcaugcuuaaggcaccaggccagcccugccgguccccggguugagagggggcugggaaacccgagggccucgccacgcccccgcuaaaagcgccuucccgggcuucguucccccuucugggaacaccccuuuuauuaucgccuuuccuaucucacucuugguguuaagugccuuccacuggccacguccccguuaccgggcgucuucccuggccaugcccacguugccaagccaauuacucggccacgcuuucaguaucugaggcguccuggcugcucaccacuccauuggccugccugcgcgccaauucccuucggugggccccgguuggcugcaggcugaggucuauuccacugaccaccccucucggugccgcccacagugauccuggugcacgccucguugcgccugcgcaaccuuaagaacaagauugagaacaagaucgagagcauuggucucaagcggacgccaaugggccugcuacuagaggcacugggacaagagcaggaggcuggauccuaggccccugggaucuguacccaggaccuggagaauaccaccccacccccagcccauaauugggacccagagcccuuucccagcacuuaaaacaggagccuagagcccccugcccaaacaaaacaggacaucugugaccgcccuacccccacgccagccccaaacuaagauaucccucacacccagcccccauuaccuagggacaagagucuuccccagccuugaaccuaggaccaagagccaccuacauccagccccaaaacuggggcuucaggccagagcauccauggccaauuucaaauugugaacccagagacacucccauccacccuucuccaugcucauccccaaacuggggccuggagcaaggcacucucaaaucuugaacccuggaccaaagcuuuuccagaccccacccuaccuuccaacccaggucaagacauugccaaaucuugaacucagaacccaaguguuccaugccccuguguggauggagucggguauccugacuguuggaccccugguccaggugaucccgacccucaccagucccauuugccucccuccagcucugcuuaggcauuuugccccucaccccaauguuccacaccaucgacaaccaaggggugagguggggacaggccucagcagggaauggggcguauauguuaguguugcugcaacaauaaagccuguugcaucuc

SEQ ID NO: 17179 - RNA, 7691 nt, Homo sapiens
agcggggaucugacgagcuuuucucuacuugugucacuaacggaccguuuaucaugagcagcaacucggcuucugcagguaaggccgggacucggcccagggcaagacccgugggugucuuucccuggaacaacguuacguucuuguucugggacucuacuuuccaucuccaacugcaggggcccaugguccacgcuacagacccagguccaaguucucgcugcagagaauuuccagggaggcgcuggauggaugguccaggcuggcacuuggaccugugggcggguugucaggagcugucgggagcagggguccugacugugcaggucuuggccucucgcgcugcugguucacaugcacccuccuggggcucaggguuggucuccguagcaggcagggcucuagggggauagcagggaccuuccucugugggcuccugcgaguuggugccugcaucucauggcacccccuuuucagcaaacggaaaugacagcaagaaguucaaaggugacagccgaagugcaggcguccccucuagagugauccacauccggaagcuccccaucgacgucacggagggggaagucaucucccuggggcugcccuuugggaaggucaccaaccuccugaugcugaaggggaaaaaccagguaccugagccgcguuucuccggggugcucacaccgugcaggcggggacgaggagggcccagcgcucacugccuccccaacaggccuucaucgagaugaacacggaggaggcugccaacaccauggugaacuacuacaccucggugaccccugugcugcgcggccagcccaucuacauccaguucuccaaccacaaggagcugaagaccgacagcucucccaaccaggcggugcguggccccgcggcggaccccagcagcccggggaccucgggggugggcccagccgcaggggccggggacucacggcugugccucccacagcgggcccaggcggcccugcaggcggugaacucgguccagucggggaaccuggccuuggcugccucggcggcggccguggacgcagggauggcgauggccgggcagagccccgugcucaggaucaucguggagaaccucuucuacccugugacccuggaugugcugcaccaggugagguggucccaucaccgccagggcaggucggcugcuauugcugugggcacaggcacacgggaggggccuggcagggcuggugggcaccgggcaggagcucaugcuguggcccgggaccugcagauuuucuccaaguucggcacaguguugaagaucaucaccuucaccaagaacaaccaguuccaggcccugcugcaguaugcggaccccgugagcgcccagcacgccaagcuggugaguggggcucccgggacggcgcccgcccuggcccuggcccggcgacgucucacggucccucuccccucagucgcuggacgggcagaacaucuacaacgccugcugcacgcugcgcaucgacuuuuccaagcucaccagccucaacgucaaguacaacaaugacaagagccgugacuacacacgcccagaccugccuuccggggacagccagcccucgcuggaccagaccauggccgcggccuucgguaagaggcugcccgacgcggcgccagugugcagaguggucuauuagggccgcucaguccggagccccggcggcacgggcccggcccugcaccagggugaugcaccugcugcucucugcacggccagcacagcacgguccagugucccccacgucgggaccacggcccccccuggagcagcggaucugcccgcgaaggcucugccggggccgcccgccggccggguuggggcccaucccgcagcacagcgcccgcucgcgguggagguugugggugcgaugauuagugucucauuuauuucuaggugcaccugguauaaucucagccucuccguaugcaggagcugguuucccucccaccuuugccauuccucaagcugcagguauucaaacgcuuggucuugguuccccagcgacugcaugcccacaccaccuucccaggcagcuccgcauccacggcggcagccugggcggacugggcacucgagugccaggucaggggcccuucccgggagaggggacgccacguccacagagcaggcuuggccagggcagugguaggacagggcuguggaggcccacguguggacggcgccagccagaagccgcuaaucgcacagucuuuguggucugguucccuucaagcaccuccgggcgagcgcgaggaccgccagugguuggagggaugucucuaguaguugaauuugaguggccugguaagcgcgcggcccgaggcugagcagcaugaccggcggcgggacgugugugcguggccguccucccgcuucccuucugggaccggggcccggccgccccagugcuggccguggacggagcagcgcgugccgcccggcggccgccucgucugcauggaggcaugggcgcgcaugcgcgguggucccgggacgggcccugcuugccgagggccccgugucugugcuggcggagccggagcuuuucugugcugugggcggggcgcaugcagaugagcccaggcccggcccggcccgugcugugaggagaggcgggcgcuggugcaggagccggcggguggcugugcgggggucggacgaccccacaggcacccaggguagggccagagccagggccgccucccgcgcggcucggcuccucggugcaugaggacggggagcgucggccucucccacucugcgguggagucgggggcgccgccgcucaucucaccuccugcuuuuccaggccuuuccguuccgaacguccacggcgcccuggccccccuggccauccccucggcggcggcggcagcugcggcggcaggucggaucgccaucccgggccuggcgggggcaggaaauucuguauugcuggucagcaaccucaacccagagguacgugggcuuuuccuccgcgccgccguuccucccggaagagcgagcaggggauguugugcucgggcucgggucccggagcagcgccgccccucgcugugucugcgccucugcccuggcagccccucugcugcagcgcugagacccuccuuuuccaagauggcuugaguuuuccucuuuuccugaauucacaucuugguucgcguuuucucuugcaugauacgcagaaugaauuauuuuuugguuacccaaaggcaaucuaaaaauuacuuggagcugagcagggcgcgcaguucagagccccagcaggccgcccugcuggucagcgggacacacaggguuagcgcggcggggugugggcagccccuguggcucgagagccugucacuuaacugguggauccguuauuucccagaaugguuaaauuccccucggggagagcuugggugaaacaagaggcccaaaauauguaacucuugauggaugggauccuccuggaaucagcauuucaggcuguucuguuucccggcaacuccugugacuuccucaaggcggugcccagccuggcccucccucgcgggggcccaggacgcacucccugccugugccucuuaccacgagccgggugcugucccuccagcuccuccugagcgaggccgugcacuaacagacucgaucucccuucacgccuguaaucguccuuagagacugacuugugccacagcugcgggagacagcgcugcugcagggcuuggcugagguggccgcgagcggagcugcacgcgcgcuccuggggggcgugguugggaucggcuucugggagccccuccagcagcgcugucucugccggcaugugagugaaggugcuucucuuaccgugugcccgucgagguaaaccuguaacuggaauguguguggagugugacugauagaacacuaccugauucuuauguauuuacugaccuguguuuuuuugcuacuuuuuuucuuuucuccccuuccccuuucccuauuuuuuuucuugcccugauccggaauuucuuugccaacugacugcacgguacuucugcuuccuguuguugcuugaaacaaaacaaaaacauaaacaaauaaaaaacaaaaauucccccucaaacccugcucuccggaaaccaaccugcccuugaauauuaacauccugacaacuucaucauccaucaaccacugcacgccugcggggacugucuuccucguguggacgauuggcaacucgccccccuugaccucucccucuccccugucccuccgcugccuugcucugcugucucuaaagagagucacaccccaaagccucuuuauucuuuucgguauguuaucguucacacuuuuauuaccuuguuuucauuaauugagaugauuuugaugcccugagacguauuaugaguuugcgguuuggcacucugaugcuccguggcauccgccucguuuuaugguuugcuuucgguuugcgaauuuuauuuggucccguagauacguacgcaugguuuaucgcccugcaugcuuuucagaguuagaccugucgguggcauaugccaccguggccacccgcuggcagcuuaccuguccuggaugcuaugacuuugcugaacggagcugcuccuguuagcgcgcccuguggcugcgagacgcagcuccgcaguggccgauaaagcaaacccggccgggcugagccgggccuugugggggugcgcggggccggggcugacggggagaugggcggggcaggcagcaggagacucaggccccaucccugggcuuuugaaggcgucuacggugacgugcagcgcgugaagauccuguucaauaagaaggagaacgcccuagugcagauggcggacggcaaccaggcccagcuggguaagaggccggggcggccccgggguggagggggcaggggcgggggcugcguucccucucgggcgccuggucacgcgggugcugcucccccagccaugagccaccugaacgggcacaagcugcacgggaagcccauccgcaucacgcucucgaagcaccagaacgugcagcugccccgcgagggccaggaggaccagggccugaccaaggacuacggcaacucaccccugcaccgcuucaagaagccgggcuccaagaacuuccagaacauauucccgcccucggccacgcugcaccucuccaacaucccgugagugcugggccggggggcucauggggccgggggcgggcaagggcucugcuuggcuguccuaccgcgucgguguguggacuucuggcguuuccagagugcaggucgggcaccucuuaccccaaaccugaaguacugcaaggccuggagcuugagccgagggcugcucaagggagggggucguuggacacuuuggagguuuuggcucaggggaugcucccugugagaauguauaaugcacacauuuauuuauuuauauuuuuugaggcgaagucuugcuuugucacccaggcuggaguacaguggaacgaucucgguucacugcaaccuccgccucuuggguucaagugauugugccaccucagcuucccgaguagcugggacuguaggcacccacaaccacaccuggcuaauuuuuguauuuuuaguagagacgggguuucaccauauuggccaggcugaucuugaucuccugaccuugugauccgccugcuucggccucccaaagugcugggauacaggcgugagccaccgcgccuagccacauuuauuuauuuauuuauuuauuuuacuuauuuugagauggagucacgcucugucgcccaggcuggagugcaguggcgggaucucugcaaguucugccuccuggguucaugccacucugcugccucagccucccgaguagcugggagggacuauaggugcccgccagcacgcccggcuaauuuuuuguauuuuuaguggaaacgggguuucacuguguuagccaggauggugucgaucuccugacuuugugaucaacccgccucggccucccaaagugcugggauaacaggugggagccaccacgccuggccuaaugcacaccuuuauaaucccaguacuguggggggccgggcaggggauugcuugaacccaagaguuaagaccagccugagcaauaaagugagaccucugucucuacaggaacaauugguuaaaauuagcuaggagugguggugugcacgucaggucccagcucuuccggauugggagguugaggugggagguucacuucgcgcucaggagguugagguugcagugagcugugauugcacugccagacuccaggcugggcggcagaguaagacccugucuguaaaaauuacauaaugcaaguauuuggaaaugcagguacaucuggccccaagcaugucaaccaguaguaagcccuuugauauuuaacacguuacuugugaaauguuaucagaaaaucaacaaggggccuggcagaguggcucacgccuaucaucccagcacuuuaggaggccgaggcaggcagaucaccugaggucaggaguucaagaccaaccuggccaaccuggugaaaccccgucucuacuaaaaauaaaaaaauuagccuggcaugguguugcgugccuguaaucccagcuacuugggagacugaggcaggagaaucacuugaaccugcaggcggagguuguggugagcugagaucacgccacugugcucccgccugggcgacagagcaagauuccaucuggaaaaaaaaaaguggaggagcgugguacucuguuucugcaaacuuguagaugccugguuucguuagaagcugcuucagaccauuguggacaugauuugauaccccauuucugggcuccuaaaaggcccuacgccuuccccggcuacucugaaaacuagucuggggaaagccucgcggaccugacugggcgcccccacccccacgcggccccaggcucacgccuuucuccucccacaggcccucagucuccgaggaggaucucaagguccuguuuuccagcaaugggggcgucgucaaaggauucaaguucuuccagugaguaugaggcgggcugucccuggcucuccccaggcugcccugcggccggcccugacccccugucuugcaggaaggaccgcaagauggcacugauccagaugggcuccguggaggaggcgguccaggcccucauugaccugcacaaccacgaccucggggagaaccaccaccugcgggucuccuucuccaaguccaccaucuaggggcacaggcccccacggccgggcccccuggcgacaacuuccaucauuccagagaaaagccacuuuaaaaacagcugaagugaccuuagcagaccagagauuuuauuuuuuuaaagagaaaucaguuuaccuguuuuuaaaaaaauuaaaucuaguucaccuugcucacccugcggugacagggacagcucaggcucuuggugacuguggcagcgggaguucccggcccuccacacccggggccagacccucggggccaugccuugguggggccugugucgggcguggggccugcaggugggcgccccgaccacgacuuggcuuccuugugccuuaaaaaaccugccuuccugcagccacacacccacccgggguguccuggggacccaaggggugggggggucacaccagagagaggcaggg

SEQ ID NO: 17180 - RNA, 847 nt, Homo sapiens
cugugccuaacguagccauggcucguggucccaagaagcaucuaaagcagguagcagcuccaaagcauuggaugcuggauaaauugacugguguguuugcuccucauccauccaccaguccccacaaguugagagagugucucccccucaucauuuucauaaggaacagacuuaaguaugcccugacaggagaggaaguaaagaagauuugcaugcagcgguucauuaagaucgauggcaagguccgcacugauauaaccuacccugcuggauucauggaugucaucagcauugacaagaugggagagaauuucugucugaucugugacaccaagggucacuuugcuguacaucguauuacaccugaggaggccaaguacaaguugugaaaagugagaaaaaauauuugugcgcacaaaaggaaucccucaucuggugacucaugaugcucguaccaucugcuacccugauccccucaucaaggugaaugacaccauucagauugauuuggagacuggcaagauuacugacuucaucagguucgacacugguaaccuguguauggugacuggaggugccaaccugggaagaauuggugugaucaccaacagagagaggcacccuggaucucuugacgugguucacaugaaagaugccaauggcaacagcuuugccacuugacuuuccaacauuuuuguuguuugcaagggcaacauaccauggauuucucuuccccaaggaaaagguaucugccucaccauugcugaagagagagacaagagauuggcaaccaaucaaagcaguggguaaaauggucccuggauggcauguuagaucuuuguaugua

SEQ ID NO: 17181 - RNA, 847 nt, Homo sapiens
uacauacaaagaucuaacaugccauccagggaccauuuuacccacugcuuugauugguugccaaucucuugucucucucuucagcaauggugaggcagauaccuuuuccuuggggaagagaaauccaugguauguugcccuugcaaacaacaaaaauguuggaaagucaaguggcaaagcuguugccauuggcaucuuucaugugaaccacgucaagagauccagggugccucucucuguuggugaucacaccaauucuucccagguuggcaccuccagucaccauacacagguuaccagugucgaaccugaugaagucaguaaucuugccagucuccaaaucaaucugaauggugucauucaccuugaugaggggaucaggguagcagaugguacgagcaucaugagucaccagaugagggauuccuuuugugcgcacaaauauuuuuucucacuuuucacaacuuguacuuggccuccucagguguaauacgauguacagcaaagugacccuuggugucacagaucagacagaaauucucucccaucuugucaaugcugaugacauccaugaauccagcaggguagguuauaucagugcggaccuugccaucgaucuuaaugaaccgcugcaugcaaaucuucuuuacuuccucuccugucagggcauacuuaagucuguuccuuaugaaaaugaugagggggagacacucucucaacuuguggggacugguggauggaugaggagcaaacacaccagucaauuuauccagcauccaaugcuuuggagcugcuaccugcuuuagaugcuucuugggaccacgagccauggcuacguuaggcacag

SEQ ID NO: 17182 - RNA, 1935 nt, Homo sapiens
cgaggugccccgggaauuccggacaugcggccgucguggugaaaguccugccgaggccgcggcggcccuggaggagggaggcccccuaggucccagauagcugcugaauggggagggaaaguuaggguacccuacucuggcgcuuuguugugcagagggcuccgggggcguccggcugcagacuggaccgggccuuuagccggagggggaauggggcagccaccucugcuaccuacagcggggagguccugggaaugggaaaagguucgcgaguccgggccccgaggacagagaccuucucucucaccccuggaggcgcaggauuuaaccccccaccccccacccuuugaaagggagguugaguuuugcucaggucgaaaucaguuuaaaacuuaaggacgaggcgcgauuaugcuauccccuuccugaaguuauucuuuaaggagacgacaagcgaaauuguggcgaacaccccuuucucccacccuugggaucccgugggggacggugucuccccucccccaggaccgcucgcucgcccacccccgauaagccccaacccuccccgaccagauggcuggucuucccaagguuuccaccagggagguccucccagccggagagagaauuccguuuccaaccgagacuccuuuaccccaaaaagaccauuuguguaugcgagucguuuuuaaaugucuccucguagaaaaacugaaaguagaaagaaaggaagcaauuucugagcagaugucugaccaccccuucucgcacacucccagcaucggguuacaggguccugggagcccccacccacauucugcggccccacacggauggacccacaguccuuccgcuccagcuugugcgcgaccccugaacgcccuccggcaccccuggaccccgucucccugcacguccgggccucaggaggcggggaggguagcggcgcaacacaaugauauagggauaaauauuaagccgugacauugacgugcccggcgccuccccucccccgcgcucccggcacacucugggcugcucggcacgcccccucccguuccacugcgucccgcgccgcucgcucauccccgaggggccccugcaaccucuccgcgcgaagacggcuucagcccugcagggaaagaaaaguaacuucgcuuuucucggaggaaccaggaaggauuaagcggcuugggagagggcaggagcgcgcggaggguagcgauggaggcuucguaaaggaggaggaggggagucuggaggaaccccgaggaaggcuucugggcugucugauugcacuuucuucuuauccucccgucuccuccuuuaggugcaaugauucuggacugagacgcgcuugggcagaggcuauguaaucgugucuguguugaggacuucgcuucgaggagggaagaggagggaucggcucgcuccuccggcggcggcggcggcggcgacucugcaggcggaguuucgcggcggcggcaccaggguuacgccagccccgcggggaggucucuccauccagcuucugcagcggcgaaagccccagcgcccgagcgccugagccggcggggagcaaguaaagcuagaccgaucuccggggagccccggaguaggcgagcggcggccgccagcuaguugagcgcaccccccgcccgccccagcggcgccgcggcgggcggcguccaggcggcauggagaaggacggccugugccgcgcugaccagcaguacgaaugcguggcggagaucggggagggcgccuaugggaagguguucaaggcccgcgacuugaagaacggaggccguuucguggcguugaagcgcgugcgggugcagaccggcgaggagggcaugccgcucuccaccauccgcgagguggcggugcugaggcaccuggagaccuucgagcaccccaacguggucaggugag

SEQ ID NO: 17183 - RNA, 699 nt, Homo sapiens
uuuuuuuuuuuuuuugaacugguaauagaauuuauucaaaugugccuuaauauaggcgcuggggcuugcccauggugcucucgauauauaaggcccggacauucugccaguuuuucuugagcaaugacaccaagaaguugacagccaggugaauguuauacacaagcucaucggcugucaucuucacgugaccaacagcuacagccagacauaacaccuucuucauuuggaacuugauuguggacuucaccucacccacuuuggccaccauguuuucguugugugugagcagggaagggaacuuuccugccuuauuuagaccugggccgaggauucguggaaucugcuugaucagagacucugaggccaaaaacgcaucauacuucuuggccagcuucuugaccaguuuuuuauucuuuuugaguuuuuucagcgccucgauguccaugugggggauauccacggccuuagccucgucacagugcugcuggucccccaggacacacacacacaacuuagggcggggaguggacuuaagucugacggugcccgagaagcacuuguccuucugggggucauaguucuucaagcugaucugcaacuccaccgucuccaggaacuugcggcgcuugcgcugguuccggugcaggacuucccgcaccgccucguacaggguguugcgagagacugcugcucaug

SEQ ID NO: 17184 - RNA, 699 nt, Homo sapiens
caugagcagcagucucucgcaacacccuguacgaggcggugcgggaaguccugcaccggaaccagcgcaagcgccgcaaguuccuggagacgguggaguugcagaucagcuugaagaacuaugacccccagaaggacaagugcuucucgggcaccgucagacuuaaguccacuccccgcccuaaguuguguguguguguccugggggaccagcagcacugugacgaggcuaaggccguggauaucccccacauggacaucgaggcgcugaaaaaacucaaaaagaauaaaaaacuggucaagaagcuggccaagaaguaugaugcguuuuuggccucagagucucugaucaagcagauuccacgaauccucggcccaggucuaaauaaggcaggaaaguucccuucccugcucacacacaacgaaaacaugguggccaaagugggugaggugaaguccacaaucaaguuccaaaugaagaagguguuaugucuggcuguagcuguuggucacgugaagaugacagccgaugagcuuguguauaacauucaccuggcugucaacuucuuggugucauugcucaagaaaaacuggcagaauguccgggccuuauauaucgagagcaccaugggcaagccccagcgccuauauuaaggcacauuugaauaaauucuauuaccaguucaaaaaaaaaaaaaaa

SEQ ID NO: 17185 - RNA, 6676 nt, Homo sapiens
auacaccaagaucuucaaugacuucaaagaccggaugaagucggaccacaagcgggagacagagcguguuguccgagaagcucuggagaagguaaugcuugucgccacugugggugcccugcugcagccggcacuccugucaugguuaggcuccuuucacucaugcaucaacccaguagcagcuuuuacauguagccauauaaugacaccaguaucuuuuacagcauuucaaguaauaaugauacuuuccucaccuaaauuuuuuacacauguaaugaaggggaaaaaagguaccucaugcaaguuguguuaaguuucuguuccaguguagauggucuguguuaaguugugugcugacgcacuguggguugucuuuucauuccagcugcguucugaaauggaagaagaaaagagacaagcuguaaauaaagcuguagccaacaugcagggugagauggacagaaaauguaagcaaguaaaggaaaaguguaaggaagaauuuguagaagaaaucaagaagcuggcaacacagcacaagcaacugauuucucagaccaagaagaagcaguggguaaauaccagucuuuuuuagacccuuauuucugaaaauguaccacagguaugaugcccguuaauucagaagguagcuguggcacaugcagaagauguuucugaaauaagaucaaaugugaaauggucagcuuuaguuuuaaaaauuuuauuaaaaguccuaugaucucucaaccccagaucccauauuacuguguacugcucaggauuauuuuguuaaauugagauuauaauaccuuaguacauauuuauuacaauuaacuuauauaauuucuccaucuaugcauauauuuuauuugggcaaaguggcuggcccugacuuuuaccuggugauuucagauggguaacauccaaauggugaaauuauaaauguaauuaucacaauaaauaguuucagauuucccugcacuuaacauuuauacauuagauuuuguuaaagaaaucaguuacuuuuacuuuauaguagugacaucucauuggucucuaacuacccucccucauaccugacuaguaucauuugucaucguguccugcucgccagucucauccuccccacuagagugggagcuucugagugcacaggguccaagugcucguccuacagccgccacagugcucagugaauuagggaaaaguuuugcucccgaaagcucauaacuugguuucaguuuuaauaaaugacuauauaaaguuuugugauaaacuaauucuucauuuuaucaagccuauauuauauaaauacacauaagcuuuucaugaaagaaauauuuuuaaaucugugacaaagauuuggcaagaaggaaaauggaaacuucgaauagaugaagauaacuugguaggaagagcuggugaauaacaaaauaaauauuguuaacaaaagaccaggagaucuguggagggaaaaagagaacuuuauuuucuguuaaaaaaacaaccugcacauuggguguuauagccuucaguacaagugaaagcgugcuuuccgaauaacuuuuccauguucuucuuuaagaaauuucacugcugcucguaagguuuugaggagcugacaagcucugacuggugagggauggcagucggcaaaacuagucugagagcugcagccaacauuuuguguuccaggugcuucuccccccagcuucucaacucaguuuuaguuggguaugacaagaaugacugaauuugugugaucaacucucacaauaucauuagaugggaauuaaggugugcugaagauaacagaagcacaacacccaaagacgccaggugcaguggcucaugcccguagucccagugcuuugggaggccaagguggaaggauugguugagcccaggagugcaagguugcagagaggugucauugcaccacugcacuccagccugggcgauggagcaagacccugucucuuaaaaaauucuuaugaguagaaaucucuuaaguuuacuaaagaaucaagaaaaugggaagaagaggcuauaauuauaauacugucuuuuguagcacuuuaccauuugugaaacagcuaaaguggguauuuuuguacucuucuuuaagaugaagaauuugaggcuuaugagauuaaauagaaugauuaaaaaccuaguuggcagagcugagcuuuuugugcucaucacauucuaguaaaaggguuagaauucuuucuucucggccaggcucggugcucacaccuguaauuccagcacuugggaaggccgaggugggcagaucacuugagaccagccugggcaacauggugaaaccccaucucuacaaaaaauacaaaaauuagccgggcgugguggugugugccugaaaccccagcuacuugagaggcucaggcagaagaaucucuugaacccaggaggcagagaucaaaaugagcugagauugugccacugcacuccagccugggcgacagagcgagacucacucucaaagaaucaagaauucuuucuucccaauuacaucuuacauuguuguaagaaauagaguaguauuauaggacagaaagcauguagguaugccagaugccgaauaauggaugucacgagaaacacagauagauguauccauuaaauauauccccagaaagggagaaauugaaaacgaaauaauaggguauuugggagaagggaugguggugcuguguaaagucugaaagaugaggaaacuaagaaguuaaauaacuugaagccacaugaccaguggguggcacagaccccagaugugaaucccgacacgccucauccaagccguuuccaaaacugacucugcaccuaauggggauuuuucugaaggugcacuugcugacauaauggauaauaaugcacacaauacacaggaaggaaauuagaauguuuagguaucaaauguaggcuagucucccuggguucuuccuccagggcucucaacagccgucagaucugcaugugucuaucuacagaacuuucauauuuauacugaccuguugucaaguguuuguuuacauccagaaggucucucaucuuccuugccucacugugggugucuguucaugguacuacuguuaguucaccaacccagcuuggaacuuuagcuuuacuuuuuucacucuucucuucucccaugaccaaagaguucaaccaugguauauggacccuugcacuagaacauucuuugggggagguguacauggugggauguuuaacagcaucccaggccucugucugccaguaguaccuucugcccuuaaguugugacagucaaaaauaucuccagacauugccaaauaagaugaagacugagacuuggccacuagauuugaaguuguaagugacccugcuagcagcauauuaguggcaugguaugaguaaagacugcagcguauguuaacgacgagagaagaauuugaaauagggaguuuaggcaagucuuucaaggagcuuguggggagcagagaaaugcaagugguagcuggaaagggaugugaagucaagagcauuuuaagaaaagaaacgggaaugacucucacagagauggaaaaaacgggaggugucagguaccaccugacagcagcuugaguuugcugacaaccaggcaugagcugcagucauccccagggcucccuuuccaucugcugugcauaaaacguauucagauuccacaaaagguugagccagaaagaucuuuuaaaagcaccaccucaagaguuugccauuuuaaccagucgcuuacacauccacacccaagucuaaagacugccccgauuucuuaccugcagugcuacaacugugaggaggaggccauguaccacugcugcuggaacacauccuacugcuccaucaagugccagcaggagcacuggcacgcggagcacaagcgcaccugccgccggaaaagaugaagcuggcccuucccggagucaccccgaugauuacucuuuucagacacagcgguuuuuguuuccaagaagccaaaauuguuuagaauuugcuucccauuuugcaccagccuuuaaacacuuuucgugaagaaauuuugcacaguaguuuaaaucuuuuguuaaugcuccuccgaaguuuuucaggggguaaaaguaacaucaguggaggguauuauuuuaaauaaauuuuaauugagaauuuguugcauuuucagcaaauuuuaaaacauuuuuagguuuuacagagauuuuaaccuuuaaacaacagaucuuuaaaaaacaggugaauacaagugaguuuaacaaagaaacauuuagaauagaucugaauguaagaacuacagaacuguuucagaaauaaaacauacuaccuugaugugacauuuuuuucuuaaccuuguugagcugguuuuguucagcuuaauuuacuguucaaaggcauuaucuguuggucacaccaguggguauaugauugaauuuagggaacaggguugacacagcagggcuaguccugcauauuuuuucuuaaauauuucccaauuguguuuuucauuauuucuuuucaauauauaacuuuuauaacaaauuauuagcuuugaucuuguaguuuaaaauugcagggaacugggguaaucuuuuacugagcuggaucuuagagaaaaugaauauuuaaauuuuaaaguuugcacauuucaucuuuguccuaacaugagugcuuguaacaaaauaaacaacaaaaacaaagccaaaaacuaccuuuauccauaugugaaauuauagaugaggcauacgaauuuguuuaaugcuucccuucccuucccacauaucaucucacugccuauuaucuggugucaccucauguaucguaaguuaauacuaaaagaagagaaagcacuuaaguuucacagaagccguuauguuuguaguaaugggucauugccuacuaaugaacuccaucacuguacacagaaugaagaauaaugcauguuaauuuucuuguauuaaagaugccgugauuuguaaaaagucuguauuuugcggaaugucuggauuaagaagcauuaccaauaggaauggaucgauaguugaauaaugauuuuuuauacauagauauauaaaauacagccaggaaaacuuaaauuacuuuucuuuuaaaauaucucacaauuuaugugguauuuuuaaagacugaucuuagaccaagucaaauucccauuuaucauuuaguuauuuuuugagguuagagaauaauuuguacauauuuauuuagaccuuugauauuuauuaaagcaauuacucacaauggaagugaaagaaucaggagaaaagccuuuuaaaaaguauucuccagguuugucagggucacucuaaagauaaaaauguaacuaagucuucugugaaauaucauccaucuaaucuugaugcuguugcagaugguggugacacaaguuaauugacaaacuacugccaaauggugcacaauauuuuguaaaaaguacccaguagccccauuucauacaauguaccuaaauuaugcaguaacuuggcaucaucguucccuccuuguugcuguguaauuagucaguguugccacaguguguggcgcugauggagaugucagaaccgagaacacuuaaccuucuuugauuguuuuucaaguuuuaagacuucgauccaccccuaugagagcaaguaauuguggaaauauuuuugguguaaaaucauuccagaguauguaauauuuaacugauagcugcaugaaagugagauucguguuacuuuggcuuuucugucucuguugacacgguugcacauuuccaaguuacuacagcgugaaaacuguguguuuaaaaaaaaacaaaauuaaaaaaagagauuguggccugguuuuguaaaaguuuuagguaaaauuacaauugauuguuuuaggaaucauuauuaaaaauuuucugcaaaucauaaagcuauaucgagguguugagcuuagccacuaugcacauuguaauuauucauuguggcuguccaguucuaugaugcauucuggcauuuuguaagcugcucugacuagcaauauauagauucauuuaauguguuaacauugguuaauaaauguauuuaaaaaaaacuagcuuuaguaauuuguuuauuuaguguaguccccuauacccaaccaaauacuaccgucgcuaaauguugaucacauacugugggucacucuuuagugacugcuuaacuuuauauaaaaucaguguguuaaacaucauuuguucacuuaaacguauaaauugaauuuacuuucaccagaucucaaaaagaccauacaugauauaauaaggagaggaugauuauuauaucagcugcauaucaauuauugcaaaucagccugaaaaacagauacacaacucagaauggaauagauucuuaauuggaggccagcugaggcuaacccucugcuguuuucaucuacuucuugguaugguaguuguggguaguugaccagccccaggucuuagugccaacauuaacccagccuuagucgguacucugguuuucaucauucaugccaucauucaucauucaugugauagacguaucacaacugggaucagaugguuuaggucugaauauuaaagucccaguuccuguaggauuguaaaguuuccaacaguaguaguaguaucauu

SEQ ID NO: 17186 - RNA, 56634 nt, Homo sapiens
guccggcgggcugaggggcgggcuuucgucucgggaggcggagcugucucgucgcauucccggcaagcuugaaccucuucacuugccguagcgccugcagcaggaaguugcucuacagcaugccuuagguuuccgggugaggguugggcuccuugguaccaugugggaagcgcugugaagaguuguugccuuccaagauauacccaaauucccaguuccagguaagcggcacagagccgcuugauguggcugcggaugggggcggcauaucgagggaggguaagaguuuuccggauaucugcggaaucaggguugaaggaaagccuuggcgcggucgccgcuacuguaauuaguuguuaacgcugcugccaucgucuuugcaucuccgggguccacaaaucucaggacacccgcguuguguguccaugacggugcugagugcagaagagaauuguuuguuuacgaggcgccuuauaauuucguagaaacuuaucaaagugcuuacguuuuuuuagcccgugucauuaaaacuccgcuggcgugaaagaugacguccuuagcccagcagcugcaacgacucgcccucccucaaagugaugccagccucuuaucuagagaugaaguugcuucuuuguuauuugacccuaaggaagcggccacaaucgacagggacaccgccuucgccauuggugagccaucuuuuaacuuagaaaagcucuuggaagcguuuguuuucuggauguuacuguuuuuuuuuuuuccccuuguuuucucuucugucccguccucuuccuuagcaguuucuagcauguugauguauauuuuuaagggaaagagaacauaacagucaggugcuuggugcuugaaauguuuaugaguagagguaucuggauuucacagaugaagaaacaaaauuagagaggucaacuaauaugucaaagagaagaacagcuaaaagggggauggaggcagugacuggggugacggagaaguccucucagaggacuggccuaguuauuguaggggauauccaaaaaaaaaaaaaaaaaaguguucccugccacgaaguacuuucuguucuaguagaugagauaggauuuacucuaaaaguugaaaacuagaaaucaguguuugggacuguauuauaaauuauauguacuuaaagaauucagaaacuucuuagggguaaguaaaacuguaaaagaggggugggaugaauuugcuuacgaagaauuguuaaauaaacuggccuuuuuugaaauuuaggauguacuggccuggaagaguugcuuggaauugauccuuccuuugagcaguuugaagcaccguuguucagucagcuagcaaaaaccuuggagcgaaguguucagaccaaagcaguaaacaaacaguuggaugaaaacauuucauuauuccuuauucacuugucgccuuacuuccugcuuaagccagcacagaagugucuggagugguugauucacagguagcuaauagaauuacagaaauaacuauggguuaaucacuuuggucuuguaaaaaauuaaguaguugagaacuuaucaaauuaaagcugaaaaauuagguauauuaagagauugauacaauguccauugugugagauaagcaugcucuucugccuuuaaauucuuuuuuguugauagugaaaaguagaacuacuggugauuuugaguaaauggucuaaccucauuaguuuuuuuuugagauagagucuugcugggcacucaggcuggagugcaauauugaaaucuuggcucacugcaaccucugccucccagguucaagugauucucccaccucagccucccaaguagcugggauuacaggcaccugccauaaugccuggaugaguuuuguguuuuuguagagauggaguuucaccguguuagccaggcuggucuuuaaccccugaccucaggugauccacccgccucggccucccaaaauacugggauuacaggugugagccaccucgcccagccuaaccucguuaguucugaagagcccaugcuacuuugccauuacagcuuguuccugcacacuugaggcagugaguacuaagcugcuuucuuggcaaaauaacaagaugguuggggaagcaggcaauguuauccucugaaauaccauugcuugagaaaaacaaugauagcuaauguguuuuugagcauuuauacacuaggcccugguaagcacuuuaucugcauuaucucauuuaauucucacagcauuccucuggugagauuauuuguauuauccuuguuuuacaguugagaaaacugaggcuuagagggauuaaguuucuugagucacacagcuaguaaguggcagagcuaggauacagcugaaguuuauuuccaaggucugaucuuuuaucugcuuugggaauugucucaguaagcuuaguuuauuuucucacauauuggugucacaucacagcauacacauuuuuguuuuauuuauucucccaauauguaugucuuuuuuuuuugagacagucucgcacugucgcccaggcuggagugcaguggcacgaucucaucucacugcaaccuccaccucccagguucaagcaauucuccugccucagccucccaaguagcugggauuacaggcacauaccacuacgcccaguuaauuuuuuguauuuuuuuuuuuuuaguaaagaugggguuucaucacguuggccaggcuggucucaaacuccugaccucgugauccacucgucuuagccucccaaagugcuggugugagccaccacagccacugcacacggcugucuuuuuauuuuuauuuuauugagugucaggauuucacucacccaggcuggagugcaguggugugaucguggcccacucgaucuccagggcucaaaugauccuccgaucucagccacccaaguagcugggauuacaggcaugcaccaccaugcccaccuaguuuuuuuuuuguuuguuuguuuuuguuuuuguuuuuccauuuuuuguagagacagugucucacuuuguugcccaggcuggucuggaacuccuggccucaagcgauccuccugccgagucggccucccaaagugcugggguuacaggcaugagccaccacauccaguccaacuuacauguuuuaaaaguagauuucuauuccauuaauuggagacauggcuucaaggccagccuggccagcaugguaaaaccugucugugugaaaaauacaaaaauuagcugggcgcaguggcgagcacuuguaauucuagcuacuugggaggcugaggcaggagaauugcuugaauccaggagacagauuuugcagugagcugagaucacgccacugcacuccagccuggguaacagggagacgccguaucaaaaaaaaaaaacaaaaaauggagacguggggauaaacuaauuuuuuuucaagaagcaagugagucaucaagaaaacaugauuuuaacuugggucuucugauugucagaacauuagggcaaucagacaaagaauauuuaaaagucuguaauauuuccaucuguuuucuagcaccuaacuuuacccccaaauagaucauuaauguaaggaauacuuuuugcauuugauuuuucauuuuaugucuucagauaacuuauuuauucagcaaauacuaaguucaguacauagauaaguagguugccguugauuacuguuuugaaauaaaugccauaauaaaggauuaagcagaguuuuguggauauaguucugccuggaauaguugaagaaagcuucauggaaaaaguaaccgcuaaaaccguaugucaaacuaagaggcuggguucaguggcucacgccuguaaucccagcacuuugagaggcugaggcaggccagucacuugagaucaggaguuugagacgagccugaccaacauggugaaucccugucucuacuagaaauacaaaaaaaaauuagcuggguguggugcugugcaccuguaauuccagcuacuugggaggcuagggcaugagaaucgcuugaacuugggaggcgaagguugcagugagcugagaucacaccacugcacuccagccugggugaccaaguagacucuggaaaaaaaaaaaaaucuaauaaaaggcaauguaugguacuguuuaaaaaaaguacacgauguaaaaggauaggagaguuuucacagaagagggaucaguuggcagaauuagaaaaaacaucuuagccaggcaugguggcucacaccuguaguccuagcacuuugggaggcugaggcagguagauugccugagcucaggaguuggagaccagccugggcaacauggugaaaccccaucucuacuaaaguaaaaaaaaaaaauuagcugggcauggugguaugaguuuguagucccagcuacuugggaggcggaggcaggagaaucuuuuaaacuuggagguggagguugcagugagccgagauugugccacugcacuccagccugggcaacagcaagacucccucucaaaaaaaaaaaaaaaaaaaaaaaaaaaaauguugacagaccagccugggcaacacagggagaccuagucucuacacagaaauaaaaaauuagccagcugugauggugcuccccuguggucccagcuacucaggagaccuaggugggaggaucauuugagccugggagguugaggcugcagugacccgugaucgugccacugcacuccagccugaguggcagagcaagacucuauucaaaaaauuaaauaaaaauuguaaagcugagagaaaguuaaugggauguauauuuugauguagaauauucaaagauauugcauaggaauuggcuggaccauguugagggauaugugaaugcaaaauuggggacuuuuuaaaugcucuguaucuuauaauuuugugauuuuuacugcuacucguucuagguuguuuuagcuuauuaauaauacaguuugggcaugugaggaaauaggugcuuauuauuaaguuuuguguucaguuggacuguuugcuuuuuuuccccagguuccauauacaucucuauaaucaagauagccucauugcuuguguucugccauaccacgagacaagaauauuugugcgagucauacagcuucuaaaaauuaauaauucaaagcacagaugguucugguuguugccaguuaagguauaauugcugaaugacauaugucuguaaucauuacagaucuugauuaagggauuuaauuaggaaaaaauaagucauugcuccuggggauaguccagauaacuaccuccaucauuuuuauuuccugacuuccaauugaaacuauuauuaauguuaauaauauuuagcuuuuauuuaguaucugacaucaggcuaggcaauguacauuauauuaucuuggauuaucacaaaacuucauuuuuacagaugaggacaggcuacuugccaaaguucacauaacuauaaaguggcagaguugagauuugaacccaaaucugauuccagagucugugccuuuguaucguaccaugccguuuggcauuuuaaauuuggaacugagaacuuaaaaaaaaguugaaggugaagaaaggcagaaaauacuuacaaaaauuaaaaggauaaggauaacuucagggguuucaagaauuuacuaaaguugugaggaagaugcuaggaguuaauuuacagacuaagaaaaggaugcuuguauaacaggaagggucuggguaagaaaagacagcaugcuauuguaggaaaaccaacugacuaaccguuagcacuuuguuugcaacauaugguggaggaaaguagauguauguuguuagcaggaacuugacugcauguugggcauggugauccaggguagggggggaggcaaauggggaugaagguaagcuaacagaucacgaggcugugcacauuaggcugaugaugguaguggggucaguguucagaauuaguaagauaggaguaaugaggacuuuuuaauuagaaggagaauuuaagaaucugaacguaaagcacuugaacuaaagaauguuggagaaggccagccuuugauaaagcucauuaacugcucuucccaacauucacucugcccauagcaucaaaauuauucuuccucuaaucuaccuuggaucuugcugcucccuaggcacucuuauugcagguagccaaacuccacucaccuacuaaaguucacuuaaaauucuccuuucauuuauuuaaucaguauuuauggagcaucuauuacauaccauguacaacgcuagauggugggaauagugguauaaguugugcaguuuccuagucuauuucuguucuuaguguuauuguaaagcaaugacagaagcguaucauaguggcucagaaaccaaaucgaaccaguaaaguuacuaagaaucuagagaauccagauuuugauaaauaccuuucaaaaugugacauacgauaagcaaacaucuuucacuaaauaccucugcccucauugcugaccuucucuuuugaauuucuaaguuuacaugauuuuauguguuaauuucaucaccaccaccaguuauaaggagagauuauauuuuuuauuuaugaauuguagcaguaugaagacauuacuaggguaaaugcuuuaaaauaaggaucaguugaugaauguugcuaguaguuuguucuuuccaucaauaacagcaaucuggagugccguuagcuaaaggaacuuugauuacccacugcuacaaagaucuuggauucauggauuucauuugcaguuuggugacaaaaucugugaaggugagcagucuguuucaugaguauauaauuuuaugaaaagauugcuugcuuugaaugaagaaaacauacuaaaacauucccuaauaacaaugauacuuuggauaaauuuauuuuguuaaauggucugguguuuugaagcaggagcaguuugagaguccguaucuuuuuuuuuuuuuuuaagaaucagucuuuuaucaccaaagguguuuuucuacaaaaauaaaugucuauuccuugccagauucuaguuacagugacuauucaaagagagugucuagaaaugucgggaauauucaaccugggaaagcuguuuaaaaaauuuuaaggccaggugcgguggcucacgccuguaaucccaacacuuugggaggccaaggcaggcggaucacuugaagucaggaguuugagaccagccuggccaacauggugaaacaccgucucuacuaaaaauacgaaaauaaacugggcaugguggggcaugccuguaauuccagcugcucgggaggcugaggcaggaaaaucgcuugaaccugggaggcggagguugcagugacccaagaucaugccacuguacugcaaccugggcgacagagacuccaucucaaaaaaaaaaaaaaaaaauuuuuuuuuaaauaaaaauguuaggaauaucauuaggcaguuaauuguugucacauuguguauucauuguugcauaugguaauucaggagagcuguaaauauuuauuuggccuuucacuuuuuuuuuuuuuggagacauggacuugcuuugucgcccaggcuagaguacaguggugccaucauaguucauugaaaucucagccuugaacuccuggccucaagcaauccuucuaccucccuuucacuguuaaauguguuuuguuuguguuccuuguuucagguuuuugcugaguacccgggcagcucagcucaguugagggugcucuuggcuuucuaugcuucuaccauagugucggcgcugguagcugcagaggacguaucagacaauaucaucgccaaacuauuucccuauauccaaaagguuggcacugcugauguguuaaguagauuauuuuguacuuaaaggaauuuucuugcuuucgaaaguuuuuuuagauuuaaguguuuuuaaauugacaguuuauuucagaugauagcugagauuuagccuuuagguugaaaauaugacacuuuuuuauuagaaacucacuggccugggaccuuaauuaggacucuuaagaauaaauauuggcugucugguccugcggccaucuccuagauugauuuccauagcagucuuuguaccucacuggaaggaggacggagcagacagucucuuugaggcguaagcaaccucucaguauucuuugugcacuggcuccugccucucagcguuucuccuucccaagugccuucuugccugcugccuucccaggugcccuguggagguacugcuuucacuucccaccagugucccaacuugugaccuuucaucagacuuguuucuuccauuagugaucugauugaggucucccuacuauaaguaggauuuuauguauaaaagaagagcuuacuggcuccugucaggacaugugguagauguuugaguugggaaauuuucugagauccuuugucucguucaacagacuugucucaucucuguauccacucugaaaaaggggucagcuccuuuauuguuuaugucugaagagugauugacuaugcauuagguuguauuaaucucuaugacauuucuaauuugucagauuaacauuuaaaguagcagaaaauaauaugguuuaucauuuuuccuuauauuuaaaaaauauuuagggauugaaaucaucuuuaccagauuacagagcugcaacauacaugauaauaugucagauuucugugaaagugaccauggaaaauaccuuugugaauucauuggcaucacagaucaucaaaacauugaccaagauucccucuuugaucaaggauggguuaaguugcuugauagugcuccugcagagacagaagccagagagccuugggaaaaaguauguacaauugaauugagaaauggugcuagucagaggugaauaaaauuauuuugaauaauuuuuuuuuguaagauaagugauuauauauuuucuuauauuguuacucauugucuaacuuguaaagucaacacgauauguacuuuugcuucuucaaaggccauucccucacuuauguaauguuccugaucuuauuacaauacuucaugggauuucugaaacuuacgaugucaguccucuucugcauuacaugcuuccccaucuggucgucuccaucauucaucauguuacaggugugugguuuuauauuuuuuguccagaaauuuucuaagauuugaucuuaaaauaguaaccauauccugguuaacagcuucaaaauauuuaaaauuucuguuuuccaguuguucuuguguaacuugucuauuucuuaagugagaaacaucugggguggggagcagguugguugaagaaagaucauuguuaauugaguaauuucuuagaauuuuacuuuuuuuaagaucuguguucuuaaauacuuaaauagucucuacaugaaaaagacuggaauacuuuuaaaauuuauuacugaguaaaccuuugccuucucauuuagguauuuaaugaacuuuagugauucauuuauaaugaauaucucauccaguugccaaaaaaguuuuuucccuagaguaauuaaaaauauaagaccaagaaaauuuuuauacauaaaaauccaaauuaugaaacaaagcaaaaagcaaaaaguaauaauuagagggccagguggcucaaaccuauaauucuagcacuuugagaaacugagaugggcagaucauggcaaaaccccgucucuacaaaaauauacaaaaauuaaccgggcauggugacaugcaacuguggucccagcugcucgggagacugaggugggaggaucaccugaguccagggaguucgaggcuacagggaacuguguuugugccacugcaguucagccugggcgacagagugagacccuaucucaaaaauaauaauaauaauuagaaagugauuauuugcauuaugucuuuuaauaaauacagaaaggcuaggaagaaacauuugguucuguugcuacuuggagaauacuaagaaagacuucucuaaacuuaugucagucuacugaaaaaugagguuuuuguaaccaaaucuugguuugaacaugcauuuuagaaaagugacuagcaaaaugaaaauguauucuuccuauucugaagguaaugaguaaugucccagucuuugaaagcaagggcuaagaucagauucauauguuuauuauaaaucugaaauagaugacagcuuuugguucaguaaggggguggguacugagauaaaaguuuaaccucuuuucagagauaguugauuggcaccaucacaacuaauuuguaaugugaccuggggaaagacuaauuuuggacuuuuguuuuguuauuguuauaagcaugauaguacuuguuaaaaauagagaauuuuagauaaaagaaaaaugaaggugaucuauacaaaagagcuuuaaaaaauauaaaugacuaaauaaguggaaugcacuugugcaaauagauaaaaagcuggauaucaguguguguguuuuauucugagaacgauuuucugcuauaagugaauuuaauaauguuagcuugcaaaauaaauuuuucccaacacaauuuuaauuuuuacauauuaaggagaagaaacugaaggaauggauggucaaaucuacaagagacacuuagaagcuauacuuacaaaaauaucacugaagaacaacuuagaccauuuguuggcuagguaagcuauuauuuuugacaugcuuuugauuuacauuuuugugacucaguauaauuuucaagauugguuagaaauuucccagcauuccuuuuuaauguauaucuuguuuugucuguaucauuucauuaacuauaaguacuuaauccaguaacuggcagcauuaaaagcaaaaguaauuuuucuugcaugucuuuagugcuuauagaugaaaauggaaaguuagugguuaagacaaauuuggguaauaacuaaaugcaguuuguggccguuugaaguuuucucuuaguaaauggaccauaauaucugaaauaacacaucacaauuaaaacgcaguaaaugucauuuagaaacaauauugaagguaagcauagaguaaggauuauuucuuuaaagauaauucagucuuuuuuuuuuuuuuuuuuuuuuucucuuaaugggcaacucgauacagugaaaagauguaggcguuguggucagacauagguguaaauucugcgccuaccacuuccagggcuauaguaaguuuuggagguuagucuggauguagcuuugccauuuuguaggaucaagagagugccuguguguuggugugcaucauucaugccccuuugcucagaggguugguuugugaauuaaaggagaguauacacguguaguaauguugagaacauaggcucuagaaucagacuggggcuuaaaaugugaaaccccacucuguggcacagaagggcuuacugaauguugccuuuuauugcuguucucaugagcaaauuggaagacuuacacucuaguuucuuuuccuuuuuuuuuuuucuuuaagauggaguuucgcucuuauugcccaggcuggagugcaauggcacaaucucggcucacugcaaccuccgccucccagguucaagcgauucuccugccucagccucccugguagcugggauuacaggcaugugccaccaugcccagcuaauuuuguauauuuaguagagacaagguuucaccauguuggucaggcugaucucgaacuccuguccucaggugauccgcccaccuuggccucccaaaguacugggauuacaggcgugagccagcaccauuuaaaauagcaauguagucuuacuauguuguucagacaggucucgaacuccugaccuuaagcaguucuccugccccggccuccgaaagugcugggauuauaaugccaguggugugaaccacuacaccaggccucuaguuucuuuaucuguaaaauaaguauuaaacuauaccuuguauaaguaugacaauuagagauaauauuucuaaagcacuuagaauauaguagguacucaauaaauaguaacucuuauguaugcugauauuucuguuuuuuuuuuuacagccuucuauuugaagaguauauuucauauaguucacaggaagaaauggauucuaauaaagugucuuugcuuaaugaacaauuucuuccacucauuaggcuuuuagaaagcaaguaaguuacguguguauguuuaugcucuucuaaaguacuuccuguucuauaaagauaugauucacaagucacaucuuaauauacugaauuguacagagacuguccuuuuuaaauuuguucuucaagaaggggcgaguaucggaaucaaaaauauuugaaauauaagaggaaauagugguugugugggggcuauggagaguauaauuuuuuauagagagacuauuuuguuauuggaguagucauaguaacacacuugaccaaugucauuugguuuuaccuacaacauuuguuaaaauuuaagucacagucucaguaauuuuuaagauuuuaugucuuuccuuuauauguguaugguguaugagauuaauaaauuuauuaagaauaaugaauucacuuuuuaauugcuucccagauaccccagaacauuagauguuguauuagaggaacacuuaaaggaaauugcagaucugaaaaaacaagagcuuuuccaucaguuuguuucucuuucuacaaguggaggaaaguaucagguauguuguucuccaaaggaauuaugacaauuugggguacauuuguauggguaugugaagagcuccagaaggaaauuugccacuuuuuucccuuguguggaaaauuuuacagagauaaccuucuacaguuugccuaguugccugaaguacggcucugaggcaggaauagaauaauuggagaaagguacaauaauuuguacauaacuaugaacgugauacuuauuucaggaaaaguauuguuugagaauuuuguaugggauauucauuaagaaucaucagaggacggccucauguagguuucuagcauucucugucuuucaucuaggucuaugcuuuccaguguaccagccacagauggcuauuuauauuauugauuagcaagggggagauggguucuauuucaugaucacauuaaaacuugagaaauuuucuggugauucaagccuaaagcuuuauacuagagguuagacauuuaagcaggaguucuuauauuuagccuuaaaaacagauaauuaugaagagaaauaugauuguuuuaguauuucucuuccauaauuagacuuucauuuuuaaugguguugcauuuccaaaucuuagguugauggauaagacuuucuuuuuagucuaauugcguaagugaacuaaguugucacgaauuugagugucacuauuuguuauaucauguagaugaguugcauucugucuucuggaaggugcuaaaacagggauuuaucuuaggugauuuaucagauacgcauacaaaauacaaaauuacuuuguagaauuacuugacuaaauuaaaccuacacauagacacaaguauacaugaaaucauaccauuaacaauacaaauuuuuucaucaacucaugugauguucuagaaacaaagauuuugcauuuuuuuguuuguuuucuguaguuagaugguuguuacugaaaauguugggcaauuuggggugguuuucucuggguuuuauucuugaucauagacuguucagauuaagugaaaucauuugauaacuauguugaacccuguaguuuuuagcagauucugauacuucuuugaugcucagccugaaucauccacuugcuccugugagaauucuggccaugaaucauuugaaaaagaucaugaaaacaucaaagguuuguuucagaucgcuuuuuuauaugguuuuuuuuucuuaugaugagcaguguaauucugaauaagaaauugaaguuaccaccuaaguggguaaugauacagaugaguugaauaaaccucaugagaguaccuuagacuaauauuuaggacuguguaugccaguuguccccauuuuaacaauaaccuaauaacaacuacuuuuauguuuccacauugacaguuguuuaucuuuaguguuuuucaaacuggaauuuguagauuaauucacguagguucauuaauuaucugagaauuuuuuuaguuuugaaauuugauuuugggccggucacagcagcucaugccuauaaucccagcacucugugagaaggaucacuugagcccaaacguuugagaccaaccugggcaacauagggagacccccuucucuauaaaaaaguucaaaaaauaaaaaauuagccaaguuugguggcacacgcuuuggucccagcuacuugagaggcugagguaggaggaucucuugggugugagagguugaggcugcagcgagccaugaucacgccacugcucuccagccugggugacagggcaagacucuuucaaaaaaaaaccgagaaauuugauuuugauagucuuaauuuuagaugaagacauauuuugggacauuugaaugauaacuuuugaacacuguuccaugauuuuggugccugcaguuucguuugucuuuaaaauguuagugguuucaaauauguauugaggcugacuuuauuuguaaauaauuuggucuaauuugcauuuauaccaaaaggcauugguaugaagacuugguaaugaugcacauagaauaguaguuuccaaacuuuagucauucaagcagucccuguacaauuuuugcuaaauuacaaauuaccacugauaguaguauuauuuucucacaauuuuucuuuauuucagauggacucauuauuuuuuuacauagccuucaaauugugggugugaggugcuaauuguauaugcauuuuacuauaguuacuauaauuaaaauaggaaugcuccaucugugucauaucuaaaauuaugcaccgugauuugcauauuugagaaauuucuggaacagaguaaagcgguuaacagaguuuaguuuccuuguagcacauggcaguguaaacgugccgaacucuagaacuugugucauagcaauuagaagcagauucuuacuacaaguaaaaucauaugaucaguaaaauuuaauuucagcuaauuacaacuaaucacacuaaguucaucuucauuugaauuuuauugguuuuauagaguuuuuaguauuucccuuguagauuuaaaaaaaaauuuuuguuuuaugucaucuauauuuuaagaaggaguuauacuuaauuuuaaguugauauauaaacaacaaacaacauuuagaucuuugagaauguuucuuugaaagugacugauguaauauucagguuugagaaauguugcuuuauuugaucugacaugaauucugcuuuuguaaacugccaauagguuuauuuugucgauauguuaaauaaauucauugaauaauagucuuuguugugauaggaggauuucagugauaagaaauucuucuagaauaaaggggaguccuggaaucuucuguuucugaaguuauucucauccuuccuucuuuuacugccuuucucuccuguucucuggguuugguucguuuuucggugaagggccggcccugcauacauucaacuuacaggcuugaggauuguaauugcaguugauguccuccuuugcauaccauguuucauuuucuuuucuccauugaugacaggacauagguuuuauucuaaacuccagguucagauauauggcugcuuauuagcucuugaggauuuguuuaaaugauggggucuugcuauguuauccaggcuggccucaaacuccugggcuuaagcaguccucccaccucagccuccagaguagcugggauuauagacaugcaccacugugccugacuaacuuaauuuuugugaauucugugaauuuucauuuuucucccaacagagugaccuauguuuuuuauauuauuuaguugccugccacauauagauagggauauauucagguugauuagcaguccuaguuuucuuucucugugaaugaauauacauuguuuucuuuuauuuguuauauuuaaaaaaugaucucuauuuuuggcagacuggcuuuguaguacauguccuuauccuuguaaaaauuuagauaauacuagcuagcuuuuaacaguacuauguguaaagcacugugcuacagacugacauguauuuuuuaaucuucuaacaacccuugcagguagguauuauuuauuagcaaaccuguuuuauaggugagaauagugagauccagaaagguuaagugacuugacuaaaguuacacaacuaguaagugguagagcuaggauuuaaauuagacauucuuauucuuuagucuauaucccgucaauaucugggcucucacuuuaauaagaugaacuccuuaacuacaaaaacuauauuuggaguauaccauauuuacuauauuuucacugaaaacuugaaaaggauuuguaccaaacaauuauuaaucucaaaaggcccuuuagcgauuaucuaguucuaguguguuucaguccucauccagagcagagccuguguuagacugucauucuggaguguuuuucacaaaaccauacuuccuuucuagugcaaagccuuaagagauuuuuggcaacagcuaaauuaauguuuuucuuuuauugcucaggaggguguugaugaaucuuucauaaaagaagcuguuuuagcccgauuaggugaugauaauauagauguuguuuugucggcuauaagugcuuuugaggugagugaauuugucauuuguugagguauacaauuuuguaaauuuccuugcccuucucacuugauucucugcuugagacuagaauauuuuuggaaauuauuuuuccaugggaaauuuguucucuggagagcacagacuuaagucugguuaggagaaacucacagaaauucacaauuugauauauuaaauauauauggaaguuguucaaacaggaaaaauguuuugugaauuuuuauauugcuuuuaacauauuuuuaucaauagcaaauaccuugggaccuguggaaauugucuuaugaaugccacuuuugagaaauagaucuuaaaacuuuuaauuuguacuaggauuccugggagaaauuccuuauaauucauucuuuuuaaaauucgcauuuaaaaagcgccauacauguuugaagcaaguacaaaucuacucuggauauuuuuuucccuuuagauuuucaaagaacacuucaguucagaagugacgauuucaaaucuucugaaucucuuucaaagagcagaacuuucaaagaauggagaaugguauguauucauuucuccucauacuauuuugaauugaugaaguucuuauaucaaguucuuucuauuucuucuucuuuuuuuuuuuaaggcuuugauuacaugacccuuuugucgugguaguagaacagaucuuacuguaauacucucuuucauuauacaguuaauuaauuuguguuuguguguguucauuauacuguucucuauguuuggaauuucucuuaauaaaaugcaaaaggaaguauauaauguaugauauugcauucugggaaguaagauggguaggacuuucuaauuugcugcuuuauguaauuuuuacuuuauaauuaaaaacaaauaccaauguguuaaacaaauuaaaaaauaaguucagagacacaugauaccaucugugguaaguuuuuaaugagcucuguuuauuucauuuuuggcaccaaagcuuuuugcaagaaaaaguaagcaagcuccauagaggaugagagugugucuuacguguuuuuguaucuaucguauggguagauaucuaucauguaggaugugcuugguucauuuuuuuugagugccugagugaaccugauuuccgguagaguugagacaucuagugugauaugucuuauguuauaguuaaccucuagugauuucucuaagaaaaauuauuauuuuuuuuuuaagauuagacaggaugagcagauuaaaaguauuguuggccaggcacaguggcucaugccuguaaucccagcacuuguacaaaaaauaaauaaauaaaaauauugucacagauaacucuguuauuggcauggauuuuaaguggugucuuaguguaucugaauaauaguuuuggucaggagaccaggauauugucaguuaagcuggaguaauguaaugaugaauuuuugcccaauugaagccuuccaaugugucuuucaaccaagugugcuugcaugucuuuuagguacgagguacuuaagauagccgcugacauauuaauuaaagaagagauacugagugaaaaugaucaguugucaaaucaggugguuguauguuugcugccauuuaugguuaucaauaaugaugauacggaaucugcugagaugaaaauugcuauauauuuaucaaaaucaggaaucugcucccugcacccucuauuaagaggcugggaagaagguaaaaaauucaguuguuuuuuuagaaaaagugaacagauaacacaaaagaaaacaaggaaaauuuaaaauuuauuguuggucaugcuuauaugccaguaaggucuuuuaaaauuuuugccaagauaaaaaguauacagugaaaaggaagccaauucauagacaaauucagaaucggauacaaggaaaaauagaaagcaaaccuucauaaacaauaguaaaauguuugccugaauucuucaugugauucuuugaguguuggugacauaagagcucucugcauucgauuuuacuuuacagcucuugaaaauguaauuaaaagcacaaagccaggaaaacuaaucgguguagcaaaucagaagaugauugaguuguuggcugauaauauaaauuuaggagauccuucuucaauguuaaagaugguaaguaugcuuugaaaguccacccccuggauuucuuucucauacucuuauuaaauucucagcuuuugcuuuacuagauuuuucuuaaaaaaaauuucuuuuauucuugaguacuugguuuuacuuuaaacguugcaguguuguuuaauauauucugugcaauguuugaaaucuuuuaacauuuuauauauuuuuucaauguggauccauaucacacccauaagaauaauauauccuuuuuaccaccauuuuuucucauucccauuuaaaauauuagucuuuuuguuguuguuguuguuaaaauagcaaaauauaaucccaaagaggagaaaauuaucuuugccuuauuaaauaaaccuuuguaaaggauuagaugugugauuuaaauacauuaaccaguuggcaagugcaauuauguucauuacaguuucugaaauuauucuuauaauuacuuagaaaucagugcuuaguacuuuauaaaggcuuucuguuugucaucucacuuuaaauguaaaacacauaauaccuagauagaccugaguugaaaaaauuguuuuaugaaaaucaagagcaacugguaauagaguguguuuauuuuucaagguggaggauuuaauaagcgugggugaggaggaguccuuuaaccugaagcagaaaguaacguuucaugugauccugucugugcucgucucuuguuguucaucuuuaaaagaaacccacuuuccauuugcgauaagagucuucaguuuguugcagaaaaaaauaaagaagcuugaaagugucauuacugcagugguaaggaaagcagaaucuccagaaagugggauguugaauaaaacaacagccuggccuauuagucacagcaaaacugaaaaucagaggcgagauguugagucuguggauaguagcuggaugaaaugugaagcagucuuggguagcagugagauagucaacuaggcacucccuugcuuuugcggaaaguuuaguugaauuauaaaauuuuaggguugcaauauuuuguaucugaugccugacucuccucucuuuuauugucuuuauuggauaauuacccaagcuacaccuaacuaccucuagcgaugaagaauucacuugguguguuagugcuugaacaaaauacuauuucauucaauuguuuacuaaaaauagaucuuuuaggcuuuaaauaauuuuaauauuacauagauguguaucccuccagccuacuacugucuuucauaguauuacuaaaggacauguuucagcuguuuacauuugacauguuuugagguagcaagacuuuuuuuuuaauaucugcuauauguaaggauuuuguuuuuauuuguccuccaaauuuuagagggcuucucauuauaggauuuacuaaaugaauuauaucuuuuucacauuuacguauacccgcaggauuuuauaaguucugaucauggccauuguuagcuaaaauguguaaacuuuaaaaagaguaaaaucuucauauuuugaaaaauaguccagauaggcccuucuuaacuuuuaguuucuuggugucuuuugugaaguaugaugaccugaacuauacugguucucaguguuaaaaguauggacaaauagaguguuuuauuauacauauguagauaacagguuauuuuauauugcuuuacuuuuaauaccuuucucgaggucaugagcauguuuucgccuguagcagcacguugaguuaaucaaaucccucacuggagacguuacauuguaaaucuggcuuuggauuauuuuccuucuaaguuauuacucuguacugcuuguacagagucauauuugucauuuucuuacaccuguucugcauucuuuuggcacuuacaguauaauuucuaaacaccuaacauuuugcugcuuguuuaaaaucaucugcagguuuggagauuuuugccauguaccuuauucagauuagugguaaaacagugaaaucaaagaauucccuuuaacuaugucuuggcaauccaacuguuuaucuuccuguuuugaaauauaccuauuuuggccaggcacgguagcucacgccuauaaucccagcauuuugggaggccgaggcggguggaucaucugaggacaggaguucgagaccaaccuggccaaaauggugaaaccuaaucucuacuaaagauacaaaaauuagccaggcaugauggcgggcaccuguaauccuuccuacucgggaggcugaagcaguagaauugcuugaaccugggaagcggagguugcagugagcugagauugugccgcugcacuccagccugggugacagagcaagacuccgucucaaaaaaaaaaaaaaaaaaaagaaauaugccuauuuauuccuacccuuuauuggauaaacaguucauaugaauaaaguuuguuuuuagagauaauguuucaagguaagacauagauaaaauuuaacuuugucuuuccuugugaauagugauaaaccucuuuaaaaauccgaccaaagcaguucuguuaauccuuuccccaccaaaaugcacacauaaacaaaacuuuugcauauuaugcagaggaauucauauaacccauguucagaacccuuaguuuguacuaguuuuuguuuccuuuaacauuucaggaaauccccucagaauggcacauugaacugauguuagacagagggaucccaguggagcugugggcacauuauguagaagagcucaacagcacucagaggguggccguggaggacucgguuuuucuuguauuuuccuugaaaaaauuuauuuaugcacugaaagcuccuaaaucuuuuccuaaagguaagauacaagcugugaaucuuuuaaaugugauacucugcaaaacugaaugauugacuccacaaugacugucuugaauaaaaagcucccagcauguucauguaggaucuagcaucauuucucuuuccauguccuuguaggugauauaugguggaauccugaacaacugaaagaagacagcagggacuaucugcacuugcucauugggcuguuugagaugaugcucaauggugccgaugcuguucauuucagaguucugaugaaacuuuucauaaagguacaagccuccuccuuuucaggcguacucuacccuuaaagaagauauggcuggccugcaaucccagcacuuugggaggccgaggcaggcggaucacuugaggucaggaguucaauaccagccuggccaacauagugaaacuccauuucuacuaaaaauacaaaaauuagccaggcauggugauggggccuguaaucccagccacuugggaggcagaggcaggagaauucgcuugaacccgggaggcagagguugcagugagccgagaucacaccaccguacuccagccugggugacaagagugagacucugucucaaaaaaaaaagaugggcugggcgcaguagcucacgccuauaauccgagcacuuugggaggccaagguggguggaucacgaggucaggagaucgagaccauccuggcuaacauggugaaacgccgucucuacgaaaaauacaaaaaaaauuagccgggugugguggcgggcuccugaagucccagcuacucgggaggcugaggcaggagaauggcaugaaccugggagguggagcuugcagugagcggagaucgcuccacugcacuccagccugggcgacagagcgagacuccaucucaaaaaaaauaauaaauaaauaaaaagauacuguggguuauuuggguuaugacaguuuauaauguaaacaaaaguagacuuguaaacagugaagaguauauaauagcacgggcccuguaaaagaguacaaucacaauacuaaucgguagguugaauagaaacuaacauugcuacacuccuacuaauauguuaggcccauuacuauauuuaaaaauaacaacagcccagucuuuuugauugguuaauaccauuuaaaaaugugaauacugguguucagagagguuauuuagcacacgugaaguuacucaggaaauuucauccccagcaccagugaccuccauguugccaggcccaguggucaguuccuguucuugccugacuuguucucucuacagcauuugacauggaguuggcauugcucagcacauuguugaaguauuuucuuaauuaggcgucccagauacugcucuugucuugguucuguguuuucaagugcaagguuauagugaggcuucugaauaucacucuucauugacaucuucccaguucauuaaaacauggaauauggaauaauuugaaaugauuagacaaagcaaaacuuugccuuaaauuauuuguuucuuuauaauuguacacuagugagaagaggauuuggaaccagcuuauuugaguaagaauuaaaaguuugcuuuuuuuuuuuuuuaauuaggugcaucuagaagauguuuuucaguuauucaaguucuguucuguuuuauggaccuaugguucuagccuuucaaauccacuaaacugcagugugaaaacagugcugcagacucaagcucuuuaugugggcugugcaaugcuuucuucucagaagacacaguguaaacaccaacuggcauccauaucuucuccagguauuaaaaguagcauuguuauguuuugucaugaccaacuguucaugcuuucucuauaugguuuauguaguuuggaaaauuauaacuuaaaaaaaaauagcagagggcaggcgcgguaucucacgccuguaaucccagcacuuugggaggccgaagcaggcagaucaugaggucaggagaucaagaccauccugggcaacauggugaaaccccgucucuacuaaaaauacaaaaauuagcugggcgugguggcaugugccuguaaucccagcuacuugggaggcugaggcuggagaauugcuugaaccagggaguuggagguugcagugagccgagauugugccacugcacuccagccuggugacacagcgagacuccaucucaaaaaaaaaaaaaaucgauaaaggccaggcgagguggcuuacaccuauagucucagcacuuugggaggcuaaggcaggaggaucacuugaggccaagaguucaagaccagcuuggacaacgugaugagauccugccucuacaaaaaauacaaaaauuagcugggcgugauggugcgugccuguagucccagcuacucaguugccugagguaggcagauggcuugugccugggaggucaaggcugcagugagcugugauugcaccacugcacuccaaacugggcaacagagcaagacccugucucaaaaaaaaaaaaaaagggcuguacaucuauacauauuucuggucacuucuaaguauugcuuuuaaguuacuggcacuagcaaaaucucaccaaacacaaaaguuuaauaauagaaauggcaggugauuauaugaguucuuaauaaucagcuauucauuuucugagcuguagcagcaauggguuagauauggaagucagaucaucauaauacaauuuaauaaugagcuaacaaaaacaaaacccuccugcauuuaucucuuuuaucgggcauaaaucauauucagguucggcauucucuaaugaaauaacugaaaguuaaguuuuuuuauaauguagaauugcaaauuuugcaaaagaugcagaauuucaugaaacaaugaaugcgauauugaaaaguggguugacuuacagagcuauugacaugaggggauguggcagaauuagaucagagaagaaugguugaagaugaaaaaauugauuagaauaauggacaugauuaaugcuucaaacuguaauguuauuaauaucagaggcauaggaguggcccuggggaaauuugaagauguccuugguuuuuuuuuguuuuguuucuuguuguuuuuuuuuuaauuccaaaauuacucuuuguaaauguucugugaaagcaaguuagaugaucguauacuuuucccugaacaauuccucaguguuuauuuuuuguuaguucuuugaaagagcacauaauuacauuuguaaccaaauuuuguuacauuuaaaguagauauguaauuucaaguuuuauuucuaaaauaaaauuccacaaaaguaauuuuuuauucgcuuacaaaauuucggucuuuauuuuaggugaguuuacuguuaagguuuuucuaguuauauuuggauaagaacaacucuauacauuuuuuaacuuuaauuuuucaauuaauauggacaucuuuccauauuaauaaauggaaaaauuuaucuuuuuacaacugccugcagaguauuccauuguauggagauagcaauuuauuaaaauaguuauuuucugcuaaacuuguggguuuucaaaaagguacauauauuuuauuuagagauaacuauuucuguuuuccaauuugguauuaaauguuuacuguccuuugacaguggccucugagucauauaugucauuuugacuguaaauagcaagauggaagaacuucaguuuuccauugguauugcccuuugugggcaugcuuguguggaagaauuugggcuuugugaaaaagauacauugcagcugcagggggcugggagggucuuuuuuucuguggggacacugaauaaacaguuguaugccugcauuuucacugcagcccgucacaugaggucagguguggaauuuuccacuugugucauauuggugcuccgaaaauuugagauuuuggaauuuuuggaucaagguugcucaaccuguaugaacuucuuaggcagguuugaaaccuugucaagcuuuaucuuaguauuucagaaauggaaaguauaauggaaaauuucuagcaaaauauaaaugaccguaguuugcugcaguagauaugaaauaaagcuuaaauaacuaauuacuguaaaaggaauuuagauaucucuuuguuccaaagacaucuuuuuaaaaacccuagcgcaguuggucucacagaugcauuccuacuagaucuuugaagcagauuuuuucaauguuguugaacugggcagggcauagagaagggaagcuuccagauucuuuauuuaaaacuggcauaacauugaaaauugagaaagccuacagacaaaaacuauaggucauguugcuuugaauaauauuauguaaaaauccuaaagaaaauauucgcaaauaggcucuagcagcauauuuauaaaaaucauuuaccuagcuagaguucaugcccagaauauaaaauugguucaguaaagggaacuauguuaauauaauugacuguaucagugaaggacaaaacccauaaaguguccaaagauuugaaaaggcauuagccaaaaaucaguaauccugauugacagcagaauaggaguaacaugaucaaaaauuccucaaaucaaaagcuagcguuuucacuucauaauugggaaaacaaaggcauuccugcugaaaucaucacucucauugaacaugauucuagaaguacuagccggcagaaauagacaaguuucaaauacuuauggaauguaugaauauaauaaaggcaaaaucaaagaucugugagaugguuauguggauuguuaaaugggacaucuggcuauccauuuggaaacauuaggaaguuugacuccaaccucauuccuuagauagaaauuucaugugaacuaaagauuuaacauaaacuuagcucuggcauuagaagaaagcaugagguacauaugaucucucccucuaaauauagagagagguacuuucuaaauucacuuagagugaggagggccuuucuaagcaccagaaaaaaaguagaagaaaaacuugacucuaacauuucucuaucaaaaaguaaaaucaaaacacaccagucugggaccaaauauuuguagaguacgaugcacagguggguaauuucccgugcacgcuuguacaaggcuguaugugcagcgguguuuguugcagcauuguuuugaugacaaaagaauagaaacaaccuaaacuuuaccaguaagguaccgguuuuuaaaauauggaaaauacauuggaguauacaauuaaaaaauaaugauuuggccggguuugauggcucacaccuauaaucccagcacuuugggaggccgaggugggcggaucaccugagguugggaguucgagaccagccugaccaacaugaagaaaccccgucucuacuaaaaauacaaaauuagccggaugugguggcgcgugccuguaaucccagcuacuugggaggcugaggcaggagaaucgcuugaauccaggaggcagagguugcagugagccgagaucgugccauugcacuccagccugggcaacaagaggaaaacuccaucugaaaaaaaaaaaaaaaagaaugauguaauuuggauauguauguacuuauggaaaacauucgcaagaguuuagaugugucuguaaucccagcacuuugggaggccaagguggguggcucacuugaggucaggaguucgaaaccagccuggccaacauggugaaacccagucucuacuaacaauaccaaaauuagccaggcguguggcgugcaccuguaaucccagcugcucaagaggcugaggcaggagaauugcuugaacccaggaggcggagguugcagugagccgagauugcaccauugcgcaauguccagcucauaugugauagcaguugguguagaacagaguuuauaguaugcucuuguguauuuucaaaagaaugcaccagguaacauaugccuaaccuuucucuggaauauuaaauauucaaacagugaacagagaaggaguuugaauucgaagggaaacuuuuuaucaaguaccuuugguacuauguaaauuuuguacuguuucaguuuuuaaaauuguuucuuaaauuuuuuuuuccuuugauuuuaguggugacaucuuuacucauuaaccugggaagccccguaaaagaaguucguagggcugccauucagugucuccaggcccucaguggaguggcauccccguuuuaucugauaauagaucauuugauuucuaaagcagaggagaucacuucagaugcugccuauguuauucagguaagcucguuagcaaagaagauugaguguguucaugccucuguguacuggagcaauuuucuccauucucgacauuucacuguguagggauuuugauggacuaagucauuggauuuaggaacugauaggucaauaucuguacaucugugucccccuacuuuugaaaagauagcaaugucauauuucaauuuaguucuuuucauuggauaaagguuuaguguguagcuuuucauaguaagccagcuguguguuuuuaauaacguuucuuauuaagguuuuaaggagaaauggaaaauuauaaacaaugucacaucauuuggguaagagucuuccguaauuaauauauuuagccuuuguaguuucuuaacccuuuuuuauccaauuuucuuuuugguaucuuaggauuuggcuacuuuauuugaggaacuacagagagaaaagaaacugaaaucucaucagaaguugucugaaacuuugaaaaacuuacuuaguuguguguauaguugcccaucuuauauagcaaaagauuugaugaaaguacuucagggagucaacggugagguaugugccauuuaaguggauuguacauuccugugauguuacuaaagaauuguuguaacugcuugugggugaagaagacaauuguaagaguugcaugugugcgcucagaagagauaaauguaauauuaauuugagagggggaugaguugagguagagaaaaacagauacaagauacaaagacaaguacuggugaguuucuuuuuauuuuaaaauuaaauguguugucccugucuaaucauuaaguuuauuuuaaaugaacuuaacagucucgugucucauggggcugcacugcugaaagaagcuguugguucaucucuguuuuucaagugaaaauucuauacaaaggaauauauuuggacacgagucuaugaaaauuccaaaaucauuugcucguuuauuauauauauuuagagcuuucauuguguuuucgaagaagcuuguguuacaaaagaaagcaguugugaaacacuuguugaugugauggcaugugcugaccaacauaaaaaagguucuuucaucccaguguuacagaaaugccugugugcuucaucaguccuagacugacugugggcuuagagaacuaaaaugagccaaauggauugaagaccauuugauuacacuuucuugguaggaacaaacagguugcauucagcccuuaguugucccugguauaguuuaaauuaauaauugacaaauuucuuggguaaaggaccagauaggaaauauuuuaugcuuuuggggccacacagucucuguugcagcuacucaucucugcaguuguaucaggaaagcagccacagacaggguguaaacaaaugagcauggcuguguuucaguaaauaaaauuuacaaaaacagguggucuguugaauuugaccugcaagccauaauuugcuggccccuaguuuagcaguuaaagauuuacauacauaauuugaauuaauauuaauuauaccaaguuggaaacauugaaggacacauacaguguuuuagggaaucuuaaacuuuauuuuuauucucuaaaguuuuaguuuguguuuucuguucucaagucuugaggaaugcucacagauuaucuuucugcucaucucugaaggguuuagcacuuuugagcauuacacaugaacugucagaaaggaccugagugccuuagugugaauuaauagcugucuccaugucuaagaaguuaccaucauuggguuuuuuccuccaggcuaaacucccaucuuccagcaggcuuugagugucucuguagagugagcaaaaacauaucaguauacauaacuauuuacuacuaagucuuuggaucuuuagauggugcuuucucagcuauugccuauggcugaacaacugcuagaaaagauccagaaggagcccacagcugugcugaaagaugaggccaugguucugcaucucacucugggaaaguauaaugaauuuucaguuucccuuuuaaaugaggauccgaagagucuagauauauuuauaaaagcugugcacacaacaaaggaacuuuacgcgggaaugccaaccauucagaucacagcccuugaaaaggucagugauuucuuucagaaacuaaggcauagcauguucaagcauuuaaagguagaaggcaacaggaacagcguuaaaaaaaaaaagauuaauauuuuauuuggagaagauaguuacagguggacuagacguuuuaaaggaaaaugauguauuugacccauuuuugaaaacugaacguuguacaugggucauuaaaaagaauugcauuuuaacugacaaaauuaagugggaaacaauuuuguauuuugagagagguugauauaaaaauuauuucuggaauuuaaacuuguucacugaacucaguugccuuuuuucuacccccucuagauuacaaaaccauuuuuugcagccauaucagaugaaaaaguucagcagaagcuuuuaagaauguuguuugauuuauuggugaacuguaaaaacucacauugugcucagacugucagcaguguuuuuaaagggguaagcugcaaacuucuuguaauuuuuuuuauuaauguuuauagucucuuccaagggacaccauguuuaagaguccuguauuuuauagugcuuguaagaggucagauguuaccauuaacaaaaaucauggaaaaguaagucagagagaggcauaaaauaaaaauuuuaaaucuuuaccauuauuuuauuuuaugaaguauuuguugauaauuuuaaccagauaggauguguaggaauaugugugugugugaucuuucucauauuagacggaaucuaccuauuccuuuaugcaaggaauaggaaugagucaauggcucaguauugaacuggguaacauuauucuacuuaauuuaaauaguuguuuaaugacauauaauggaauugaaauucugcuuguugguuuuauacguauauugaaaccuuguuauuaucagaauagccaccugguuauucucuuuuuugaauauagaauaauacaaaguucuaguaucuagauucagcaguucucagaauuuuaacauauuaaucuuuuuuccuucuuuuucuuugcugaaauauuuuaaaguaaaucucauaaugucaugcacuuucaucccucuguacuucagugugcaucuuuugaaaaguggauaugacuacaaugccauuagaaguaaaaaaaaaaauaauuccuugguauuaucuaauaccuaguucauaaucauauuuccaugguuaucacaaaaguauuuuuuauaguuguuuucuuugaaucagaauccaaagauuuaguugugauguuagaaccuuauaaaaagagauaucuggaucccaccccauaucuaaagaaucucuggggcaguaaaucuguuuuugugcauguguguauaugucuuauuccuuccuagcugauuagaauauacauaucugauccggcacuuggaaacaaucgguauggaugauucuguauugcauuacuaguuguccacucuaagggaugagcgugaaauugagugacucuggacuggagaagugauacuguaucauaaucaagacaagugcagggcuguaacuugagacucccaagacaaauuguauagaaagcaagugcaugguaguaggagagcuugguuaaaaugaaaaucugaaguugaauuuauguuggcuagagcuuuuaguguauacucuucccuacuuugcuuucuucucauucugguuuuucaagaagucuguaacaagguaguagcauccaaugcugggggggguucagaugcauauccaguaagucauucuucccucuuaauugaauaaauccuuccuagggguuaacauuuauugcucuaauuuuaucccaauggauuauaucaucaacucuucuuccuucaauauuucagauuuccguuaaugcugaacaaguccgaauagaacuggagccaccagauaaagcuaaacccuugggcacaguucagcaaaaaagaaggcaaaaaaugcagcagaaguaagagcuacaaaugcauugagcacaugcuguuguucccugacucugaauguuaugaaaccauuggaacuuuuugauacucaucaauuugcuauaaucaggcacaaugguuuuuacuuagcacaugauagaguuugcuuuuccaacguuuugucuucuccauuuuccagaaaaucacaagaucuagaaucuguucaggaaguuggagguucuuacuggcaaagaguaacucucauccuggaauuacugcagcacaaaaagaagcucagaaguccucagauauuggugccaacucuuuuuaacuugcuaucaagguaaugacacuuggcuuugaucugugagagaauaggacucuaauucuugcccaucuuaucuaacauucucuuuucaacauacucuucucuuguuuagauagucuguaaaauaaagcaaguacuauaggugaaauuaaaagauugguuuuagguauccauugcuggugccccaaacugaccuuaguguccugugucauguaguaaauggccacucacuguacagccuacuuuccucugaacuuuucaguagcgugccugggacgucauuacuugcauuucaagauauaguguugaauuuauauagauauagauauguguguauauaguguuugcuaucuaaauauauuuucauauauauagauguauauauucuauauacguagauuuguguauguguguguguaaauugaguaugaauuguagcgugugcuuucaugugaaaggcaaaguaauucugaagguuguccuguaagauuccagauaggcuaauggaaagugcaauagagaggacguggaauuugacauagcgccugucuauaugagagaaaauuagaguuagaaaucuuauaucuuauuucuagacuugauguuuaaugauaguauuuuaguuauuccuuauugaaugaguuccuuauugaaugaguucuggacaauggccauuaauguaacaaugaauuguacaacuuuuacauuucccaucauuucucuuuuggguguccugaagauguuuagaacccuugccacaagagcagggaaauauggaauacaccaaacaauuaauucuuaguugucugcucaacaucugccaaaaacuaucuccagaugguggcaaaauacccaaagguagguacuuuuuggaaggaaagguuagaaaaauuaucuacuuugagcgugaguguaccugccacuuaggguuuuugucuuucucaccauuguagauauuuuagaugaggagaaguucaacguggaguugauaguucagugcauccgccuuucggagaugccgcagacccaucaccaugcccuuuuacuuuugggcacuguugcuggaauauuuccgguaagcguuaaugauauaagauuuuagcagauauuucagauauuuuucuuccacagaaaugcacuggcaccuguugauuuuaaauuuaaucaauuaggcuuuggaaucuuccagcacuggugagacucucagcccugccucuucauagcugggacuguauaagccaguugaucuugcuaagcuuugguuucccuuuuuaucaagugggaauaauaaccuucuucacuggauuguugggggaauucaguuggauaauuugugguuaguacuuagcauaauaccuggcacacuaucuaucuaauaaaacaguagguauugguguuaauugggaaaaguuaauaucucauuuauccucaaguaauccucaaaguaaccuuuaaccagugacuucagaaaauuaauuugaucauaaacuaugucauuuaaagaaaucaugucccuuuuaugaaaaauaucauuuaaacauuuguaaagagauugaagcuauuuucauauugaggauuugagucagagcuccuuaaccugggguucuccaugagcuuuaggggaucuuaaucuacugaaaucauaugcaaaguuuuaucuguaugggauuucuuuuuuucuuguaagagagucugugcuucucaaagggguugauaauccagaaacaguuaagaaucauuaauauuuuuucuguuuuuauugaaauauaguucagaugccauaaaauucacccauuuaaaguauacaauuaagugauuuuaguauauucacgaaguuucuguaaucaccaccacgaucuacuugaagaguauuuucaucaccccagaaaagaaacccuacacccauuaacugucacucuuccucucccuccucccugccgcugccaccgucaccaccagcaccaccaccaccaccaugaccaccacccugcuccuggccacuaguaauccauuuucugucucucucaaucugccuaugcuggacaugucauauaaauugagucauacaauauguggcccucugugucugguuucuuuugcuuagcauaauguuuuuguuuguuuguuuguuuguuuugagacggagucucgcucuguugccgaggcuggagugcaguggcgcgaucucagcucacugcaagcucugccucuuggguucaugccauucuccugccuccgccucccgaguagcuaggacuacaggcacccgccaccacgcccggcuaauuuuuuuguauuuuuaguagagacgggguuucaccguguuagccaggauggucucgaucuccugaugucaugauccgcccgccucggccucccaaagugcuggaacuacaggcgugagccaccgugcccggcugcuuagcauaauguuuuugagguucauucuuguugaagcuugaauccguauuccuuuuaugacugaauaauauuguuguauguguaugccacauuuuguuuaucuguucaucgguugauggacauuuggguuguuucaacuguggggcuauuauaaauuauguugcuaugaauauuguagacaugguuuuguguggacauguuuucauaucuccuggguauauauaccuaggaguggaauuguugggucacacggaauuuuauguuuagcuuuggaguaacuugcaagacuauuuuccauaguggccacaccauuuugcuuccaccagcagccuguaaaguucccaauuucuucacauccuugccaguacuuguuacugucuuuuuuaucgccauucuagugggugugaaguaguauuugugcuuauauucuuuucguaugaauuuuuucuuugaagaaaugucuuuucaaauccuuugccuguuuuuuaaucagguuauuucucuuuuuauuggugaguuguaaugaauuguugaaauggaaaauguuagccugagcaggaauaucacuuguggccaggaguucaagaccagccugggaguucaagaccagccuggguaacauagugagaccccacccuuacaaaacagaaaaggaaaaaaaauuagcugggcaggguagcaugcaccuguaguccuagcuacucaggaggcugagguggaaggauugcuugagcuuaggaguccaagguuucagugaacugugaucacacaacugcacugcaucccagccugaaugacggagcgagacgcuaucucuugaaaaaaaaauuaguagaaauuaacagaaauaaaaaauguugauaguuguguuuucuuucaggauaaaguuuuacacaauaucaugucuauuuuuacauuuaugggagccaaugucaugcgccuagaugauacuuacaguuuucaaguuauuaacaagacagugaaaaugguuauucccgcacuuauucagguaaggucucuuuauaccaucgugggguuucuuuuuuuaauuuaaaaauuuugcauauaaaugacauuaaaagccuuuuuuuuaguuuuuuuuuuuuguuuuuuuuuuuuaauauccucaacaguuguauaaaagccuuucugaaaugcugaaguacauugcccuuaaguuuuagaacauugaagcuaagaagcagucuuggcaaugucuuucucaauaauauaaacaaacguguuauagcugguucugcugugcugugaguguguaacuguaagugucuuaacaucauucgggugggguaaauugacauccaccaucuauuucaggacauugcaucaguuugauaauaccuucuuacauguugaugaggcuaggaacuuuuagagcuacagugacaaauuuguuaacaugcaguuuagcaaauguuuaccaagcauucucuaagagcuaaacucagagagagaggugagauguucucucucccaguaaggaaugaacaauucaaaaguuaaaaguagccucaagaguaaaagagcuuguucaucuacuugaguugucuauguacccuucacuuguuaauuaaugucuuuucucaugcuauugacccucugagggaugaccauauucagcaccuucuuuuaaccuuaguauuagauugguguucucaguguccaccaaguuggcaaguauaggauauauaccuaaaaagaaaaauaauaauaugcauucauaugaucagugccagucgaauaaguaaaugcuaaagaguucagaauaggggaaagucuauaugggccaggaugaccagaaaguucuauaagaaauagaauuuguaccggugugaaagaaggaugggauuuguucagugauggcagagccaauaguaugagaaaaggcaugaucuaggaaugugcacagcauguuugaagaauguaauggugauugauugauggagagcagaggguugagacagguagacauugguuuauucauucauucaaguguuuucugucauucuuucugucauuuauucaacaacuauauuuugaucaccaauaccuggaguaaaaugguucaaacuuuauucugaaagcagcaggaaguuguuggccuuuucugugcucugcuuaucuucauucuucuugaggcacaacccaaauccugugugauuugugcagccuucccaggcagucuaagcagacuugcuaucagugucacauauuuggcaugugccauuacugccuccuguuaucuuuucacacauguauuguuucuuuuguuuguuugagacagaguuuugcucuuguugcccaggcuagagugcaauggcaugaucuugggucacugcgaccucugccuccugguuucaagugauucuccugccucagccuccugaguagcugggacuacaggcacgcaccaccacgcccggcuaauuuuguauuuuuaguagagauggguuuaaccauguuggccuggcuggucuugaacuccugaccuuaggugaucugcccagcuuggccucccaaaguguugggauuacaggcgugagccacugcgcccagccauguauccuguuucauacagaaaauaaaucuccuuuggggcagggcucauaucguacacuuuguauuccccuuggggcuaaguagcgcuugggacaugacagguacuuacugaauauuuauuguuaggccuuugauuauuaaaacucuuguggcugagugugguggcaugcaccuguaacaccagcacuuugggaggcugaggugggauuauuugaggccaggaguuugagaacagcccggucaacauagcaaaaccccgucucuacaaaaauuuuuaaaaagugguggugggguccugggaugucccagcuucuucggaggcuggggcaggaggaucucuuugagcucaggagauccaggcugcggugagauaugaucacaucacugcacuucagccugggccauggagaaagacccugucucuaaaaaaauaaauaaaauucuucuggcaauuucuuggggcccaucuaaaagccuuaucuuguucaccuaaacuuguuuuguggaagauuacuugcaccuacucauugucucugcuugcuguuuugcagucugauaguggagauucuauagaaguuucaagaaacguugaagagauugugguaaaaaucauuaguguauuuguggaugcgcugccacacgucccggagcacaggcgccugcccauccuuguucaacuuguugauacacugggugcagagaaauuccucuggauucuccucaucuugcuuuuugaacaguaugucacaaaaacagugcuggcggcugccuauggcgaaaaggucagaaccuagggugggaagauaaggaaaauggugauuucucacacagauuuuaugauauuguccaguuuaaacauggggcugaugaugccuaauguguguuauuuagaaccuuuuugcucagaaccuuuuucaaaaagguuuuuggcauuuuaaaaaauugcauucagagcccauagcacucugaauauccucaguugcagcaaaacaucugaaggcgaauuaacuuuucugagaaacaguucuggugccacgcaagugguucucuuuuaagcccagcagaguauggcugaagaguaaugaaacagugucucuucaaagcgguuuugaaggcaguuuguggggaaauagaggagcguccgugucccugaagucaguaagacacaaacacaggugauuguuuggauaaagcccuguuuggauaagucgaggaccauuuuuaaaugacuucuuagacaugggaucugggaguagaucucgacccacucuaaauaaaguaguauacucuguucugcuagaaauccuaacgcacauuauccugaaauuaugccuucacaauuccuaaguacagauuuguuaccuuuuucuuuuucuacacaggaugcuauuuuagaagcagacacugaauuuugguuuucagucuguugugaguuuaguguccagcaucagauacaaagcuugaugaauauccuccaguacuuacuaaagcugccagaggaaaaagaagguaagcguagaucgggugucacuuacuguucaaucugaaagcuaaagagaaacagaagagaaugcagguuauccuuaguacaucuucagaaggauuuuuaaaguaaguuaaucauuuuaauuugauuguguaguuucuugaauccuuauggaaaauagucggaauuccauuugccauuccucacacauugucuuuuauaccucugugcucugcgcugacgucuuggcuguggaauguugcugguauccaggaugaguuagguucaaaugacaguaaaugaucaggaccucauuagcugucucucagcuucucauuaaaauaucugaagacauuuacaugaaaagaaaaaaaguagguaccacaggaguggcagcaaaauauuaaaauuguaccaugcagcagagccuugaagaaaaucccacgaaccgcagcaccacugaggcuggcuuaggaaaggguugaugaagccaggugugaugguguuagccuguggucccagcuacccaggagaaugagacaggaggaucacuuuagcgcaguucaagaccagccugagcaacauaguaagacgccaucucuaaaaaaaacuuuuuuucauuaagaaaggguugacguguugauaguucuuaguucucuacaauucgaagcagaacgacaaggcacguuagaaggaagguacucuaagagcuccgcagagacuguuuucugcguggccagccauuggcccugucaucccuguuuggcgaggcaguaacuugucccauccugcagucagcucagguuuggcagggacagacgagggaggucccuggacaguaugugguguaugugguauauguggugauguggguaaggaagugucuuagcaguaagucauucuauaggcuagugguuuuuaacacugcacugccaaccccauuuacauuagacacauugaauaaagaaaucuacaccugcaguuggaaguucagagacuccuuccgugaugugguuucuuccauuugauuguccaguuucccuguuuuguuuuuugucuuaaacacucgcuucucagggccacuggguacuuucuuggcaaauacacucacguuuuucacuaauuuagaagaggagaaacuggauguaauagaugaacacauuucucugggaaaauguuaucccguuaauuguccuuuacuugaaagguuauaucuguuaauucuguaugaaggauucaggugaaaaugaguaaggucacuuguuuuauugcuguuucagaaaccauucccaaagcagugucauuuaauaagagugaaucacaagaagaaaugcuacagguuuuuaauguagagacucacacuagcaagcaacugcggcauuuuaaauuuuugucaguguccuucaugucucagcuccugucuuccaauaauuuucugaaaaagguaauguguucuuuaaauguguuuauaaaaagguauucugcugucuccaaggaacuguucucaaccaguagaaguagcuugguaaauggcucaugaaaaugggaggcacgccuuuaaagauaauagaacaagaaaguacguuucaccaugaaaagccguucgucaugaucuacugagauggaacauaauguaaacucugugacucagugguuucauucuuaaguguuguguacccaucagaaguuuaugaaccuguacaccaaaaaaacuacaagaaucuuuauaauauucauaacauucuucaugguagcacaaaacugguaacaacuccagugucuaccagcagaguagauaaauugccuguauuuuauuuuauuuuuugagacaggucucacuccaugucccaggcugaagugcaguagagcaaucauggcucacugcaaccugaaacuccugggcucaagcaauccucuugccucagccucccaaguagcugggacuacaggcgugugccaccuacaucuggcuaauuuuaaaacuuuuuuuauagagacagggucucgcucuauuacccaggcugaugucaaauuccuggccucaagcgauccucccaacucgaguucccauagugcugggauuacaggcaugagccaucaugcccagccuuucuuuaccuggauauagugaguucugcauguaugauuuguauacaucucuguuuguguauuaaacuuguuuaaacaaugagagaaaaggaaggaaagaaaggaauacgaccaggaauacaaaaaugguuugacauuagaguacuguaaaguccauuagguccuauaaugcguuaacagaugaagaagggaaaccauaugaucauuuuacauuucacagugaaauaauucagcagacucaaugcuuauucacaacuuaagagagaaaaauccucgcucacaccuguaaucccagcacuuugggaggccgaggcgggcggaucaugaggucaggagaucgagaccauccuggcuaacauggucucuacuaaaaaauacaaaaaauuagccgggcgugguggugggcgccuguagucccagcuacucgggaggcugaggaaggagaauggcgugaacccgggaggcauagcuugcagugagccaagaucgagccaaugcauuccaccaaccugggugacagagcgagauucugucugaaaaaauaaaaaaaauaaaaaaaaggaaaaaacuccucucagcagugcaggauagaugggaauuacuuuggccuaauaaaggugacaaucugaagcuugugguuuauaucauaccuaaugaugaaauauuaauggugugccugcuacagucagggacaagaaucuccucugucauuguuucuauucaggaaaagaaaugaaguguaagaaucaggaaagaagagaaucagcaauuagaacuaauaaugaguucaguaagcuugcuuaagagagaucaguguagacacuaucuagagaucaguguagguugugaucuguaucaagcaggcuggcugaacuaauuagucucaccacuguuauauaauauuguuauuccucaaauuagaaaacagaguagaaaaaaagauuuccuguauaauacaaacauaaacuuauaagguaccaagaauaagccugacaaaaauaugugcacaaauauuacaggggaaaugugcaagauaugaagggacacagaagaaaacuuggaagaaauagagagacacuguguuuacgcaugaagaagccucacuauuuaaagguggcagaucugcccagauuggucuagaaacucagugugcuuuuucaauuauaucauuuuaagaaaugauauugauacauugauaccaaacuguaaggggccaaggacagugguauggugcaggaguaaucagauggaucaaugugacugaacaguaggcccagaaacacaugcaggcauagguaagaggugcagcaggugauuuuacaaagcaguugggggagagaaugguccaagugcuggcccuggcaugauuuguuucccauuuggggaaaagucugaugucacaccuuguagaaaagacaacuuuagucagaguaaaaacuucauuguaaaaaacaacaguucaaauguuuagaagaaaaucaaggagaacaugauugugacuggaggauaggaaagaauuccuuuaaaauuuugauucaauagaaagccacaggcugagagaagauuauugcucugcauaaaucaaaaagccucaguuuccauuagaacaacuggcaaagaauaugaauucacugaagaggaauuacagauggccaguuaauguacaaugucauuuagccuccaguaagcaggaaaugugauuaaaugugauacccaucaaauuggcaaaacuguugaagucguuaguaccagggauuggguacguaguggcagacagugugauuguuccaaccacuuuagaaagcaauuggcaggaucccaugagguugaaaguuccaguaauuccugugaucuggucauucccuuccuuagguauauaugcuguaaaaacuucccaagaugaucaaagggacauaaaaauguucuucucuagcauuauuaguaaaaggggaaaaaauggacauaaacuaaacaucuaacaacagaggcaaauggauagauaagugguauuuauagaggaauaucauaugcaguuaaaaugaaggaacuagaacauaagucaccaugcauagaucucaaaaauauguuuccagaaaaacauguuguuccgugauauguaguguuugaaacauuuggaagcagauuugggaugaugguuuuguuuguggggcuugggguagagggagaauaggaccaaggagcaguacuugggggauuccagcugaaucuguaauguuuaacuucucaacaaaggauaugugagcucaccagcucagcaugucauagaauucgguagugcuaauugaguguugauugcuguauuuuucugaaccauuguaguacuuuuuagauacuaccaguagaauguaauuaaaauaaauuaagagaaauagaguuacuacaguauaaugaagaugauaugaaccugauuaaauuguaaugucagaaaacaguugcuguggaagguuucagugaaugguccgaguuucauugaacugacuugaaaugacuuuuauuauugacuucccuaccguucuaaugacgucuucuuuaaaaauuagguaguugagaguggugguccugagauuuuaaaaggccuugaagagagguauguuuccuuuucuuuuucuacuuuuuauuuggaaaugacuucaaacuuauagaaaaccuggaaaaacaguacagaaaauucauauacucuuuacaaccagguucaccauuugauaauacuuucugccacauuugccuuagcguucucccuauguaggguuuuuucucugagccauuugaaaguaaaucauauacauuaugucucuaagaauaagagauguucuuauaaaaccacaguacauugaucaaauucagaaaauuuaacauugauccaauccagugauguaaucuacaguucauacuccagucucccuaauuaucccaacacucuccuuuacaccgcauguguuucugcaucaugauccaugucaagucuguguauuguauugaguugcaguaucuguuuagugucuuaaucuggcccugauuucuaugggcucaugaauucuuuauucuguggauucuaauccauaugcugccauuauauauuugggugcaggaauuuuccuuucucucccauguccucgggguuugccuccuggccuugcuguguaccuccuuuucagaugcauggcauucccagggccacuguccugccccuuccacuggaaagugccugcccugcagccaggaaugugagcugcugaguuccaguccugugggcugacuuguagcgcuaugcguaggacuuucguuuuuggagcugauuuugucugcgcccccuucuccccuccucugcugugcggugucaacuucugucuccacucuucccucuagcuccccccucaggcuggcagcaguggggggaucuccaguggcagcuguguuggaauuuggugugugcuuuucuaauuacaaguuauuugaaguuuguagucuuuuuuuuuugucuccuaauaaugugaaagaaguggguuauauguucauuucuauuaauauuucucuuuauauaaaugguguauggugugugugcauguguaugugugcgugugugugccugugugugugugcgcgcacacaccugccauuaaccuagggccauaacucccugaacaccccacuuggacagcccagugagauccacugagcaugagcuagauaugagugaguuccuuaaacgcuuucagcaucuguugcuuauucagcaccucacagagucugagcgaggucgaugcuucugcacagaagcgccuaguuacuucuugaugaucucugucuauggcaauaaucccucauuuccuuucuuuccgaguaguuuuugaaauaauuuaguacagaauuauuuaacucgucuuucuacuugaaacauuuagcauaagguagacaugaacaaguucucugagugccuucagcugccguuugcugagcgagccucuguguuucagguugcuggagaccguucucggcuauaucagugcaguugcacaguccauggaaaggaacgcagacaaacucaccgugaaguucuggcgcgcgcuccuuaguaaagcuuacgaccuguuagauaagguagguguucauuucucccuggaauuacuguuuuguugcuguuuuuuaaauuauugugaaauuauguaaaguuuuuaagaauaaacuuagcaauuccuuuuaugaauauaaugaagcucagauuuuucuuagaaaacaaucucuugaugacuagaaauagauuugucuggaaaaaauuguuuccuuaccaguuaugagaacauguaccucguauauuuuaauaauuaagucauauaauauauacuguucuacuuuauucaaguggaauaaaauaaaaguaugaaguauauuacauacauaucacuggccucgaaguuaggauugcugauucaaaucuagcucagucauuuagcugcaugccuuuggcacuuccuccugacaucaggcuuuuguuuuguucgauaaugugugguugguaaugccuaccugaaagguuauuuuaagaauuaaauaagaaaauguguguggaagugccuggugccuggaggugugcaguggacagcagucugucuuaauugaaguugguuuuuuuuuuaauuuguuuuucuuuucauguuaaauauaaaauuucucuuuaggucaaugccuugcugcccacagagacauucauuccugugaucagagggcuggugggcaauccccugccaucuguucgccgcaaagcgcuggaccuuuugaauaacaagcugcagcaaaauauauccuggaagaagacaauagugagugaagacccaggacacacccauuuacuguacuuugcuuuaucaaagagcugcauuuaacucccuucaauuucucuagugguacaauuucaaauugaaguauauuauuuucugaauauaauaccaugacauguuuuaaaaugugacguuaauucuaacgggaauauauguguguuguaagagcucuuagaauggaauuucagccuaguggaauucuugcuuacuacagagcuuacguggccuuagccuuagcauaguucuaagucccuuuuacuccagaucagugggugcuuuguauaagugaaacacuggcuagaacaugcacaucgcuuagcaugacugugugacucaggacccccgagucugauuuccauuuagacaaucucaagcugugacaaugggaaaauggacaaacauuuuuugcagcuuuaaugauuuggggauucuggcuguccccuucagguuacccguuuccuaaaacugguuccagaccuuuuggccauugugcagcguaagaaaaaggaaggggaagaagaacaagcaaucaacagacagacagcauuguauaccuuaaagcuuuuaugcaagaauuuuggugcagaaaauccagauccuuuugucccagugcugaacacugcugugaaacugauugcuccagagagaaaggaggagaagaauguccugggaagcgcgcugcugugcauagcagaggugaccuccacccuggaggcgcuggccaucccccagcuucccagguaugcggccggagacuuggaacaggagcuguuaccgccuggcacacauugaaaaauaacacuuuggugacuuuuuuuuuuuuuccucugaguagacguugcauaaaauuggaauuuguuaaagaauugaucuugcagggugugguggcucacggcugugaucccaccacuuugggaggccaaggcagggagaucguuugagcccaggaguuugaggcugcagugagcuaugacugcaccacugcacuguagccugggcaacagagugagacccugucucuuaaagaaauaauaauaaaaauaauuaaucuucaaacagaaagaugcagccuucccguuuaucuucagaugcacuacuuugcaguguuaaucguccuccauucuuccuuccuuuugucuaguauagucaaaaagcagugggugaagguucuuggcagaggggcccacccaguuaggcaaggccaaagcugccuucugcugccaaauuuggaaguuagaagcuccuggcugugguaguuccuuacuguacagccaguauguuccuuaaccuguuagagcuuugcugucuauaaaacagagacaguaucuaccucauaggauuucuguagggcagugcuugcaaggaguuuugcauagugccugacacauaguaaguguucaguuaaugaaagacauuguuauuuuuuaaauuacuguuguguccguacuguuagcacugggagauuucuugugcuuagccacauaaaauguauagacacugcuuuuuaggcuaugaagcagauagcgauguaauaggcacaguuugcugguuuuuuucauaaugcccucuacuccauucccuagccucuguuucugcuucaaguucuucuaaagcucuuacuuuguuucuagccugaugccaucguugcugacaacaaugaagaacaccagcgagcuggucuccagcgaggucuaccugcucagugccuuggcugcucugcagaagguuguggagacucucccgcacuucaucagccccuaucuggaaggcauucucucccaggugagccacgauagccacgacaugcuacgcaggguggcuggggaagguaaaagaucacaaauguagugauuuuguuuuuucuuuaaggguuaguuuccguuugacagaaaggagucuuauuucugaagagaugugcuugcuuuuauuaaauguguacuuuuucucuuccaucauccuugccacuuaaucuugaaauugauaugggggucacuuuuuagcgagaugcuucucuucuuuaauugugcggaauguauucuggcuuuuuuuucuucugugagaucuuuggaguugggcugguagagccgccuuuuauuacuuguggaaauugaugggcccuguuucuacugugagagguauaauccuaaggcaucuugcaaagcagaauuuuuguauugcacgucagcgguuuccugucaacacgcuaggggccagugguauuuaugauugaagaugcucaagaauguugagaccuggcuguuccauuguguugaucauuugccauuuacaagguuaggagccuucauuaccauggggcaaaugauuaaaccgcuucacuuacaccacagccaggguuuaaaaguagccuucucagagaaaggggccugugcucugaggagcuuucucaguuuuuuagcaacuugacucuugccguggucccuugcauuccuguccucuaagaaaaucaucugucugggugcugugugugcgucugcgucuaccaucggccuucgucccugaucgcaaguugggcaagaggugucugcccaguuuuauccacugacguuuagggcugacuuuaaaaggaauucuguguguaguuaaaaagugcuaagcauuuuccaaacacuaguaccucaucaugaagccucucuguaaguguguguuugucagcgaagaucugcaguggcccugaucacuuuuuuuauauuccuguaggugauucaucuggagaaaaucacuagugaaauggguucugcgucacaggcuaauauccgucucacaucucuuaaaaagacacuggcuaccacacuugcaccccgaguccuguugcccgccaucaaaaaaacuuacaagcagauugagaagaacuggaagguuagaucuuauuggguauuaagacuuuggagaagggagaggugguacugcaauguguaaacuuugacuuaaagaagaagauuuaguuuuuaaaaauacacaccgcugaacucuaggaaucauuugaaaauggcacaucucuuuccuguguuauugguagaaucacauggguccguuuaugagcaucuugcaagagcauauuggggugaugaagaaggaagagcucaccucccaucagucucagcuaaccgccuuuuuccuggaagcccuggacuuccgagcccagcacucugagguaagcucagguucacuccuccaaauccuaaagcuguuauccaccuauugaagaguccgagaacaaucuagccguguaacagugguacuugccaaaauaauuuacagucagguaucagcacucuaauaaaugggcucuucuguuuucagaacgaucuggaggaaguuggaaaaacggaaaauuguaucauugacugucuaguagccaugguugucaaacuuuccgaggucacauucaggccccuguucuucaaggugacgcuuucuuccucuuccucucuuuugugcucagauuuaagugacaagaugucgaagaaacuaauacugucuuauccuuucagcuguuugauugggcuaaaacagaagaugccccaaaggacagguuguugacauuuuacaacuuggcagauugcauugcugaaaagcugaaagggcuuuuuacucuguuugccggccacuuagugaagccuuuugcugacaccuugaaccaggugaacaucuccaaaacagguggguggucgcuucaguucagcugucacccuugcccugugugccuuauacaagguaccaguaagacacaaccuagugcuuggaagcaagauuuuagagguucuuaaguccuaagcuaaggagggugaauuuuuuacuucauuguugucagacagugaaguguuguuuuagcaucaugagcgaauguuauaagucaccucacuugggagaaagaauaaaguaaauggccguuacugucaguuacuggaaguaacuuuaaaacgcaaaaauuaagauuaguuuauucucuaaugcuaauacgugacccacuugacaguugagggaauuuaacuugccagagugaguguuagaaucuuaacucuaaaagaaggaaucauucuucgagagaccauccauuguguucugccuucguccugauuaugauuucuagaucauuuuagacucuucugauuuaguuauuuuaauagugauuucaauguaaacauuggagauuaaaugguuaaguucaguguuuuuucauuuuuacucuucccacgucuacagaugaagcauuuuuugacucugaaaaugacccugaaaagugcugcuugcuguugcaguuuauuuugaacuguuuauacaaaaucuuccuuuuugauacccagcauuuuauaaguaaagagagagcagaagccuugaugaugccucugguggaucagguaaccaaacagaaucaucuuucguugcugaggaagccaucacuguucgagcuuggcagguuuuagaucugcucaaaugacagcuugcuaggauuuuucuuuguaagguuguuuuuucuggucuuuuuaaugaaauguuuuauuugaaaauuguuuuuucaaagauauaacuucauuguggaauuugaguuuuguuuuguuguuuugagacagggucuugcucugucacccaggcuggagugcaguggugcaaucucggcucgcugcaaccuccaccucccgguuucaagcaauucuugugccucagccucccgaauagcugggaucacaggcgcccgccuccacaccuggcuaauuuuuguauuuuuaguagggaugagguuuugccauguuggccaggcuggucucgaacuccugaccucaagugauccacccaccuuggccucccaaacugcugggauuacaggcgugagccaccaugccuggcccugaguuauuuuuuauuuuuuauuuuuuaaacugcucaaaagacagacaugauauaagcugucaugguuaauguauucauuuguuuuaacugggccucacugagaacgcgucagagcauggcuguccucuggagcaaagagcuccucugagauguucugcuggagagaaaggggcgaugauaaaggguaugagauuccauuugaguucuagaaggcaauacauuugcccuagagaguauuagaauaaugccugguuuuugaaccugcuaauaucaugaaagauaguaaaauauuuguauguuggauauuuuuucaaacagaagaaagaaaugagacuuguuguucaaagucuuugucuuacucuuccuagcuggaaaacaggcuugggggagaagagaaauuccaggaacgggugacaaagcaccugauaccaugcaucgcacaguuuucgguggccauggcggaugacucucuuuggaaaccacugaacuaccagauucugcuaaagacgagagacuccucgccuaagguuaggaacugcgugacaaguacugaaacugcaucuuuucacugcauagccuaaacagccugcagguggucacagauguaggcccccuaguaaacuggcagggaagaacauugcuauuugucauccaguacuagagguccggucuuuuguauuaggcagaaauuugugccuaagaaaauuuuguuuuuuacuuacaggcuauuuguaaagaauagcaaugcccuauccccaccccaauggugcguugggcagaaguacuaaaauacuuucuaaauacuuuuaaauaacaaagauuugaaguaauuccuucuuuuuuaagugccauugaaaugucauugugcuccagagagaaaugcauugaauuuauccacacuauagucuuuugaguuagagcaauacauucuguuguuuauagauacuaggcuuaugaucuuguugaguaagugguggcaguggaaauaaaacauggguagguugaguggaagucaaaauuugacacccaaguguuacgaauuucaaacuguuuuagcaaugagucaccauuucucaaacuaaugauuguauuagaacuuuacuggcuauaacagaccaaagcagaauuuuauuaauaggauuuauuaguucaaauucuuuauuaggauaugcuaacaaugagacuauuaugaugaacccccacauuuuaaaccauagguuuuuauacaaguagcaguaucaaauuuauuguaauauuuuacuuugcacaaaucaaggaaauccugauugaaucuagguaguuacaaaugguuuuuuaauaauucacuuuguacuguccagauauucuuuaauuaaaauauccaaaauuagaagaccaguagggcuuuuguuucaaaagcuaacaauacccaacuacugcuugcuuuccuuauuauagacaaggcaugugaggaacaccuagacguuuuuaaagccccaaaacuaggauauugugacacagaauguuuuuuauucagugcugagaugggaguuuaucccaagcgacuguccuggccccucauacaauuauaguggugaccagucaggggcugugggugaggagaccugccagagguggcuggaggcacuuuauugccagccuggcgggcuggcgagcgccaaugaaguaaaaucuggugacacacuugaguuugcaugcggcauuuuauuuuauugguuuuuuuuaaaggaagagauuauaaaaagacauuucacauuaaagauuugcaguccugggacacaguuuggaaaacacuauuuauaagguugcacauauuacaaacagcucccaaauggugaaacugguauucuaagaugaaagcuuaaugaacauaaugaagugaauaaacgcaugugaacuaauguuuaaaaaguuagagcuugucucaagucaguacagcucuuaagauaauaaauacaguaacacuacuuuuuauuucuuugcucuuuuaucccuuucagguucgauuugcugcuuugauuacuguguuagcacuggcugaaaaacuaaaggagaauuauauugucuugcuaccagaauccauuccuuucuuagcagaguugauggaagguaauucccaaacuauucccaaccauuaaacaauuaaggaauaauucaguaaaauucugugaaaaugugcccaaugauaaugcagauuuggauauaacgugacuagcaguugauccaguccucauacaggcagcuccagucucaaauacaggcaggcucgagcuccuguuuugaguuggguggagggagcaaguugcgaagugaccaccuccugaucauuugagaguccguuuacaguguaaucuucacgaucuuuucuuuuguggugguuugugaucauacaagcagauuacaguaguguuuuuaauuaaccucauacauuuauaugauugaaguuuugguccccagauuguauggaaaugccuaguggcauuaaggaugcaguaggauguccacuuuuaguagcaaccgauguucauucacuacuccauguuaggugcuuuacuuggauuaucucacuuaaaaaccacaacauuuuaucucuguuuuacaaaggaagaaacuagaggcuuaaaagauuucaguuauuugacaaagaucacaagcuagugagugugacauggggagcugugacaguucuggaacauagagucuuaggcccaggaaauaacaguaaauguuauuauuaagggaggggugguggagcaaguagaucaguccuuuacugauucauugcuuaucuaagcuacaaaaguacauucuccuuuguuucuuagcucuuggaggggggaggugugagcuacuaaagggguggcaucccuaggaaguuugaguuuuggggauucuuauucagcuuccagugcaagccugugggcaaggaaugaaggcggaaggagcgguguggagggaggcgguccguggcgccuccugcuuuguuaaugugcuucauuucacucuuuugauugaaugauugccggaaagugcaaggcauuaagaauuaaacuaaugagaaccgaggcaggcggacugacucagauuuuaauuuugauuuuuuuuuuuuuuuuuuagaugaaugugaagaaguagaacaucagugccaaaagacuauucagcaacuggaaacuguccugggagagccacuccagagcuauuucuaagacuuucugugguguuucauacucuacucagaguucacacucauauuucauauuuuuauuuuuggguguugggugccauguuacuuuuggugccuuaauacaccuacuuggauuacuuacaaauguuuuaucacuucuuuacaaaauccccaccuggcuugugcugccacauaagccucuccugccuaucguauagagcugcagaaagaguaaaugauacacgguauuuuuauacagacugcuguguuuguuuaaacauuuauuauucucuuccugauugaugguaauaauauuagacuuguuaauuuuagcacccaaagcugacgccucauuugcacuguaagccuuaacucuucuguacagcaguaucuuacauacaugguauccauguugcagauuucacucaaaguugcucuauuucaagaaaaugaaguuauuuagcaaucaacagaaguacuuuugacuguaaagccuacuuuucauuuuggguaggcgaacuucagccuucguuucuuuguugugcccauaaagagaagugguucuggaaugcuuuuuuuaacccaggagugugacugucaccuuuauccuuuguucuuuugggaaacgggagagaugaaggcaacacgcugcuucuaaaacagcucacaccuggcugcucacacagagggcccagaaacacuggguggcacgaggaagcuccuccaggauucagaaugaacccaguuccauuggugguuaacuaagaacuacuugucuaagaaaguaaguaucaguagauuuuuuucaaugcuuugaagugcccuaaucucuaguacugggucauggugaaguuggaaagugaggguucaaauaaaauuagaucugcccccuuuuuaaaggcaucuaagaacaucccguagaauguucgcauugaguuuaaaagccuuugaagcuaauauagaaguuuaaugcagaaauguggcaagcaaaaggccaacuugcauuuuagagacagagcuugcuaguauagaagugcauauuucuaagaaaugucucaguaaaauucauuaauaaauacuaauagcuuuuuaaauuuuuuuccuccacguaaaaugaaaaugaacuuaagacuuacaaggaaugaugugagugggcuauuuuuuuccuaaaugccucacagucuccaacagcucaguuaagcacucugauggucuuuauggagaaaaauaacucugggggauucucgagucuucuugccuucuacagcuuucccuguggcacccuccacccccaaccagugucuuugagcuuggugagacucugcauacauuaauaugaaaagcuggaaaagaauuaagggcuagcgauuucuacacugaguacuuuuaaaaaaauaagauugacaaugguauucuuuucaauauauggauagaaauaauaucuaaaaucuguucugaaaauauuccuaaauccuggcagaguucugccccagucuaaugugauaaaaugauccucacugacugagcuuuuuucccuccccacucccaaaccuuugaaauuuccuguaacaagaucugaccuguaaagaucccauauacauggaacuucugccaacuccccucaaauaauagaaaaaucacagaaauggaaccauuuaacuugcugauacagguuugauuuuaaucacguaaaguggaagagugcuuugaucucaguugcuaaugaugauggacuaaucuuuagaagaacggaggccuugauuggugauuucaugggaacaaaacagauuucugcauuaccucugccugcuuugugggucccuuaguuggcguacacuuucugauagugccugccuuaugaaugccugaagucuaauccugaccuuacuuuguugcccauaaauaucuuucaaauugaaugcaucuugccucuuccugaaacuuucuguaggcgucuguguagacucugauuugcccuaaguucaaauacacagaaaucagcugccuugggcuuggcaucaaguuaauuucagcaccauguauuuguuuugcuuugguuuuuugccuuaauuucugugcucagaugucaugccaauuacuugguaaagcuugcagcuaauagagccacauguuuauuacgauaaagaaaaugaugucagucaacaucaguccucagugaugggauacgguagagcacugguuaugacagugaucacuggggaaggaguugugucuucuguaaguuagugucuucgggugauuuaauaucugcauaacuaaucccagaggaccccuuaggaguugauguaaugccuguagaaaaagcagugcgcagcaguagcgcacagaagagucgaagcucaagagaacagggaacauacugguuuguuucaccaaguauauauccuagcucuucacaguuuuaccaaaaaaaaucugugcucaauacauguuagcuacuguauuauaguagguacuccauaaauacuuguugaauggcauucuugaagagucagccaaaguaggagagagggcagaguggcuuuaacuggcuauaaguguugcugcccccaguuuccccauucagugcuagacaccaccauacuucauggcaaggacugagaacacccagcaggaccuaauggugcacaagcucauuuuaacaauauaaacaauagaaugacagugagaugcguuucagcaaggccaguaucacagaagccauucuguauuuugguuuuuguagcagcuguguagguaggcuaccagcuccuuacuuccaguaaguggaugucuccauuaauuuccagcgugucaauacugcugagcucuuuaaaucuguguuuguacuccaggcuguguacgccauuuacugcaaccuugaauucucuaacaucacaauaaauuaucaucug

SEQ ID NO: 17187 - RNA, 70407 nt, Homo sapiens
cgcgcuugggggcguggccgaggagccaagcgagccgggggcggggccgccugggggaugaagugggggcgcucgccuuuccugccucacucgcagcugccggguguuggggaaagagucgccugccuccggacuggagugcagaccucugacccuggagucgcucggccgcugggaaccguccccuugggucgucgccugggccgcccgucguuccccggccccgagggguccggcuggccgcgguguggguagaggucagcaugagccaagggguccgccgggcaggcgcugggcaggggguagcggccgcggugcagcugcuggucacccugagcuuccugcggagcgucgucgaggcgcagguaagcccgagugauagcgggccgggaacccccggccgaacacccgcggccgcuacacacgggccgcggcugugacgcggggagggccgggcagggccgggccagaaaagaggugauuucuggcgagcagaaaacccggggagcagagaccugaccguccagugcgggaaacaucugcgaaccgcccgcaggguggggggacggcgacacuccggguaauggcagucaaaagaggaagauggugacggucccccugagcuguuuucguuuuuuccucucggauguguuaagcggcugggaguguggcgggagaugggacgggcaugaaccaccucggcugucuugcgaagggagcgagcgcccagagaaacggugacguccuucccuucaggaguuagugagggagggagacugagaguugggggcacuccgcagacccccgaggccccgccaggcgcaggggauugggagggggcaagacuucacucgaacugucggacuagagcuuucugggcuuuuacucuuccucgagcaccuucccuugcucaagauugcuuuauuuuuacccagcugagcugugucugccaaguggcaucgccagguaagucccaauacgagacugggggggucugaguggggcguuguggcucguggauggaggcucuggcucuggcagucgugaggugcuggcugguuguugaugugaagcgaugauuacaaguguucucagugugcuagaaaucugaggcuuagcugaccagauccuuucgccuucagagagguguuugcuucuauucaguagaauuugaauugauugccaggugcugcugcuuguugucugcaccugcugcaaggaggcagcacugcugagggccaaaaaaauaaaacgaaggucucagguggccugaugaugaggggagaugucauuugaagcaauuagugcucauccaagaaaaauugaaggugacucugaguguaaccgugaaaacauguuuuucugaauugagucacuuuauuucaugguuuuauggugcccugcacuaaaucccagagugccugaauaguccguuugugucuguguuugaaccauaaaaauaaaaggggcaaauuuuugguauuggggaacauguuaaaaugcagauucucuggcccuaccuccacauguauugauuggaucuggaauauggcccagauaucagcauuuuaaacaaacauugcaaguacaguauaacuguagcaaaguuaucuuuugacuaccucuuggaccucacuuggaaaacacugagauggaauagauagugguaaucugggcagacuuacuaaaguaaauuuuccaaauugucuuuggcaaaauuauuuucuagucacuaguugaguguuucugagugaaauuuacaauucgauauuuuucugaaaugagaguucccauuuucucuuuuuauauagcacauauuaauuuaugcuuaucugucuagaaacuucauuuuaaauuuuuuucauuuaccacuaauuauguguaauuaauguuuuauaauuucaccuguauuuuuaaaauucuuguguagagauggggacuauguuauuaggcugaucuucaacuccuggccuccagcgagccucuuacuuuggcuucccaggugcugggauuacaggugugagccacuguaccuggccugccccuguacuuuuaauuucauuauauccaaaugaauauaaauauaguccaacaguuaaagauuugugaauauuugaaguagcauugugccaaacagucuuccaagugaauauauuugguuuuuguugccagcaguacuuacuuucuuuuuuuuuuuuuuuuugagauagugucucacucuguuggccaggcuggaugcaauggcauguguuggcucacugcaaccucugccucacagguucaagcaauucugucugccucagcuucccaaguagcugggauuacaggugcuugccaccgcgccuggcuaauuuuuguguguguguuuuuuuuuuuuuucccaguagacaggguuuugccauguuggccgagcuggucuugaacuccugaccuaaggugauccgccugccucggccucccaaagugcugggauuacaggcgugagccaccgcgcccaggccgccagcaguacuuucuacugugcuguuuuuuuuuuuuuuuugagauggagucucgcucugugucacccagacuggagugcgguggcgccaucuuggcucagugcagccuccaccuccuggguucaagugauucuucugucucagccucccgaguaacugggacuauaggugugugccaccacacacggcuaauuuuguauuuuuuaguagagaugagguuucaccauguuggccaggcuggucucgaacuccugaccauagguaauccacccgccuuggccucccaaagugcugggauuacaggcgugagccaccgugccuggccugaucaucuuuuagauaguacuuuaaucuauaacaugguuacacguacaaucucuccgaagugggaccauugagguaauugaaguucaaagaacuuaaaugucuuaauugaaugagugacuuuacaguggagcccuaauguggaacccuuucuggucuauacaguauguugguauuuucaguucucucuaguauagaaaaagagauggaaaauaggaaaaucaaaaaguggaauucagccaguucuuugacuucauccauauaauaaauugguagaaaacugauaaagggaagaauuagaauuuuugaaaacuaccucuguucacaagaaaucaaagucauuaaaggagauacauauuuuaaauguuauccccuuccaaaauaaaagcagaaaaauauuuuugaacacacaaaaugauacguguuuguauaucucaugccccauuaucguauaaaugaaauguaaauauacuuuggugaagcacuggaaacuaaaggcauagugcauacaagugauauaacaaucuuccuuuaaaaaguaauuucaauuagauauauguaaguuuuucuaaaugcauuucugagguggcauaaaauugaguaauacacagagccccucaauauaugaaaagccagaaacuuagaacuuaaauagugcuauaccaguccguuacucugagggcuucuccuaaacccuaaagaucuugagcugcuuuagcaguugcauggaguggagugggcaagaaauaaccccgugucugcccagugagaggaaacuaauaggagccuccaccauaauucauuucucguuuacccuuauauugaggauguagcuguuuggagccuggacuucaaacaauuacauccucaguauaaggguaaacgagaaaugaaacccauucuaaguaaagggaauaaaagaaacuugcugggagaagcagggaagaaacuuuugagaauuuguaaccaugagacaguccucacacagguucgcaagccaaauauuuauucugggaaaauucauagcagucccaaauuugugugcccuggguuuccaauaaaagcaaauauccaucaccucuggaggaauuuauuuucaacucaaaccucgaaaaauuauugaagaugaagugccaaggagaauaaacagcuagcaguaaaauaucacaaaacacccaaggaaacagggcaccaugaaucagauauuagacaacagaaacaaacacauaaugaccuuagguucugaaauuaucagauaauuuaauaucacuauguuuaauguguucaaauaaaaagaaacuugaaguauagaagggaaaaaagauuuuaaagaguggccaaaaagauuuuaauaauaaugaauuagaaguucuagaacugaaauuuaaaacucgauggauagauuaaauagcugaucauauccagcugaagaaaugauuauugaauuagacaaccauuucaugucuuuuuucuuucuccuuaauucuccaucaccuuuucaucuauccuuacucucaguucauaccuuacuaaaauuggagcaaucagaagagaaauuccacagaguaacccauaucuauccauuuacuagucucuguacccacauauuuugacuuccuguugguuaccauugaugaacugugugcuuuuaucaaaggcagccccuucacuuguauguuaggucucauuccuuguuugccgcucauggacauggcuccaguaaucuucucuuucuuuccuggaucaucaguuuuuccuucucaaauggaauuuuacugucaucauguauuaguccauucuuuuuuuuuuuuuuuuccuggaguagagucucgcucugucacccaggcuggagagcaguggcucgaucucaguucacugcaaccucugucucccaggcucaagcaauucuuaugccucagccucccaaguagcugggauuacaagcuccugccacaacgcccagcuaauuuuuguauuuuuaguagagaugggguuuugccauguuggccaggcuggucucaaauuccugaccucaagugaucugccugccuuggccucccaaagugcugggauuacaggcgugagccacugugccuggcuuaguccauucuuguauugcuguaaagaacugccugagacuggguaauuuuuaaagaaaagagauuuaauugacucacagcuguacaggaagcauggcuggcgaggccucaggaaacuuacaaucggggaagugcugcacacuuuuaaacaaccagaucucaugagagcucacuaucaggagaacagcaagggggaaguccgcccccaugauucaaacaccucccaccaggccccuccccaacacuggggauuauaauuugacaugagauuugagugaagagauaaagccagacuauauaucauaaaacaugcugcuaauucuacuguuuuaaaguuaucuuuucauccacauauuccuucugccuuugccuauuuuuucuguucccucuagaaaauucaagaguuagauuuaauuuauucuuccuuugcugguucuucuauuuuucagcccauucuaaucagacuuuugcuccuaccgcaccucugaaacugcucuuggcaaggucgccgauguccuccuuguugcuaaggccaacgguuuguucuuaaaccucagcuuuaccuguuggcggcauuuuuucacaacucaucacucacucuccuugaaauaauuuuuauucugacauccuggauacuaaacuuuucugauugucuuccugucuaguggaccagucugucuuagcauucuuucuuuguuccuccccugccauugacugcuaaucauuugaaccucaggguucaaagcuuguacucuuucuucucuuuaucuuagucaucucuucuggucucuuagcuuuaaauaccaaauguacaguggacucucaguguuagucuccaagacuaggauucucagcuuuagaucuauguauccaacuucuuuuuggacaucuccacuuggaggauuaauagauaucacaaacuugauauagaaaccacauuucugaucuuuucccccaaaucugcuuuuuccacagucuuccccccuuauacauaagcuccagccaaauuggccugccuguuguucuuaaacauggcagauacauucuugccugaaagccuuuguacuguuucuucuaccuagcacacacuuuucucguguauucauaugauucacucuguuagauuucugcuaaagugucacuuuaucugacaucucuugucuuaaaugucccugaccacacaaauauaaaagagaaacauucuauccucaccaaauuccugucacccuuugcuuaaaacuccccauuggcuuccugucucacauggugucauccaaaaauauauuuggucuuuauuucugauugcugacauagagcccuuuaaaacccuuggaauuugagucauaggagugccuuuuguuacucauaaugagccccuuucaaucacacuuguguuuauaguaaugaaaugacuuaagacggggacccuacauagauagccucaggauugggggcuggucaccacaaagacccaagugauuagaaaguugaaacuuuuggccccaccaaucugcaggaaggggagaggugggugcuggagauuuagcuccguaagaacucuugaacaacuugauuugaugagcuuccggguuggggaauacauugacuuauugggaggguggcauguugagagaggcacggaggcucugcacaucccucugccuuaguagcuugcccaaugcaucucuuccauuugguuauuacugaguuguauccuuuauaauugauaacuguaaguaaagugucuuucugaguucugugagccauucuggcaaauuaucaaaccugcaauggaagugcuaggaacccacaauugauagccagucagaagaacaaguggcucaggaccugagauuugugucaggaguggggccaucuugugggacucagcccuuaauuuguaggucugcacugaugguggauagugucagaauugaauuguuggacaccacccaguuggucucagaguuggagaauugguuggugugagaaaauaacucagauucaguaaaagcuaaaaucuuauaguggucuaauucuccuucuugccuauuguauaguccuccuuauuccucaaaaacauggggcaagcuuacugcauuaggaucuuugcacucacucccaaugccuggaaugcuguccccccagauaccugcaugucuugcuccuugccaaaauuucaugacaccuucuguaacuguccuauuuuaaaugguuagcagccccaguucugcagucuguuuccaguccuuaguuuuaucuauaucacuuuauuaccaucugacauucuguacuuuguucauucauuuugcacccccuuuucccuaugagaauguaaacuccuugagggcagagauuuuugucugucuuuuuuuuuucuucuaauuuuauauccccagcacuuaaagcagugcaaaucuuauguugggccucaguaaauaggcugaauuaaugaauaagugaauggaagauagaugcaaauaaauuauucagaaugaaaucuaaagagacaaugggauaauaaauauuaaagagaacuuaagauaccuggagaauagagugagaaugucuaauacaucuaauuggaguucuaaaagaauauaauagaauagggaagaagcaguauugauuucugcagaugaguaugaagaagauaaccuaacagaaaagugaaucaaagauauaaauagacauuuuacacaagaagaaauauaaaugugucauaaaacauaugaacauuguaccuucuuagugcaaauaagaaaaaagauaaucuuucaugcuaacuagauuggcaaaaauuaaagcauagauuaauauuaaauauugaugaggauaugggcuggcacaguggcucacaccugcaaucccagcacuuugagaggcugaggcaggcggaucacuggaggccaggaguuugagaccagccuggccaacauggugaaacgcugucucuacuaaaaauacaaaaauuagcugggcaugguggcaugugccuguagucccagcuacucgggaggcugaggcacgagaaucacuugaacccaggaagcggagguuucagugagccaagacugugauccugcgcucuugcuugggugacagagugagacucugucucaaaaaaaaaaaaaaaaaaaaauaggauauggcucaacaguaagucccauucauuguugaggggcugauaaauugguaaaacuguuuuggaaaucauuuugccauuuccugaaaaagcugaacauauacuuucagcgguucuauuccuaagcauauaaccuggagaaacucuuuuuuuuuuuuuuuuuuuuucuuuugagacaaggucucgcucuuuuccccaagcuggagugcaguggugugauuuuggcucacugcaaccucgacccccugaguucaggugauccucccaucucagccucuugaguagcugggacuacagaugcucaccaccagaccuggcuaauuuuuguacuuuuguagagacaggguuuugccauguugcccaggcuggacucaauucuccuguguccgccucccaaagugcuaagauuacaggugugagucauugugccuggcccaaccuggagaaacucuugcauguguuuuuacaccagaauaugugcccagaaacauuuguguagcaauguucuuuagccaaaucugaaaacaaucuaaauuuggauugugguaauuuucuauugcuguugugacaaauugccacaaauauaaugacuuaaaaacaauauaaauuuauuaugcuguaguucugggggccagaauucugaaaaugggauuuacaggguuaaaaucaagaugucagcaagguugcauuuccuucuggaggcuucuuuucaagcuucuagguauugucaugauuuuuggcuuaugaccucuuuauuccuucaucuucagagccagcaguauagcaucuuccagucucucucugacucugacacucccgccuuccucucucauaaagaacucaucucaccugaauaauccaguauaccccuuccaucucaagauccucaaauuaaucacaucuuugaaguccccuuugccaugcaaaaauaauauauuugcuuauuucaggaauuagggacaucuuggggguggggcauucugucuacuguaugcaucaagaguagaauggauaaauuaugauauucuaauaaaauguaacacuugcaacagggaaaaugaaugaggugcuacaaaccucaucaucauagaugccauaauaacguguuaacaaaagaggcacaucacagaaaaauucacacauuagauuccauuaauauuaaaguucaaaaaugggggaaaaaaaccucaagcauauuguuuagggaugcauuaccagaaaaggaaaaacugauaacaaaaacaauauuuauuucuaccuuuagggagagggagguagauguaauuaaagaggagcuuaaaggauacuggcaguauuuauuuuuauuuuuuauuuuuuuccuaaguuucaggggguacaugugcagguuuguuacauggguauagggaauuuuucagcucuugucccccucuuuccucaccuuuugggguccccaguguuguuuccuuccuuauguucauguauacucaguguuagcucccacuuacaagugagaacaugcaguauuugauuuucugcuuuugcauuaauucacuuaggauaauggccuccagcugcauccauguugcugcaaaggacauuauuucauuuuuuuaaaauggcuacuuaguauuccaugguguacauagaccacauuuucuuuauuccauccaccguugauggguacuugacuacgugaugauugcacgacuucaguacugugaauagugccgugauaaacguucaagugcaggugucuuuuugauauaaugauuuccuuuggguagauagaugcccgguagugggauugcagggucaaaugaugguucuacuuuuaguucuuugauaaaucuccauauuguuuuucauagguguugaacuaauuugcauucccacuaacaguguauaagcauucccuuuuuuccacauccuugccaacaucuguuuuuuuguuuuacuuuuuaauaugauacuggcaguauuuaaaaaguuuuuggugauacacagguuucugucucaguagucuuuuaaagguuacaaauauguacauggcaacuuuguuaacccauccccuaccacaauuaaaauguuuuaaagaaguaaaauauggugcuuuauaaacuaaaagucaacaauuuaagaaaaauuuauaagaaagaacaaaaaaacucaagcauauuguuuagggcugcauuaccagaaaaggaaaaauugauaacaaaacaaaaacaagauuuauuucuaccuuuagggagagggagguagauguaauuaaagaggagcuuaaaggacacuggcaguauuuauuuuguuauuuaauuauauauuauauauaaaaaacaaucacuagauaaaauauuuuuaaaaccuagggagcuuuuugguuuguauuuuuuuccuauuuaggggcuaugauuugaagucuuuacaaacauauuucagacuggcuggggaggaaggaaaaaauagaacucgcagucuuguaaguaguaagugagagcaauggaaugaaauuugggaguuagugacaggauccuagugagucggacagcaaaguaaauguaacucuagagccaaaauucuugguaaugaucauuuaucucaagauaauauagcccuaacucuguugaagggagucuggggacacauuuauacuccuagggagagagaaugagaaugaaacagcuugcaaggacugguuuccauuuucugaucauuacuugcauauauuccuccuauggaccauauaaauaaccuuuaacaggcugagacccauuuuuuguuuuuuugaaaauuuugguuguuaguucauauggaguugcaagaaauaacacagaaaucccauauacucuuuaucuauuuaucccaaugguaacauccuguaaacauguaguacaguguuauaauugggacauugacagugauagaaucuacugaucuuguucagauucucccaguuuuacuuguuuuguuuguauguguauguauuaguuccauauaauuuuaucacauacauagguucauguguucaccaucacagucaaaauacugaacaguuuugucaccacaaauauugcuucuguugcccuuuuauaaccacacuauuuccuuccuacccuaccuaccccaucauccauccccuaccccagucccuaaucccuggcaacaaaugauaugcuuuccauuucuaaaauuuuuucauuuaaaaaguguucuguaaauggaaucauauaguguguaaccuuuuggcuuggcuuuuucauucaggauaauuccuggaagauaaauccagguugugcauaucagucaaugaguuccauuuuuaauuuagccaaagauuguuuuauggaauuuugggacucuaaauucacuuuguaaauaccaauuucucuucuuggauuagcaaauaaucuuugaauaguggauaagaucauugauuuuaaagucugauagauugggaauaaguuccauuucuacuuuggaaaaauuaagguugcuaaaccuuaauuuccuuauauguaauaugaagauuauaauaccucauucaugaaauacuuuuaaagaggaaaugagauaauauaaagcucuuaauacugugccugucauguaaguguuccauaaauggccaccuaaaggaaagauaaaagacauggguuacuacagcaauauuauuacagucuguaacuucuagguuaguuugggaagauauugcuuugguauuccaguggccacuuggauuucauauauguuuaaguagaggaaggagaauucaauacucuucaagugcuaaagagaaauguucuuccaaauggguauagcuaaucuuucuauuguuuuuuaucucauuggccacaguaaaaaguaaguugacugcuuuaauguuauaucuuaaucagcaaguaccggcuaacuugaaugaauaaauuacauuuuuauauaauaguguagauuuguuaagguugaaacaucaguaguuuacauauuuuaaauuauauaaauucuaggucacuggaguucuggaugauugcuugugugauauugacagcaucgauaacuucaauaccuacaaaaucuuccccaaaauaaaaaaauugcaagagagagacuauuuucguuauuacaagguaagguuguaauuuuuuauucuguugauaucaaagguauuauaugugaccuuuaugauccuuuugaaagcccauuucaguuccucucagcaccuuguguauaucuuucaucacugaauuuauuauguauugcaguggaaaccuauugaucuuuuuaaacaguacaaaucuuagcccccuuccuuuguauggggaguuccucauuuuucaguuuugguuuuuaggcagagacuacugucucuauagaagcugaaaaugccacagacuuacuuugucagccucucuuauaacauaguucugccaucuggacacaccuacucagccuuugaguugugcugaugucagugugcuagcauuguuaguggaaaggaccacagcagcaucuuuguuggaccucuuucugagagggcuggcaaaacaggcugaggcuccaaguagaccacuaccgacagugaugcuccagaauugguucuuaaaucuaguaauagucuacucuagaccuuuacaaaauaaccggugauacuuuaaaggcagcagcaaucuuuaaauauagcaguaaggcaauauucaaaagaacaguguuuuaaauuuuagaacaacauuuuauuuuauuuuauuuuuuauuauucuuacuauuuuugagaugaagucucgcucugucacccaggcugaagugcaguggcacaaucucagcucacugcaaccuccgccuccuggcuucaagcgauucuucugcuucagccuucugaguagcugggauuacaggcgcccgccaccacacccagcuaguuuuuguauuuuuaguacagacuggguuuugccauauuggccaggcuggucucaaacuccugaucucaggucauccaccugccucagccucccaaagugcugggauuacaggugugagucacugugcccggccuaaauauauguauuuuguuauuuaauaauauauauauguuuuuguuuuugcuuuuauuuuuucucucgagacagagucucacuccgucgcccaggcuggagugcaguggcgcgaucucggcucacugcaagcucuacuucccagguucacaccauucuccugccucaggcucccgaguagcugggacuacaggcaccugccaccacgcacggcuaauauuuuguauuuuuaguagagacgggguuucaccauguuagccaggauggucuugaucuccugaccuugugauccgcccgccuuggccucccaaagugcugggauuacaggcgugagccaccgcgcccggccuuguuuuugcuuuuuuuagagacagggucuugccauguuugcccaggccgaucucaaauuccuggcuucaagugaucuaucgauugaucaaucuaucuaucuauccaugugucuuuuuguuuucuaggcuuacgucagcuaaauuaauuuuuuuuuguuuuuuuuuagacagggucucgcucugucgcccagacuggagugcaguggcuccaucucaguucacugcaaccuccgccuccuggcuucaagcgauucuucugccucagccucccgaguagcugggauuacaggcgcccaccaccacgccuggcuaauuuuuguauuuuuaguagagacgagguuucaccauguuggcuaggcuggucaaauuaaauauuuuugaugauuaaaaacuaguaucuugugcagaaauauaacaaauaagagaauuaaagauuugggaacacaucucucuuaucagcaccaggaacauccaaaaaaggugauguauguuucuccucuguacaaaauccuuuaggaaagcauauuucaugaauuuauuucaaagaguaaucuauaccuaaauagacuauugagugucuguuacucuaggcauuuuacauaugaauaagacaugugcuucuuucauuuuuuuuuuuuucccccggaggggugcaccguuccugaaguacugcaauaccaggucgaugcgaggaguggauggagcaagcuccuauuccaucucccuacuccaaaaauccauguaauauauuguucucggguagaggacauaucagguauuaacagauacuucacuugaucuuagccaaaaggccgagaagccauuggagagacaggugcuucuuuaaauuuccaccacuaaaucuauaaaucuaagugcauuuguagcugcuuucucuuguuucuuuucuaccauaacauugaacuauaugaaauuuuuacuuuuauauuucaaaaaugguugaacaugccaguuucauauugcucaauguaauacagugggggaaguguuucuuguaucaaaaaccaucucuucacaagugguccaguucacaucucuacauaauguuaugucccucacucuuucacuccuucacuuuggguuuguaucuuguguuucucuaucccuagcaggcuuggucaguagaaguacucaaauauuugaauguuugaaugaauaucucguuuaaucuucacaccaaaauuuucucaauauuagucacauuuuucaaaugaaaaaguaauaguuuagguauuccagguaggguauuuuuguuggcuaacaaacaaaacagaaguuuuauuaagaaaagauaugaaguagcuaacaaaauugaaagacaagcugaggaaacauacuucagaaaagauaaaacuaaagcuggaacuaaugaccauuuccuuuaaggaaccacugggauuuuguaucaaauuaacuauuuucccauauuuuccaaacuuuauguaagaguuauauuucuguccagguacggucauaugaccuguuggaccaaaagaaggaaggacaccuugguugacagucucauuugcaugaguaaaaguggagucauuguuucccaaagggaaauuagggacuguuacaaaagaaggaauaauggaacuuggauaggcaaaagugacaaugugguucuuggcuacucaacaaucugauucuuccucuuacacaugcaguuuaaaaauguucugaucaacacagugaaauuauuccauaugaaaccaaaacaugcucauacccucucacagaggaggguuaaugccaugaucuaguuaaugcauucagcucuaacucuaggauauuugggugauaucuaugccucuuuuuguucugucagccuauaaaagaaauaagaaggaauauacucuacucaauauacucuaccuacaacaguggcaaagaaaggaaagcuuuaaaaagaaaaagcuaagagaaaagguuaauuuaacuuauuauuauuuuuuaauuuuaauuuuuuuuuuuuugagacagagucuugcucuguugcccaggcuggagugcagugguacgaucuugguucacugcaaccucagccucccagguucaagugauucuccugccucagccuccugaguagcugggacuacaggcccacaccacuacacccggcuaauuuuuauauuuuuaguagauacgggguuucaccauguuggccaggcugguccgcaacuccugaucucaggugauccacccgccuuggccucccaaagugcugggauuacaggcgugagccaccaugcccaaccaaaaagaaguuaauuuuaaacacaugauucaacaagcaaggaauacagguggagguaacagucugccuuuaugcaguugggcaguuggcugcuguagcugguauuucuaacuucucuuuuuuacuucuuauuccuuuccuuuaugcaguaaauauuuauugaaugauuaguuugugucagguacuauggauacaguagugaauaagacaaaacuuuucugauaagagagacaaacaauaaacaaguaaacaauaaaauauaauuucagaugcuuauaagguaaauucuauggagaaaaguaaaguaggagagaaugaauauuggggaauuggagggugggagagguagguagcccuacauuagagaaaguauuugggaaaauaagguauuuaugcuaauguaacauuugagcaaaguccuaccuaaugugaaagagccaugagaagguuuggggaaagaacaugccagggaaaagauguagaauaccaaguaaauggucuugagauagaaauaagcuugguguguugaauaggcagaaagcugguauagcuggagugaacgagagggagaguuggaaauauagguaggcaccagauuuaaaaaacaguaggaccguauugaccauguaaggaugcuggauuuuauuuuaagcaggauaagaaacuacugaagggauuuuugugcaaaaaagacuguaaggguagaagacaagaaauagaggaaccauuuaggagacucuuguguuaguucagauaaaaacaauacagauuugcaauagaaugcugcagcugaaaaauguagaaaaugaucaaauuaggguuguacacaaaaggcaacaccagcaagcuuuucugaugaauugagugugacguaugauauagaaaugaaaucaaggaugaugccuaaguuuugagugcacauauacaagcacaaauguacauauauguaaaaucaugaccaaauagauuuuauuccaagaaugcaaggaugauucuugcauugauguugauaaucaucaaaauucaauaugugcuccugauuuuuaaaauaauaagaaugauguauauuucuuaacaugaugauuucaguccuaacaucagcauagcuaacacgucuugcauauggggaaacacuagaggaauucucacuuaggucaggaaccaagacaaggauacccacuaucugcauuaacuguuggauauacuacccagcacagucaaauaagaaaaaaacaacuauccagugugauggcucugauuuaaaaaaaaaaaaaagagaaaaaaauaacuagagccauaaaauuuuauuuuacuuuuuuguguauaaauuuaagggguacaagugcaguuuuguuacauggauauauugccuaguggugaagccugggccuuuaauggaaccaucgcccggauagugugcauuguaccccuuaugaaauuucucaucccuuacuccccucccacccuucuuuuuuuuuggagacagucucaccuuuguugcccaagcuggagugcuguggugugaucucgacucacugcaaucuccaccuccuggguucaagugauucuccugccucagggcucccaaguagcugggacuacaggugugugccaccaugccuggcuaauuuuuauauuuauaguagagaugggguuucaccauguuggccagguuggucuugaacuccugaucucaagugaucugcccaccuuggccucucaaagugcuaggaugauaugcaugagccaccaugccuggcccaccccacccuucugagucuccagugacuauuacuccacauucuaugcccauguguacacauuauuuaccuccuacuaauaagugacaauggagaggcauacagauuuuaaaggaauaaguauaacuauuuccauuuauaaaugaaaaaaguugucugggcaugguggcuucugccuguaaucccggcacgcugggaggcugaggcaaguggaucaguugaggccaggaguucgagacuagucuggucaacauggcagaacccugucuccacuaaaaauacaagaaacuagcugggcaugguggcgugugccuguaauuccagcuacugguuggggggcaggcagaggcaugagaauugcuugaacccaggagguagagguugcagugagccaagaucacgccacugcacuccagccugggugacagcgagacucugucucaaaaauaagaaaauguaguuauaugaaaaaaguuauauguaaaaaaugcaaaagaaucaauaauaaaaacaauaaaacauauguuaauauagcaagccauaaacuugauauacaaaaagucaauaucuucauaaauguaaauaauaaccauuuagaaguuauaacagaaaggaaaccaccauuuacauuagcaaugaagccaggcaugguggugcaugccuguagucccagcuacuugggagacuuagcuggaaguaucgcuugagcccaggagguugagacaagccuaggcaacauagcgauacuacugacucaaaaaaaaaaaaaaaaaaaaaaaaaaaagcaaacaaaauaaaacaaaaaauauauuagcgauaaaacagauaagauauauaggaauaaguacaucaagaaguaugcaaaaccuaaaggaggaaagcuuuaaaacauucuugaaagacacaaaaguagauuugaacaaauggaaagauauccuuuguagccuaacaauuuuaauucgccccuaguuaauauguaaauuuaaugugauccuaauaaaaauacugaauuuuggccuggugcaguggaucacaccuguaauccaagcacuuugggagcugaggugggugcaucacuugaggucaggaguucgagacccgccuggccaaccuagugaaaccccaucucuacuaaaaauacaaaaaauuagccaggcgugguggagugugcuuguaaucccagcuacuugggaggcugaggugggagaaucguuugaaccugggagguggaaguugcugugagccgagaucaugccacugcacuccagccugggugacagagcaagacuucaucucaaaaacaacaacaacaacaacaaaacugaaguuuuuguuuauuuuccuggagcuagacaaguugucacagguuagguucucugggaagcauaugcugagacagugauaaguguacaagagcuuaguuaggguauacucuugggaacaacaguuuggggaaggcagggaaucaggauugggcaaagggagaugucaagcugugaugcagccucaguggaaaccucagguaagccuguggggaauucuuaagauggaauaacccuuccgaguuagucguccccauuuggcacgagagguauaggccuuuauaucucuccaucaguuggucauuggaugaaggccaccagaggaaauaaggauccaaucuuggguaaggugguucuuuucacccaagcuugucuaccugcagcauuuccacaacugagguaauuacauccccuuuauuccugaagggugaucugaguaguauguuacagugucuaccacaguccacucguugcaccauguauuucuguugcugaauuaaaaaauuagcuuuaaauuuagcagcuuaaaacagcagggcugggcaugguggcucacgcucguaaucccagcacuuugggaggccgaggcuaguggaucauuugaggucaggaguucaagaccagccuggccaacauggugaaaccccaucucuacuaaaaauacaaaaaaaaaauuaggcaguagugaugugcaacuguaaucccagcuacuugggaggcugaggcaggagaaucacuugagccugggaggcagagguuguggugaacugagguugcaucacugcacuccagccugggcgacagagugagacccugucucaaaaaaacaaacaaaaaaagacugaaaagaugccauuucaggaagaccuaaagagugugagaaagcaagcaauguggauaccuggggaagagcauuuuuguaugagguaaggauccaguuucauuccugugaaugugaauauccaguuuucccaacacuuuauuaaagagacuguccuuucccuguuguguguucuuggcacuuuugccaaaaaucaauugaccauacauacuugggagucuuagguuuauuucugggcuuccuaacuuguuccauugguugaugugucuauuuuuaugccaguaccaugcuguuuugauuacaguagcuuuguaauauauuuugcaaucacagugugcaaugaguccaccuuuggauuuuuugcucaugauugcuuuggcuauucagagucauuucuggauccauacaaauuuuaggauuguucuuuuuuuguuuguuuguuuuuguuuuuguuuuugagacagagccuugcucuguugccugggcuggagugcaguggcacaaucauagcucacuguagccuugaaaaccuuguacugaccucaacugauccucccaccucugcuuccuaaagugcugggauuacagaugugagcugcugugucuggccguauuguuuuuuauguaucuguaaagaaaugauauaggaauuuugauaggaauuguauugaaucuguagaucacuuuaggugauauggacauuuuaacaauuuaauucuuccaaucagugaauaugggaugucuuuccacuuauuuaugucuucaguuucuuucauuaguguuuuaguuuuuagugcauagaucuuucaccuccuugguuaaaguuacaacuauuucauuucuugauguuacuguaaauaugaucucucaauuuugggggggauuguucauuguuaguguauagaaaugcuauggacuuuuguaugcugacaucguaaccugcaacuuugcagaauuuaucaccaguuuauuacuagauuuuuugguggagucuuuaaaguuuucucucuaugagaucaugucaucagcaaacagacauucucauuucuuuuucuauauagaugucuuuuauuucuuuuucuugccuuauugcucugacuagaacuuccaguacuauguugaauagaaguggcaagagugggcguucuugucuuguuucuaaucuuagaggaaaagcuuuucaguuuucaccacugaguaugauguuagcuguggguauaugaccuuuauuaugcugggguacauuuuuuccauaccuuauuuuucagggguaguuuuuaucaugaaaggauguugaauuuugucauauguuuuuucugcaucuaucaaaauaaucauguggcuuuugucuuuaauuugcuuaauguguauuauuuuuauugauuuauguacaucaaacuacucuugcaucucugggauaaaucucacuugaucauggugagugaucuuuuuacuaugcucuuggauuugguucacuaauauuuuauuaaggauuuuugcauuuuuuuucaucagggcuguuggccuguaguuuccuuuguuuauuuuuuuguagugucuuuuucugccuucgaaaucaggguaaauacuggcuuucuaaaaugaguuuggaaguauuaccuucucuucaauuuuuuugaaaaguuuaaggauugguugcuguucuuuauauguuugguagaacucagcggugaagccaugagguccuggucugucugucuuuuuuuuuuuuuuugagaccaacucuugcucuguugcccaggcuggagugcaguggcgcgaucucggcucauugcaaccuccaucuccuggguucaagugauucuccugccucagccuguugaguagcugggauuauaggcccaugccaccacacccagcuaauuuuuguauuuuuaauagagacaggguuucaccauguuguccaggcuggucuugaacuccugaccugaccucaggugauccaccugccuuagcuucccaaagugcugagauuacaggcaugagccacugcgcccagugccucgucuuucuuugauaagauacuuuuuauugaaucaguuuccuuaauuauuauuggccuauucagauuuucaugacuuccuuacuccagcuuuuguaggcugcauguuucuaguaauaucuucauuucuucuagguuauccaauuuauuggaacauagucgugauuaguagucucuuuuucuucgaugucaguuguaaugucuccucuuuaauucugauuuuguuggcaucuucucuuuuucuuuguuaaucuagcuaaagguuugucuauuuguuuaucuuuaaaaaaaaacuuugguuucauugauuacugauuucuaguuucauguuaguguggucacauaagauacuucguaugauuucaguguucuuaaauuuguuaagacuuguuuuguggccuaacaugcucuauccuggagaauguuccauaugcacugagaauaauguauauucuguuacuguuguauggaauauucuauaaauaucugguagggccauuuggucuaaaguguaguucaaauccaguguuuccucauugauuuuuuuuuuucugucuaggugaucuaauguugaaaguggaguauugaagucuuauuguauugcaauuuaucucucucuucaaagcuauugauauuugcuuuauauauuuaccuuuucagaaguugggugcauauauauauuuaguuuuuguaacuucuugauaaauugacccccuuaucauuuuaaaugaccuucuuuaucucuuuuuacauguuugacuuaaagucuauuuugucugacauauggauagcuaccccugcucuuuugguuucuaguugcauagaacaucuuuuucuaucuuuucagucuguguguguccuuagaggugaagcaagucuuuuauaagcagcauauaguuaggucuuauuuuuuaauccauucgccacuuuuaauccaauccacuuuugauuggauaauuuaauccauuugcauucaaaguaaucauugauagguaaggacuuacuauugccauucuguuaauugcuuuuuuuguuaaucuguaauucguuuguucucuccuccucucuugcuguuuuccuuugugguuugaugauuuuuuuauagugguaugccuugaaucuuuuaucuuuucugcaacuacuaaagguuuuugcuuuguaguuaccaugagaccuacauacaucuuguguuaguagcaggcuguuuucagcugauacugacuuaacuuugaucacuugcauaaaugcuauacuuuuacuugccuccccaccccaauuuguuuuuaaggacaugucuuauaucuuguauaguuuguauaguguauuauagcuauaguuauuuauuuuuaauauuuugucuuuuaacuuuccuauuagauauauaauugauauuuacaccaccaguacaguauaauaguguucugaguuuguaugcuuacuuuuacuagugaguuuuauguuuucuaauuuauuuauuuauuuauguuugagauggagucuuacucuaucacccaggcuggagugcaguggcacgaucuuggcucacugcaacguccgccucccaaguucaagugauucucuugacucggcuucccgaguagcugggauuacaggugcacaccagcacacccagcuaauuuuuguacuuuuuuaguagagaugagguuucaccacguuggccaggcuggucucgaauuucuggccucaagugauccacccgcuucggccucccaaguuguugggauuacagguguaagccccugcacccagccguuuucauauguuuuuaauauugcuaguuggcagcauuuuucuucagcuugaaggauccuuuuagcauuucucauaaggcagaucuaguggugauaaauuuccuuacguuuugucugagaaaguuuuuauuuccccuuuuauuuuugaagaacaggaucacuggauauaguauuuuugguugacaauucuuuuucuuccuuuucuuucagcuuuuugaaucuaacauuccacuccuuucuggccuacaagguuucuguugaaaauuuugccuauaauuuacuggaaguucccuuguuuguaacaacucacuuuucccuugcagcuuucaauauuuucucugucuuuaacuuuugacaauuugauaauaacgucuuuuggugugugagucucuucggauuccuccuaucaaguuuucauugaacuuccuggaucuggcuggguuuuuuuuuuuuuugcuuuguuuuucuuuuuuuucuuucucucucucucucuuucuguccuucuuucuuucuuucaucauaagcaagcuaacaggagggaucuggcuuucuguuuccuuccccagacuuggaaaguguucugccacuuuuucuuugaauuuuuuuugucccuuuuucucuuucuucuccuucugguacucugauaauguguguaauucugcuuggugguauccuaugagucccuuagacugucuucacucuuuuucauucuuuuuucuuuuuguuccucagauuggaugauuuccauugaacugucuucaaguuugcuaauccuuucuucugcuugaucuagucugcuguuggaccccucuacugaauuuuuuuaguuuggcuauuguguucuucaggucaaugauuucuguuugauauuuuaaaaauauuuucuaccucuuuguugauauucucaauuuguucaugcaucgcacuccuuaccucagugagcaucuuuaugacuccuucuaaauguccuguuagguaaaucacauaucuuccuuucaguaggguuggcuucuaauugagauugucuuguucuuuuuuuuuuuuggagcauauuucccuauuucuucauuuuucuuaacuuaaggcacauagaaugcugucccuucuguuuaggcuucaggagguuuauucuuuauuugcuacauaggcuccuagauacuggcuuguuagaagccaaaucugcagggaguugcuggaaaggcugccaagauuuuggcuugaggaacuagaauaauggaguugcuguuuacucagauggugaguauuacuagaaggaguaauucuucauuuuucuuaacucuguauugguuucuguguauuauauaaaagaacuaccuucucuagucuuguuagacuggucuuauguaccagguguuucuucccaaucagccuuggcaguauucuaguuucgcaaaacuuugugcuuguccagccugcugucucuguucuuaguggccuccaagaaauuagagucaaguuguacuauugccuugagagaggugguauagaagccauucccuugggauaugacuagagauauugggauguuagaugugugcuuugguuucuucuuuccuugcagagaagcugaaagccagaguuuaucucccacugauucugcucugcaccaaagagagcaucugaggcagaugccuguauucuugaucuaacuggugacuuuuuaacuuggaagagagagauagcugcugaauauuuauuugcaaguuuaaaagucaccuguuuguucucuguggucuaggagacucaggaguguagggcuucaucaacucccagagcuaggugauuuagcagccuaucccuccagugaaggcuauaaaaguugggguucuugauguguucaaaaauuauuuucauggagaguugaagaccuggaauuauugccagagccuguaggggaaaaggugcaggaagcccacucuacuuuuugggccagcaggucucaugccccccuagcagggggagacuucugaucugaagcuauuacugaagcaugccaggagaaaggcacagggagugcugacuuuccuuuucaggaauggggagguccccccgccuccuuccauugagagauugugggaguuugucucuagagcacauggaggcagaaggcaugagaagugcugucccuuccauucgugguggcagagauuucagaguugggauugugucuggagcaagccagggaaggaggugcagagugugcuuacucucccguucaagcaagaagucucacaugcaccuugcaggaguaaccuuuuggucuggaguucccugaagcaagccagggaagaagacacagggaauauccccuucucuuucuugucauggagagguccccuugccuccuucuaaugagagguugcagaaacuuaucucaggagcaagucagggaagaaagcgcagagggugcuguuccuccuguucuugcuggcagaggccuccaaccuuuuuccaaggagagaguggauggcugggauuagcgccugaaguaagccaggggaagaaggcacauagagugcugucccuucuguuuaggcucaaggagguuuauucuuuauuugcuacauggguucccagauacuggcuuguuagaggccagagccucagggaguugcuggaaaagcugccaagauuuuuggcuugaggaacuagaauaauggaguugcauuuuacucagaugguaagaauuucuagaaggaggaggugcaguuuuggauauguuaauuuugagguaccuaugaaugccuuguccaggaagagauaauccaggaagcagguggguauacaggccagaagcuuaagggagguguccaggcugagaacuugcaguccccagaugugccaugcuguuuuaagguucuuuguuuaugcacauccugccccacugccucuaaaucucccucaaacacuucuagucauacccauuuuacauauuaccaaaagucagaguugaucacccucuccucuauguugccaaucuaccuauuuuugccuucuucucuguaauauagauauuguuuacuuaaccauauuaauuaggugucuacuauguauuauaccacuguuccaagcacuaaggauaagaugaugcaaaauucugauccuuaugguaggaggcgcagacaauaagcagauaacauucagggauaagugccauaaaagaauguaaaacaguacguugggguagagguugcauacugagcacuacuuuagcaagccuggccaggaauggucucucugcuuaggugugauaugugagagagacuugaaugcggcgaaagagugagccgucauaagaucuggaggagcaauaauacaggcagagaggacagcaaauauaaagaccuugaggccgggcaugguggcucacaccuauaaucuuaacacugggagucugagguggguggauggcuugagcccaggaauuccagcccaaccugggaaacauagugagaccuugucucuacuuaaaaaaaaaaaagaaagaaaaaaaaaauuagccagguguggugguacaucuguggucccagcuacuugggaggcugagguacaaagaucaccugagcccaggaguucgaggcugcagugagccagguucgugccacugcacuccagccuggguaacagagcaagacucugucucaaaaaagaaaaaaaaaaagauaaagaccggccaggcacggugguucaugccucuaaucccagcacuuugggaggccaaggcaggcgggucaccugaggucaggaguucgaaaccagccuggccaacauggugaaacccugucucuacuaaaaauacaaaaauuagccaggcguggugguggacaccuguaaucccagcuacuuggggggcugaggcaggagaaucacuugaacccaggaggcagagguugcagugagccaaaacugcaccauugcacuccagccugggugacagagugagacucugucucaaaaaauaaaaaaaaaauaaagaucuugagacauagggagcaugguauguucccagcaaggccaguguggccagaggagcauaauagaagaggucagagagauaggccagaggccagguuauggagggccuuguggagcuugcugcagaguuuauaaacucuaagggugaugggaagccacaggaagguuuugaggagggauugauaugaucugaucuguuuuaaauagauaacuguaguugcuguauggacauagaaguagaagcagggagacuauugcaauaguguaggcaagagguagguggugacaaauggaaaaaugaauuguuugauggggaacaagaaaagggaggaaggagaauaaaaccuagauuuuggcaugggcaaucugcaaguccuauugaauuacugucuuccuguaauguguagaauaggaaaauccagcuuuuuuaccaugguuaaaauguccugcaugacugucccuuguuuaccuccauccucguucucugccacccucccccuucuacauuaaacgucagcccaacugguguuuuuuaguucacacaacugcccaggcuuuuuauugccuuauccaaaugcacacuuccuccauccuaaaauauuacugccucagaggccuccauccgcuagccucacuauuacaguucucuggauuuucuuuguagcacugacuacaacucguacuaaacuuacaaauauuuaauuuguuuccuucaauagauuuuuaaguuccagagggauaggggaguucuuuuucuguccauuuuccccccauagccuacccagugccugacacauaguggaugcucaguucuuauuuguugaauaaaugggugcaugagagaauucucauuaauaagauaacauuaggaggcuggaagacauucaaguaguucuaaaugcuuucucugucacccagucuggagugcaauggcaugaucuagcucauugcugucauuuuaaauucugaaccuuauaggugccacgaggauaggaaguauuccuucuuauucaccaccaugucacuggugcccaacacaaugacacuuugagagcaccccauaacuauaauaugaguuuacuaacuuuguucuuucuuucaagguuaaucugaagcgaccuuguccuuucugggcagaagauggccacuguucaauaaaagacugucauguggagcccuguccagagguauaauaaauaaaauaacagggcaaagccaauuuucucuuggacuuuuagaaaagcauaaccucuauuuuauuucaggcuaaugucaauggauuuggaugugucagcaaauucauaugcucucagcucucuccuuuagaaccagauuauugaagauucuauacuugacaccaaaauggguuugaagacacuuguauccagugauacuggugaucaaauauggaaauauagucuuauucuaaaauggaaggaaaaucagaggccuguucuaggauuggaucugcaguugucuuuuauuucaugcuuuauugaaucagcaucuuguuucauaggaaaaaaaaaacaaaauaaaaacaagcuacuggacccuauauuucaaauuuauagugauuuaauuggggaaauuucaggcuuagaauuagauuuucacuuggccuuguuacauuuacauuuaaaaaaaaaccuauacuuaauaccaagagaaugcuacauuuuagacuuugauuuuuguuaucuaacauaauuaauuauauuccucuucuucaacaguaauuaguuguaagcuuuguuuuccuuucacuuucugcuuuucuuaccuaaucaguuagucuaguuuguuguccuuaaaaaucuguaccaauguccuuccuaaagggaacauucuuuaaaaauuuauaauauucaguuuccuuuaagaauaaaauauguauuaaguauuucguuuaaaguucuguuugauaaacugguuguaauaauucagauacauuuauuaaagccuaacacuaauuauuggccuugugaaaaagaauguuccagcuacaugcacuucucccauugguaaacccuagauuagauugguaaacucuagguuaaucgugugggccaaaaaaagcuuucuaguaauccaaaauugccuacacuuuguuagagcagaaguuaaaauugcacauaauacauugcaaauaauuuugaacuuucaaaacuuucuuuucuaugguaacaaaguuuguggaaggaagugauugucaguguuuucaaccuaaauuauauaaacuauaaaaaauacugcaauaguuauuagagcugcuuuuggcuuucuuacuuuguguaugucauucaguuuucuauacuuugauuuauaagucuguauauugggauaacacuuuuacuuuaugagauagugugaaaacacaauuugagugaguguauauuugccccucauagaguaaaaugcuugaugaaauagagcaaugcauugacaauucgugaagaaauuccaaaaaaaauaaagaucacuuaaaaauuuuuuugcuuuucuuguuuuuuuaagaguaaaauuccgguuggaauaaaagcugggcauucuaauaagguaagucccuccucuuccuugaguguuucugcuuuacauugugaaacuuaccauuuacugacugacaguggcuguaguaaagaaccauauuaugguuaguugggaauggagacauuuugccucagaauuccaaaucccuaacucuugcgucaagcagauagauuguacauuucuagauucuuuugaaauugcuucaguacuguuuuuggaaucucuggaacaacuauuaaauguaacuauagugucagauccccuagucagcagguguuuuaucacauagcuauuuuuagucuucuguuucaacuaguuagccuggcagguucagaauuauauuguauagaguaaauaauuaucaagauauuuugagcagaguacuuucagaugguauuaagauauucauuuuuaauuauuguucuuguccuuuuaugagaguauuauauuuugccauugauauguuuuuagagaaccguuuauuuccuguuuuucacuacugcgcauccauaauaaagaucaucauacccucucucucugucuccuucuugugccuccuuugcguuuucuucuugcucucucucccguguaaucuuuuguuuuuacuuuauuguauuuauuuuugcuucagaucugaaauaaauaaaaccauauaaaagcaguugaaacccccucagccauuucccaguucguucuaauuccuuccucccagagcuaaccauuuuucugaaguauccugugauuuuauauucuuauugcagguguaucuacaaguaauauauuuuacacuuuuauugcauguguauccacaaguaauauguaauuuauuguguguaaauuuuuuuuaauuuaaauaauauuaauaauauuuuucuauuucuuuagguuacaaacuuuuuuucaguuugugcuuuuacucagucuuacacuuuugaaauuuucucuguugguauauguggauuuugcucaucaucuuaauagcuguagucaguuguaugacuauaacacauauuagccauuccucuauugauggacauuucaguuguucccaauuuuuggcuauuucaaacaguaaugcacuagcauuuuuguccuuugucucauugugcacacauguaagaguuucucuaggucuaccuguaaaggcaggauugcugaaccauaaggcaugccuaucucaacauuagaaauaauaccaaauaauuuuccaaggcaguuguaccuuuuuaaaaaaaugguugcccugggauguggucucacuagugggacugcagguucaaagguuuaagcauuuugcaaacguguguguguauguguguguguguauauauauguacguauguauauauauauguguguguauauauaacuuuuauauaaaaacccucuuuagaacuaaauuugaccauauauauauauauguuugcacacacacguuugauauauauauauauauauauauauauauauauauauauauauauauggucaaauuuacuucccaagaggguuguuuuuucaguugauaucaccaacacaucagugcuaauuguuaacuuuuacuuuugaauuuuuauuuauuuuuuugagacagagucuugcucugucaugcaggcuggagugcaguggcgugaucucagcucacuucaaccucuaccucccagguucaagcaauucuccugccucagccucucccgaguagcugggauuacaggcgugugccaccacacuuggauaauuuuuguauuuuuaguagagacgggguuucaccauguugaccaggcuggucuugaacuccugaccucaagugauccgcccgccuuggccucccaaagugcugauuacagacgugagccacugcacccagccuaauuguuaaauuuuaauauguuguugauggaaauaauauuuaguugguggaaauuucugccucauuuucauuuguauuucuuacauaugauagggauuuuuauaauggaauguauguauauuuaguguauaucauuguugacagauugauuauucugccaauagaaacugaaauaaagaauaagguaauaauuuuuacuaaacuuacgaacuucuuugcaguacuugaaaauggcaaacaauaccaaagaauuagaagauugugagcaagcuaauaaacugggagcaauuaacagcacauuaaggcaaguuuuauuuugguaauauuaagaaaauauucucauugauaucaagaaucaauuuuuuaugauuuugguaaaacauuuucgaacccauuaaaguuuuaacuaauauauuuuuaaaaggaagaaaaaguuuuucuuuauccuaaauuucauaauagcuuugccucuucuuggcugauuuauccuuaaauuucuagaauguaucauccauaguaaaucuuuuaaaaaguagaaauuuacaagauuguucagcuaacaggguuuauggaucaauuuuuccugauuacuauggaagaaggggcuugaacuccuaaaucuuuuuaaauagugauugagucuggauguuacauuuugaaugauaaaaguuauuagccuguuaaauuucguagauuuuuuuucuguuaacuuuuccuuauuuguucuacacagaaaccagcauaaacaauauauaaauggccucaaauuguguaguauaaaaugacuagacauaaucaguaguugggaaugagauauuucagaaauuccuuuacauucccauuugauuagguuuguauuuaugagccgggcaugguggcucaugccuguaaucccagcacuuugggaggcugaagugggcagaucaccugaggccaggaguuuaggacuagccuggccaacauggugaaaccccaucucuacuaaaaauacaaaaauuagccgggugugguggcgggugccuauaaucccagcuaccugagaggcugaggcaggagaauugcuugaaccugggaggcggagguugcagugagcugagaucacaccguugcacucuaaccugggugacaagagugagacucugucucaaaaaaaaaaaaaaaaagauuuguauuuauguaccauaauugcuaaugacucaguauaaguuagcaauuuuauuuauugaagacaaaauuuaauauaggaaaauaaaagauaauaaacacccacauacauauccuccauuucaaauaaauaauccuccauuccaaguaaauaaauauuaacauuuuuugccauauguuuuaaggaacaagaaacaucacagauaaauuuaaaaucccuuaugcuguauucccuaauccaguagagguaacuacuaucaagaauuaguugguguauauccagucuguuuuuguuuuuauauauuuauauguauaaauaagauaguuuuauuuuguguauaugguuuuauuuuuccuuuguauaaaugauauccuauauuuaacauucugcuacauuuuucauuguacauuuugcuuucuagaucuguccauguugaaacacagauuuauucuuuuaacugaugaaugauuuucaucauauaaauaucccauauuuuacuuagcuauucacuuauugauggauguuuagcuauuuccaauuauuuacuuuuacaaacaugccaccuugagcauucccaaauuuuuuuucacauuagaaguagaauuguugaaucuuaggauugucuuuuuaauacccauucuugauauugccugaugacauuccauaguacuuggugugaauauauacugacuccagugcugacagcuuguaucauucucuacauccuuaccaaaaguugauaauguuuguugagugugaaauaguaccuuguuuuuauuuuauacuucguaauuacuaguggauuugagcauuuuuuauuuauuggacauuugaguuucuuauucauucaacaaaugaaugucuacaaugugccaagcacuguucuaggguacuaggaauccaguagcguaauggauaaaauuuccgcccucgugcaacuugauccuugucagaggaaauaacacaauaaacaaguaaaauauaugagaaauaaguaaguaaaaugaugaugaaugcuagggaagacaggcagggaagaacaaagagggcuaggagugagagaguggcacuguuuuaaauuggguggucagagaagauaauacaacauuugaacaaauugccgaagaaggugaaggcaugagucuuacuaugguuggcugggggaugagcauuccagguauauauaaauguuaguugaaaacccccauggcaggaucaugccuagacuuaaacacaauaagaccaauguaacugcagcacagucaucaagggcaaaguagcagaagacaaggucaaaagaugcuagggauggggcaggaggugggguggguagagaucuuguagagccuugaaagcaauuauaaugaguguuugcucuuagacuggguggaauaaaacucacagggagguuuugaacagaggaguuaagggcauguguugagggagccugauauguugcagaagccuuauuacgugauuaucguaguaauccaaauaagacauuauggugauuuaaaccagggugauagcaguggaaaugaugagaagcggucagguucuggauguauuuugaagauaaagcuaacaggauuugcugcaguauuggauaugugguauugagaagauaugagcuuuuggaugacuacaagauuuggaauuauaaaaauggaguugccauuuacugaccuguggacagcuggaggaggagcaagucugagacaaaguuauagucaaauuuggauuuguuaaguuugagcugccugugagacauccacuuggagauuucagguaggcaguuggauauacaaaucugaaauaggggagaggucuggaugucagucaaugaauagaugguguuuagcagccauaaaccuaaaugagaucaccaaggagagaguguaaauagaggaaugaucuagggacuaggcuuaagucauuggaagauuuugggguaaauugccaguuuauauucuuugucauuuuuuucuccauuggguuggauuuuaaaauuauuacugauuuguaagcauucuuuauauaaugugauaauucuuuguuggcuguguuguuaggauuuguccuuuaauuuugcauauaguuuuuuguuguugaacagaaauuauucuuuaaacuuaaaaaauuuaaguauaauacacauaugguggaauagaaaauucuuaaguguaaaggucaauguaacuuuacaaagugaacccaacucuauagccaccauccagagcauuauacuugcuguccagauuaccauguguacuuuccuagucauuaucaccuuccaaaguuaaccgugauuuugagauacugacagagauuaguuuuaacuguuuauaaauagaaugauauagaacauauucuguuguaucuggcuucuuuuuguuaacaugugucugagauucauucauguuuuugggcauaguaauguuuaauucuuuuuuauuggcacauaguauucuauaguaagaaugugccauguuuccauucugcucuugauagcuuaugcuuuggggccauuucagaaauauuuugguggauacaguuggacaugguggcucaugccuguaaucccaguacuuugggaggccaagggaggaggauugguugaagccaggaguucaaaaucagccuggccaacaagugagauccugucucuacaaaaaauuaaaaaaaaaaauagccaggugcaguggcaugagccuauagucccaguuacuugaguggcugaggcaggaggaucacuuugaguucaugaguuugagacugcaaugagcuaugauugugccacuguacuccccagccugagugacaaagugagacacuaucugugaaaaaauaaaaaaaaaauuugguacauacauauguauauuuuuauggagaauauaccuagaaaugagauuagguacugccaaauuguuuucuaaaauugcuaccaaauuauauugcuacuaguaguguaucaguuaucuguucuacaacuucuccagugauugguacuaugauuuuuaaacagcuuuacuuugagguauaaugaaauaugauacacugcauauaaaguauacaguuugauguuuugacauguguccacccauauaacaucaucacaauuaagauaccauagguuggguguugugucucaugccuguaauccuagcacuuugggaggccgaggcagggggaucaugugaggccaggaguucaagaccaaccuggccaacauggugaaaauacuacuuaaauacuacuaaaaauaaaaaaauuagccaggcgugguggcagacgccuguaaucccagcuacucaggagggugaggcaggagaaucacuugaacccaggagguggagguugcggugagccaagaucgugccacuacacuccagccugggugacagaguaaaacugugucucaaaaaaaaaaaaaaaaaaaaaaauauauauauauauauauauauauauacacacacauacauacacacauauauauacacacacauacauacacacauauauauauacguguauauauauacguauauauauacguguguauauauauacguauauauauacguguguauauauauacguauauauauacguguguauauauauacguauauauauacguguguauauauauacguauauauauacguguguauauauauacguauauauauacguguguguauauauauauauauauauauauauuuugacugggcauggugacucacaccuguacucccagcacuuugggaggccaagacaagcagaucacuugagcccaggaguuugagaccagccugggcaacauagcaagacccugucuguacaaaaaaauaaauaaauaaauuagcuggauguguuggcguaugucuauaguucgagcuacuugggaggcugaggauagaaggaucacuugaucccagaaggucaaggcuacagugaacuaugaugucagugcacuccagccugggugcagugagacccugucucaaaaaauauauguauauauuuaucacucccagaaaguuucucauucccuauuccaucuuuuaugcuccucauuucccaguuugaagacuacuacuuuaaccuugggacacuaucuugaaaggaagugcugaguuaaguccaagaaauucucaugcaaauaguguugcauccaucuucaaacugacauuuggaaaagcugaaguagauaaccucuaaggucccuucuaacucauuuauaaaucaaacugagccagcuuuauuagcauuagaugcacauucaauguuuuuucgggcuuaggcauggcuuuacugugguuuuaggcagggguuaggugaaagaaucagcaaagccucuucaaaugaggaugcucaaagaagaaauuuccugaaagucauauuguuaacaagaaaauaggaauuuguaucacuauugauuuguucuucacuacuuucaacauaagaucuaucuuauuaaacacaaguuuaguuaacgucauuuuagcuguaauuaggcauuauuguuuauggcaucacguauuucaguugggucaacugugauacaauauuuuuguuaauuuuuauuauauacucccauagggaaaaaaauuccacaguaaguugaacuggaaaaauguauugauaaaguugauguaguacagccaagcuuauacacuucuuuguaguggcuucucaaauacaaaacaaauucuugauuaugacaguaccacauuuaggaauuaccugauuuuuaccuuuauauaccugauuuauacaguuuuuuguaccuuguuuuuuccuuuuguguuaugaauaaagaggguagcaaaaugaugccucucugauagauacuaccaucaugaguauucaauacagagaaggccugaauauagguucaaguuaauguagaucaaaguugauuucaaggaauguaguuguuacuuaucaguucuucaaguuagaaaucuugaucauagauuuuguuaaauguuaacuaggcugugaaacgagugauacaccaugauaaaaguggcauuguuguaaccagugaauaccacauuggaugggagauuauagaaauacaguuauugguauuuuagaucuuguaaguauagacacaauuuaaauuaaaagaauucugaaaauaaauuuaauuacuucggaaaaaauacguuuaacguuauaauuucuaaguuaauugaaaaguuuagcuugaguuuuguguuuaacuacauguuauauguauuuacaaauuaauuucuccuugaaauaauuauuauugacuaguccuaauaauucaguauaguuaagaaauauaaauuacucaaggaaauuaauacauauauuuuccuauaacuuguuuuuugucaucccuucauguaaucacuaauagcagaauugugacaucaucuaaucuuuaacugaccucagauuaucuauuuuaauuacacuagaauacaguauuaaaaguuucagcuccaaauuuaauaauuuuucuuuuuuauuccuccuucccauaguaaucaaagcaaagaagcuuucauugacugggcaagauaugaugauucacgggaucacuuuugugaacuugaugguaauacaauaaacuauuauaauuaaauuauuuuaacuuuaacccuuuuauaagacauuuuaaucaaugaaaauauaaacugaauuauagcuucaguacuggauuuugcuauguagaccuuauuauucauaauggcauuuauugagagccuguguuccaggcccuauguuaagugccuuaaauacauuauuucuggucuuugcagcuaccuucauaaguguguauuauuucauaucugagaaaacugagucugaaaaagacuaaauaacuugcccaagaucacacaauagcaagaggcugaggcaggauuugaucccauauccgaauccaaaaccuguauucuuuccauuaugauauaccaucugccauggaccuucaauugaagccacuuaguuauaggucugugaacauuuuguaaaaauauuuacacuggaauuugcuagaggucuuaacaaacucauguaaagaugcuuucuaaugcuggggaggacucuaauucgacuucuccacagcccuuuuuccaagaguccccuggaaugguagaaagacuggacacucuccaccagaguaacuaccacuucucuuaacagaagguaauugcagugacucaaaauuuuuuaucugugggauaauauucccaaagaauugugcugaguaggcauaaaucauucauuuaguuucucuucaccuuuuuccuugguauuguuauauuuuucacaguggaaaagaauuuggggauuaagugugcauaguuggaaauaguaguucuuuggaacucuucaaguaucuagaaugcucugcuuucuaaaguuuuaaaaaagauucacggguagaauugugcuauaaauccagcccauaguggaguaaguuagagugagcuucuacgauaguaugguaaacugagaauaauacugggagauggaauguuaucuuggcuuauaugguuucaguaaggaaauuuuaaaggaaucugagugagguuauacuaagggguaauuaaugaaguaucuguccucucuaugauauagagaauugguaaaacuuuuaucaaagcaagccauugaaccucuccuuucacauuugcucuuugguugccauuuauauuugagugcuuaacacucauagucauuuauuucuaaauuguccauuuaccuauucuuugauuaaaguauaaauaauagugcuuauuuaauagguuuucaaauuaauaauuugugugacuauauauuacucuuaugguaaauagguauuuaauaaaaauacuuaauugcaggaaguacuugcuauaaauaaauugauauguagauuaccugccaucaguauaaacaguguuaacgauuuuuuuuuuuuuuuugagacagagucucgcugugucgcccaggcuggagugcaguggcacaaucucggcucacugcaagcuccgccccccagguucacgccauucuccugccucagccucccgaguagcugggacuacaggugcccaccaccacgcccagcuaauuuuuuguauauuuaguagagacgggguuucaccauguuagccaggauggucuugaucuccugaccucgugauccaccugccucagccucccaaagugcugggauuacaggcuugagccacugcaccuggccguguuaacuauuuuuuaaaauauuaguuucuuaaauuguagaaaguaagaaauauuuuuuaagaauuuacaugaaaucauccccuuaagauuuucaagauuauauuuaaaaucaauuauuuuuauauucuuauaaaaccaugguaccuacuaauugguuuaccaugacucuucugaguuguaauguucauauauauuccaaugguuuauaugcaguuuguuuuugauuuguuuuguuuuguuuugagauggagucucacucuguugcccaggcuggagugcaauggcacaaucuuggcucacugcaaccugucuccuagguucaagcaauucugccucagccucccuaguggcugggauuacaggcaugcaccaccaugcacagcuaauuuuuuuuuuuauuuuuaguagagacaggguuucgccauguuggccagguuggucucaaacuccugaccucaggugauccgucugccuuggccucccacagugcugggauuacagccaucagccaccgugccuggccuauaguaguuuuuaaaauuacugucaggguagcuuuagaaucauuguuuaguuauugcuguuucccaaauucaguggauuaaaacaaaaauauaaagaauauucacccaguuuacuagggaauauguccauuuccugcuguuuugcuguugauaaugacuucauuugaauggaagaugaucccuauagaucaaauaguaguuuuuaaaauaauuuaguaauuuaauauccuuuaagguaaacugcuuucccuaccacucuuuuuuguuguuguuguuacugucuuuaucauggcuugcuucuuguucauguuucuccucaaaugucacuuuaucagaaaagccugcucucaucucgcuguguaagauaguagccacuaucacucccugucccuuugcuuugauggcccccacccugcccaagcacuaacaacugucugacaguauauggcauauuauugaguguaucgguuucuugucagucuuccccagcuagauugugagcuauuugagggcaagggcuuuguuuuugguucacuaauguaucccuagugccuagaauggugccuggacgugguagaugcuuaguaaauacuugcugaaugaacuaguugguucauaaaaagccuaaauagcaugauagauuuuuaguuuuauuuuuucccuuaaaauauguucauuaauaaauuuaauguuuaaaacaguaguuucuaaaucugguuguguaucaaaauuuuuugagagcuuuauaaacuguagcuucuccuugacuguaaaucauguuuuaauagugaguuaguagcaguuugggguaggguuggugauggagggcuuuaagcuuaauccugagucuauaauacaguauuuuuuuaucugugaccguagcaaagagcuugcacacuaaguuguucuguaugcuaccauuaauguuuaagagauauaugaguuaggaaguagggaggaaaguuuaacauccuagaaaaugugguaugaccucauaacucuauuaaauuaggacaguggaaaggaaauucaguuagaaaaaaaucguauacuuaaggccaggcacgguggcccaugccuguaaucccagcacuuugggaggcugaggcaggugaaucaccugaaguuaggaguuugagacuggcuuggccaacauggcaaaacccugccucuacuaauaauacaaaaacuagccaggcguggugguacaugucuguagucccagcuacaugggaggcugaggcaggagaauugcuugaacccgacaggcagagguugcauugagcugagaccaugccauugcacuccccacugcucaacagagucagccucaucgcaaaaaaaaaaaauauauauauauauauauauacacacacacacacauauacacauauauauauacauauauacacauauauauauacacauauauauacacauauauauauacacacauauauauauauauauacuugaagaggaggaaauaacacuaguucaacuucaugaauuccaagaauaaggaauuaugaagcugcuuuguagaggcagaaagaagauaaaacuuuugugggagagggucauaguagagggccagauaauuuagagagaauuaucugaaugaaugacgcagcugugcaaacugagacaaguuucaguugaacaaaugaaaaucagugucacagauggcccagggauaaggaugggcacuaccagcuaguguguuuguagagaacuuggccuguagaugcuuucugccacacacguugcucacucuggaugucccaugaaauucuugucaguauagagcagagguugguaagcuuuuuaagaaaauggacuaaugguaacuauuuuaggcuuuauagacugacuauagggucucuguuggaauuacucaucucugccauaauagugugaaagcaguauguaaacaaaugaacauggcuguguuccaugaaaacuuuauuuacaaaaauaagcagcaggccagauuuggcacacaagcuguaguuugcaaacuccuuguauagguuaacaaaacccacucuuuucaugauuugaaaaaguauuacaagauuuuuuuaaaaaguauugauuaaacuaagggaauaaacauuaagaacauugaaaauguaaguuuuacuuaaguaguuauaaaaccugauguaauugagcugugugucguggugagcaccuggagucccagcuacuugggaggcugaggcaggaggcuugcuugagcucaggaguucgaguccagccugcacaacaaaguaagaccacuuuucuuaaaaaagaacaaugaaaaaccugauauaauugauuuuccucuugugauuuuuuagcucccuuaaaguauauuuuaaaucaucaugguuuaauaucugaaucaugguuuuucuucuuuauugguuauuugguugguuuucuugggaaaagagguugguacuaguccaauuugcacguuuguagaggauucuauacacauguaguccuacauguacacacacauacacaaauuauuuauaaauauauaauauauaugugucagagaacauaaauuaauguuauauugugaagcuuauauauaauucaguuuugcagaugaauuuauucaagagcagcuuauggagauuaaaacuauacaacuuagaaauuaaauacugaauuuuaagauuuuuuuucuuuccuaaaagccauacuuucuuuuuuuuuuuaaaaaaaaaaaaaaaaaggcuguugcccaggguggaguguaguggugccaucauaguucacugcagccuccgacuccugggcucaagugauccucccacuucagccucccaagcaacugggacuagaggcaugugccaccaugcccauaucaaaagccauacuuauacuucauaauuugaauuuuuauuuuaaauuaagauuuuaaaaguuauuguuuuugagcccugagucaaucuguguucuuggacaguuuuuucuauccaucuguaaauuguuuuccuugccuugcuuuuuauaguggaguaucuuuacaaauuuagagcuagaaauagagccaguauucuuauagucugcaaaaucauguuuccauugucuaaguuauauacaacccauuuaauacaguaaauuguuaguuauccuuguauucuuccuacaucaugaaagugccaggcagguggaucaccugagaucaggaguuugagaccagccuggcuaagauggcauaaccccgucucuacuaaaaauacaaaaaaccaaccaggcaugguggcgagugccuguaaucucagcuacuugggaggcugagacaggauaauugcuugaaccugggaggcggagguuacagugaguugagaucucacacugcacuccagccugagagacaaagcaagacucugucucaaaaacaaaagugccagguaauucuuggaaggcauggaucaagaugcuguuuugcccuugugaucauggauaaucccagucuguggucauugacuguccagggaauacuguuuacugacaggaaaauauaccaucagguaaugaaagagagacauuuaaugaccacauuugacuccuguuuuaaaccagcugccucuguacuauuguuuaaauucaugacaacaaacgguaguaagcauauaaauaaaggaauauacgugugccauauauaacacuugagcaucuauguauuaugagcauacaugugugaggcauggucauuauaauuuuucuuuagcuaugaaaagcacguuucccauuucuauucagaaugugagcuucaauaauuaagauuuuuaaaaucuuuuguauuucucagagaucucaauuaaaauguccaaauagggccgggcacaguggcucacaccuguaaucccgccacuuugggaggccgaggcagguggaucacgaggucaggaguuugagaccagccuggccaacauagugaaaccccgucuuuacuaaaaauacaaaaagccagacaugguggugcgcaccuguaguaccagcuacuugggaggcugaggcaggagaaucgcuugaaccugggaggcggagguuguggugagcugagauugcgccacugcacuccagcuuaggcaacagagugagacuccgucucaaaaaaaaaaaaaaaaaaaaaguccaaauaguggagaucgggguaaauacucauuuggguuucaauauggaaaaugguuauuuaguuuuaaauauuucaacaaguuugugaaaguugugccuacuauguuuuaguuugagagcaaaaaaaacacuucaauauguugacaucaguaaaaauaguaauauauaacuuuuaaaaacuagagcaugguauagcuuuaugaauaaucagauuuggaucacaaaguuauggagccguuuacuucaugaguccaagcagagaguagcagggaaaucucuauuuuuaauacaauauauguuacaaaauguuuccaagugcgugguuagguggauauauucuuagagaagaaaucauaugaaauauuaaagcagguuaugauucuguuuggucuuuucaauccugggugguuaaaacuuaagaaaugauucaugucucuaauaaggugaaggggauguuauauuacuuaaaagagcacugcguauccaaaggaaauggaagaguuguuuuuucuucucuuaaggaauuuguccaaguuauuacaaaucuugcaucaaguacagucacaaguauacuaaccacuauaccauuuaaguuggagauuacuugaaaagcaugacauuuuucuuaccuuugaguaguccgguuugcuuuguacuguuaaaucuuagauaaauggugaaauauggaugguuuuuaugaauuuuuucuuguucagaugagagaucuccagcugcucaguauguagaccuauugcugaacccagagcguuacacuggcuauaaagggaccucugcauggagaguguggaacagcaucuaugaagagaacuguuucaaguaacuggagggggugggggaagaaggaacgacugauagagggucgggagaggccgggugcuguggcucacgccuguaaucccagcacuuugggaggccaagguggguggaucaucugaggucaggaguucaagaccagccuggccaacauggugaaaccccgugucaacuaaaaauacaaaaaaauuagccgggcaugauggcaggugccuguaaucccagcuacuugggaggcugaggcaggagaaucacuugaacccgggaggcagagguuacaaugagcagagauugcgccacuguacuccagccugggugacuaagugaaacucugucucaaaaaaaaaagaggguggggaggggaguauuuguuucuauuggaauaaaauuauacacuauaaaaguuaaaacauucuauguuuggguauuaugcuuucuuuuucaggccucgaucuguuuaucguccuuuaaauccucuggcgccuagccgagguagguuuuucauauguacauuuucaugcuuuucauuguuuauaaaaugucuuuauaacuaaacuucauauugaaaaaacuuucauuuuuauauuuuguuuaauuugaaugaugaacaaaaaguguaagauuaguucauagucgagucucgagaucucuaggcauguuguuuuacauaauuacugucauuuauugaaugccugcucugugccagacccuaaacuaggaaguuuauguaaaauaauuaaaauaugugaguaaucaauauauaucaaagauuuccuggggacuuauuaaaaaaucugguugcucaggcccuacgcuauauuaauuaagucagaauccuuggaaugagaacaccaggcauuguuauuuuuuaaacucuccacaugauuccaguaugcaaccaaguuugacagccagugucucguaacagugcuucuagacuucagugugcauacacaucacccaggagccuugguaacauacagcuucugauucuguauuucuugggagagguccaaacacacuccuaggugcugccucaggugccgacucauguaccacacuuucaguaggaaaaauguacaacaauuuuagaaacuuuagcagugcucuauaucuguacuguccaauaaaguaaccaguuuccacaugggacuguggaacacaugaaauuuggcuagugugaaacugaauuuuaaauuguauuuaaucuuaguuuauuuagauguaaaaacuauauuguuaaacagaaccuuauuguuuugguaagacuacuauaaccuaugcgucauguaacauauuuuuguuguaguguguguauacuuuugaauuuuaaaaauguggcuauuagaaacauuuuaaguuaacacucguguguggcguuauauuucaauggaacagcauuacugucaucagugggauacauccucagucuguucucagugaggaaccaaacccugggagcaacucugucauugaccugccauuccaguguuuucuuuagacggggaguguuuuaagaaauuugauuuccugaucuaaauuuguaucuuuagaccuuucugagaaccaaauagacuuggaaggguugacugcauagacugcuuuuucaugcucacucugucacaauguggcaaauacuuguuuuccccaaauucacauugaaacugccuggagaaggaaguugguccugaaaaagacgugccuggcuucuuauccuuugucucuuuuacuacuuuugccucacaacuuuucuauuuucaacuuaaagguuuuaauuaaacaaaauuuuauaaaaauugaagcaauauaguaguuauauaaagugaaaagggaaagcucuucuauuccauaguacagaguuugaaagguguucuuccagaccuuuucuacagccacuuaauacuuuuaaagcagaaaauacaauuuuuucacuuaagaaaaccaucaaguccuaagaaacacuucauuuccauguuagugauauaucagagacauaacacugcugaaaagaugaggaaaaggaaacuacuacauagaaaaagaggaagggaagaggagaaaagaagaaaaaugaaauaugaaagaagacaagacuagguaaagagaaugguuccuagcuguuauaggaguacucuaugaaguaauuaauagcucuugcuguugcuauuuaccugcuaucuccauugaaauugguugauuaauaguucuuuaaucuucuuaacucuuucuuccacauuucugagucauaaccccuaggcuuauacaacuauuuucuaacagguuuugagcaauaggaacuuuuguccaaaaaugaaaucuuauuucagaaccuacauaauaaagcugauaggcagagcugcuguguugcccuagagcccaaccucuggccucuuccucaccucuaggccuccuggaagcagcaccuugcccaaggguuucacugauuacaguuugggauauacucuuacuaaggccugucucugcugaggagcaguaauuuaaaagagaaaaauauuccagguuggaaacaguaauguucagagaggauugugugcauaaugauuaaaggagcaacuuuauguaguaauuaauuaauuauugaaaauaguggucuuuaugacuuuuuaguugcuuucugauguuauuguauuuuaaaaugugcaaaucuuuuuuuuuuuuucuugagacagagucgcacucugucacucaggcuggagugcaguggugugaucucggcucacugcaaccuccgccuccuggguucaagcaguucucugccucagccuccugagcagcugggaugacaaggugccggucaccacgccuggcuaauuuuuuguauuuuuaguagagaugggguuucacuaucuuggccaggcugaucuugaacuccugaccuggugauccucccaaagugcugggauuacaggccugagccaccgugcccagccuucuucuuuuuuuuuuuuuugagacggaauuuugcucuuguugcccaggcuggagugcaauggcgcgaucuuggcucacugaaaccuccaccuccuggguucaagugauucuccugccucagccucccaaguagcugggauuacagguacaugccaccaugccuggcuaauuuuuguauuuuuaguugagacaggguuucacauguuggccaggcuggucucaaacuccugaccucaggugauccacccaccuuggccucccaaaguccugggauuaccgccgugagccaccacgccuggccaaaaugugcaaaucuuauacucuuugaccuguauucugauuaagaggacucauuugcagggcgucuacucagugaccaagguuugugauauaauuaauaguuuaacaguuuuaaucucaaaaaauaguauugggaucugagcuauguaagacauuuucuaaaaucuuuucuauuauuuucucuuuuaggcgaagaugauggugagcaaaacucauguuuguuuguuucaaguguggaggaaauuuuuuguaacaaucagaauuugauuuuuccuuuauggaauucaaaagaaaguauuccuguuuucuaagaaaauagcuacuaaugaauggugaccaaaaaaaaaaagauuauuuuauauauaucaaguuauccuauguuaaaaaaaaaagaccauuuuuccuaaaugcuuaguuuguaaaucaauucacauuacaaguuccccauuuucugguuauuauauaauuuacuugaauauguccugaggaaguggggagaaggaguuaagguaguuuuaccagauaauuugucuugugaccucuuuauuuucuuauugacugaaauuucuaaccucagguaucaauauaauacuuaauuugaugacgagcaauuuauuaacaauugauuauugaaugaauguugguuaaaagauacccccaaaauagccaaaauaauuauuucaacugaauguuuaccucucuguguucaggggcacugaugggcauuguccaggguaggaagauguuuaaaacauggugcuuucccucuaggagcugaggauauauaggauaguaggaaagauaagcacuguacauaaacaaugguaaugagguaaagaaauacuccauagaugguacaaacaguaggugauauauauagcuccuuagaggagaaacagaucguaucucacaggagcgaugugggaaagcuuacuggaggagggguagcauuugaggugaauuuugaauaaugggacagauuuagauccguacaauuggauagugcauguuggaggaaacagcaugcagcugggaguugagacaagucaggcauguuuggggagacaguaaagagacccuuuuagugguagguaagacuauauagugguaguuuaaauuagauugauagaggccauauuuuuuaguacguuggguacuagacuuuuccuguuggcacuugagguguuuugaaucacaagugauauaaugauaaaugauccuuacuauauguugaaugaauuaauuuguuagacguuuucauuuuuguacaaaguaugaagacucucaggaggcaaaguaauuccccaccgucuaguuuaucccuagacuccuuacucagcucaucugaguguucgguuuuucuauaauuucuaucauucucaauuuaaaaaaaaacaacaucaaggauagguaacgcaggaagugcauuaacaauuuugauucuuauugacugcucucuuuucuuucucuuuccccaacucagaagaagguuacagggccaggaaugguucuuuuuuuuuuuuuuuuucaaguguuuaacauguuuugaaauauguauacauuguggaauggguauauugagcuaauuagcucacauaccauuuuuuuggcgaaaacacuuaaaaucgcagcaauuuucaagaauacaauacguuguaauuaacuguagucagcauguucuacaauaaaucucuugaacuuacugcauuucuuuaacugaaauuuuguaucccuugaccagcaucucccugaccccaggaauguucuucagcauuaguacacagauuagucaagcccuucuguauucuauuaacuuuccugaagaauuauauugaaaauuaagagauuuuuuagcugucccuuaaaacuuauuagucuuagaaaauugaggaaauauuuuuaguuuuauuggauuaggaaaaauggaauaaucaauaguuggacguuuguguuaauuauaauuccuuauuuucuuggaauauuuaaaaagcacuaugguuguuaugaaaagcaaauuugagaucguuaaaauguuugcccuauguuuucagauauuuacaccuucaaugaauaagauuuauauacuuuuuuuuuuuaaaagaggcaggaucuugcuauguugcccagguuggauccgaucuccugggcucaagcaauccuucccccucaaccuucugaguuaacuggggcuacagguccaagccacuguggccagcucauauuuugacugaaauguuuucuuaaaaaauuuaauagucaaaauauuuguaaaaacacucucuuaaaguuacuuaaauuauuuguagguuuuauuuccuagaaccauaugguuauuuuucuauuuuaccugaagcaguagacauuuuagagagauuacuuaaucugucauaauuuuuuuuuuuuuuuuuuuuuuuuuugagacagggucucacucugucacccaggcuggagggcagugguaugaucucggcucacagcaaccuuagccuccuggguccaagcaauucuccugccucauccucccgaguagcuggauuacaggccugcaccuccauacccggcuaauuuuuuguauuuuuaguagagaugggguuucgccauguuggccaggcuggucuuaaacuccuggccucaagugaucagcccaccucggccucccaaagugcuaggauuauaggcaugagccaccaugcccugcagaaagauuuuauaaaccuaauuuauucuacuuuauaaaugaccauauaauguuuuaauccacuuuucucucucucucaggagaaucauucuacacauggcuagaagguaaacagucuguucuaaauuuauuggauuuuuuguuaaaaaauacugauuuauuuagcauauuuuuguaaggucuaggauuuuauuaccuagucaacuaauuuugacaguuugaaaaaaaaaauguguuuuagguuaacauauggggauaaaauuaugugaaaaguuugaagauaguggucagcuaaaaaccagguuuauauaaauacacaggccaaauacugucaucagguuuucauaacugguucccuaaucuuauuucuguucuguauguaauguucauucaaacuacuucucuaguaacgaguaugcaaaauauuuuaaaaguggagacauuccuuuuggaaggaaguacuuuuuauauauaaaauuaauggaagauaaauaugaauucaaaagauucgaaacauauuugccacguuaauauagucuaaccuugucugauuaaaagauaaagcaauauagauccugauauauuagaugcuuuugcauucuuguacuuccaguguugaaaauaucaaaugcuauuaauggaaaggugaaauguuguaggauuuuaauaacucagguuaauaacuggauauaugaugcuuuuaaaaauuuaccuuaccaaauugccauuaguauaugaaauuaaaaauuaaaauauauuaguaacagauaagcaaguagaaugacauaggaaaauugauauuucauagccauaaccuuauaggaauacuacagaguaaaacuaauucuauuuuaugcaugucaauuggucauguuaucuuaugaauauuauuucuuuuuuuuuuuuuugagucagagucucgcuguugcccaggcuggagugcaguggcgccaucucggcucacugcaaccucugccucccagggucaagugauccuccugccucagccucccaaauagcugggauuacaggcacccgccaccacacccagcuaauuuuuguauuuuuaguagagaugagguuucgccguguuggccaggcugguuugaacuccaggccucaagugaucugcccaccucagccucccaaagugcugggauaacaggugugagccaccauaccuggccuauuucuuuguuuguaaugaacuaugugcauauguuggccauuauuaaggugaacauuauugaugugcaaauucuguuaggaguuauaugagaaaaucacuuauguagaagauguuuagcuuuguuuaauaagcucuacucuaaagauacaaauugugaaaaguagcauuuaggcuagaaaagguagucagagacucugaguguuaguaaugagaaugaaauuuagaaacaauauuggauucuauguauauuauaucaaccauucuuccagucuuacuguuuugaguaucugaauauugauacaugguuccaaagagcauucccuuauaggcagcugacucaaccuuuucugagauucaguuuccucaucuggagcguggagaggagcaauagcaguccuacuuacacugugaguguagaugauuccuguaaagguuccuuuggaaaccacaaauccacguccaaaugccaaauauuacuguuacaguaaaugcaaccccuuucugaaaguucaagugcugaaaaugcauuuuaaugaaauuaaaucgaaaagaggaagaagagaaccauuuucuaaauuguguaauugaauugcucuauguuguuagaaguugguggauucugccuugguaagucagcuuuugcagaugucacuucagagugagauugagaaggcuuuugccuggaccucgguaauuaaagauaccauccagccuggcacagacuguguguaggccaggagaagcucuccagcaauuuccugcuaaguguguugugugucugggugcacuuacuuggugcauauuuuauuauuaauuugcuuaaaguuaccuguuuuucacaguuuguggaaauacauuucuauuccucuccccucacuuauccccuaccucauugcagugguaggggcuuugugggcuuugcaaauuauaacugccucccaguuuuccagguccugguuuguaggcauauggauuuucaugaguuuugcuuugcuuacugucccuucucuugucuuuauccauuuuauuggacauaagcacugcuuagagagagagguugggaagaaaauaaagugaacuucaaaucugauauuuuguuacuugauaauagaucugaugaaaaguuuuaguagaagagaaguuaguacuuaauguuguauuaaauauauucauauuguuuguauccauuguuaucguaaacauucaaaauugucauauacuuuuagggaggaagcuacaaaauaaaauucaauuucuuuugguccccauccaugacaauuugaauauucuagcaagaauucccaauuagggaacgagaacucaaaagaauuauuuuuucuaguuagaggccacgugcuucagaaucaucugugauaggacagaaagagagagugaauugcuggaaaaucuuaauagacacaaagaaaaccacauacucuuacauuaaaaaaaaauuucccccaucauauaaaugagacuauuuugcuuuccacuauuaaagcccauuuuccugcauggggaaaguguuaaaaaccuguuggaugaaggagggaaaagcucauggccguguauccagugacuucuuaaaauuuucugcauuuuuauuuauuuaagaauuuaccaucuuaaucauuuuuaaguuuacuguuuaguggcauuaaauacauucacaauguguauuacuccuauuaugagagaaaaucuuuuaaaaugggggcagggguuaggauaggaugacgggauaucuugaccucuuaaguucucagcaaaaaagccccuguggcuuaagaaggcuacaucaaauaacguucuguuauauuccuguacuccacugauaugauuccacugaaguaguaaacagucaacuuguuguucuuuuuuuaauuaguugaaauuccuggauuucuguuuuccaaguuucagcuccuuacaaguagaacauaugguuaaaaaauuagacaauuucagggcagaagguuaauaaaacccuuauuucucugcuagcaaauaacacauauaaggaagggggaaaaauccagcagugacuuuauaauuacauuuacuucaguaaguucuuagccuaaaccacaagaaaaccugugcuguugcugucuaacaugggaacuugccaacuuuauccauaguguuuugaccccuaguugcucaaacuuuucugcuuuuuucagcauuaaguucucaucauauucaguuaacuccauucugaagccaaaaucuuacuuugccuucuagugagagaaucuugaucuaaucaguuuuauauuauuccuugauuuauuuuaauguucuucaaucaaaaauaagccuacauacugaaccuccuugagucaauauuucugauaucuaaauagguguaauuucuuuuucaauauuuuucugaauagguuugugucuggagaaaagagucuucuauaagcuuauaucgggacuucaugcuagcaucaauuuacaucuaugcgcaaauuaucuuuuggaagguaaucauauuuuuaagucgagauuuugccuucuauuaguguaaaaauuauuggagagaauacauauucuuuagagcagaaaaaaaauccuguuuacuaaaacaauguaauguauuucucuuucucuuuagaaaccugggguaagcccaguuggggaccuaauauuaaagaauucaaacaccgcuuugacccuguggaaaccaagggagaagguccaagaaggcucaagaaucuuuacuuuuuauacuugauugagcuucgagcuuugucaaagguggcuccauauuuugagcgcucaauugucgaucuuuacacuggaaaugcagaagaagaugcugacacaaaaacucuucuacugaauaucuuucaagauacaaaguaagaauugacuauccgugauuugaaauucuccucucuguauucaaaugagguagcacuuaaaguacacaaaaacugacuccuaaaaguuaaccgaggggagauguagaacagaaaaggaaagugaucaauagaacaacagaauuuaaaaauauuucugaaaauguugaugaaaaagcauuaauaaggcuuucuuuugcagaaauuuucacacuugagaauagugcuuuaaaauaucacuaaauuuuauguaguaucaaaauuuagugcuacuuuaauggucuuucuaccaauuuuguauucuucuagucacuuuauuuacuuacuuauuuuugagacagaggcuugcucuguugcccaggcuggagugcaauggcacaaucuuggcucacugcagccucugccucccagguucaagcaauucuugugccucagccuucuaaguaacugagauuacaggugugugccaucacacccagcuaauuuuuguauuuuuaguagagauaggguuucaccauguuggacaggcuggucucaagcuccuggccucaagugaugcacccuccucugccucccaaagugcugggauuagaggcaugggccaucgcgccuggccucuagucacuauauuuaaauuuagaugauaauauacauguguuugcauugggauggauauguaaggaaacauuagccuuaucuucuagaauauaaccuuuuaaacaaaacgcuuggucaagaaaacuugaguuaacugguuuuuaaaauagccuggaagagaaagauuaaaaaguguuuaaaguaaauuauguauuaaauuuuuaaagaauauuaagggaauauugccuauuuuuuacauagauuguuuucaguuaauuuuuuagauuaccugugucauuuauuuaaaacauuacagucuuacuaaauuuaacagccaucugugucuugcuuuagucuuuuaugaaauaguuuaugugugaacuguuugucacuuuucuacauuaccaaaacuuacaucggaguaaauaaugaauuuuaaauauucauaaggauagaaaauuuuaucagguuucugauacagaguacguggauuuuucauguguaacuuaauccaauacuaucauuuuaucagguccuuucccaugcacuuugaugagaaauccauguuugcaggugacaaaaaaggggccaagucacuaaagguaaaaaguucucgauugggacacgggguugggagcaguuugcugguuaugcuuuaaugcugugcauccaaacuguuuucuuucccaguuuuccagcuucuugucagaguuggucugauuggauuuuaauacaaaugguacaaaaagccuuuccauauuucucaguuccauugaccaacugcuuagugaaucauuggucauuaguauguccuauaacaccuuuauaaaugucuuuuuaaaagauacuaguugagggaaaguuuucuuaguuuaaaagcaguguauauugucguuuugaugcagcuuucagaauaccaugagcuuuuagccacuuugaggacaauaaauauuuuucuaaaguuuauuuuauggaauguuacgguuuuugaaacauauauuauguuuuugucccuuuggacuaacuuaaaagguuaaaacuaccuguuaacaugugacaucagaaggagaauauguuuugggaacauuaccaaacuucauguuagguguucuuuauuuucauuugcuuaaaguacauuaagaaacaaauuguacccuuaaaauguucauaaaaguauuugaaauuggcauuuuuuuuuuuuuuacuuuuaaauuuauuuuuugagauggggucucgcuauguugcccaggcuggucucaaacuccuggcccugagcugucuucccaccucagccucccaaguaccuaggauuacaggcacaagccaccauaccuggccacaaauaaucuuugaguacaacuucauagucuuuuauauguacuucugaaauccggguaguuucaaaaacugaaacauuuucuuauguuuagugcaagguaauuuuuuagcaaaaccugaccuaaacugguguaagaauauagcagauauucguaguuuugugggguuguuuucaaauucugcuugguaugaauuuuuuauauuuugcuacagaaacauuaacggauuugacugcaggguguuuccucacacucuggugagauguuucauaauauacaguacauguacuguauuucuaaaauuuaaaaacuucugaauucuaaaacacauuugaccccaagauguuuuagauguggauguacuauaggaaccaauaaaucaauacugagugauucuccuuuggcgagacuuucuugguauuucugaaauaaguaauuuagucacaacuauauuuuaguguuggaagguuguuuuauuuuacaguuguuuuagagguauauugccauuuugguauuuuguauguuaauucauuuuuauaaugcuuccuguuuucuaaguaucaacacauauguucuacuuuuaaucuucagaaugaucuuguguaauagggcaacuauaauuauguauguuuuuguagaugaggaaagugagacuaagcaaagccuaagugucucacagcaagcuuuuaacuacacaaugcugggauuuuguuugcuguuugucaagaauguaugaaggagaaccuaugucccuuuuccaucugcugcaaagaacuuacauuacaugagaauaugaccagcacaggaguuuuuguguucuauuuauauugucuuucuuugccaagguauugauuccuuucaacccucuggcagcuggucagggcuugugguagccagaguuuucaggcuacuugccucccgcuucaugcaauaaaauauuucccucaaugcaauaaaaugauuuuuauuuucugcaguugccaugugaaacaaaugaggaaauuuucucuuaaccaaucuuauccgcagauaaagugagaccaaccuuaaaggcauauugcacacaaaugcuuauaggcagaagaauuuccccaguguaggaaacuucucuuuuuuuuuuuuuuuuuuuuuugagacagaguuucacucuaguugcccaggcuggagugcaguggugcgaucuuggcucacugcaaccuccaccucccggguucaagcuauucuucuuccucagccucccaaguagcugggauuacaggcaugcaccaccacaccuggcagauuuuguauuuuuaguagacaugagguuucacuauguuguuuaggcuggucucaaacuuaugaccucaagugaucacaccuuggucucccaaagugcugggauuacaggcgugagccacccugccugaccagugugggaaacuauuacagcaaaauagagggauccaguaagcaucuccauaacaacugcauuagcaaauguagaggacugugggaccauaugugucacacaggccuguuaucauucauauugauugagcaaccaugacaaacauagugugguacuaaggagugauacaaaaauugaucauuguucuaggacuagcuuucugauauaggcuuacacaaagcaaaggaucaaaaauaagugaaacauaaacuagacauauuuauuguugguuguauguagauaacaaauggaagcagcaauuaaguuccuuaaaaguaaagaccauguauuauuuacuuuuguaucucccauagugcauauuuuggugcuuugcauaaaguagcuccucaguggaaagugaauuaauaugcagaaugaauuuuauuaauuuccauuaaugucaguauuuuauguaccauguuauaguauacaaguaucaaguauuuuucuuuacuguugaaaaacacaacucggguuggguaugguggcuuacaccguaaucccagcacuuugggaggucgaggugggcagaucauuugaggccaggaguucaagaccagccuggacaacauggcgaaaccccgucucuacuaaaaauacaaaaauuagcugggcauggcggcaugcgccuauaaucuaagcuacuugggaggcugaggagacaggagaaucccuugaaccugggagguggagguugcacuaagccgagauggcaccacugcacuccagccugggcgacaaagcaaaacuccuucucaaacaaacaaaaaacacaacugauuuauuaauaagcaucaaaacuuacuuaucguuuagccaaaugcgguucaauuuuaaaagucuaauuagacugaaaauauuuucugcuugcuaggaggaauuccgauuacauuucaagaauaucucccguauaauggacuguguuggaugugacaaaugcagauuauggggaaaauuacagguauauguguugucuucucuuuugaagccauuacuaaccuuuauuuuuuccacugaguccaagcuuuuuauuaaaauguccucauuguucauugaauuagaauuuaggaauaggcagauccaagguguuuuuucuguugaugaaaaaauuaaaguauauguguuacauguaugugaaaggauguuucucauauuauucuuuagugauuuuaguuuuauugugucuauguuucuauugauacaauaccagauucauuugugaaguugguggucauuacgaaccgaguauauccguauuuuacauauguauauagaaagguaaaauguaauuacauaaaaagauugaaauaugaagucuuggucauugaauuuguauaaaugagcaaaagaaggucacuuagucaaaacaggaaagcuccgcaagacagguccauuacucuguguaagccagugucaaaaggauuguugaauauuuuaucucuuucuaacaaagaugguaacuuauagaaaauuaagagacaaaauuauuacaguggaggcuauacugaaauaaaaugucuuuuucuauagugcuaauaauugagaaauuauuaaguguggguaucaauaaucucugaguuuugaauugcuaaaagcuguaaaaaguccuuuaugguuacaaauugaacauuguaauccuaauaugguauuuucaagguuaaaaaagucauuuuaauaauuuggaauaguaugauauguauucaauaaguguuaagacuauucagguuuccuuaacugcucagauguguuuauuauaugcauaaccugugagaaaguagaaacuguaguaauauuuuugugaaaagcucaguucauaugaauuuccuaacuggcauaacaguggcuauauauuccuuuaagccuuuuuacuaguuauuauuauuuaaaguuaauuaugaguuuauugcuauuuucuuuagacucaggguuuaggaacugcccugaagauauuauucucugaaaaagaaauccaaaagcuuccagagaauaguccaucuaaaggcuuccaacucacccgacaggaaauaguugcucuuuuaaaugcuuuuggaagguaagaaccauuauauguugaagauuuuugauuucccauuggguuucaacaaacugcaaagauaaucuucuuugcuaaaaguaggguuuguuuuguugacaaaaaaaaauuuuauauuguaucuguacuaacuuagagaggccuuaaugcugacaagucaguuucucuacaggucauaggaaaaacuaaguuuccaauugccaguguuuuucaguuugcugccuuaauuuuguaagggagauauucuucuaauauucuuuuugcuuggcuauaacuuguucaacuacaauagcaggaguaaggaaugugugauugagaaggugauaaaagaaaauuaaaaccuucaucugcuccuuauuuuucuuaaauuuucauuacuauuuuuuucuuuucucaccuuuuuccugcacuaugcucuuuauuucugaagcucagaggucauuuuucuuucacucauuucuacaugauuuacuucuguauagagacauauaauuugcuugcuuguuuauaucaccagugguuuaaaaaauaauuugaauuugccagcagagauacauguaaugccaacugaggaauacagaacagaaggaaaagaaucacagaaaauaauacuaugcuuccuuggggaaaaagagaaaaaagucaacuugaggaagaauuaaaaaaaaaaaaauaggggacuaaguaauacaaagauuauuucuugguuuucuuaacauguguuuuaaguuaaaaagaagcaguuaaauuaaaaacagauuuauuauauguccccugcuuuuuuuuuuuuuuuuuuuuuuuuuaaaagagaugagggucucgcucugucauccaggcuggaaugcaguggcacaaucauggcucacugcagcauccaaauccuggggucaggcguuccuuccacuugagcuucccaaguagcugggacuacggacacaugcuauuuugccuggcuaauuaaaaaauuuuuuuuguagagaugggggucucacuuuguuguccagucuggucucaaacaccuggcuucaagugauucuccugucuuggccucccaaagugcugggauuacaggcaugagccacuguaccuggccauuucccaucuuaauaacaaggauuucagcuguugcuucccuguauuuaaagaugacuauguagguugagauuucagacacaggauagauauagacuauccauuaacugguauuucauaaaaaauucaguccauccacuuaugaggccuguagaaagauaacacaggagauacugaaugaaauuuaaauaaauugaaaugaaaaauauuguaaauaacuuaagcaucucuuaaguccaaauuaaauugagaaagaugaaaacaauugagaauuucaaaacaauugaaaauuuccuucgaucucauaaaaaauauucacaaaugcagccuuucuuguuuuaguucuauaucuagagcuuauuaccuuuuauuguucccuagaguaauggacucagaaucagggguccuaaaguucuggaauccuggccugcccuuuaguagugguaugaacucaggcaaaucacugcuuuccuaguuuguuuccugauaaugagaucauauaugugaugggcuuagaacauugccuguccuccuaagugauuaaggaauaauuuuucuucuaucaaauaguuaaagauuuuucuucuaucaccccugaauuguacauagggauacuugagcuuuuagaauuacuuuuuuauauuucccaucccagaguuuuacuuuuuggccugggcugagaagcacuucauuuagucagucaguaaucauuuacugaauacuauaagcaucaauggguauggggcacaggagagagacucagcaggagaugaaauagagucuuuacccuuagggagcuaacaacauaagacaaauuaguguguuuggggaacauugaguaaagagcaaucauuugaagaggaaugugcaaaauaaauuuauuagaccaauuguaaaugauuugagauucuuuauuaagaauuauucauaucacuguucccauuauuaaucuaaugucuguagauaguaugaaguaacaggcuuccuuugccccuucuaaaccagucuuaaugagaacacuaauuuaaacauggaagcuucaguguuugagguuuuuuauuuuagguuuugcuuucaaauuauagcuuauguaacaauaucaauaauuugaaacaguaugcaacauguuagccuuacuaauaagcuuuuucuuucuuccauaggcuuucuacaaguauaagagacuuacagaauuuuaaagucuuauuacaacacaguagguaauaaaggcuuuuaugugucuaacuagagacauaaagugacuguggaaagccuuuuaauuauggacauucaucagaaagacacuaaucugacuucaagaauucugaacuauuaaauagaaaauuuaaaugcucacuugaauauuuaugauucuuaauagauuauuaucaacuagagauauuuauaaaugaaguauauacuuuuaaaacauguaaguuauacuaauuuuguguuuaauuucauauguuuucauguaaugaaaauucuauuuuuuuuagaauugguuuuguuuuuauucuauuauccuuuauuuccaguugucaaacuuuaaauggcuaugucugcauucuaauaacacuguucagucuguuauggaaaaggagaacuagggaacaaauguugcucagggcuggugucagugagaaaaauuuaucaaugcuuuuuaauguguuuuuacccuugccucacugugugugugucacuuucuauaauauaaagaaauacuauaauauuucuagaaucuggaacugucaccaugaugaauggcccuuucaaugcauaguuacagaaauuccugaagauuccccaggacuucaauuucauugguuuuuauuugcaguuuuuaguugcuguaauuguugcuguuuccagucuaaaggaccuccuuugguaaaggugaacaagaccucuccccuaugcuacccagccagauuuuguguguguaaugggcuggcccaagaguguucuuuuacuuagaacuccuuuugauuuugcuuuucucugccccuagaaauuuuagggacaaagacauuuuggaaauugucaguuacuuuuagaaagaaaacacugcagaaauauuuaacagauuacuucuugauaaaauuuaaaugggauuauaugaauuuauaaugccaauugaaaauauuauauacacaaaauuugcuauuuucacuuaaaguaagcauuuuuaaaggauuuauuuuagaauacaaucuaugcaauccucgaacucagugugcuuuucccugacaggauauauaaaaagguagauuaggucaacccuccuuuaagcuuacucuccccucaccuuuucuuuucacuguauauaaacgguacuuucugugauucauaccaacagaggacuuucugugauucauaccaacaguccuaaacugucauuuucuaaaucugggauuuaaaaucuuuagacaauauuuaaaaucuugauuuuuuuuaaaugucagcagauacaauuuggaagauugcaucuguguagaaguaaugcagguacaagaucuagaguuuuuccuuagacucuuuagucuuuucugaauuaaagaauaagugcucuuaaauccauauuuuauccugucaaagucugaaauguguucauugaugauuuggugacaucuaaaaaauuguauuuaguuggcuuggcucaccccucuuaaaaauacuuagccaucucuuggugggaugugguggggguauuaaggucucagaguuauuuauuuucucaccuaauuucaaaccuuuauaaacuugggguuuuguuguugauggugguaguauuuuuuguuaaguuguuuaaaaggcugacuugauuggagccuccucuacuuuuucuugaggguugcaaguauuguauggugggggaggggggccuuaaggcaaacugucuaaaaagugacuauccaauuaauuuaacuaguaaauuaguaagaauuauucuuaguauucacucagaguuuaagaugugaaaaaucugcacuuuguuuaucacucuaaauguaaagaacuuuuugauaguguuauuucaccacucccucaguuaaaggcuauuauuuaaacuguuuacuggagaaaauccucgcucauguccauuuauuguuuuuuucuguacugugauuuguuucaagcuuaggaaaacuaguauauuagaguauguucuaggaaauuaaaagaucugguuagaguaaaaaguucuuuuuaagguucuuaacuaauuuuuucacaacuaagaaaauaaaugaaguauucuuaggcugaaauucaucuuauuuuaucauaaauuagauuguaggggcagccuacauuuuuguguauguguuuuuauuucuuaaaugauugugugagccuggugacauuuuaugguucuugugaucuaaacuguuuuuccaauucacaucuuuugucgugaagugauauuauacuagaguacuguuugcauuguaaaaaugcuuugcuggugcucuggcauuuugucuuuaucucaucaccuaauuuaaaaacccagcacuugauaauauaacugacagaaaugauuguacccacugaugaaguaaugaaaaugaagaaaaggaaaauauuccuuccuucaauggcguaaguuuauuuuuuacuuaaguggcaucuauguaaguuagacaaacuauauauuaaaauugguaaacuuugaauguuucuccuguuuugauucuuagauuaugaggaggaucagacagaauaagacuccacacuuuugaaauuugauaagucaaaacguuuuauuuugacauuuuuaacauugugaauuauucgauauuuguaaucucuguauguauaugaaacucugccauguuuuucaacuuugccuaugugccacuguauauaagaaaggacagcuauuuugaucuucaucagcauugccuucagcugaaaauuugggaacaguucacaguaaaccucucaguaguuugcaaacugagguaccugcagaaaccauagcuacucaccaaaauacacagauuaggugcaugguaucguggaaauuauuugguaaaaaaacacacacacaaaucuauguguacuguauuuuaaggaauaucuacaggugcagcuuugauuuugaacagaauuccaaauaauuuacuguuguacccaccagaaucuagaaaaugugaauuaaaguacauguuucugcaaucuuuucugucuuguuuuuccccgcuauuuuaaguguuucuuuuuauggcaugagaauuugauuguaaccuguggagaagggagaaaauguauuuauaaguagucugagguuguuucuuaucauaauggcaagcauuggcuggcauuguauuaagggcuuuuacaugcauaguuuggcuuuaaaagaauacaccguuaaucuucacaauagcacuaguagguagguacaauuacuucucuguuuuauaaguaagaagacugaggauaaaaaaggcuaaguaaccuguccauagucacaaauucuagguuguggagcaagaauuugagacgagaaagacugauucuagaaccuuugugacauuuuguaaguuggccuauuuccauucagcuacaaagugggaacaauuaaaagcauuguuugauuuguauugaaucauaaagcuuauaaaauaugcuuaucuuauuuaauuuuuugaauagguaauacauucacaugguuaaaagaaacaaacaauauaaaaaguuauucagugaauguguuccuguguccuuggcccagcuuccuccacugcacacucaucucccaccaugaauagccugugcucuugguuucuuagguuuccauucacacuguuguagacagguacaaacauauacaaauggaaagucuuauuuuuucucucauuuuuacucaaaaauugacaucauauacauacgacuucauuuuuuucaccuaguauuucuuggcagucuucacauaugacuagauaguuuucucauuuuuugaaguagauacuugguauucuguuaugugaaugugccaguguugaauuaacccguccucuauuaaugggcagcuggguuguuuccagaccuuguacauaugucauuucacauuuauauaaauauuguaccuguagaauaaauucccaaagauaagaauuuugggggcaaagacugugugcauuuauaauuuugaaagauauuggcauauuguccuucauagggguagucaucaauucacauaccaucuaaaauuuaugauaguacuugcuaaccugcaacauuaccaauguagauguuauuaaaauguuggauucuggccauucugguagaugaaaauuuauaucaauguguacauucuuuuauuuuccuuaaaaaagagacagggucccacguuaucacccaggcuggagugcagugguaugaucauaguucaccguagccucaaacucgugggcucaagugauccuccagccuuaaccucccgaauagccuggcuuauaggugcacgccacacaccugacugcucaguauguaaauuuuuacuaugccuaagguugaccaccuuuuaauauguuuaggagccauuuguauuuccuuuuguuucccauauuguuuuguuccuauccauuuuucuacuauaucguugauauguuguuuauuuguuagggauaugaacccuuugacaguaaugaguugcaaauauuuucuuuccaauuugucaucugucuuuugcuuaugauggcuuugucaugaguuuuaaaaaauuuuuauguagucugaauuaccaguuuuuuuagugguuucuggauuuugagucauaauuagaauguuuuucucaauccagagcaauagaguaauucaccuaaauucuacaucuaaauuuugaaccucugaagcauauucuggcauaagauauaaguuauggaucuaaccuaauuuuuuccgcaggugauuaacccaguuguuccaauauuauuuauugaacuguuuguuuuuuccugacgaguuugagaggcuacauugaucuuaucuuagaauccgucauauguauuuagcuguguaucugcuucuguuucucuguaucuguuucuauuucauugcucuauuuagucaugcacuaguaccacauuguuuuaauuacccaggcuuuaguuuuaaucuagugcauugguccucccucauuccuccccugcccaccuuuuuuuuuuuuaacaguuuuucuaacuguucuuauuuuuccauaugagcuuuaaaaaauucuuaacauauagagcauacuaaaacuguccaacucaaguucucucccaaggguugcacuuuuaaccacuuauuuugucacuguucuuuugauacuuuaccugauaaagauacacuuuuuacuacuuuuaaauuauuacaguguucuauuuggcagugcccaaacaggugauggcagauagaggcaggaugcaaugccuguguggaaagaaugucaucucagugcuucuauuuuaagauagucucuaggaaugauuuaaggacuguucucauguaaaaucccuauuucuuuuuuuauuccauuacgaauuauuugcccaaaaguuggauaucugucaaagauucauaagacaagagggagagacccuuaaauaaguacuaaacuuguaaaaucaauauguggauaaaagugcaaguacaagaaguuacuuuggaaaaaaaaaaaaaagcagacaucuaccaaaaaacaggauuugacuauucauucacuguuauaggagcugggacuauagcagugaacaaaacagacaaacauuccugccaucauauaacuuaagacauuauaaccuaccuagauuguagugagaaugcaccaaaagaaaaaauacaucaaccaaagggaaauggccaacuagacacccaucuagugcagaagguguccucaacaugaaugaaucuuaguguugucuugacaaugccaucagauugucauagauugaugcuauuaaucaauuaaagucauuccccuaacacuggucagagcggaguuaacauuccaagcaacauucugguaucauuuaacuucugcuauggcuuuccuucauagaauauaccuccaaauggguguguguucuguucccuuuaaugagcuuaaaccugcaaaccuggagcccagacucuuggcuagugaauucaccaaggagauagcacucaaaggauacuaaguuacacauauuuaauggcccugguaaagcacuauuuguuuaggauaaaugcaugcuaauccauuaaugcaguuaauccguucaaggagcacuguaacuugggccugccaagagacuggagggacuguuguagguuagcgcgauucauggggaaaaggucauaguaacaggaaucaauagaaaaagggggcaauuuugggaaucuuauaggcaucugaucuccacuuaaguucaggggcagaaaaucuguucuggacauagucuaauauuuugagugguaggacauccaagguccaaaagggcagaccagguuuggagcuagagaauuaguauuagcaagauguuaaucaguuugagaaaacagaagacaggguccagccauagcucaaggacuagagguagagaauccagacuuggaggaaccagguagaugucauuaggaguugcugagucacuggauuuagaucuuacaacccugaacccauaauuaaugaccugggcagccaaucucagaacuccacacggaaggcauguaguaucagugcccuggcccauaggaaccgggcaacagguacagggacucugacacagaucuagguuaugggcacagggacauccucagaagacuucaauguauuuugacccuuggugcaagaguucuuauguauccuugcuaagggccuagaguaacguuaauaaguggguguuccugaguauagacuaggauccacagaaacgugacgagugccuaguccagcgucucucauauaauagguacugaauagacauugaaucccacucucuuauccucacuguuccuuguuaaauguuuccucacuuuaauccguuuauuaauugaaucuuuuugaugagacaaauuccccaauuuuagccugauccuuuucagcagcuccuccaucuggaccca

SEQ ID NO: 17188 - RNA, 430 nt, Homo sapiens
ggaggagagggggcugccaggggcguccgguuacauccccgccuuccucuguccuggccgcgggaccggguuugcgggaccgcaguucgggaacauguuggccucgagcagccggauccgggcugcguggacgcgggcgcugcugcugccgcugcugcuggcggggccugugggcugccugagccgccaggagcucuuucccuucggccccggacagggggaccuggagcuggaggacggggaugacuucgucucuccugcccuggagcugaguggggcgcuccgcuucuacgacagauccgacaucgacgcagucuacgugagugagccccgggagggcgggcgaggggcugcagggcgcggcgggccgggggcgcccguggagccggacggacuugggcguagcaggcggggacccggacccgcuggc

SEQ ID NO: 17189 - RNA, 430 nt, Homo sapiens
gccagcggguccggguccccgccugcuacgcccaaguccguccggcuccacgggcgcccccggcccgccgcgcccugcagccccucgcccgcccucccggggcucacucacguagacugcgucgaugucggaucugucguagaagcggagcgccccacucagcuccagggcaggagagacgaagucauccccguccuccagcuccaggucccccuguccggggccgaagggaaagagcuccuggcggcucaggcagcccacaggccccgccagcagcagcggcagcagcagcgcccgcguccacgcagcccggauccggcugcucgaggccaacauguucccgaacugcggucccgcaaacccggucccgcggccaggacagaggaaggcggggauguaaccggacgccccuggcagcccccucuccucc

SEQ ID NO: 17190 - RNA, 1555 nt, Homo sapiens
uuuagucuaauuuuuuuaagguuuucucuuugaguuugggaugcuguaaacuaccugaaacaguuuauuccuaucucauuucaugaagcauagacauguuucaggaaugaaucccuuuuguuagucacaaauccuagcuauaacucucaucaccuguguaaaacaguggugaaagugcauuuauuagguaacucguauauguaccuugauguugggugagaauuucuuaagaaaaguuuugguuugaguaagaaauaauaaguucagaagccgaauaaauaaaagguuuaguuuggaguaaauguaaugugucacauuucccaguguuguagugcuugucacuucuuaggugcucuauaaauguuugguuaaaagaaauguaguuaaguugaaagucugagauuaaaauguuuuuuuucuuccuuucguuuccuuuuuuuuuuuaaguagucuguuuaaaaaaaugaaaguauguuggaaacuuuagccuuaaaaguuucuugguaauacuagccaaaugcaaauuuuuugguaucuuuuuagaaauacuaauuuuaagugcucagcauuacauucuacugcauuuuuuaaaaaggugcuuuuaacguuaaaaggaaaaaguuacuaaaauaaauuucuaacuucauacaaguacuuccuguuauuauaaguauagcaaaucucagagaauuugcuaguaauuauuaguacuaaaaacuuagcuuauuucuuacaacuuuauuucuuaugugauaaaagaugagaagcuucuuguaauuuguauuuugcuuuagcaaaaauugcaauucagaaucuauuuaauguugaguguauuaggccuaaauuuuguuucuuuuucuguguguucccaauuucuuucguucuuuuuuauuuuucuuuuugauauagagucucacuauuucacccuggcuggcacgaucuguaacugcugccuccugggcucaaauaauccucccaccucagccuccugaguagcugggacuacaggcacaccuggcuaauuuuuguaguuuuuguagagaugagguuuugccguguugcccaggcuggugucgaacuucugggcucaggugacucucccgccuuagccucccaaagugcugggauuacaggcgagagucaccgugccugguguaauuucuguauuacgaugaucauugagcuacagaagguuuuaugccauuuauuggaucuuaccaaacauauuuguacuugggagcaagcuuuuaaguuugaauugucuguuguauuaacgacaacaaaucuuuaaauuuuauuaagugacaguuuauugaggugauugaaaguuagauuauguaguaauacuuuuuagguguuguuuuaaaguugaaguguuguauguuuuagcaguuuucccauguacuaccuuuaagaauuuauguaaacaaauacauucccauuacugucuaauauaugcuauguuacuuuuuucacaguauguuuuugaggaauaugauucguaauacauaaggaauuugugcuguaacauagaucgugauguugguguuauguu

SEQ ID NO: 17191 - RNA, 16320 nt, Homo sapiens
ccggguucgcuaguggcugcuccucgaggcgagaacagagccaugcaaaugcuccagcguggaguuggguuugugaagucgccaguaaaucaggccgccuccacuaggugaauaacgcgguggcagcgggccacuuugcuagugcagucgcuggaggaccgcgcuccgcacucagaagggggcaguuggcuggugcgcgagcgcucccggcucgccucuguccgcggggagccagccggccccuccgcaggucccgcucccugacauuugcugugguuucacucccuggcacugagggcuggguucagagauucccagcugcacucacugaacagugauuuuuuuccccucccugaauucuuuagcugccaaaaggggggaaaaaaucaagagcugcucuuaaaagaaguugcccuugcuggugcucaggguaaaaauagaggcugccgcuuagaccggcuuggcccuggcuccaggcauccugcgagcugggcucgagcagcggccgcguuccggcgugaucccuggaagcugccagcaggugcugcucaagguacaguagcagggccgagaagccgggacccgaagggccuggggugcggggaagcuccgggggagggggaagugaaagagaaaccaaaccaaggaaggagaaggagauucuggucaggacugggcugaccagcuugugccccgggcccuugaguuccgcagggaaaagcugauucccagucuagaauauuccacagaagcuauuuuaaccugccugcuuccuccaccacccccaccuugauuugcaccgagggaggaggcauugccacuguggugcaggugguugcagagggguugcagcacggcugguaggcuggccuggcaggugggcacucgguggcaucagauggccagcggaguuucagagucacacuuguguuguggcuccucuggucagagagcugcagauuccugugacacccauguuuaagaacagccaccaggcuucucagaaauaguaucacuuauuauuaucugacagcugcacuugacccccacagguucauaucauggaucccauuuuauagaugggaacacugaggccugaguuuacacggugagugagcagaggaacugggaucugaucuggguuuguuuugugccccccacccccaccccacgucaccuacacacacacacacacacacacacacacacacacacacacacacacuacuuuguguggaggcggaggggauguuuucaggacacuaggguucaugugugggucaggggugaguuuagaugcccugaaggucauugacuccacuaauucucagcaaaaaggguggagaaguuucuuucuuauaaaggguuugaguucacccagugcuaagcugaggggcagguuuggaguucaccaucauuaauccuauuucugucuucgccacucagauucacucucuuccucuacaaccuaaugauuuuuuuccuacuucauuucugcauaugcaguucuuagaauacuccuuccccccacccccaugcagcucagcacccacacuuucucuguaucuagccaagagagacccuuuuacacagaaaacuucugguguccuaauggaaccugcuuaagccacacaucaggaggccagagccucuauauuuugcuugugggcacagugaaaaguuuauuuuaugcauguuaaauccugcauacaaaacaacauaucuggucauauggcucucauuagcucccaauuuugcacauuuuauccaacuugucaugagaacugggcuuaugcuucaacuguaguccuucaaacaacccuucaccguucuugucagaggaccccuuccuccuguguuauuuaccagacuugccaacaccccucccccacaaaaaaagccugaccagcuuuaccccuauuucaaggaguguucacuucuuuucauuaaucugcuguuauauuuguaacaauuuagaaauuauaggaguugaaguucugguaaaaaagaaugaugcaugaggguuuuuguuguuguuguuguuguguguguguguguguguguguguguuugguuaguuagaaugagauucuaaagaccugggaaggauacuuaugaaguucauuuaaagagaauuacuauuuccaaaguucuugauuuaugaagcaggcauucaauuucaagauguaaaauaauaguguaaguugguuggggucgggggagaccaucaucauaugauuauacagauuuucccaauuuuuuuccucaaugaaauagcuuauuuuaaaaauauaaaauuagaaucccuauaaagaacacuaccaauuuucuuuccugaaagaaacaauaaaauacuuuguaaauagaagcaacuucaugaaguaacagauguuuuauguaaagacauaaaacugaaccugaauauaacgagacgugugugcgaguaguaaaaguugaaaguuggacacacucauugagacauaucuauuugauuccaauguuuuucuaaaagguagaguaauccuagccagagguuucacuggcucagugcaucacccaguagugucucagaagccaggaagggcuuuccauuagauaaugaauuaugaaaugucucacacuggaaaaaccagucauccgcugaugucaugcugauuccaaccaaucccaaacaaagccccagcccuccucuguuucagugguaccaaugugugguguacaaauaaguaguacaguauaaaacuucacagugccaauaccaugaagaggagcucagacagcucuuaccacaugauacaagagccggcugguggaagaguggggaccagaaagguaaugcuuuuuaacucuuacuucugagcucuuuacacauucaaagauaggaaagcuaggaggaauuuuacaacuaauuggcauuuccaaugugcauugugauguguaccuuuuuauauuauucaggcagguuaauacagcuuuuaauaguccuagagcaugcaaauagauuauauguuuauacaagccacucagcacauauauacaaguacauaugccaaagagaaagcuauuuuuaagaguuacauucgcaaacaguaaauucagggaacacacacauacucagaugcagagagaauccaaauauugauaaguugcacuuaucuaaaugcugcuauuaggacuccugaguuguuuagagccauuaaacuuuugguuguauuucagacuuucuuguaaaacuuaauugaacugcaaaacauuuuggguacuguauaugugacuccaaauagguggaugauguuaaguauuauagcacaaagauuuuuuauaaaaccauuguaacacaaauguccccugccucccccauucucuuucaccauccccguaaaaaauaugaggcuuuuuaggcaauguugacaaaguuuuaacaauaaugguggaguaauugauguuucuggagcugaaaccccaaagguguuagguuacuuguaacagaaaaagucuuacaaauaguuguuuuggaaaaggggacaguauauauaauucagaaagcauuguuaaccugugcaaacuguaauuauaacuuagugucacaauuuucuugcccucuuccccuugcacucagaucuuaucuuguaguaaugauauuuauuaacucuuuccaccuaaacugcauugcuugacuguaaugcuaugaacacacuaggugucagauauaagcugaguguaucuucagaaaccaagagggcuuaugugugggaaagaaaccgagagggaaggaacgcuuuaacagauggaccccuuaaagauucuucugcaagauaaaagcaauaagacagaaaaugaaaaagaggggagggggaagaauuuuuuuuaagccuuagaaaggcauuguuaaaaaauucacauuuuucuuuuucugugcacacuaaaauccaugaugauuucaucugcacuguuccuuugagggaaaaagaagcagucaaggaggcugucuaugaaugcacuggucgggacaggcuuggggcaagcugaaaaaacuaccacaugacagagaaaaauaauuugccaauauauuuuagagagucuuuucccauaggaccaguuauucaagucauacgagugcacucuuuuuauaaaaggaugugggaaaggccaagagaauuuugcauuuuaucugugaaguccggcgaguggugguaggcuguaaugugugagagugaguggguccccggcagaagggggcagcugaacgcgacggggagaaagcgcuucuggaacuugggcuugugacaggcugccugcccucugguccuucagugcccugcugcauuucacaguugggaagaguggaguguauuauaugaccccaaacaaaaguuccauugcgcucuccucagauugccugccaguguugaugaccugaacauuuaaauaugaaugaauugggggaaaggaccaucuccccuggaucccaucaggccagaacaauccucuguuaccccugagucccucuucccugaccuccacuaccuguccacuggaccucccugcacccucugccccaccacguggccaggugggcguucuaccaccuagggcuguggcuuggcuggguggaggggcggugggaacacuuuuucaaucaauucaucccuauugauugagacacuguguuuguuugggguuucuuuucuccccuccaaaaaaggaagaaggugaaaccaggagacugggcagagaaagaaaaaaaaauagugaacaaaauuaggauaauuuauuuuagaagagaaaguagaacccccgaaaauggugauauuugaagagaggugucugugaggaagcuaagagcagaaggagagcagccugucagaaaacgggcugucccucccucccuaaucacagcccuacucacagcaaacucccucccucuccauucacucacuuacuuagggccaauccuuucucucucucucucucucucucucucucucucucucuuccuuucccucucucccucucccccucccuucccucccucucucccucucucucccccuucuuucccucucucuucucucccccucucuccucucucucugucucugucucccucccauccucucucucugucucugucugucuccccgccacccugucucucccucccucccugucucccucccucccucccuccuuccuucucucuuacucggagacagucagaacucuccucccugacagccacaaaccuacagcacugacugcauucagagaggaaccugcaaacaaaacuucacagaaaacuuuuuguucuuguuccagagaauuugcugaagaggagaaggaaaaaaaaaacaccaaaaaaaaaaauaaaaaaauccacacacacaaaaaaaccugcgcgugaggggggaggaaaagcagggccuuuuaaaaaggcaaucacaacaacuuuugcugccaggaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcuucaugugggcaaagucggggagaacggguauguggagauagaggaugacauuggaaggagggcagaaaugaaugaacuuauggagcagaccucggagaucaucacguuugccgagucagguuggugcuggcauuggcaggggguggggagggguggggggugggaggguaaaauauauuucuuugacagucccaggaggaacuucuuuucccuucagcuggaaacugccugggaagguuauuaguuauuaggugaugguagcggacuagccgacggagggcaggcaggggagggggagaggacuuuacagaaaaggaauucucggucgagcucugccuggagaugacuggcuuacacuuacuaaacccagcgggucacacagagaggaagcucggggccaauguugagcuggaaggcagacugugaggggcugccuugcccugccugugaaaccagaucugagcagccggaggaaagccgcggcauuuucgggugcuaggggagcagaggaggcuuccggaccccauccaaguuuuuauugaggguagaggggugaauguaccaggauuggaguggaauggcacagaugaagucacucucuuaaaacaaaccuuccccuuuaaaaguccaaucuggggccacauuggagaagcagggcauauuuaugagugacagucauuuuuaccuuuagaaaaugucuauaagugcacaggcaccacauucaagacagggaagagcuacuuugggggacaguugucauugaaccagcaguuacuuuugggacacugacuuuugcucucugaaagaaaaaaaaauaaauaaaacaaccaguuuuguucuuucuaaaguuacuaagagcucucugccaaggaacgcaaccuugacaaaguacucucagauacuacgcugaacucacucaauccuuaagaggaagaacuuuaauaaauagauucuaaucguuggcccaggaccacacuaaccuguugcugaauagcaauaccugucaaaaguaugggcccauggacuuggagccaggcuauuuuuauaguuaagugacacagauccuuugcaugccugcaagcccaugcacgucaggcacacagauguguuaauaccguguuacuuucaugguaaugccaggcuaaagaauugcauccuuugccaacuccauuugaaaggaaugccauuguuuuguuugguagagcauauggccaguaaaguaugugcagggacucccagcauuuuuguuuaaaaguuugccgcagcaguauaaacaauuaaggcaacacucagaauuuccaaucugaaaaccuguugacucagauguucuguuuucaagaaaaccaugaaagaccagggcaucuuuccgggggugcagauagccugcuggcuguguggcuuccccuugcaggagaagcccugguguccuacaagcuucccaguuuggcucucucaccagaagccucucucacuuagggaagauccuacuuucuuucccuaaagcucuuucuuaacccagccccaaaaggcaugaucauuaggacuuuaucuucuggagcuuuuugaggaagaaagcuagguuggaacuuuucaaguugacacccauuuuuuuuucucaacuuuucauggugggaaaagguaaaaaagaaaauauuuacaauauuuggcugugcaugugaaacagauuucaguggucuagaggguugcuuccugucuuuguauaccaaccuccacacaugauggauucaaugacagcucguauccaguugccuuuaaccaugucauaugacuaaguauaccuaugccuuugaccacuuuuaaccgcacuaccguuacuagcaauaugccccucuuucugacuuacuggacuuguauagcaaaucacucucuuagcauuuagagauuuggcagugaaaaaauuugaccauuuacauucuuucuuauguguggucuuccuuucugugacagucuucucucaguuguaugagaucuugucauuuuuuuacuucucaguuagguguuuaguuugaaaaaaaaugagcgacuuuugaaaaagcgauucguuggacguucacauugagucaaguuuaagauuuguaaugggaaacuccugguugacuuuacaacuugacuuuggauucuuagaaaacacuuauuacaauugcuuauuuuucucugagggauuucacacaucaacuucaaguugauuuaauguaauuucauguauuuaaugauugcuguauggacugucuacucuucaagcagaaaaccacgugagcauuuugcugcugauuuugcuaguccagaaaagacauuuaucauccaaaugauuguagcaaauauaugaacaugaauagaaaagaccuaugucuuguugcuuuuggaauaauucaacuuuaauaacauuccaacuauguggaaugucaagaguuuuuggagaauagaaaaaggaaugcauuuuucuuucccuuauaaccauuuugugcagcauagaauccagacauugucacccaugagcaugccacagaugcagacccauagcagccccuuucaaccucaagauucuucaauuugaggcuacguuuaauuuuugccuuuucucuccuugauuguuggauaaagccaaggccuggcuacagaaguagagagccuccaaaagcugaagugcugaggacucuuuuaacugaguuugucccauccuguuuagguagaaagugcucaauuuuuguaaaguugaugcgaguuguuauugacuaaacagcagggaaucacucuaaggcucucugaaauguaucccaacaaacaaaaauuauuuuauuuuuauauaugucacaucacccaagauuucucaccaagguuaguguguucuuugcauggcuggcacaaaacccucaauguuuuaccuuaaggccuacagaguucuucacaaggaaagauagaagggauggguaaagccaagcuaucacuauaaaugucaugaagcuaaauucaguggccuuuucagcugaugcagcuuauuuuuauuuuauuuugacucaugacaguagguggucaaucaaugcauaauaauaauguaccucuaagucuccauaugcugucaaaccuggauguggguucugguaauuagcuuagcaauugauagcacuuguuguagaaagaauagggaaagaaagacaaaugacacaccaagaaauggaugugcucacguagccuagguguuguuaagcgcaacacauaagucuaccccuuggaggauacuauguauggaagauuugaguuagaaguuugcacugcccagacagggauccaagaagcuuugcuuggaugaccauuuuccccaccccaagaaagccaucucaaaaugaagcugacucccaccauuccaaucccaccuuccgaacuuuucugugaaucaccccuccuuuagggaugccuuuagggguuacacgcucucuuccgugaauaauggggaagagcggccacaagagggcgcguuccaaagacuuuugcuccuugucaguguauccagggaaaggcaguugcgcguacuggaagccccugucuguagcgcccuaaucuuggugauuaucaguuaccgccugcucccucucauccugcagaaaaaguuaggaauuuaugagaugggagaagcaugacuaccuguaauacauuaaaugagacagaaggaaaggaaauggaaauucuagugauacaugugaacauuccggagcucuauggaaggcagacgagugauaaauuucaaaagcaaacaaagcggagcagggagaaaugugacuaugaaucaucagcgauacugauuugcucacaagucucucccuaauacggucucccgggucguaacaaaaacaucuuccaucuccccugauuuuguugccuaguuuuccugccuuaucaacaguuuccaccagcgacaaaugacaagugacuucaaacagggaggaaaaagguucuuucuguaaugccuugugggaacaugguguucggcuucugaggaugcguuuguuuccgaacugaggguguggagagaaauggugggaaagaugggaaaagagauuaauaguggucugcggccugugcaguggauggacugggcugggggugguggagaugccaggguggaaaguccguuguaauauuuaaagaacugcaguaauaccuucccaggcacuuuucuugaaaacacauauuugucuuggccccucuucugcuaaaaaauacuugcacgugaucuccuagcuguaguucugaauucuucguacucgacugguuccuaaguccaaaaugagaagugccaaaguucucaggaacuuuggaagaagucucugaaauuuuguggguuaaaccuuaagaauuuuugcuacuuguaggaaccuaaaaccccuuucucccaaaauauuuaaccuuuuucaucaccacuuuaauggaagaggcauggaugauggacguuugugccagggcauuuauaaaucaauaauggacccuaaggagggaaauuaaagcuaaaaaauuaaucaagauaauuuauggccaaaccuauaguucuacugcaggaaagauccucuacuguaggucaaaggaggaauaaccuuaagaccucacuugcugcuuucugcagaaaccccuggaagcaguccaaaugcaaaguuagggcuucagagaaugcacccuguaaaugguaguuguguauacccuuaccauugacuauaccauaucuaggcacagugaaaucuugaugaagaauggaaaauuaaaggaacagacgcuuuuuacagggaggcuucccccagcccccaucccaugguaaguuuaaauguguucuauaaacaacgaggcuuuccacauucacauuagagacauaacuauugcccauauguaaaagagcaacauauuuuaagcaggacccuggugaggaaaacaaaaccaaaucgaaacacugcauguguguguugcuuauuuaacugaaaauguucauagacccacaaaucugagaugcuggacuuuuggaugaguccagcauuuugcaucuuaguguagggggagggaacaacaaggggcuuaguugcuuaacccuugccaugccuucaugauugacuuauucaaaacauuuuuaaaauucugaaagcaaaggaaaaugugcugcaaacacccuuccagcuaucuuuccuuccagcuuacacagucucuccucuguccaauccuucccacccagcagcauuucagagguauucccugugagguacaaaauuucucuuugcccauuuuucugcaccucuuuuucucucucuuugguauguguccaccaagcucauagagguuuaagugaugaaauauuaucacccacauggguuugcgugggacuuucuuagugaauuacucaggcagagcaggcugugauacagccuugcucacaagccucgggagggaaaaaauagcacagaggaugaaaagaauauuauuagagagcagguaaugaaagguucgcaaagcaaccagcuauaucugguuagcuagguaauagugcaggaaccuaggucgcaccuguacaaacuaaugcagaaccugcucacggcgcacuaugggaagacauucauuucaagaguuuacagcaugagauauuugaguaaaaccugaaacugauuagaaauugauccugaacaucccagccuuagucaaccuucccuuuuucaaauuguuaugcauggagauuggaggauuggggcaucuugaaagugucacugcaguauagcaaucucucucagguaauauagagauaaagggaauauaauaaauugaccuguuauuuauuaucuuuuucauaccuaggacauuccgaggcuuaauauauuucugaagccuacagcccugauaaacaucaaucccacgucaguuuccagcagucucaucuccccacacccuucugcaaugaaagcuaauguaaaagaaagaaauaugcacugcuuaauaagucagaauacaauagaacuuguaaaauguaccugcauauaagguagacauuaggaagacuugaaucucucucuucccccuguucuccugagcauuauggcaacagcauuuucaugaaauuagaucuguuuuauauuuuuuccugauaaaauaucaugcaauauacaaauagcaguuccagaaauggacaccaggagaaggaggcgacaggcaugucaauuaguagggggaaaauccaaaugucagaaauaugggggagagagaaagcacgcaggcaguggaugcaaauacagggaacagagucuuucaauucagauaauuaaacggaugcauaaaucagcacccuugccucucuacaauacgcaggcgaugccaugcaguuaauuaucagccaagaccagcaugaaagucauuuuaugaugacucucugauccuaauauaacagcaccugacagauugagcccccucuaaugaguacucucuuuguacaauccucucucaggaacacuaaaucauuugcuuccaaguacagcugccugugaagaagggguggggcuagaucaugcaucagaaaccugcucuugugaaaucaggggcuguccuguaggcugugugacuggaagccagcagccucagccucucuggcccuaaaaaagcaauuugcacacggcugucccuaauucuagucagccaaguaacccucccucggcacccccaccuaaacaucuguagucagccuuggguguuauucauggaaaguccacugcaugcgggucagcacugcuguccaucggcuucacccugaccccuucuggcagguguggaugagaguagagcagagcucauggggaugaguuaccccaaaccuauuaagccucccuauccggggcacuagucagacacuccaguuuuacacucuuuccuagaaaaacaaaacccaaccuugugcccucuggguucucuaauuuagcagcuacuaucugucuguuuuuggagugacacccugugcaguuuaggauuucagaagcuguccugcauagaggcagaagggaaaacagcagguaucuuguuaacauucucuauggggcaaggcagaugugcccaagcuggaggaaaccugcacacccuccaggcuaguuauccaaggcuugggagguuucccucggccuucuccuaaggccuuggcaggacccugccacccuaaaaucaacugcugauugccuuuuuagauuuaaaugauuaagcucugcuuaugggaaucuucuucucuuuuauuuuguuaagaaacaaacaacaacaacaaaacccacaccaauucuuagcaaaggggaauaucgaauucagauuuugaaaaaauaagucaucaugcuuccuaaaauaagacagcuucucccucuaacugcucucucugcucugguauucuaucuaaucauaaacccagcuuuauuauucauuucaacuccugccaaagacaugaggucggagucagaggaacuccccuuaccaccgccaccaucaucauggccagcauccucguaaguuuauagaaagaugccagagaaccuuuccuauccaucugcagcccugcuuggcccuugccucagugaauuuaccacuaucauaaucacagugugcagaguguguuaaauuaagaacagaauccacaguacgcaaugcacagaaaagccugccuucugcugcagagaacuugaaacugugccuaaaauuuauaguaccguaaacaucucagggccucgagugauaaguauggcuggauuuccguuaacuauagaaauccaggcagggagauccucccagggaguugcaaguucuaagaugaacuucuugaagauuguucccagauuugugcaugggauacauguacagcagacaguuguaaggagguccacggucauggaaaagaggauauguuucuauaugccaccaagugggaaaaauggaagugagggaaaauauuugauuaaucaaaaaauuuuaguuuggauaccugcuuucauaguaauuguugcugugucauuaaacauacaguugcuuaggaaaagagaaggaaauaggugacuuucuaauuuuagaguuaggcuggaacugagugguugcuaaauucaacugcccugacaauguggggauuuccuguccauuagcagcgauugcuauuugacauauguuucuggugcccauuaaucugcccuguaaugggucagaggcaaaaaugggggauucagagguacuagguggcucucuuaauuuaauagaacucaaugcuaaggacgccucuauuuguuaauaaguaaucaagucauuggcuacuuucugcuaaacacuagacuaugauagugaccuuagaccccgggcauucuaaaccaggcuggcaggaggguggugguggaggugaugugagguaagccuccuagaggaacugucauccaaacaaucugaaaauugaaacauuauuaaaggcagcacuaagggugguauguuggaguuggggcaggagcacuuaaggcagaaggaacagcaggugucacugccugcaguugagaaaggggguggaauucucaaggccuuagaccccagagaacaggacugggcaagagcugacauucaagggaggaacagcauguacagagcccaaagucccagccacuuucuguuggauacugagcaauaggaauucaguaaaggacuuucaagaagaagugaugugaucagauccaccugugggaaagaugccuuuagcugcuucauggagaaaugacuggagaggaggccuuccuuaguguugcagaggcaaaguaaagaaaaugcugcugcagugacccagcaaagaggugauggcggaggaaucaggcugugacaagggaagaagaggcuggcucaagugugucucgacugcacagacuuacacagcgagguggggccaggggcugcauuuuugucugagaauaguauuuccuuagcuuucuagagcuuacagugucuuuuuguuuauguuaucucauuugaccuuccuaaaccugugagauaacaggucaaauguccuuaugucauucccauuuuuauagaagaugaaacugagguugagcaauuagucaacagacacagacucgcaggcccucuucauucuaaagcaaggguccaaaaccuuuuuucuauaaagggccagagaguaaauaauuuaggcuuugugagccaggcagucuguugcagcuacgcaguccuugguuauuauagugcaaaaacagccauaggcagcauguacagaaaugagcauaaccaugcuccaacaaaacuuuauuuacaggcacuaauguuuaaauuucagguaauuuucacaugucacaaaauaucacuuuucuuuaaccacuuaaaaguauaaaagccauucuuaguuugcaggcaguacagaaacaguuucagcccaugggcugucauuuguugaccccuauucaagagggucugucacagaagacuccugcuugccugaaauuuacgagugcauguaaauguuggaauuaacaggugugccuguuuucucuuaugcugucuuucaucuucaggaacagccaggaagacgcugcacuucgagauuuccaaggaaggcagugaccugucagugguggagcgugcagaagucuggcucuuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaagagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagaguugcccagcccagggggaaagggagcaagaguuguccagagaagacaguggcaaaaugaagaaauuuuuaagguuucugaguuaaccagaaaaauagaaauuaaaaacaaaacaaaaaaaaaaacaaaaaa

SEQ ID NO: 17192 - RNA, 3664 nt, Homo sapiens
guuuguccaucuguuggauccaaacauuucuauauuuuguaaauguuguuguuguuuuuuuuuuaaucguuuacuauuugcacuacaaugguguuugaccugucuaauccuuauuuaacaaguauuuucuuugguugggggugggggugggguuuaagagcugcacuuaaugugagcuauaaaagaacugcuacagcacacaaaauagcuauuuuuauuauuauaauuauaauuauuauuauuauuuuguaccuuaaaaaauagacacauacaccaaagacauuugugugagccuuuaaacagucugucugugguugguaucauucaccaucaaugagucagggguugggauucaagguugaguaguguggauuguguucaggcuuaaaagaccugagaaguuugguuuuugacuccuuuuacauccaugaaacaggacauuucauacuggauguacaguaguuguacacuguuggauaucaaguucaaucaaauucauggaacuacaugcuuguauguguauauauacauugcuugugcauaugcauaucuguauguauauauacauguauuguaccauguccauacacauuuuaagcacuucaggcugucauuuuuuaauguucuuaaagcaaugaauguuugugugcaaaacacaguauuuuuaagaaggauaggcuauaguuuuugcuuuuacucugaacuaggugggcgcauuucaaaaauucggaugggaaaaagccuggaaauuccagugaauauucagcaaggcccucuuucauuguacagggaucaaauuuccuccucuuuuuugugcccccucccacuucuacaaguuauccccuguggggaaaacaggaugauaaucaaaacucugggcugauguuuuuccaacuuagugucuauuggaaucaaucuuaaaucagaagcuuuuucagaaaaauaauauuuaggccagaauuagaguugaguguauuuuuuaaaaaugauuaaggcuugguugugagaaauauuaccuguaccagcugggaaaaauaaugucaucacuaacuaaaagauaauuaauuugagagaaaguguuaagagagggagaguaaggaagagaacaguuaagaggaggcagaggugagggcaguaguaaaaaucucuaaaauuuuaauuuacagccaaaauucuucauguguaaauuuguauugauucagaugcagaaaugaaaaaaaaacaccuuuguuuuauaaauaucaaaguacaugcuuaaagccaaguuuuuaucuaguuuauucuaguacuuagcuugccuggaauagcuaauaaauuauucauguaugugcuuuugaaaauccagagcccuauuuuuacacacuugugugaaguuggcaaacauuuugaaaaauggaaaaaaguuucuaauaauugggaacaauuacauuaauuaauauuuuguaaaauauugaagcuuuuagcccuaugucaauuuguagauuaaaauaaauuaauuauaggaaaggaagauaacagugagaaaccaaacauuacaaaaggugguuuagcucuccuugaaaaauauacuaaguugguauacuauaacacuuggcuauauguaggcaaugucacuacugggcaaauacacuuacuguguucuagaggcagcccuuucuuaugcagaaaauacaauacgcacugcaugagaagcuugagaguggauucuaauccaggucugucgaccuuggauaucaugcaugugggaagguggguguggugagaaaaguuuuaaggcaagaguagauggccauguucaacuuuacaaaauuucuuggaaaacuggcaguauuuugaacugcaucuucuuugguaccggaaccugcagaaacagugugagaaauuaaguccugguucacugcgcaguagcaaagauggucaaggccauggaaaaagcagaaauuuaccaagaaagcugauacccauguauaguucccacucaucucaaauacaucugcuaucuuuuuaagcuaaguccuagacauaucggggauaacauggggguugauuagugaccacaguuaucagaagcagagaaauguaauuccauauuuuauuugaaacuuauuccauauuuuaauuggauauugagugauuggguuaucaaacacccacaaacuuuaauuuuguuaaauuuauauggcuuugaaauagaaguauaaguugcuaccauuuuuugauaacauugaaagauaguauuuuaccaucuuuaaucaucuuggaaaauacaaguccugugaacaaccacucuuucaccuagcagcaugaggccaaaaguaaaggcuuuaaauuauaacauaugggauucuuaguaguauguuuuuuucuugaaacucaguggcucuaucuaaccuuacuaucuccucacucuuucucuaagacuaaacucuaggcucuuaaaaaucugcccacaccaaucuuagaagcucugaaaagaauuugucuuuaaauaucuuuuaauaguaacauguauuuuauggaccaaauugacauuuucgacuauuuuuuccaaaaaagucaggugaauuucagcacacugaguugggaauuucuuaucccagaagaccaaccaauuucauauuuauuuaagauugauuccauacuccguuuucaaggagaaucccugcagucuccuuaaagguagaacaaauacuuucuauuuuuuuuucaccauugugggauuggacuuuaagaggugacucuaaaaaaacagagaacaaauaugucucaguuguauuaagcacggacccauauuaucauauucacuuaaaaaaaugauuuccugugcaccuuuuggcaacuucucuuuucaauguagggaaaaacuuagucacccugaaaacccacaaaauaaauaaaacuuguagaugugggcagaagguuuggggguggacauuguauguguuuaaauuaaacccuguaucacugagaagcuguuguaugggucagagaaaaugaaugcuuagaagcuguucacaucuucaagagcagaagcaaaccacaugucucagcuauauuauuauuuauuuuuuaugcauaaagugaaucauuucuucuguauuaauuuccaaaggguuuuacccucuauuuaaaugcuuugaaaaacagugcauugacaauggguugauauuuuucuuuaaaagaaaaauauaauuaugaaagccaagauaaucugaagccuguuuuauuuuaaaacuuuuuauguucugugguugauguuguuuguuuguuuguuucuauuuuguugguuuuuuacuuuguuuuuuguuuuguuuuguuuuguuuugcauacuacaugcaguucuuuaaccaaugucuguuuggcuaauguaauuaaaguuguuaauuuauaugagugcauuucaacuaugucaaugguuucuuaauauuuauuguguagaaguacugguaauuuuuuuauuuacaauauguuuaaagagauaacaguuugauauguuuucauguguuuauagcagaaguuauuuauuucuauggcauuccagcggauauuuugguguuugcgaggcaugcagucaauauuuuguacaguuaguggacaguauucagcaacgccugauagcuucuuuggccuuauguuaaauaaaaagaccuguuugggauguau

SEQ ID NO: 17193 - RNA, 819 nt, Homo sapiens
aucuuaggcaggugcacccaguuuucaccaugauuaagggucucuauggaauaaaggaugaugucguccuuaggguuccuugcauuuugggacagaauggaaucucagaccuugugaaagugacucugacuccugaggaagaggccuguuugaagaagagugcagauacacuuugggggauccaaaaagagcugcaauuuuaaagucuucugaugucauaucauuuuacugucuaggcuacaacaggauucuaguuggagguuguacaugcuguccuuuuuaucugaucugugauuaaagcaguaauauuuuaagauggacugggaaaaacaucaacuccucaaguuagaaauaggaaugauuuguaaaauccacagcuauauccugaugcuggaugguauuaaucuuguguaguccuaaacugguuagugugaaguaguucugccaccucugaugcaccacugccaaugcuguacaugcugcauuugccccuugagccagguggauguuuaccguguguuauauaacuuccuggcuccuucacugaacaugccuaguccaacguuuuuucccagucagucacauccugggauccaguguguaaauccaauaucguaugucuugugcauaauuguuccaaaggaucuuauuuugugaacuauauguaucagcaguguacauuaccauauaauguaaaaagaucuacauguaaacaaugcagcuaacuauccaaguguuauaccaacuaaaacccccaauaaaccuugaacagugaaaaaauaaauaaauaaaugaguuaaugcauguaaauaaaaacgu

SEQ ID NO: 17194 - RNA, 1739 nt, Homo sapiens
agaccauuaaacauuagaauauuggucuauggauggacacauaucaccauauuggguuuuuuaaugcaguauuucaguaauuuucccaaguaaaggcagggagaaaggagaagugguuuugaaacugugcucaaugacguaagacugcagucagcuugguuauggucaucuaaaccugugguguuuccaacuucagcccagcuccucccuagagcucuagacccauauagcaaccaccauuagacagcaccacucuuacuucacucaucaacuccaaaacugaacucauuuuuuuucugcaaaaauguccccucccaggacucauccuaacucuuccuuaucuuauuuaguaaaauacacccuuauccugccccucccucaaagcaaaacaaggcaucaucauugccucuuccauucuccuaucuggcagcugccccuagcaaccaauuaccaguugauauggccucuugaauauuuuaggaauccaucuccuuuggaugcucacuaccauucacacaggguccuuaaguuuucucuuacuggcuucugcaauggcccccuugugggcucucugcuuauccuucucugcccccccaccuccacccccccaaguuaucuguucucuaccaacagaagaauagcuuaaauuguaaucuguccacucauugccucaccaaggcauagacgauucgugauuuggcuccuguuuucuucuccagccucaucuucuucagcaaccuaaguuugaacuucaagaccuguaauuauuacucauucuucucaacaaauuauuuguccccgugcugcaucuccuuucuguucggauccggauuugccaucccaccccuauuuuuguaguagaaaaugccuauuuaucuuuaaaacucuaaccuacguuaguaaagcuauccauucuucacgcuguacaucuugauaaaccauacuuccaauagcaaugauuugcuuucauguaugucugcccacuagacuggacauuccuugaauggcucauaccaggaauauaguugguacucaauuuguggggagcaaagagagauaagcgaauaaaugucaagacauaagaaucuguagcugcuaacuuaaauuuacggauuuagugaaacuacuucucacaagcuaccaaaucacagugccauggggccgcaagaugaucucagugccacaccgacaccugcagagucgcagggggguccgacaccccucagaaagaacucgcagaccguccgagaaagcgaauucuccaggggaucagcaguuagaugaggcccagggcagccacgagacccuccagccaggguaggcggcugacccgccuccugggauuuggcccgugacaagccacgucgccagcuccgcucugaauacccccggccacgccacacgagcggccucaacccugagacgcccagggaacaugagcugacccucuagaagcaagauggcggccuccgcucuccccuccuucccccaagaacccccuccugguccccaaaagaaagacaaggacaccgcggcaacgacgccgagauccgggaaccuccgcgaggcccgcggccacucccgagcccccgggagaugacuucaccucgcggagcucagagagccggggguggggccgucggaaagacagcgcggacagcccucagcuugcagggggcggaggccgggcagccugcgcccuccgagccacuguucugcggcccaggcccaugaucacc

SEQ ID NO: 17195 - RNA, 3784 nt, Homo sapiens
gagaagccaccggaagcggaagccagguauggcguucggggcccgggagucugggcaauacaguuuugugcucacugggugaagaggcugacuuagggcggggaaaggagggagccaggcuggaucucuuuccgcagcucuccucacguuccccucuagucccggcgcggcgcugcugcccaggggacuggccuauccucggccaauccgcuggguccuuauugccuguugggccccuagugcgaaucagucccgccagagacccuugacgggcauacuguuuccuccgggcuccugccucaugaggggagaggugcggcuuggcuccgugcguagggacuugggugggguggggugggcggugugagaacuggaacgucccagugcgcuaaccugagguggugccagccauucugcucgucccuuugcacuucuccauuuccccuuaggcucuaagugugaccuucgaacccuggucagaguaauggugaggggcaggcgugacguuauuucauuacacggcuucucggcauuccacagguuucccuccgccuccugagggccuuuccuaacccacagaguggauuccuggcuccagaaaaugggcuuggagcgggggccacguugaggaaggcgaagggcauugugggggcguuauguaaaaguaggaccccaaccgacagauccuagugcucgcgccaccugggcgcgcggagcuuugcucguuuacuauugaaaaaguuccagcgcgggaaacugaacccggagcuuugcgcacgcccgagcccucaaguaauguggguugugguuuuuguuguuguugucgccacgcaugcgucuucgugccguguggcuauuugauugugucaacucuucugauuagaauggcgccauuuugcgguacggaagcuacacagcaacacguauaggagacucuccccgagaucuucuagggagugacccaucuauuuuuguuugggaagaggaaacuccgaaaugggaucgcggaagacuuaaagggccaggcugauuuuuuuuuccuacugguaugucuuacggggugggaaagugguuucagaaagaggcugguguuuauuguuggugaggaugggggugggggccggacgcaggaccucuggacaacagucucauggaguuuuauuaaucuuuacuaaggagcaaagucgguauuguaggguuccauguuuuuacgcaaagucucucucccuuaggcccugcagaguccuaaguugugggguuacuuuaguggcaggaaaguguuuuugacuacuuuuucucaucccagcaggucucugaggcugugguugcuacagggucaccacgagcuuggcuuacuugucucauccuucccuugccugguaucauuuucucaguucucccaaaagccaugucccggcccuugcucaucaccuucaccccagccacugaccccagcgaccucuggaaggaugggcagcagcagccacagcccgagaagccagaguccacccuggauggggcugcagcccgagcuuucuaugaggcccugauuggggaugagagcagcgcuccugacucccagagaucucagacugaaccugccagagaaagaaagagaaagaaaagaagaauaaugaaggcaccagcagcagaagcaguggcagaaggagcaucaggaagacauggacaagggagaucccuugaggcugaggauaagaugacucaccggauacugagggcagcccaggagggggaccugccagaacuuaggagacugcuggaaccgcaugaggcaggaggagcuggggggaauaucaacgcccgggaugccuucugguggaccccacugaugugugcugcucgagcgggccagggggcagcugugagcuaucuccugggccguggggcugccugggugggggucugugagcugaguggcagggaugcggcucagcucgcugaagaagcuggcuucccugagguagcccgcauggucagggagagccauggagagacaaggagcccggaaaaccgguaaggggaaacuuuagcucagacccaugucucauuguguucugccucucccagccacaccacaccagacgccccagcacagugcugaagaguucuuuccuuauccucauguguagguugacaggguaguauagucaagugguuauaaacaugagcucccuggauuuaaagccugauuccacuuacuugggcaaacaaccuaaugucuacauguuccaguuuucucaucuuagaaauggggguaguaagaauuguuguuaggauucaauggguuaauauauguaaaaugcuagaauagugcaugccgcauaguaugcaauacaugaauguuagcuauagucauuaugacuaaugucccuccccuugcccaagaguuugcuaggucugguuaccauuuuuuucuuucaacuauucugcucuggaucccacaaugguuuaaagaaauuuguuuuuaagacaagucaagugcaguagugagaaggaggggaaaaguggaguaaggaguuugaucuguaacugagugaacaauuaauucagauaacucaccaccaccuuuggaccagccuggaucccucacuguuaaguaggaaggaaggcaauuugucccuuuuuuuuuuuuuuuuuuuuuugagacaaagucucacucaucucacucugucgcccaggcuggugugcaauggugugauuucagcucacugcaaccuccgcuuccugggcucaagcauauuuuuuguagaaagcaggcuuugccgggacaugguggcaugugccuguaaucccggcuacuugggaggcugaggcaggagaaucgcuaagguggaaguugcagugagccaggaucauggcacugcacuccaaccugggcagcagagcaagacuccaucucaaaaaaaaaaaaaaaaaaagcaggcguugccauuuugcccaggcuggucucaaacuccugagcucaaagccaucugcccgccucugccucccaaaguguugggauuacaggcgugagccacuaugccuagcuggcaauuuguuccuuagcagaaaagcugaaaagauccuauucuacccugccagcccccucugaggccucaacucuuccccuuuuccuuccccugcccuuaaugcuuuuucuucuuucucugcaggucuccuacucccucccuccaguacugcgagaacugugacacccacuuccaagauuccaaccaccgcacauccacugcucaccugcugucacugucgcaggguccucagccucccaaccuuccacuuggggugcccaucuccagcccgggcuucaaacugcugcugagggggggcugggagccaggaauggggcugggaccccggggugagggccgugccaaucccauccccacuguccucaagagggaccaggaaggacuaggcuacagaucagcaccccagccccgagugacacauuucccagcuugggauacccgagcuguggcugggagggagagacccccucggguggccacacugagcuggagggaggagagaaggagggaggagaaagacagggcuugggagcgggaucuaaggacuuacaugaaccucgaguucugacuuugguaaagucugacccuagucugcugcugaagucugaacuugggccucugaccugggcccuuugacuuccccuuccugggaucugcucagaugcagauccugaaguuuuuggucaauaggcucugucuucgugagagacgggcugagagucagaaauaaa

SEQ ID NO: 17196 - RNA, 1299 nt, Homo sapiens
agauauguguaacacaccaacuuacugugaccugggaaaggcugcugaggaugucuucaacaaaggauauggcuuuggcauggggaagauagaccugaaaaccaaguccuguagugcaguggaauuuucuacuucuggucaugcuuacacugauacagggaaagcaucaggcaaccuagaacccgaauguaaggucuguaacuauggacuuaccuucacucaaaaacggaacacagacaauacucuugggacagaaaucucuuuggagaauaaguuggcuaaaggguugaaacugagucuugauaccauauugguaccaaacacaggaaagaagaguggggaauugaaggccuccuauaaaugggauuguuuuaguguuggcaguaauguugaucuagauuuuuccggaccaaccaucuauggcugggcuguguuggucuuugaaggguggcuugccggcuaucagaugaguuuugacacagccaaauccaaauugucacagaauaauuucgcccuggguuacgaggcugcagacuuccagcugcacacacaugugaccgauggcacugaauuuggagguucuaucuaccagaagguuaaugggauugaaaugucaauaaaccuugcuuggacggcuggaguaacaacacccauuuuggcauugcuacuaaguacaagcuggauuguagaacuucucucucugcuaaaguaaauaaugccagccugauuggacuggguuauacucagacccuucgacccggagucaaauugacccuuuaucagcuuuaaucgauggaaacaacuucagugcaggaggucacaagguuggcuuggcguuugaacugcaagcuuaaugugguuugaggaaagcaucagauuugucccuggaagugaagagaaaugaacccaccauguuuuggcccuacaauccuucugugaaauuucaaaagugugaacuuuuuacucuuccaaaaaauuguaauccuccccacacugaagucuagggguugugagucccuccugaggggaggcgcuggaaagcaugccuggaagcuguccuguuugugccacguuucgguucaguucugcaguguuauuaaauguguuccucggcgacaguguggugucauguuagaggagacgaucugaaccuccaguuuguaccucguguccugcauguucacaccauuuuuuucaugacucuguaauauauuggucucugugcuauuguggaaucuuugauuuugcaucagaguaaaauaaaauaaacccaucacauuuggaacauaaaaaaaaaaa

SEQ ID NO: 17197 - RNA, 1667 nt, Homo sapiens
uccaaauuccaucaagaaaagcucccugcgaagagaaguuaacaagauaacauaugauggaugcuaaauauuuaaauauaugccggcagcgguuacauaaggccugcucaguucugagaucuauaauugggagggucuaacuaggacagggaaaauauaaaauaaaaguaaucuuccagaguggaacaaaaaagaaauauauucauccgacagucguaacaccauucaugugcagugauuuuuuuauaguuuuauaauuuuguauuguuuuauaaauuauuuauaagguguuguaaugcuucuuauauuaauuuuuuacagauaaauuuuuugcuacaaggcauaaaaaggugccugaaccgauucuuaggaauauaaauuauacuguguaacucauaagucuuugggaccacaccuaaugcuuaauuuuaugaugacauuucucaugucuacuuguaaacaacuucauaugccaauggcguuuaagugucuuuuauguuuccaugaacugaagguuaagguugccacccacaaaaaauaaaagccacuuugggcauaugugauuguauuucaagcuucaguauuuuucucacauaauuuuuaauuauuguuaucugcauuuucauuacuucaugaaaaaaugacaguggauauuacauuuuacacuuguuuauagauuuucuuucuuuuucaaccaagaaaauauuuugaacaauugaaacuuuuaauugcauuugcaagguuuuggcuucuuuauguugucaucacacagaugcacacacacauacacauacaacacaaaagagagaacaaaaaagcaaaaggagcuaggaaaaaaacaaaacaaaacaaguagagguguaucaaagaacucaagcuauaaccaaaaagaaaucguaaaaugccuuugcucguuucucuacgcuggaccaaagcucaauauuuguagguauaugcacauuguauagauauggcuaaauguugcugacaaucucgcaauacuaaacuguuccuauuuuaagaaaaaaaaaagaaauacaaacuguucaucaauguuuuaccucagcacucuacuuguacccaguuaaugaccaagcuuaaaaaaaaauugagauaaaggaaauugauuuucauuucaauguuugacuguaaaaucuguuuggauaacauuuuguaaugagcuuuuugucaugugauuugcuugucuucaacuugaaauuaugugaggcacauuuguuuauuuguuguuaagaaagugauuuuuuuuuuuuuuuguccuaugugcugugaucuagacuggucaccggggucacuuaugaggcaccacaaagagaucugcuucuccgugcccggagcaggcagcaggagggagggcaggaaacaggacuggguugcuuuggaaaaaucaucaugacaagaaguugacaugauagacuugugaccaagaagccaaacugaauauuuaaaagcuccuuacuugcucugacauugaaaccaaagcugauuuuaucugcacagguugcuuaauauuuaaaaaaaaaaaaaacuguacuuaaucuagagcaauaucuguauggucaguaaagcugcacuuuguguauuucuuaacagcuucagaucugucacuuuuaauuuguaccauaaaaaauaaauaauuguuugacaug

SEQ ID NO: 17198 - RNA, 185338 nt, Homo sapiens
ucugucaggugacucucccguggcgccauggcggaagcagaggagcagguaaagggugcaggugguaguugagggcacagggauauagagacuagggugggcuguuuggggaggguggaguggaguggguggaggugcggagcugcuggaauagcgcaaggcagguccgcggcagggcggggugggauggcgaaaguugguuucggggagcagagaggaugccagccccgggagggcaccuagggaaagcgcucugacacacccccgcguucgggcugccuuuccucgggccccaucccuguggccuuugcccagggaaauuuuggcaugaaggcaggcccggcuaccucagggacugacugccugugggaggaggaagagaggccgggugacugaaauuuaaguugcuuuccacuugaaguaggacaauaagaacuaggagagaguagacgaugaguuuuguuuuguaucuauuggaguuagguacagagcuggagcacuguugcggugcagcagggauuaaaugcauccguucuggagcaaaaaugccugggguccaagugcugguuccuuuucuuacccaaugugcuacuuugagcuacuuauuuaacuuuccagugugagauggggguaauaauaaggccguccucagagggugguuuaagauggagagaggaguuuauacacaaaguuagaguacuuagaacuguugggcuuaguaaaaauuaaaugggauuauuuguugcugguaguauccagucaacaacuggcaacguggcacugaaguuuaggguagaaauuggugaugggaauaugaauuauuuucauauagcaguagugguaaucacacauuuuaugaaaugacgaaguaaaauaaaaaagacaaaaaagagaagcagaccaaaaaagaggcuagaacuugggggagauaacuuaaguuuccauuuccaguguuauuucaguuggauacuguuuuucuucacaaguuaacagggcugucaguugcagucauugucucuaaacagugacuugaugaugggcuguuuaguaucauaagagucauuuaccuaguucaauaauuuuuacuauuuucaacauacuucauuuguuuuuacuucauagugaaaauuuguucuguauauauuuuauauaugccaauaauugagacguuugacuagguagaaauuugguuuggcugguccuugugauaacaagauaacaaagucucuuaucuaacacuagagacuccuauuuccauucuagcaguucaaaggaaaacacucauuaagaacauaucauuucaugacugccauugcuccuuugaauaagggugagauuguuuuucacauugugcaucuuuauuucauguugaaauguuuguuuuaugguuugauuugaaagcaaaaaacugaguuucauauguucuuagauauaguggaauagaaauggagagaguugcuccuagaaaaaccauuguuuuuucuuccauugaaaaaaaccuaugaaauauuuaccacuguuuagugcagaagaagaauuuaacaaaguugucugauauaaaaaugacacauacaaaauuagggauauaauaauguuucacauuuguacauuauuuucuaguuuuaaaaacccuuccauauugcauuuggucuucccaaaagaauucuaugagguaaauguuuacucucauacaugggugaaacaccucugauauucuagacuuuccaggggcuucuaaucuuauucagaggaaaagccacagccauuacgguagccugguugucccacaggaccuugacccagcugcccuuagccaccuuuucuugaccucauuuuucccacuacucuccuucccuucugugacucugcaucagcuguacuggcucucuuagucuucaaaaagccaggcagguuccuaucucagggccucuuugcucaugcuguuccuuuuugaggaacccugauauuuacaggcuuccucauuuccuucaugucuuuguccaaguguucuuuuucauugcgaccuucccugaccaugcuuugaaaccuuccugcauuauuuuucccuauaaugugcaucaccguuugacauacuguauuauaaaauuuguuuuuuuuuuuuucccuguauauuucuguguaccucuuaccacagagcuuggaacauccugacaaggauuuguucacugcuguauguccaauaccuagaauauugcuuguuacuuaauaaauuuguguuaaaugauugacuuuuacugauaaacaaauugaaauucaggcaacuugaguaacgugcucaggcuuauaucuauaauauaauaaaucuccaguccucugucuccauagcucaugacuuuucacuagaauacccuaccuuuuuaaaauauauguaagaaccuaaaucuaaauaguuuuuuuacuuuaugaaguagaauuagcccuuuccauuuuaaugauuuucccucaagccaccauuccacuuugaugcuuuaacagccaauauguaguuggagugggcauucuccucuccaguggugucaguaucuuaaaaagacuagucguggaccaggcacaauggcccauaccuguaaucccagcacuuugggaggccaagguggggcgauuguuugagcccaggaguucgagacgagccugggcaacauagcaaaacccuaucucuacaaaaauuacaaaaauuagccaggcauggugguguguagucccagcuacucgggaggcugaggugggaggauugcuugagucaagagggucggggcagcagugagccaugaucgugccacugcacuucagucugggcaacagagcaagacccuguuuaaaaaaaaaacgaaaaacaaacaaaaaaaaacccagcagucuguuguaaauggcugaaagacacauucacaaauuguucaguucuuuuuuuuaaaagaaaguaaguaauuguaccuaaucuuauccuuuauagauuaaaaaugguuaggcuuuucucugauuuguuuuugcauuucacaguaggaagccauugaaaucugaugacgguaguagggcuuuauuauaccauuuuuuuaaagcuaaaaguguauaaaaauggagaaaauagggcugcgugcgguggcucaugccuguaaucccagcacuucgggaggcugaggcggguggaucaccugaggucaggaguucgagaccagacgggccaacauggugaaaccccgucacuacuaaaaauacaaaaaaauuagucaggcaugguggugggcgccuguaaucccagcuacucgggaggcugaggcaggagaaucacuugaacccaggaggcagagguugcagugagccgagauugugccauugcacuccagccugggugacaagagggagacuccaucucaaaaacaaacaacaacaacaaaaaaacccccaaaaauggagaaaauaacuguucuauugaacuuuuuagaaaacuuggcauacauuuuuuucuugguaucauguaucauaaaugccaguaaucuccaggauuagcaacacaaaacuaaaugucuccacauuaucuuucgugaguguuguuucuuuggugauugcuccccuccccauuuauuuucagaagaaccaaaauagugacaucugcacugaguuauugugguauaaaacagcucagaggaucugaaacuaaaaccacuuuuuagguaugaaugaaaauuuuuuuauaagucacugggaaauucuugcuuuugccuaauaugguaaagguaguugucaaaaguaacuacauauauauuuuauaguuuacagaaaaaaugaauacccugcauucugccuggaaaucuucuaaccagcaguuuugcuuagcuccaaaacgauuuauaguugaccuucauauucacagaugcccaacaguauuuguccauaucuuucuuaugaauaacauucugcuugaagucugguuguuuguguauuugucuuaucucuccuagagauugcugaguccucaagaauaagaacaagaacuuacucaugucuguaucuuccacagggcuagugcuuuauagguacuaaguguuuaguaaaguguuuaaaugaauuuauuagggggaaaauagcauuucaaauugucaaauuguauauuaguaggauuugcgugaaauuauuuuaucuuacuugcaccuuuuuuaaguuauuaauucagauguaauguggauuacaucuauacuauaauguagguuacauucuauacuuucuuuacucuugccugcuccccagguacccuuugaucuuccuaaucaaccaaccuggacccugguccauuaaaguauuuccacgauuagaccaucuauuucuuaaucaaguaggagaguuucuacuuugaauucuccuucugcauuuuagaaauuaggggaauucuguccuuauuguagaucacuuauggauuauuagaugucauauuugucauguauauccccaugugauuauguuacaauaaaaaucaaaucaauacaaauuugagugcuucgauuuucuugccuguaacugggaauuuuacucucuaaaacuuuugugaguaugaaguauguuaaaacuuuugugaauauaaaguauguuaaaguggcuagguugaaaugguuguauaaauaagacagagguuaaucaucgaaaccuggacuuggcuuacguaugcacaauucucuuuucuuacaguuuggcuaagauagauauuuuaaaggcaguguuacuacuaacuaaaggaaaaacaaaacccaaacaagaaguuuuaaaaguauagaaucagacagauuuuagagggugcacucuuucccaucauguaacuaaaauguagucacagauuaguuuugcuggacuagcggauugcuuuguuaguuuuuccacuuaucuucaccugaauuggucggcuagaggccacuucacuagcugauuauuaguagccuccgccgcgcccacauuaacaccuuggagagaggacacucaucagaucaggggcuucugugucucaugcuacuucccauucauggcugugcaguccccuguugccuuuguuucuucuugaugccugggccuccuuaugguuuuuuuguuuuuguuuuuguuaaaaauggcuugugauuccaggcucuuauuuuaaaccuacugaaucagagucugugcagauggaguguguuaguggguauuagcuaauuccccaaacugaguuuugaugauucucaugcaaaggcagauuugggacugggucaccugguuaccaaguuugcccucuuuuccacgcuggggcacacgucaagauuuuucuucauuugcagaauaagaugagugcaguagcugagcccaguaggcugaaugggcuugguaaccugaguccucaucuuuacuacucaaccagccuagucccugagugucuaaagcuggccacaacuccuuugagguuuuuuaaauugaagcucugugacaacagggauaucacauacauaccacacaaaauauuuccuccuuccugugccuauaucagacagugccuauaucagaacucucuuucucauuaugcucagcuagggcgcauaguuuguugggaagacagagaagguggcaguaccucagugaguguucacauguaccuccaggcauagauggagauagaugauuucuuggagccuggucucugcucuuuuuuuuccugcaacacagacccaggugagcccuccugcaaaguuuggaguggccuuccuuaggccccaggcuaccauuucucccccaaauucuguuuuucuuccccaacaguaugugggcacuuacaauucugaggacuucacaacccaggcaaguccuggauccucucuguccugggcugacagucuuccuuuucaccacuccugaccucugaggccagcugggccaagccuucucccaggccauugucauaggguucuaugcugaugggaggauuagggaugggggcugguugaaagccuguaugagagaagucuucuaggagcccaaggaauuguuggaauugcugcauuuguuggaaggugcuaccuuccugcaguucccuuucuguaacuguccuacaguucauaagcuaauaauucagacaugagucuggagaaaauaugcuugguauugcucauaagggaaaggcaacauauggaggaggaagaauuuguuuuagauuggcagcuugucucaucaucaucaccagcaacauguuuuuccaguaggauacugggagacaaagaaggcaaagccuuuggguuuauccacagcauauuuaaaaugagaacuuguaggacaaggcaguuaauauuaggugcuagcugagggguacgggaagaaacguaaaaaccaagcucugauauugaagagagagugaauguccucaggcugagugccuggcaaccucucccugggguaucccugagagacccacugagccuguagagcauuccaucaggaugagugcaggauggggccaggggccuucuaaauggagggagugacaugaggaaagugcagagcaggcagcacaaacucaggcaggcaggggguggugcacaugagcaggcgugccuuggugucagaaauugggaguggugggggugguggagugcauucuguccuggguguaaccgcucagcugcaacugaugguauguggaaguguggaucuuauguagacauacagucaggaguacagguuuuuauauggaagcuuuuuuaaaaacaccaccuaggccaaacaaaacaccugcaggccauauccagaccccaggccacugauuugccacuuguggcacagagauauaagcaauaucucggcgagggguccuccaguguggcuggagggucacagguuuguggagagaguggggagugaggcuaaaggucuguugggggccagacugggaaggacuuugacuacuuugcuggggaaucugaaagcuauucuucaggcuggagcacuacugaggguuguuugaggagggcaguggccgucuggucugugcuuugggaagauaauccugauggcaggugaugaguacauuagagaggccacaugucaaggcacagaaaucacacaguaaagcuguuuggguaggugguugggcuuaagggauugguuugcaaaagaaagguaaaaugaaauguuucugaguuuaacugucaauccguuacccagaauuggcucagauagacauuugugucacuggguaucuuccagccuaucacuuuugcuuugaucaacagcacuuuauuauaguaaaauacacauagcauaaaauuaccauuuuaaccauuaaaaaaguugaaaacauuuuuuuuuguagagacaggaucuuucuguguugcccacacuggucucaaauucccuggccuuaagcaauccucuugccuuagccucccaaagugcugggauuacaggugugagccacccccaccuuaaccauuuuuaaguguaugauucaguggcauuaaauacacucacauuguugugcaaccaucaccacugcuguaguugugauguuuguccaccuaaaaucucauguuccccaguauuagaggugggagaucuaaugggggcagaucucucacgauggcuuggucccauccuugaaauagugaguucucuuucuauuaguucccaagagagcugguuguuaaaaagagccuggcaccuccccauugcccucuuuugcuuccugucuugccaugugaucucugcauaugccagcuacccuucaaccuacugccaugaguagaagcagccugaggcccucaucagaagcagaugcuggugccgugcuucugguacagacugcagaaccgugagccaaauaacgcucuuuucuuuauaaauuaacccgccuuaguuagguauuccuuuagagcaacacaaauguacuaagacaaccacucugccucucuagaacuuuuaaucaucacaaacugaaacucuguacccauuuaacaguaacuccccacuacauccucccucugccuuugguaaccucuguuuuacuucuguguuauauaaguggaaucaugcaauauuuguccuuuugugucuugcuuauuucacuuugaaaacagcauaauuuauaacuuacauuucaggauuugaaguuagauucuuuaaaugagagugugaagcuaaaaaaaaaguuugaaaaccacugacucauucucaaauuguuaccuuucucaaaguucagccuucuuggauuucuuaaugaggacauuuacuuuacgucuucuuugccuuucucucucuagcauauuaauuagagggcuugaugaaugaaugaagcuaagaaauaacagaccagccuaauucuugacaucacucaugcauugcuuugguaggauuguggaaacaaguuuuuuuugagaucgccugucugugugagauguucguaguggugcugaaggcaagucucagaguuuccuagaguaaauguucuccaucaauuccauagccaaagaagcuacucucagagcccaguuuucccugaagauucaggucucagaucuuccugccucacggugucaaauucuggcacugcaugcuuucugguguggagaaagaguguaauuugauuuugaguuuuuggauugaaauugcugguuggagacuucuguuuuuucuuuuuuaauuuacauacauuuaauggguacaggugcaauuuuguuacauauauugcauaguggugaacucugggauuuuagugucacugucaccugaauaauauauauuguauccauuaaauaauuuucucaucaucuacccuucccagucuccguggucugccauucucuacucuuuguccacguguacacauuauuuagcuucuacuuauaaguaagaacaugcauauuugacuguuucugaguuguuucacuuaagauaauuuuguuuuguuuuguuuuguuuuaaucgagacagugucuuacucuguuccucaggcuggaacgcagugacgcaaucacagcucacugcagccuugaccugcugggcucgagugauucuuccggguucaagugguccucccaaguagcugggacuacaggugcaugccaccacaccuagcuaauuuucuuuucauuuuuucuagagaugagguuucaccauguuggccagucuggucuugaacuccuuaccucaggugauccaccugccucggccucccaaaaugcugggauuacgggcgugagccacugugcccagcccagauguuuuuguuuuaaugaagaacauaaaugggguauucacccauuuaccucaugugcauacuugaguggauucuauaugaggaaaaaaaaauuuccuuagguuuaaugugauuuuccugaaagaguacucaagugucuuuuuagaacuguacauacaggaaauaggaaucuuaagugugguuuauuggcauaguuaucaaagccuuguauugcugaugcuaauaacauaauauucagcgacucacagagauggaaaggauguuagaagucauuaaacucaaccucuaagccucacucuuccaaccccagugguguuaggaaaguuuauaauguuguggguggugaauggaacauaaugagcaguuuauaauagauguucaguaaagaagucagaauagugauuguuaauguuaaaguggacuauguccacaagagaaggaucaguacaguaagaggacuaaaaccaggaacugugauggugagugcagaggagaaacauuuuagaagguggaacaugauacaugucauuaacucucuggacagcuaucauguagugcaauaauuguuuuuuuuauguagugcuaagaacaaaaauguuacuguggauuauuguagcuucaaaugaauaagaacuuuaugagacuuggauugacauuaagcuaaacaggcugcauugaguuacagaggagauucuaauauucauugugguuaaugauacaaguauaauaaaauucuuaauuacaaggaacauauccccauuuuacccauggccuuugaaggcaaggacuguguuguccuccaggcuguacuuuggaaggugccugccaccugucaggcucuugcuaauuuuugaugaaugaaauuaaaaugauuuuaaacacuagauuuacauuuaucccgcuguccaacuuguauugaguaauauaugcaucgaucuuccuuaaaauguucauuuuuuucuugaaaauguauuaguuauaucuaaaauguccuugccccauuuuuuucuuguucuuuguuuaucucauggauuguuguaaagugcuuacauucagugucagcauauuaguuguaaccuuuuauugcuauugauaucuauaaguacguuaaguaaaucuucauuuugcugaccucuuugaggaugcauggcaucagcagauucucucuuucacuggacaggugagagauuagcaggaucaagucaauuuuucccuuuuugcuuuguuuccuucagagcagcaagauucauugucuagcgagagggaaacuguguuaaauggcagaauuugucuuaguggugaugguuuaaagagugcauguaaauuauacagcuuguuuacacagggucugauagguaccacuguaggagauucuuuuaaaaagcuauuuuagcaagacagucauuuuaacucaaccagauuaauagcaugauaauuaauagcacaagaacuuuucaguauaaaaauuggcuuguagauaacaugagauggcaguuuccucuucccuucugagauuagugaggcugcuuugccagauggguuuccauuauuaacaagggagagagucuuccaggcccucagaugauaaguuccugggguaauuuguuuaccuguuaacucuuugagggagagcagcaggaucugccugccaggguguggagaaguugcaggagacaugugaaagucagagcaugugguccucuaaaguauaguuguagauucucuuccaaaaagggcagaugcgugguaguaggaacaugaggacucuuuccccuugcaaaugauuauucuuuuaucaucucuucugaccauuuucuuuuucuaugcuuuauaggaaacugggucccuugaagaaucuacagaugagucugagguaagguggugacucaggagcccucggauuuguagcucaccacguuguucucuugaguugcgcuucuuugcuaaaugcaacauucccaggggcugaggguguaaagcagggcgauagguaacuaagccuuggggaagagcuuuuaauaugccagcuaucuuaaaaaagauuaaauggauuagcuuaaaaaauaagaaaaggaacaaaaaguuuucaucugaaacaauauuuuaacuugaaacauguuggcaguuggaaaauugauacaaaguuuuagaaauuuaucucaacacuuuaacaucccccucaccugcuuuuuaaaaauagccacuguagguuuuaugauguuuauucuuuauuuguucuuuuaaugaaugugacauguuuguugguauaauuuuugaaucauugaaauuggaguuugcuucuuuuuuuuuuuuuuuuuugagacggagucucgcucuguugcccaggcuggaguguaguggcuccaucucggcucacugcaggcuccgucucccagguucacaccauucuccugccucagccuccugaguaacugggacuacaggcgcccgccgccacgcccagcuaauuuuuuguauuuuuaguagaggcaggguuucaccguguuagccaggauggucuugaucuccugaccuugugauccacccgccucugccucccaaagugcugggauuacaggcgugagccaccgcgcccggccuggaguuugcuucuuaaaaagggagcuacuuuaaaaguuguuagguuauugugauaaagauaguuucuuaaggagaauaauauauaaggaaggaguuuuuaaaaaauuuauuuucaagucugcauaagaaauguuuaagcauaauauaaauuuuuuuuuuuuuuuuuuugagacagaguuucacucuugucaccuaggcuagagugcaauggugcagucugggcucacuauaaccucuaucuccuggguucaagugauucuccagccucagccucccgaguagcugggauuacaggcgcccaccaccaugcccagauaauuuuuguauuuuuaguagagacaggguuucaccauguuggccaggcugcucucaaacucuugaccucaggugauccgccugccuuggccucccaaagugcugggauuauaggcaugagucacugcaccuggcccaagcauaauguaauuggcuuaucaauuuuauagauggacucauaagaagaauuacauuuuuccuuuuaauauuucauuucgcucagaggaaugaaaauguaucugugauaaccugcuagaaauacacacugauaugacucuagccaugauaaucuauuacauuuggguugauacugcauaagcuuaugugaauuuuguugcuuuuccagggaaaaguuggacuuaugcauauuucucuagagaacagauuauauaucagggauguccaaucuuuuggcuccccgggucacauuggaagaagaauugucuugggccacacauaaaauacacuaacaauagcugaugagcuaaaaaaaauugcagcagaaaaucaaacaguguuuuaagaaaguuuaugaauuuguguugagcugcauucaaagccauccuaggccauauguggccugcgggccauggguuggacaagcuuguuauguauuaugucauuguguagucaugguuucuaacauuuucauuaauaaggauuuccauuacuguggggcuucugguaaggcauuucugaguuugcuuauagauaggguauauuuguuaauuucucauacaguauugaaaagcauuuuagguuaccuuauuuuggaaaucucuaauuaacuaagauuccaguguucuuagaaucauugguacagaaucagacagugcuggaacucuguugaggaauuucauuuugcaggugaggaggguguuggcagccaccuaaaucuaaaucuuuccacacaugcuccaaauacuaaacagcucaacaaagaguaaauaaaagcacacacaaucuaggccucuaguauaauuagcaaauggggaguaauacaaacuucagugcaagugggaaaauaaacauccaaagccagcagagucggcucuggaguugacgcuggagcugacagucagauggagacuggguagaaauaaagagaguacagcugagacccagccgaggcagaaugcacauaaaaaucaucuuagugagaagggggccccauucuuaguggggagaucugagaacagaugugagacuugguggauuucgagaauuuaaagaaaggagcuugaaaguguauagggcuuuaggugacaagaguuggauggugcugcuuuuggcagagaugggggaggcauccuuagcggcuuggcagugaaagaaaaggacaaagcagaggaaauuaagggugcccagaaacaaagaacaucaucagaucaggagacuuaccuacucaccaaaaaaagaugccuccuagaaaagaaaaugcagaaaccugguaaaccacacagaugcuucaccccuucuucccugguaacgucuguuacugcuauccaggaaaauccaagacauuuaaaaaugaauugaaaugacaaguaacauccauaaaaagcuacuauaggaagaaagaaagucagaaucagagguuucaguagcagaaaacaauaacauaacacuccaucaugaguugaaugucuauaaacaagcauuugcagauacaauaaacuaccuuaacgugguuuguuuuuuuuauuuuuuuauuuuuauuuuuuuuuagacaaagucuugcuuugucaccaagacuggagugcaguggcacgaucucggcucacugcaaccuccaccucccagguucaagcgauucucaugcuucaggcuccugaguagcugugauuacaggugugcaccaacacgcccaguucacuuuuguguuuuuaguagagaugggguuuugccauguuggccaagcaggugucaaacuccuggccucaagugaucugccugccucagccucccaaaguguugggauuauaggcgugagccaccgugccuggccacaguaaaguaccuuaaaucagauauuuaaaaacuauauuagaaauggacaaagaaacuaggaaguuagggaaugagacuuggccaaacugaggagauaaauggaaggaaaagguaguuauuuuaagauugaggaaagugagacccaaauguggcuugauugccuaauguccuacagcugaugaggaggagaaagggguuccaacucugggcucuuuccauuuucuugcugucuagccuccagugccuacugcuugggauagugcuaaagaacuggagguggacccucauuuguaucauggccauaccuugugcuuuuuguaugaccugggcauagcacuuaccuccuguauucuucaguuuccucgugugaaaaaugggucuuguugcuugccuuguaugguugcugugaagauagauacgauuaauguucauaaagcaucuuauauagagccuagcacaugggaagcacuugcuaaauauuaaugaccuucaguuuauauuuuagauauugucaugguggcucauuuuccagcuuggugcuucaaccugagggcuuagagagauuccucccccacuuccccccaacccuagccuccgugccccccgcugccucuagcucuaugaaaacaguuacucuccuagauauuacugauucuacugaguuuauggaccagcaaaguagucaggauguugauggaccagguuuaggccuuguaaguguaguaagccuguuugcaguugagccuuugaagacuuuggaguuuuuuuacucaguuugaaucacuuuccaguuccaggagcgauauuuugagacaccacucaguccaccagagauuccuccuucauccauuucucuucguucucuaucaucucuucucguguuuuguaacuguuaaacuuuuuuugaaggacaggcauuuuccuuauauauuucuaccuuuuccuuauucaagugcuaggauaauuuccauuuccauaaagaauaauguguaguguuuucaaccauauaacaauuuauauaucauuuuaugaaauguugcauuucauguaaacugugcuuuuauauuauaucaguaagacuuuuaaauuuaucugaaggucuuauuuuaauauauguuugggaaaagaauauugucuaccaaaaacuggccguauguuuuucauuacucuugaaaacuacaaucaaaugaaaugaaauuguuuaguuaguauuauuaauguaaaggaaagugguguacaugucaauauuuaaaacuuuaagaauuuuaauauauuuugcaguuaaaguagaaaugcaaaaucauguuacaaccaagauaguuaaguaugucauuuaauaggcuacauaguuaaggguccugcauuuacaguaauaauugguuguggcaaaauuuugagacuaacuaaacugguccuuccagcguggauguuuugaaaaauaugcaguguacuguuuauuucaccuugauauugugagccagacuacuucuuagaugguguuuuauuuuugaagagcauaacaaagaaguacauuaucuucaaaaggauuucacuccuauuuugaagcauuaagaucuuuucaauacuuagggaugauugcucuuguguaaaugguaacagagugaggugggagcacagaggaguggaugaauggucaggaauggcuucaguuggagucuucaagagugagucugccuagaaucuugggaggugagucugggcagcgaagcugggagucuuugggaaggagggaauguaugugcagagacugagucaugcaagaguauguauguauguuuagccacccaugaggcacucaauguggcuguaguguagaaggguggggcagugaggcuggugaaggaaauuggugcgguugugaagcuccuaauguauuaaaccaggaaguguggacuugauucuguggccaucggggagccacccaaaaguuugauuguugagaguagggaagggguuggugacagaugaacuggaaggagagaugauagcaggaagaccauuugcgugguucucauggaaguccccauaagagauaggaggaguguagaggccugggcaaggcaguagcggaagacaaagaggaacugacuccaaggaaaugcuucuugaguccagucaauaggaaauauaggauaguguggaagagacgagccaaauggggagucaggaagauuccagugucuaguucagcuuuguuacaguaaaaugaguccaguauaaacagugagaggaaaaagauguucuaauccugaauucugaaccuaaagauugaugucuuuauguuuagauuauucuuuucuuuaaagugguacuuuguaauccauuggugaccucuuuuauauggccuuguucaagcugaaacaaguaauaugcuuccguauuaaauauauuuucaaacaaaagcaaaugaucaaauuaauuucuggaauuuuauuuuuuaaguccuacaaguuacugcuuguuagaggcaggucugggcccccuuuggagcaaagauguaauggaacaaguaucgugugagaagucuacccugauaaugaugaucauuacaaaaaugaacaguuauuuaguauagaaaacagugcugggcacuuugguaugcucuuuagguaucuuaaucugcccugugacuuggccaugaugaucacuuccaguuuacagauaaaaacacagacuucaaguuuucgguaacuuugcaaggcuacccaguugguaaaugcauuuggaucccguaguuugacuccgaggcuccaaccucuaguuauacugccuuuaacuuccuuuugacucucuguuuuuaggccaaacucuucuucuauguaccuuuauagaauuugacaggauuaaaaaaaaaaaucuuuggaauuuucucuauguauaauaaugagauuuuuggguaauauuacagauuucgauuuguucaacuuguaggaaaauauaccaguuucagaauugcuuucuauuccagagaauagagaauaguuaauuuauauauaauauuaauuguuuaauaaaguuccuguuauaccucaaaauauauaaugcuguuuauuuacaaaacaauuauaaaaauauuuaugaaauaauguuagcugugagaccuccuuaaaaauacucauuucuguauuuagaaauuuagcuauaagagcauucauuugcuuuguauaauacaaaaauuuggaaacaggcuaaauauccagaaaugaauugauuaauaaagguuuagucauauaacccauauaauggauuguuauucugccacuaacuugauuaauggcauuaauuuuuaaguaaagaaaauauucauauguccuuuuucauguuaucuuuauaauuuaaaaagcuuuuuauaaaaaugccauuaagaacaggagucgacaggcguuuucuguaaaguucuagguaguaaauauuuaaaagcuuugcagacagaggcaauauggcagauauuauguguguaucugccauguauguaacuguguaaaaguguaaacaucaugcuuaguuuaugggcuguucaaaaacagaugccuggcuggauuuggucugcaggcuguaguuugcugauucccgauuuaggauauauacugguuucucucuaccccacaaaauccauauauaaacaaaggaaaagcauacaaggccauauuaucacugggacaugugcuuuuuaauuuuauuuacuaucauuaucugccuucauuuucuaaauuuucuauaauaugcauaacuuauauacuuagcaaaauaacuuuuuuuuagcaaaacauauucaucuuuauacauauuauaggugucuucuguauugauguuuggguugcagagcuauggaacccagaaugaaaugguaugucuuuccuuccccaucucaaacucucuaacaagggaguuaggggaaagauuugguuuauuucuuagccaauuuuauuguauucaagauuuucuguuaauauaaagccaaaauuguuuuuuauucuacuacacuuuuuuuuccuugagauauuaaauuuaaaaaaaagucauuuugaaauaaccguauauucacauguaguuaagaaauaacacagaggugggaggucaaggcgggaggaucacuugaggccaggaguuugagaccagcuggggcaacacagugagaccccgucucuacaaaaaauuuaaaaauugacuaggcaugauggagcuugccuguagacaugguuacuugggaggcugaggugggaggaucacuucagcccaggagguugaggcugcauugaaccaugauuaugccacugcacuccagacuggacagcagagcaagacccuaucucuaaaagaaaaaaaaaaagggaaaaaugcaaagauauucugaauauccuucacccgcuuuccaaaggguaacaucuuacguaacucuaguacaauaucacgccaggaaauugauauugauacaaggcacagaccuuauuuggauuucacccguauuacaugcauucauuugugugugugcaugaguuuguguguacuuaguucugugcaguuuuaucaugugaagauucauguaaccaccacuccacugcagugaaaauacaggacaguuucaucacaagguucccugugcuaucuuuuuuuggucacagccacuccuugccgcacauccaacuccuggcaacuacuaaucuguucuccaucuguauaauuuugucguuuuauacauacuauaugcauagaaccauauagagcguaaccuuuggaaaugggcuuuuuuuggugcucugccagucuuuuaacuaguuguaggcagaccacucacauuuaaaguaaugauauguuaaggcuuaagucugccauuuuuugguuuucuguuuguauccuccguuuuucauuucucuuguuucucuuuccuuucuuuccugugcguuacuugaacauguuuuaggauuccaucuuaauuuauaauauuuuuuaguuccuuuguauaauuuccuagugguugcucuagguauugaaauauauauacauaacuuaucacagucuacugguguccacaacaguuugccacuucuagugaaguguagaaaccuuacuuccauuuaguuccuuuacccuccuugcuuuuuaagugcaauuguuuaaauauuuacuuuauguacuuugagcaccacaucaguugguauuguauuuuuuggcuucaacuaucaaaugucauuuaagaaacucaugaaaagaauaaucuauuauauuuaccccuguuuucacucaucucuguguucucuucuccuuuuugaaguucuaagccuuuuuuucuguuaucuucuaucuucuacuguuccuuucuguauggaaaacuccuauuagccacucuuuaaggauaggcuugcaagugagaaauucuuaguuauuuuaaauuuuuaaauuuuuuaauaugagaguaucuuuaucuucccuucaguuuuaagguuuuuuuuuuuuuuuguuuuguuuuguuuuguuuuuuuaaccagauacagcauuugugguuggcaauucuuuucuuugaggacauaagauauauugugccacuucccucuggcuucuaucauuucaaaugagaaacccauuuucauuugaauugguguuuccgguaagaaaugugcuguuucccuagcuguuuucaagauuuuuuuuuuuuuuaacuuuaguguuugcaaguuuaauuauaaggucuuugggcaugaauuucuuuuauuugucuuauuugggguuugcucagcuucuggaaucuguagguuuaugcccuucaccaaauugugaaaguuuucaaccauuuuuucuccaaauacuuuuucaaucccacucucuuucccuguggaacuguaauaacaugaauguuggcccuuuuauuauuuuuuucacaggucccugagacucuucauuuuuuuuuuuuuaaauuauacuuuaaguucuggguuacaugugcagaacaugcaauuuuguuacauagguauacaagugccauggugguuuucugcacccaucaaccugucaccuacauuagguauuucuccuaaugauuucccuccccuagccccccaccccccacaggccccagugugugauguuccccaguagucauucaggaacagguuguucaguuuccauguaguugugugguuuugagugagguucuuaauccugaguucuaauuugauugcuuuguggucugagagacaguuuguugugauuucuguucuuuuacauuugcugaggaguguuuuauuuccacuuauguggucaauuuuagaauaagugcaauguggugcugagaagaauguauauucuguugauuugggguggggaguucuguagaugucuauuaggucugcuugcuccagagcugaguucaaguccuggauauccuuguuaauuuucugucucguugaugugucugauauuaacagugggguguuaaagucucccauuauuacugugugggagucuaagucucuuuguaggucucuaagaacuugcuuuaugaaucugggugcuccuguauuggguacauauauauuuaggauaguuagcucuucuuguugaauugauaccuuuaccauuauguaauaccugcuuugucucuuuugaucuuuguugguuuaaagucuguuuuaucagaguccaggauugcaaccccugcuuuuuuuucacuuuucauuugcuuucuacaucuuccaccaucccuuuauuuugagccuaugugugucuuugcaugugagguaggucuccugaauacugcacaccaaugggucuugacucuauccaguuugcgucugugucuuuuaauuggggcauuuagcccguuuacauuuaagguuaauauuguuaugugugaauuugauccugucaugaugaugcuagcugguuauuucccccguuaauugauacaguuuuuucauagcaucgauggucuuuacaauuuggcauguuuuugcaguggcugguaccaguuguuccuauccacgucuagugcuuccuucaggagcucuuguaaugcaggccugauggugaugaaaucucucagcauuugcuugucuguaaagaauuuuauuucuccuuuacuuaugaagcuuaguuugacuggauaugaaauucuggguugaaaauucuuuucuuuaagaauguugaauauuggcccccacucucuucuggcuuguaggguuucugcagagagaccugcugucagucugauaggccucccuuugugggugaccugaccuuucucucuggcugcccuuaacauuuuuuccuucauuucaaccuuggugaaucugacaauuaugugucuugggguugcucuucucgaggaguaucuuugugguguucucuguauuuccugaaugugaauguuggccugucuugcuagguuggggaaguucuccuggauaauacccugaagaguguuuuccaacuugguuccauuauccccgccacuuucagguacaccaaucagacguagauuuggucuuuucacauagucccauauuucuuggagguguuguuuguuucuuuucacucuuuuuucucuaaucuugucuucuugcuuuguuucacuaauucgaucuucaaucacugauauccuuucuuccagccgaucgaauuggcuauugaagcuuguguaugcuuuacgaaguucucauauugugguuuucagcuccauuaggucauuuaagcucuucucuacacuguuuauucuaguuagccauucgucuaaccuuuuuucaagguuuuuagcuuccucgugauggguuagaacgugcugcuuuaguuuggagaaguuaguuauuaccggccuuugaagccuacuucggucaacuugucaaacucguuauccauccaguuuuguucccuugcuggcgaggaguuguguuccuuuggaggagaagagguguuuugguuuuuagaauuuucugccuuucugcucugguuucuccccaucuuugugguuuuauccaccuuuggucuuugauguuggugaccuauguaugggauuuugguguugauguccuuuuuguuuauguugaugcuauuccuuucuguuuguuaguuuuccuucuaacagacaggccccucagcugcaggucuguugcaguuugcuagagguccauuccagaugcuguuugccuaggugucaccagcagaggcugcagaacagcaaauauugcugccugauccuuccucuggaagcuucgucccagaggggcaccugccuguaugaggugucuguuggccccuacuggaaggugucucccagucaggcuacccaggggucagugacccacuugaggaggcagucuguccguuauuggagcucaaaugccgugcugggagaaccacugcucccuucagagcugugaggcagggacauuuaagucuggagaagcugucugcugccuuuuguucagauauacccugcccccagagguggaaccuagaaaggcaguaggccuugcugaacugcggugggcucugcccaguuugagcuucccugccacuuuguuuacacugugagcauagaaccgccuacucaagccucaguaacggcagacaccccuccccccaccaagcuccggcaucccaggucaaucuuagacugcugcguuagcagcgaguaaggcuccaugggcaugguaccugccgagccaggcacgggagaggaucuccuggucugcugguugcaaagaccgugggaaaagcacaguauuugggcaggaguauaccguuccuccagguacagucacuuauggcuuccauugacuaagaaagggaaaucccccgaccccuuuugugagggugaggugacgcccugcccugcuucugcuugcccucugugggcugcacccacuguccaaccagucccaaugagaugaaccagguaccucaguuggaaaugcagaaaucacccaucuucugcaucagucucgcugggagcuguagaccggagcuguuccuguuuggccaucuuggaagugacgacucuucguuuuaaaaagcugguuuucucucucucauucagaggguauacauucucuugaucuauccucagauucagugguucugucuugugucaucuccacacuguuauugagcccauccagugaguuaugucuuuugguuauuguauuuucuaguucuaaaauuuuccuuuuuuuaaaaaaauucuauuuauuuucugagauguccuauuguuucacuugcuucaagagaauuuauaguuacuuguugaaacauuuuucuaauggcuacuuugauauuuccaacacuggauucaucucacgauaaacauuuuaaugcaagacaauauuuaaaucaugaagacucaauugcuucaauauuuccuauaugccucauguuaugcugaguccuuuauguggauuaucucauuuaauauggaccacaguccuaucagguaguauauuuggugggagaggcugguuaugcugaaguaacaaacaguuccaaaauuguaguaucuuaacacaacauuuauuucugaguagaauuaguagugcaggaagaggaaauugagcgauuaauaauacagaaaugugaucauuuucuguaggguuuuuucuauuuauggaacauaaacaaugugcuauggaauacauuggugauagaacuggagacuaaagcagcucugcuucauggagauaaguauuuuuuaaaaaauccugcgucucaguggauuaugagguggggagaucgagaccguccuggcuaauacggugaaaccccgucucuacuaaaaauacaaaaaaucagccgggcauaguggcaugcgccuguaauuccagcuacuugggaggcugaggcaggggaauugccugaaccugggagguggaggcugccgugagccgagauugugccacugcacuccagccugggugacagagugagacuccgucucaaaaaaauaaauaaauaaaaaauaaaauccugcgcucugaauagguucuugguguauuauauauuuagaaguauaucccaccuuucucagaagaguuuagaguauaguacaaagaacuuugcaauguaagcaucaaauuauuagccuaacauuucaagauuacaguugaacagcagagagaagaauaagaagggaaaaaacaggcuaaagaggaguguuaaggaaagagaagagcaccaaauagcaagugaaguguuuugaggucugcuuuguaccagaugaggguuccagagaccuuugauuugugaacgcaacuaaauagcugaacuaggcuuauucugccuauaguuuguuccguugaagcaaagauugugugcgcauuguauuacucagagcccaggccaaggcagguaguuacagaacaguuaauugguguaggccaggcgcaguggcucacacuuguaaucacagcacauugggaagccgaggugggaggauugcuugaggucacgaguucaagaccagccuggguaacauagugauccuuccucucuacaaaaaaagcaaauaaaaaaaaauuguguuaccuuugucuuuacaauuuuuguuaccauuauuaaauaagcaugccuccuaaacagaugugcauuuaguucugguuuaguucuuccaaauaccaguuaggaguucuuaaauauguuagauguguaaauuuuaauaaaaccaaguggacugacaaauacuugaaauuauuuaaaauaaaccuguaugcuauuuaguugaaugagaaauuaauuuuaaaaugaaaugcaauuucuaggugcaucagccacaaagagaguucuuuuucaguuuuguuaaaaugaaaaccagucauugugagaaaucaggagauagcuuuuuaaaucaggaaaugcaucacacaaaagucauuuauuuaucucacuugguggguagaacauuaugaaucauuuauugaaaauuaaauugauucuuuacauguauuaauuuuaauaaacagauuuauggcaacuaauaacaaaaaugguaaugugcccuguuaugagauugauugcugagaaaaauggagcauaggguuauaguguccacauagcuuccacauagcacuuggcuuacaaacuugcucuuucauuuaaugagcuauuaauauuaacagguucugcugauuauugcaucauucaggcauggauaaacauucccuuugaagcauauauuauaaaaauuauauguuuggaaacuuaguagaaacuuucugggggcaagauuuuugaaucucuauuacgccccuuucuuagagauugaagagaugaaaacaacuccccugguaugauauauauuugagcagaauuuauaauuucacuaccuagaagaaaaauuauuuuaggcaguccaagauugguugaucauuuuauucauucaaaaaauauuuauugaugacuuuuauauccuagaugcuaggauacacaaguauuucaugagggagacaguaaacaaaaaaacuuaaauauauaauaaaccaagugaaauaacacuaguuaaggggacuauggaguggucugaggaguugcuguuuuauccugggugguuagggaaggccugucuguucaggugacauuugaguaaauauuugaggaaaaagucucauagguaaaaggaagagcaaacacugugcccagagguagggucaugcuggaugucuucuaggaugugaguguggcuggagcagaguggugggaaaugguguccaagaaguaaugggcagcuaagaauguugacccuacaggucaauuucuugucuuuguuguuuuauuuuuuauuuuuuguuuguuuuugaggagucucacucugucacccaggcuggagcgcagcggccgaucucggcucacugcaaccucugccucccagguucaagugauucuccugccucagccucucgaauagcuaggaguacaggugcaugccaccaugccuagcuaauuuuuguauuuuuaguagagauggaguuucaccauguuggccaggcuggucucaaacuccugaccucaaguaauccaucugccucggccucccaaagugcugggauuacaggcaugagccacugugccuggcccuugucuuuauuuuuuacuguaagcuggaaagcauuggagagucuuuguuuuaguaggaucacucuggaugcuguuuuaaaaaaugucuaaggaggauaaguaggaauaggggagaccauuggggaggcuuuguuaaaacucugggcuagaggcgaugaaggcuguaguugcuuuuuguuuuuuaaaguauagccaacagauuuccugacuaaaaugugggcauguaagugaaagggaacagucaaggaugagcaauuggaaugaugggguugcuguaacuaagguaggggaggacucuggcuagaguuaguuuuggugcucagggugaaaauaguggugguggguagguuggaaguucuacuuugcauauuuuaaguuggagaugucaauuagacauccaaguggaauugucuaguagaccugaagaagaguaguucaagucuggacuggagguaagaauuugugacucagcauuuagaugguguucaaaaccaugaaacuggaugagaucauuuagggcaugaggacagauaaagaggccugauuccuggacccugaggggugcuaccacauuuuagagaucugguagaugaagggaaaucagcaaaggaaacagagaaaggguaaccagugagguaggaaaagaaccaggagagaguggugccccagaaaccaagggaggaucccgucucuggaugaaggacaccaucauugugucaaaugcugcugagaggaggaaugagaugaggucuagggauucacucuuggaucugcaaaagugaggccaccggugauucuaagagcacuuguggugacuuguggugacuuguggugguggggcuugacuggaaggagcucaggagagauugaguuggcaaaauaccuuugagaugcccugagaaauucuuguacuguguauuacaaaauggugcaaucuagaaugcuuguaugggacacuuguugagugacuguuaaagaagauaauguguguuugacaccuugccuggcauuaaaagguauucagaaagcaugcugcugcugcuauuuuauuauuuuuuguccauauguaugcaaggcacuuucgugaggauaggcacccuggccccaguaucuaguagagcugcucgucagugaaugaaugaauugauuuuauuaaucgucucaacaauuaugucaagcugguguuguguccucauuuuggagauggugaaacuagggcuuugaggaggccuuugucaaacagaaacaaggaccacuccucgccuccugacucaaccggagaauuguuuuaucccaugccguguccucacagggaucaauauuuaauuuaggagcaaacaaaugagaaguuuuuuuauuuagcuuugaguuuggcucagagcuuccaacucuuuugcucaccaucauuuuuauccucucugauccuuauauuauucucuguaacaggcagaauaaugguuccccaaagaugucuacauccuaaucccuggaaccugugaauaugucauguuacacagcaagggaaaauuaagguugcuaaucagcugacuguaggagagugagauuaucuggacagggccaguauaauccuaagggucuuuguaaauggaagagggaggcaggagaaaaggcugugaugugggaaugauucaaccugccuuugcuagcuuugaagagggaagaagggcccacagccaaggaaugcuggcgcuuucagaagcuggaaaaggagaggaaagggauucuccccccagcuuccaggggagggcagcacuacugacacccugauuuuagcccagugagaucugugucagacuucuaaucuacagcacuguacgacaacaaauuugugucgcuucauacuacuaaguuugucacauuuuuuuuacagcaaugauaggaaacuaauacaguaaauaauuugauugaaugaccuugucuccuuaacacuuuucauuaggccgcauuucagaguuuuggaagucaaauacauccagcaaggagaacauacagaaaaugguugugacgaaacugcuaauacuguggggagcuguauuuauaaaaaugugucuuuucugaugauuguucaagaguguguuuaaaugaucauuucacuugacaauuagggccugauucuaugcugucaaggcuuuaaggcauuccugucucugcaggcucaagaaaugcuauaacaaaucuaaauagcacaaagguuucuuucauccaugagcuauuucaguuucagugcagccguuuuuaaauacagagauucacaggcauccaugucaucacaguucuuuacuuuagaauaugacuguuuuccccaaagaccugaguagauuaaauacgucucucagaaucgcaucagggagggaugggaguggggaaaccucugagagagcuuaaggguuuagucuguugucaucauuuccaucaccagugauugggcaguugugagggauuugggcugucaugggcuacuuuuagucuuuacaggcauccaggagagguucuuggcuaaaauaggagaggguagcauuuccuuuuacauuccuaauaacaagauucacacuuaaaugugugugaaaaaaaauuuuuuuaaaugaugugguaaaauaaaaaguaauguaucuucaucuuuuaauagcuuaaaacaaugagguaauuagauaagaaguguuacuguuugguuuuauggucuggucaugugauaggaaguaacuuagaagggaggccaugaguucugcagugugaaguugggguuguaauacacaucauggcuguauuuuuaguauuucacauucacuggguauuaccagauacuaagcuuugugcuuuacguacauuuauugcauuuaauucuuacaaaaguccucugaggugcagguuaucauuuccuuuucacaaaaggcaagguaaccaagguuuuaaguaacuaguacaguguauaugcgcugcauaugguagaaauggcaaaagaaaaauuuuaguuuguuuugugacuggcucuugauuaugaauuucaguaggauuuuggauaauuuucuuucuuucuuuuuuuuuuuuuuaaagaaaugacauuagugaccuuuauuaagauacuugauuguccuuacaucucauaccuauuucagcaggggucuccaacccaccgguccaugugcgcagugggggagugagcauuaccgccugcgguccaccuccuguuagaucagccacagcauuagauucucauacaagcaugaacccuacugugaucugugcaugcgaaggaucuagguugcacuccuuaugaggaucuaaugccugaugaucugagguggaacaauuucauccccaaaccgagaccaucaccaccacccucacccugguggaaaaauugucuuccacaaaaccagucccuggugccaaaaagguuggggaccacugucuuacagcagcuucuggauuuuuuuuuuucuguuauuugaauacuuccuccaaaaauacgauucagugugggaauuugugaggugacucuucugagccuucaugaagugcacuuugaguuaauccacagaggaagcagccccuaacaagcaucucuacuuguuaggaggaagggagaaaauggaggagugaaugcagccggccaguccucaccccugugaggcugggcuguugcugcccauuucuguagugaauggggaagcaaaaccaggcacccgggggagaggucaacgcuggaucuaccagcuuuccuugacccucauccuuacuguugccccuggcuccccacugugggucguuucagugccuccauaguuucuuacuugggcauguuaauuucuggaaucccucuuuccucucauuuuuagcaugucuucagggcugaguuggggguagaaggccagcagcacaggucagcucucugucuuggcagaagccauguuuuguucuuucuagucauacugucuucaaauaagaccauaccaacuaggaucaauuuauuacguuuuccauuuucuugucuuuugccuuggcuaaaacuucuaaguugguuuugaaaaaagcagaagugauuguuggcaccugugcguuguuuccugcugaugaugggaauguuucucuuauuucauugcuccauaucauguugacuucugaauucaaauggucauucguggcucuucauucuuagcucuucgguaaagaaaccuuuguauuuacugaaagcuuuuuuaagaucagaaacaaguguugaacuuuauaaaugcugucugcagugucugucaagauggcccugcguuuucuuuuuccucugacuuaucaaaugacgucagauuuccuaauacucagucuuuguguuuuugcaauauuugaucuuacauguuuuuuauuaauauaugcgggguuugauuuaugauauuuagacuuucuacauuuaaauuucuacaugagaugacagaauuuuauguauauuuuuuguuguuuuugguguacuguuugggaguuuugauaucaugguuaucaaaaugaauuuggaaguuuuuauauuugccucuuauggggcagcuuaaauaaguugggaauuuuccauucuuugaagguuuuuaauagaacuugccacugaaacagccugagccauguaccuuucugcaugagauagauaguacuuuaauggcuuuuauuuucucacuguuuuuuugugugucucauauucaauuugucuguaaaagguauuaaugcuuggacuuacuauuuuuuuuucugguuuauuaauucauuuuagcuuuacuuuuguuaguuuucucuggucccugcagugcccaccuuccugcuauuagagguccuuugguccugcacugcuuaaggcuggacucccagaccauggagggcacugcccaggugauagagguuuagagucucagccuguggaagaaagauguagaaagaugguggucagggcuaaaaugugugaggauuggagauacagugggcagaggcugcaagcauaguucuccuucuggaaaagaguagcuaagggguagggcaggggucggcucugugaggcuggggcaagcucagccccagucuugggcacagaggguuggugggagagcuagaaaucaucugaauaccuuuuguucagguggguuauguuucuugaaacaaaucagaauaugucaggaauuuagauucaacaaaugugucaguuucuccuugauuuugguaaucauuuuaaugcuuacugcuauagugaauuuuuaucuuuaucuaauuuuucuuggaaauuauugagaaacugguagaggcuuuggugggggugguuagcaaguugcuucuuugcacuuggcuuauggaaugugcaauuggaaaugcucgagaggcauuuaaucuccucucaaacaaaauaauuugaagagcuucagcauuuuccuuuuucguauaacaacauaaauuuauuagaaauaaguguaaguuuuucugacaacugaguuugcaggaccucuauuugcuucuacugcuagaagaugauauaguuccacuucuauaaauuuaucuauaauucuaguuuaugguauuucaaaauugccagcccuuuccuucuguuuggugccucgaccucccugcucccccuuuuaccccuccuucucugugucugcgaaguaacacauaguuuagaugaucucugagguuccuuugguuaauauucuaugauuuggauuuuccuguguggaaaucuaaaugagaaugucuuagaaaagcugcuuaccaaaccuggucugcuguuacuacauacguuuguuuucacuggucuuuauuagguacccacaguucuguuaggugaaguucagaacaaugaaaaggcauaaacucugcuucugaggaucuugugaucaccaagggauauuggcaagagaggaaaagaggguuauguuggcuuuaguggcggaaauuguccaccugaauggcauagcuugaagauuggugagguuauuccauauggcuagaaggaaaugaaaagcuuauuugcuuuucucauuuuuuccccucuucuauauauucuuaucgcuuucccaauauaaacuaaaugaugggaguugauccuguuuaugguauguggcuuagggcaugggaaccuucaccuuauuuuuuccuccuugaauugaacaugaaauucuaauacuacagggcacaggagagaccaggguuuaugaagacugcauaucuugugaaucuuaaguagagcuccucaauuauuaggggcucaacuucucaguuuucugguuaguguguuacgguaaagcaaagcagcuuugagagauaaaaaucuuagcucaguagauacaaaguguugaagaggauguugaaccguuuuuauaauaaauauguuuguuuuagaaaauuuagaaaauauuggcaauagcucacaacagugauuuuuuuuauuugcuaucuuuaauaguuacagcaaccgggugaugugauuucuauuuucauccccauucuacagaggaagaaaccgaccuuagggaaauuacuauauugguguuuauucuucucaucuuccccccauauaugcauauacauuucuuaaauaaaauuuggaucauacaaagcagguuuuaugaccuauucuuucacuuagaaagacauugugagaacauuucuuuuuguuauuaaauugucuuugaaaacagauuuuaauguaaauguaauauuuuaucuugugaaauuuauuuaauccagaauuuuucaaccuuggggcuacuggcacuuugggcuggauaauuuuuuguucugggagagugucuugugcauuguaaauuguuuagcauaaucccuggccucuaccugcuagaugucaguagcaccuuucccccacccaacugugacaacaaaaaugacucuagacauugccaaauaaaugucccugggggacaaaaaucaccucuggcugagaacuacucauuuaaccguauguauuuuaugcuuuaaauaauaauauguggguauaguaaacucaugcugaauuuucuguuugaaaaaguagacccaugccauccagauuacauuuaucagcuccuaauuucagcuacuuuaaaaauuaauauauuuuuuccuuaauagcaauauugcuuguaaguugaaaauuuaacaacauuuuuugcauucauauaagaauguaauugccuaucucucagcagucugauggaaaggcaugcugggagcuuugaccacaguuguuuuauuguagaugaauuccauuaucuucaugucacuuucuuaaaaaguuuggucauugaggcagcuauaauaccuuguguuauuaauggaaaccagaaguuacucuuucagcuuguuuauguaguuuucuugauacguuuugacacuuuagaaggaucuauaaagccaucuuuccuaccagauagucaucuuuguguguaaauaaaaugaucuuucuuuaauagaacuauagcauacaguauuaauaguuacaguugucuuuuuaaggaaguagcauucuuucuugggaugagguguggugggcgauacaaagcugauugaagacuuuuugauucauuuugaacuuuaccuucagguucuuuuuuaggcauucuuuuuucucaucuuggaucuuuucuacacuuuauggaaaacuuuaauacgaaugugacaaauuuggagauguccuauauuauucauguacuuuuagugauaauguuauaguuucaaauaaaugugaauauccaauaauauguagcuccuguguauguugccuuuugugcguguuguuaauguguuaauauccugugauagugacuggaacuauuccuuaaaauauuguuauauguuuuugaaacucaagauguguuuugauugauuguauuaauuuuaauuaugcucuuaaaaauuuauuuguauuugguaccaacuguguuuuaucuuucuauucucuccucuuaauaguaauagcaaagaaauauuuuagucauagggcuucuacaaauugaauuauuuguaaagagagaauuuuuuaaaaugcaaauuuccuaaaauucaaauguucugauacaggauuuugauagcuguuuuuuauauguuaagcuuguaagguccacuacuaauuuuggauauuucaauuccccauagguaauuagaguucuagaaagaauguucuagaggaagaaaaccuguauuuuauagcuucauccccaggguugguuaucgauuuucuuuuuauuaauaguugguuuuuuacuguggaaguucaaacugcaugaaagguuuuuuuuguguguguuugugugugaauuucuuuugaggauauuaguguuucccuauuguaucuagcuuuaaaacauuggauauuuauuaaaaggauuugccccuagucagauguaguugaugacaugaaaccaacuaaaccauucaucuuauuaaaauuccuggagguucagcugaggucuuucucaggugaagcuggagaggaugaaggucaucuccacagagugagaugugaauaguugaggagugcuccacugguggugguuucuaccagccuaauuugggcuuuauaagauaucucaccuuuccccaaucaguauauugaguaucauuuuauuuuguaaaaacaaaacaaaauggauuuuaauaaagaaaugguauccagaggugacauuuuaaguucuguguaaguaguaacaguagaaaaugugaugaucuuucucuuaaccccuagaauucaugugacacacauuuuuaaaaaguaaaauucaagucuucauuuggccuguaacagugaugccauauaaaauguaccaauauaugugaaagauauguuuaaacaagaugaaaaauguagaacccauucugcacaauuauuuuugguuguaaacacugaaaaaaucaauuucuuguauacaaauuuuaaauuauuaggugaaaagaaauguaaaauauucuuguugguauacaagaccaaguuagguaaacaggacuuccuccaugaaaauuuaccccaugguaacacuguaacaacaucacuaaacaguuuuucagggagaagucuuuaaaugcuuugauuuguuauccuuaaaaguaauuucccuccuccuaaguccaaaacucaguaagauugaccaugaugugacauuuauuuucagauaguguuuagaauucuguaggaugguauaaaggacuugucuuuaauuaaaagugcucuacacuuaguaaaaaucuaugugaguugaggaauugauucuuuuuaaaagaaagccgcaaauuuuucuuguauggguaaaugucacucuguucauaucuucgcuuagcugcaagucaggacuuguacuauuccacuagguugucauagaaacgcaguuaacugucaucuuaacucagacuguugaugguuuuauuuguagguuuguaggauuauuaaaauuuaacaaaaauuauugauuugcuuuuuauuaacacuggguuguuuaccguggaaguccaaacugcaugaaaaccuuuuuucuauuauuauuauuuuuuuaguuaaagagaaacucuauaaucuacuagacuuuuaaauguuuuuuauuuaaagugugauauagagucagcagcagcagaauaaccuccaugaaucguauuuuucaaucacuuucuauuuucuuuguuuacagcaagaaggaaaaaaaaaaccuuaaaaaauucaccuuuacccuacuuuuaacuuaacauaaaagauacccgucagaaaagcgugaaaugauacaucaaaugccuaauauuggaguuuucauuuuauuuaugguuuuugaaaccccguaaggaugcuucacugagcuguguugugaaaacauuuauuuuuguauauuuaugugugagaaauuauuuaguuuucacuuauaaguaagacagggaaaccuuauuuacaguaacuuuaucuaaugguccguggaugagugcuuuuaugcaaaauagucaagaggcuagaauuaacuuuucacauuggaugcacauuugauguccagacuugagcaacauguggcaucuuauuauaaagacuaacacucaggauucaauuuguauuuaacauguuuacuucagaaugcacacaucaucugugcuacauuuaauauuaacuuuguaaugauuucucuuucuugcuuguauuuacauaaguagaagugucuguuguuuuuugcaguuuucuuuuuucacauuuuuuagacuuggcuaauuagcuauuuuauauuuucuguuaaaaacaggucaguuuugagguguaacagcuccuuggguuggguagaugaucacuaccuuuucauagaaauguguaggcccuauggauaacugugcauauacuucccuuuuguugcuauuaguucuuaaaguuauucuuggaaaguuaauaacagguauaucaucuuuguuuuuaauacuugcauccgaaauaaacagcuaauagcuuauguauaacaagggaauugaauuuaagacagcuuaucaguagacacgaaauagccugcaugauggccuccagugauccuuaccuccuauuauucaugcucugugccugcaccucccacacugaaucaugacugacccguaugacugaaaggauauuguagaaaugacaguguuccaucugaggccauaugaaacauggauggggcuuccacuuuguuuccucuuggaucacucuugcuucguggaccccuccacagggcugcuugaucagaacauggcaaguggcuuccuccggagugagugauccaagaguguuggcaacuucugccaacagugaggaccaacuugccagccauuugauugagccaucuuggaagcagauccucuaaacccagucaggccuucugauaguuacagcccuagcugacaucuugucugcaacgccgugagaaguccucagugaaccacucagcuaagccacuucugaauugccuacccuuagaaacuguaaacgaauacauauuuauuguuguuuuaaaucaguacauuuugguggccaggaguguggcacaugcuuguagucuuagcuacuuggaaggcugaggcgagaagauuucuugaaccuaugaguuugaguccagccugggcaacauaaugagucucuaucuuuauagaaaauaauaauaaaguaaguaaaucagcaaguguuggcauaauuuguuacacaacaauagcuagcuaaugcaccugcuaaauaaacauauuuuaaaacauuuucuaaugaucacacaguuuauaauuauuucuagguuuagaauaggcuucuguugugauuuguagcaucauuuucuuuggagauuuuggaguguguuauagaagguauugacuuuagagcacucauagcugaauuugaacuuuagcuucuccucuacccacuguaugucuugaggaaauuacuuaaaaucucugaucaccaguuuuugcugaaaaucuguaaaacaggauaauuauacuuaacucucaguaggguuuguuuguuuuuucuuuuaagucaggaugaaaugagauaucugauauuaagucucuagcaugaugcuugauguacuccaucauuuccauuaauccacagauuaaccccuuuccaugugaagaugcaaucccuugccccacaggugaagacuucuguaagaauuugaguuugcagucucugccuagugugucucaucagucuuauaaucuuccauaggcagagcacuuauuacucuacaagucguuuuucuuuugccuaauuuucuuuuuacuaugaugcaccuuaggugugacuuuauauuuauccugcuuauugcagagcuucuugaguuuguagguugaugucuuaucaguuuuggaaaauucuguuguuaucucuuuaaauguugcucuuguuccuuuccauuuuuccuuauccuucugggacuguaaugaaaaguauguuagagcuuuucacuguguucuacaugccucauagauuccuuuacauauuuuccuuccauuuauucuucucuggaguucccuuuggauauuuuuuuuuacucauuucacuuauuuugucuucuguuuugcuaaucuuauauuaaaccaucuauugacuucuuaauucaguuaacauuuucaguguaaaaaauuucauuugauucuuuuuuuuuuuuuuaacagauuagaauucuguugaaaauuucuaucuuuucaucagcuuucugucuuuuucuguuuuuuuuuuuuuuuuuuuuuuuuugaacauauagucauaguuauuuuaaagcccugcuaacuucaaugucuaggucacccauuuguuuauuuuuauggucuuuuuucauccugauuuuuggucauuuggucccgucuuauggcauaccugguaauauuuuauugaauccuuaguacuguacaugaaaaauuguagaggccccaguaguuuucuuucucugaagaggagucacccuuuccuucacuagacaguuauguuggggguuauauaccuuacuccaaucaaagauugagcugagucagaacucuaagggaguuaaguuuuuguguccucuggggaccagggguuccaacuaagacugugauauucaccaggauccaauuucccgaugccucuugaacucuuauucuuaucuuuuuaacacaucaaggcagcugguuugcauuuuucuuucuguucagcuuuuuagcuucauccuuugcagcuuuagaaauugacaguugucuuacagggaaaaguagcuguguaacaagcucaugucucugccucucuuccacugauaucuuagccccgcaggucucucuccaguuuugucacuccauccccgcaagugccagaaggugugcugcuuucccuacccccggcaguggcugucuucccaggcagagcuuggguucucagccucuuguccuacacccagaauuaguaaaugccuccaggaagaaaguggcuguagaaugccagcucaauucucugcugcccuggaaucuugauccuucuaguugagguugccucagcagcccuuugaugccuuggauagauguuguuauauauuccaucaagacuuucugguuauuuguggugggagcacugauguccucaagcuacucuaauauuagcuggagggugaagacuaugcaauuauggugguuugaaugguuuuuugacucuacaaaccacgguaauuccauagucuucacccucuagcuaaugucaaugaguagauuauuuuuaugaacuucuguuuuggcuaguuuuaugccaucacaguucuccauauguaaacuuuuuguuuccuauuacuuauugaaguaaaauaaaaucuuacucugaaucauuauuauaauaauuuuuacaacucuccuugauuuauuaauucaaggccauuauaguaaauauugauuacuaacuuuauuccauaacugugaggauuaagaauaguuuaugaagccguaccaaauaguaagguugaacauguaaaguuagugacaauauaacaccaagucuguauacucuuguuuucaacuuuugaauuuauuuuaccagugaaguuacagcaauugauauaccuaggcaagaugaaauaugaagauuuuaaccuuuagcuguaguuggaauuauuaacaucauugaaggaaccaucucugguucucucguaagaaguguguuuugagguuuucaaaacaaauaaaucucugacgggugucauuuuucuuugccguuugugcaggaagaagagagcgaagaggaacccaagcugaaguaugaaaggcuuuccaaugggguaacugaaauacuucagaaggaugcagcuagcugcaugacaguccaugacaagguaagauagcacuuucagaggauucuucuguaaauuguuuccauuguaaauuugcuugugcuuuggaguccugauguuuuuggugguggcuuuuuacagugauucugucuccuugccacugcucucuuccuccuugccaacaaaaaaccccaaauauuuuauauguguguacgcgcccauucacacacauacaacacacuccaagacuguauuaaguagaauguagacagugaucaaagucaaagauuuauaugaaacggguuuuggcaacucugucgcucacuuaauuccucaaauuauaaggauucaauuaggaaccuguuaagauuagaaauaaugggaagcucagugcuuuuaaguuauucuuuuauuaaguuauucuuuuauuaaguuauuauuggaaaguauaagggauuacauuguagguguuaugaauaguagaaaugccccaaauuauuacuuauacgaaugaaugaauuuauuccacaucuggguccuugccguaacaaagcucucaccaacuuucugaguccaggguaaguacuagauagcaccguuagccuauucuuggaccaaaacaguuugugucauagucagaauauuggggggcagggagcuucacccauugcucucuucuucccugugaccuuguaaguuuuacuccuuccacaaaaagcaaacugcucuugucugauccaucuccuggcuuuauccuauguuacuagcaguuggccucauccucccgcuugcuucccacccaguuccuuuuuacuucaaauuuuguuucauuguaaauagaguccuguacccccaacacuuuauuagaauguaugccugcuuucucauguuuuaccagcaaccuucuccuuugagaugccagccauuuggcugcaaugccaucgaccccuuuucauugcugccauucuccaacuucuggucccuuuucuucacucauugaauauuggccuuguaguucuucaaccaaauuucauuccagugacccuuaccucuucucuguuucaucuccccauugauaaggccacacuuuggauggugucagcacuggaacuugaggaucuuagccucugugacacucucuguugacccuuguuauacuucaagcuuuugugcucauuuucccacaagcuauaugacuuuauggaguccugaucucuaauccuuucauucuuuuucuuuuauuuuucugugucuaugaaaugauugauuauccuaacucuaucuuaccagcaucuucaguucucauacaucccugucuucccguugugccccucagccauacucucaacccugaauuagugcuuucaugacaagugcagccaugugcugguauagacucacacaccuagguaaaguugucacuaaaaauuguucugaauuauuuguccuuugucaguuucuuuaguccucaggcccucuucugaaccauugucccuucuuucuuagaggaugaugucauuucuauguaagaagauugaaaaugucagguaugaacagccucaauuccugaccucuuuuucacacccauucuuacccacaggagauuuucuuucuuucuuuuauuuauuuauuuuuuuuuuuugagauggagucucacucuuguugcccaggcuggagugcaauggcgcaaucugggcucacugcaaccuccgccucccagguucaagcaauucuccugccucaaccuccuaaguagcugggauuacaggcaccugccaccacaccuggcaaauuuuuauauuuuuaguagagacaggguuucaccuauuggccaggcuggucucuaacuucugaccucaggugauccacccgccucagccucccaaagugcugagauuacaggcgugagccaccacaccuggccacccacagauuuucuuucuccuauucaugaaucuuuuguucuucacuucaucacauuuccucccuuguuucccagagaugcauacuauauauuggaacauaccuaaugcuaccuccaaguaaccagaaaucuaccucguaucuauauagauuugccuauuuugguguauuucauguaaaugcagucaacauuauuugaucucuuguguuugguuucuuucacuuaauguaaugauuuugagguucauucaugauguagcauguaucaguacuucauuccuuuuuuuugcugaacaguauuccauuguauagguaugccauguuuugucuauccauucaucagcugauggacauuuugcugauucuaaauucuggaucucaccuuucuucucaaaacuucuuuaucgugacaccauucuuuuccuauugaucauuugugacauuccuuucuguuucuuucacuuuccuuuguuugccuccacuuuuccuuuacguguuggcuuuccuaggauuugguccauuauccacauuucuucuuaauuuauacuuuaucuugguuuuaaaucucaggauuucugugaccaccugcacacugaccuucacuggaauagcaugcauauuuacuuaguugccucuuaaacaucuuuaucugcuguugucuuuuuuccugaaccucagcauguccauaaugaauucauuuucauuucccucuaaacuuggaucuaucuuuguucuuuaucccauuugguggcaucaccaccuccuuugucaccuaagccacggaugaauccucugcuuucacccagccauuugcuaaguccuggugauuuucuuacuacucuugcucuggcuuaggcucuuaucuucuacugccuccacagaguaaauaaaagaaucucuugugccucuaauuuuucuacuuuaaacccaucugccaccugguugccagaauaaucugcugaaaauacagauauuaaaacucuuguaugauuuuucaucaacuacgaaauaagaccugagcucguuaauguuguaucuaaggcucucuaagaucuugcucccugucuauuauuggcuucugucuuaaccacuuucugccauaaguguggugcucuggccacaacacuuggcuguuucuauucacaacaccacauucugcuugauccacacacaucuggagcucuuuucuuuguucagguauucuuuauuuuuccugggaacuaaugcacauacugugaacuugucuauuuuccuucagauuugcuuucacucuagucuguucauaacauucuacuaaaguaaucuuccagaaaccucaaccugaucauguaauccuccuucuuagaauucuuuauuggcuucuugaugacuuaaugauuugggccuucccacccugauuuccucuacuuuccugccuuucaucucuccauaaauauuugaaugccucuuauuagcugaccuuuccaaccuuaucaccugucucuuccccugggcaugaauuagaugugucauccauaauuucuugacuuuguccugcauuuuaugugucucugugccuuugagcaaguuguagccacucugccuaaaaugguuuuuacuacaagccuacccugucugccuuggugucuauuuucuaauuucuuuuuuaaaguucagcacagcugucaucuacuauguuccauagggucuuagagauacuuccauuuuaagcauucucuuuaaauuuaauuguaauuaauccauuuuuaugucuguuucccucauuauaccauaacccuuuuaagucacacuuggucauugucuaagcguauuauagaguguuuuuuuuuguguguguuuguugaaugaaccagugaaugaaugaaauggagaacaaaguuugccugccuagaggucaaacuucauuaacauuguacguaaaccaacuuugccaaagagccugauguuugggaacuguaaucaaugcuaacuuuuagaacaugcacucuuuaucugaaguccauguuucuauuuaagaggauucugauccaguugaguguuuuagcuuuuaauucugauccuaauucugcuacucaucgacuguuuccagggaagucucaucaacuuucugagcuuauuuccucauguguaauugaaggcacucccugcuguaaugcuuugaauacuauaaaacacuaugugaagguagaugauauuagacaguugaccagauuuaaaauggacuacucuuguuuccuuugcauuguccaaaggacugcuuaucaccuuuucugcuuguuuccuuacauaaaguccagucuuuauggauguacauuuaucaguuacuuaaguuacuuacaugaaguuuaagguaaaagcaguugugcuuaguggaugaugcccaaucugguaguauagaaaaugagucaaguuucuguaauuaaacaugaaagggucuagugaaauuauauuuauucuuugcccaucuugaauuuuaaguacauucaggugaaaaaaaaaaagaaacaaaacucaauaauuacaaaaguucaaggcuuuuaauggcuggaagguggguaaaauuugagaauuuguauuuauguugucacauuuguggccauuuugcauuuuuuguuauauuuuaaguaguggaaaguauuagcaaaugaugaaaauaugacucauccauaauauugguaguuaaauaacuauaauuggcuuaguaaacuuuuuuugaagaguauauauuucuaaaaguggauaacacuaauuuaucuaaucugauaaugaaauguuuuccuaaacacaagauagcuugucauaaaaaucacugaaucuuuuuuuuccaaaauguucuaacauaguuuuaguuuuaggaugagacuguaaagucaaaauaauuauuuuauguuuucuuucuauuuuaaagauuaaaugaaugaaaugagaaauuuagaaaaaagaagggaaggaauuaaaacuuggguaaauuacauaaaacuucugacuuccauaaaauaaaauguaauuagaaguucaaaaguggccuuuacagaggugucagagaauggcagcauuaaagcguuuuaaagauccaagcucccuucucccuuaguuuccuaacaaacuaaauacgguauuuaugaggagaaucaauauugugaaauacuuggggagcagugagcuuuuaagacccauucuuuuaccacagauagccucagaauggaguauuguuuucaauucuuaucguaugugguguuuuucuauuuaaauauugucagugucacuguagagguaaaauuacaaucauuugaguucucuguuucugauuagaacauucuuuugcuuuggaggaaacauuccuguuugguuuaacuauucagacuaauuuccccccagaauuaccuguuuccccuuucccuuccagcgcccaagcauuguguuuucaccaggcuugcugucugcccuggaugacuaaucgucauggcaccuggugcauucaggcaggccugugcagcggaaucgucauaccuaguuaugucugcacaccugauguuuuauuaaccaguauugauuuuuuuuacccuggggacuuuuuucuuccugaaaaaaggcaaccuugcaggagugaaaggcauugcaggggaugaauuucuaaugaacuccuucuuucccuuuuugugacuccucuuuaauguagcuucauauuuuaagugccugaacugaaauuucauuuuaagcaauuccauuuugauaaauccuuuuaaaucuugacuuucuguaagguuauuuuuuaaagauugugcugcuugacugaaacacuuaguagugccuguaaauuugagcguuucauuauggguugcaaugaagcaugcucacaugcaaugaaauacagagaauuuuggacuauuugaguaaugcugaaauaaauaaaaaggaagaaaacucucaugucauauuucagguaguccuaaaguuucuucugguuuacuuaagguuaguucagagaauuaaagaaacaguaggacuuacgacauaaaaugaguauuuuuugacaguuauuuuauaacacaaaaggguuuuuauuuugcaugauaauauaaacauuaacacucaacauuauauauuaacuuuuauagaagcauccuaaagcuaacugaugguauaaguacaccugagauuuucggucucucaauauggcauggauuuuccauucgaaaaaauaauuuguuguuuguguaugugugcagcuuaagcgauagcacugauuuacacauuugccauaaauuagggggaguuucugaaucauucuuuucucacuuugaguucaacuguagguuggucguguuuucaccgcugcauuuaauuuacugccucaguccaucaggcauuguguauagacugcauacacaccauuaguugucaguagaugaggguccucaugagucauucugacagcuggcuugcacuaucacaauaaaauaggcccuguucuguuauuucccagaagcuggaaacaagccuucuccaaggcaugcauaucuuuugagacauugcagaucauuuaugcauuaagcaucuugucuuuaaaaaugguuuuguuacuacuuguguauuaauaguauuauuaauuaauuaacuggccucuuuguucuucuuacaguuuuuggcauugggcacacauuauggcaagguuuauuuacuugauguccaggggaacaucacucagaaguuugauguaguaaguauucuguauaaaauaauguaugagcuaaacuucauguuaaguauuuguguuuuagaauauugguuuaccaguuuguuuuaauagcauaaagaggaucuuuauuaauucaaucagagugcuaagaguauaaauuugaacuuuauaauauauucugaaaacuuaaaggugaacuuauaaagaaaggggucuagauacaugcauuauauauuuugacuggguaucuuuuauaugcaaacuccauguaaaaaucuauacaucuauuuaauugcaaauucuuuacuuaauuauagucaucuauuuggcuuuaauuucgggcauuuagaauacuccuguauucuuuuaaaauugugacaauguagaaugucuaggugaauuguuguuaaaagaaaaaaaugcugcuuucuuagugaauaauagugcaaauuuacauacucuggaaguuuguggaauccuuaaaguaugaacucccucauuuagugacuaauuucaguuguaaguacaugcccugucuucuuguugagaugccaaauguaauugaaaauugauugaucaccuugcuggaucgguuucucucuucuaaauauacaaagcuaaaauauuuuaugugacuguuuugcugcuuggacuguuaggggauuauauugauugaaagcaaagaaccaggcuuucuuuuuuaauugugauuuggaaucauugaggaugaagguacuauugaauuugaagcuugauuuuggugugaagguguaccuuaaaggugucaagaacuuccaugguuguguaaauaugacacaaccacuugguaugaaaaaggugaucauuucaggggacaaauacuacuuuuuugaagaaagcaucagcacuugucaaaauauccaucuauugauauaguuuagaaaggagauuacaguuucuaaagcugacacguuguaugggaaagaaaaagggaugccuuguuuugcugaaaagaaauggaacccuggaacgaggacaaucuuuggagcaacacagacagggaauuaugugcucuaaucauacucaugcaucaggcaaaucccuuugaggcaagaggaauauacuuuugaccuucccucuucuacccacuggacacuggacaugcaucuugaugaccaaaacauuugguauuucaguugccauccauuaaaauguguaccugguacugggccaggugucguuuuugugguguugugcgugcccccucaccuuuaaaaaagauugacugugugguuucuuacauuuccuacucccauuaaaugagucccugacacucuguuucugucuuuuugauauugaauagaaauugcaguguuugcuugcuaagguucauggacauauaccauugguuccauugccaaaagucaguccuuguaucuauucaguauaaaccuucaguuauaucuucuuucaugucuguuuuaugucgaguauauccuacauccauccucuuucagguaauuuauaguaucauccauaaauuugucuaaaucuuucuucaguucuuuuuucaguccugacuauaugacaucuuugaaaauuaagcucucuauagcuuugcaccuuuuuuuggcaagggaggaagauaguuuggugcuauuuuuguguguuuguuuaccuuacucaagaaggugauagucuguuuuugaaaguucucuuuaggccauggcuuuuucgugaucauuggcagaaucuacugaagccaagcguaugucugccuaacgaccuggcaguuugcacuccuaaguacauauucaacaaaaaugcuugcgaugcguauguccacacacacacacacacacacacacacacacacacacacacacacaaacagauuguuaauaauagcuuaauuccuaauagccucuaacucaaauguccgucaauaguagaauggauaauuguggugcauucuuagcaaauuaaaaagaacagccuauugauagauuaauuuuauagacuuaauguugagccaaagaagccagacccaaauguguucauguuguuugauaacuucuauaugguggucaagaaaaagcaaaacuaaacuauagcaauagaguucaaauaaugguuugaccugggagggagcacagaagagucuucuggagugcugaaaauacugucuuggugguuuucucaugaucuacauauguaaaaaucacuaagcuaucauuugagaucuuuguacuuuauucuauauaaguuguaccucaguaacacacacauacuugcacaagcaccuauacauguguacaugucuuugguugagcuugagcagugcucaaauuuuccuuguuuguugaagcaaccccuuucugcuacucaauauugaauaauaccuaauugccuagguugacauccuguucagagaucauuuuguaaaugaaucgugacacugagguuauucccauggcuguauauucuacaguuacauaagaagguugacaggauucuguuuuauacggccaucuuuuguugcugaagaaugacaacugcuagagugauacuuuauuauguauauuaauacucagauuucagaauauuugaaagaauauucagcauauguuaauucaaauacuuuggccauaaaugguuuuuugagauuauuucuagauauagcuuuauguuaacucaaaacuuaauugcuaaagcaauuuuacuuaacucagaguaaaauaacgugacuucagaauucuuauaaaaucuuagauuccuuuuaaauucccacgauauuuaugcccauauaaccacauuaaucauaguauaaucaugcgucguuuaacagugggaugcauucugagaaauguggcguuaggcaauuuugucauugugcagacaucauagccucuacuuacacagaccuaggugguacagccuacuguacacuuaggcuguaugguauagccuguugcuucuagacuacaaaccuguacagcauauuauuguccugaauaccauaggcaauuggaacacaauggcaaguauuugugcauuuaaacauaccuaaauauagaaaugauaccauaaaaauaugguauaaaagaugacaaaugauacaucuguacaggagacuuaucaugaauggaacuuacaggacuggaaguuguucugggugggucagugaaugagcagugagugaaugugaaggcuuaggacaguaguguacacuacuguagacauuauaaacccuguacacuuaggcuaaacucaauuuauuuaaacauuuucuuucuccacuaauacauuagccuuagcuuacuguaacuuuuuuacuuuauaaacuuuuuaauuuuaaaacuuuugacuuuauaauagcacaccuuaaagcaagcacauuguacagauguacaaaauauuucuuuauguauuuauucuauaagcucuuuucuguuuaguuuuuuuuuucuuuuuuacuucuaaaacuuuuuguuaaaaaugaagauacaaacacacacauuagccuaggccuacccagggccaggaucaucaauaucacugucuuccaccuccacauuuuguccugcuggaaggccuucagggguaguaacgcacauggagcugucaucuccugugauaacaaugccuucuucuugauaccuccagaaggaccugccugaggcuguuuuauggguaacuucuuuuuuuauaaguaggaggaauauauucuaaauaccaauaagaaauauaguauaguaaauacauaagccagcaacauagucauuuauugucauuaucacguauuauguaguacauaauugugugugcuagacuuuauaugaguggcagcugacuagguuuguuuacacuagcaucaucacagacacgugaguaacauguugugcugugcuguuacuaggcugcagugacacagaguguuaggaauuuuccagcuccauuauaaucuuuuuuuauuuaaauguuuaggaaaagauagcuuguaaagcauuacagucuuauaggaccacuguagucuaugguguaaaccaaaaauaaaguucuaagcuccucagucuacugaauggacuccucuuaggauucgugaaaaacuaguucaggccaugacgggaagggggagucagacaugccucauuauauucucuucuuuuuggaauucaggcacaacugaccggcauuaacauuaagauacagaucuuaagacugacaaaacagacucuuuguagugugaaaggaaauaagauaccagauuccaaacugacucuaauauagcaucacaugacagauagcaagcccugaaagaagucaaaguauuuugcccuaauauauauuucuuuggcauauuuugaaauagcugugcaaagcugucucuuuuggggaaaauuuacauucuguagagaauccccuucccuuuccaggucuuuuucugauccugaagagaguagcuuaaaggucugaauaggaaacguuugccguauauuaccucuaagggugccaccuauaagacuucuucuacauaguaagaaccuuggucuucacaacuccuuaucguaacccagguacuccuuucugcugauucuuucugcugauaacuuaacucuuucaaccaguugccagucagaacaucuuugaaucuaccuaugaccuguaaaccaucccucuuuccucucaucuccucuuugaguugucccaccuuucuggaccaaaccaauauauaccucacauguauugauugaugucuuaugucacccuaaaacauaaaaucaagcuguaacccaaccaccuugggcacauguucugaggaccccuugaggcuuugucaugggucaugguccuuacauuuggcucagaauaaaucucuucgaguauuuuacaauuuggcuuuuuagucaacaguggguauauguggucucuuguugaccaaaauguuguuauguagugcaugacuguaguuacuuuuucuuuaauagccuccaauuuauuuaagcauuuuaauuuaaaacuuguuaauuaaggguacuuauguugaagcagugaucaaauuauugugccaugucucuguuaaauauuuaggagcauuaugccauguguuuuaaauauuuauuccuuuaagugugcuagugagagagcaaacaacuugcugaucaaacauaaauuucuacuguucaccuuuauguguuuuucuuucuuugcuagaaauagaaaaugaugagguuuugcuguaaggcacuauaguaagagacauuauauaaauauuuauaaaauggaugauuacaaaaaaaggagauuaaaacaaaacaggagcuuaguggccauuuuguguuaagauaaauaucaaauuuuugaaauuaaacucuugaggcagagguggguugaugauucuccuugucagguagcagaaucuauugguauuucuauuccuguuuuugauuugagauuaaacuaauggacuguauuccuuaguugcugauaccuuucguguucaugugcugauaaaaacccagaccucuguccaucuaaccauugugucucugagaacauuucacaguucuuuguuacuucccacaucaaguccuaacuaucuagcuaagcauuccagacccugaucauuuggugaaacccaccuuucuaaucuuaguuuuaauuucuucccucucuaguaauuuuuaucugcucacuaccuucuaaauauugccaugggcuugccuguuucuaagcuuuugaugacuucuuuucucucuagaauacacuucugugaaucuccauucuuucugcaagguacuuccccuggauuguagcccugagguguuuccuuccuguaaacuccuauauuacuacuauuucacuuguaguguggccccucauagugucaguaccagccucacauuccuauuuaacgucuuggaggauaguugccaugucuccugguauacuucucuccucuuccccacccuuucucuuuucucugcugccguuugguauccaguaaguauauauuggcugauaauauuguuuugaaacauaaccauggaacuggugauuuucuguuacuaccuuucaggaggccucugggagcugguucucuguucuccuguguauuauucuaccuucacuuguccauuggauguauaauuagaaauuuuauacugagagcuacuguagacugaauucuuccccaccuccuaauucauauguugagguccuaacccucaaugugaugguauuuagaauuggggacuugggggguaauuaaauuuagaugagggccaggcaugguguaaacucaggaggcuacgacaggagggucacuugagcccaggaguucuaggcugcagugaguuauaauugcaccacugcacucucuagccugguugacagagcaagacugugucucuuaaaaacaaaaacaaguuaaaaacaauuuagaugaggucaugaggguggaguccucaagaugagauuagugccaacauaagaagagacaggagagaccuucccuuccucccccuuccugccggccauauaaggacacagcgggaaggcugucugcaaaccaggaagagaacccucaccagaaugugaccauacuggcagauugaggaccuccagucuccaaaacuaggagaauuucuguuguuuaagccacucuaugauauuuuguuauggcaguucaagcugacuaauauaagaucagagucuuaaaucuuacuuuuggaaaguaacccuuauguucagcaguauuuaaguuuuuaauauauacucauacauuuucuaguugcuauggguaauguauaaagucaucaaaguuuagaagcuaaagagacuuuaaaagaucauuccagaugcaaacgguaucagggaaggaaguguguaaauugggcuugagcuguucugguuauguauuccaugcccacuacucuuccacccuuaucuccuuguacauucaagaccucccuuauguagcgaaacauucuuauuagggcacuucccuaaccugaguuucaaaacauguuuuugugacugguuccucaucugugagugaugaugguuucauuuuucucccuggacuuugggacucgaccaucuuuuggacuguauugcugaccuuuuguugcuuucuuuggcugcgaagaauuuauuucuaauauaaaucagcuccucuuuucucuuugcuuuggauugauguaugagugucuggaggaucacccaucucuuuuuucauguuucagcaaaagaaaugaucauuuuccuucucuccucucucuuugacaguaucaucgugaagauucaguguuccuuuaagcugcuuaaauuucauuuuuaguauucacaaacaccuuuuuuuuuuuuuuuuuuuuuugagagggagucucacucugucagcaggcuggagugcaguggcgcaaucucagcucacugcaaccuccgccgcccagguucaagugauucuccuguuucagccuucccaaguagcugggacuacaggcaugugccacuaugcccagcuaguuuucauauuuuuaguagagacaggguuucaucauguuggcuaggauggucucgaucucuugaccucaugauccgcccaccucggccugccaaagugcugggauuacaggugugagccaccacgccuggcccacuuuuuuuuuuuauccuuuacauggcuuaaccaucuccuucuuuguguuaccuccacuuugcuuuuuuuuuuuuucuccacuucuugaacguacgguacuuuugucacaauuauaugccucaaugucauuuuccacauagaaugcuaauuuccugaggacaguuuguguaauuuaucucugcaucaucagugcucaacauaaaagcuggugaacugauagaaauaagaaauugauagaaguucgcugaacuaauccauaguuccaaaucugcaguuucacauauuuagacuauuuuccagauaaucaagguuuuuuucauaccuuccucucccauaucaggauuauuguguguacauuauaggaaauuguauggccaugaccaucucuuugacaguuaauacagaugccauacauucauuauucaccuaaacagccuaacucuuuugggcuuauucauaauguggccagugugauguugggugacuguucauugaaagaaucuuuggagcagaucuauaaacuuaagcuauguauccuugaacaaagaacccugcucuacucuuggucuaaugguacucacuuaucgaccugaagcaaauaccaucuguaguaugcuguucuagauguggcaucauuaauuggcaagcagggcauguaucuuuuugauaugaucaaagugguucauuguuggcucaagugugccagugccuguaauacuuguuuaagacugauugacaggucucagauucuuguguguuuaaagaacuuguuuucuauauuugaaccccguauuuugagugauaagagaugugucaaaggaauugaaaauuacuuaaauggaaaucauucuaacuucugauaaaugaugccaaggcaagucauauuuccaguugucugcauuaaaaaauaaucucaaguuuguggguuaaguauuuauagauaacuugauaauuuugauggcuucuacgcaccaaaguggcuaagaaaacauggucagaauuaaggaugcuucucucuuuuagaguaaagugucauacuuacugaauguuuuaacaucugacccuucagugguaacuacauuuaggcaaauaucccuuaaauagcuaaaacugaaaauauuccuucacugaaugaaauuacccugguauuucacauauuucaaagucaggguugaaguaauuuuaacuuuguggaacaugacucugaauuggguaguagacuggggcuuaguugucugaagccuuuggauuucauucuucaguacaggguacucucaguucuggugguucuuucuuugggguucaaggccauuauugcaaaguaagagcuuuaaaaggauuaugaauaagguguagaccuaggggaggaaucuccaccuuugcaguugggagacagggaaccuguagaaagugaaauuugaggugaaucuggaaaggugaauguguauuuuccagguuguuagaguggaguuaagacagugauacuuuuuuuuuuuuuuuuuuuuuuugagaaggagucucgcucugucgcccaggcuggagugcaguggcgcaaucucagcucacugcaagcuccgccucccagguugaugccguucuccugccucagccucccaaguagcugggacuacaggugccagccaccaugcccagcuaauuuuuuguauuuuuaguagagaugggguuucacuguguuagccaggauggucuugaucuccugaucuugugauccgcccaccucggcuucccaaagugcugggauuacaggcgugagccaccgcacccggccacauucuucuuaugaaacagggaaucaccaaagggugaggaacauuuaccauggacuucuugucuucauguauauuguguuaauuaucuaguaguaucuugggaguaggggaguggagaggaaagaauggauggugagaugcaauaggagcaaauuauuuggcagguuuagccaaaggaccaaaggaaaaagaauggaguguuuucaagggagugucuuuguggugacugacuuuggaguucagaguauuuagggaacuaaaugaaccagaaggaugaugguaaaucggaugucauggaccagauauguggauaaaguaugagugucugugcauaugguuuaacaauaaauaauuuuaagcuugaguuuguuuuguuaauaauagacuucuuagucucugggaaccaugacaggguauacuucaaaaugguaguguauacuucuuucuuaaacaagcucuguuuuucuguuuguguagcuuuguuuuauucaccugcucuagaacuuauuuauuuggcuauaauuucuaauguuuuucauuuaauaggaucaugauauauuaggauaguugaauacuuaauggauauuuuucaucuagccacucaagacaugaaguucuuguuacccacacaagagguugguuugauuguugggcuagguaucaacccaaugaccacaaccaaggagauuuaguaagauuuaguauuuaguaaagggauuuuauugcuuguaacaaguagggagaacaccagggauaguucucaaagcagugucucccggagcuggggacugggucagguuuuauaagcauaugauaaugaggugugaucugacuggaucuugcaaugaggugaugccgggaggucugaucuuacuggauccugacuuggggugaugcuagagcuccaucugauuggauccuggauccuguuaggugguguucgcuucuuaauucauccugcucuuagauucccccugugguugcaugcuugguucaucugggcaugcucagguuacaugagcugaggguccauggcaacugaaaacgcacaacuuugucacccagaaguugaaccauguuguucuggugcggcuauacuuccacaacauucuugucauuugguugcccagucuuuauuuuauacuucuauuaagaugaauuucauuauuuccaugggcagcuauuaaauguuaacacuuuagcuuuuuuuaaguuuaauuuauagcaaggaaaaaaucauauuaaaacuaauuaaaauggaauaaugcauaccacuaaauauaccuuuagaauggcuaaaauuacaaagacuaaucauaccaaguauugguuaggauguggaggaacuagaacucucauacacugcugguggauguacgauaguguaacaacuuuggaaaacaguuuggcaaaauuuuaaaacaugaaacauacaccuaucauacauuccacccuuucuaaacuuagagaaugaaaaaauauacuccuacaaagauuucuacaugaauaugcauaucaguuuuauuuguaauagucccaaacuggaaacaaucuauacguccauuugcaggugaauggagagacaaaaugugguauaucuaaacaauggucauucaacucaaaauaaaaaggaaugaacuauugauccgugcuaagcauggaugaaucucagcucuauuguguuaaguaaaagaaggcagauucaaaaggcuacauauuauaacauuugcauuuauauaacauucuagaaaaugcaaacaaaucuguagucaaagaaagcagaucagugguugccuggaguuucaucucagaggaaaagaauuaaaugcccuaugggguaaucuaaaaaucugauuucacuuuacugauguggaaaaaaauuaauauauuacucagggcacuuuucauugcucaguggcagacaugugugugaguucuacccuaauuauauagaaggaguuucuuacagaaaauagcagguuuguuacugcuuuaaguugcccaggaaccaacuuuucaguguccuguacacauagugagugaugugaaaucuuugggugggguggggaucuuguuacugacucuguccuuugaauaaguucuaugaggugaaaucaccuggacagaugcuguaaacauuuuuaggguucuauugcagauugcuacauuucccugcaguuagguuauaccaaaauauguuccugccagcagucugagaguuuaucauuauaucgcaucaccaguguuggcuguuguuauuugaaaauucauugccacuuagauuucuagaaaaugggaauuuaucaauuuaguuuguauuuuucugguuacuaaugaggcuguuuacucuugagaaguguuaguuuauauacuuugccaguauauguguaaaguucuaaauugauuuguaauuaaaaaauucauuguuuacaagcagaaauaacauugaucagggguggcucaugugauggcucaaaaucagaagaauuaagucgcuaccaagucaaauuuaauacuuaccagucuuccuauuauuaaaugaaauacuacgauuugcuuuuagggagacauugacuuucacacucaauauuuuaaaucugaaauuuuuuucauuugcuuguacacucguuuugaucuuuaaguuauuuaaaagcuuaauuagaagguguuuguaccaaguuuuaagaguauauauauuuuuguuaaaauguuaccuacauaaggaacucuuacagauccauaaggaaaacccaaacaacucagaaugaaauugggcaaaugacaugaacaggugcuucucagaagaacaucaaaugcccaguagccaugugaaaagacccuugauuucuuuaguaacacagaauaauaagggaaaugugaaguaagacaauaugguaccauuuuauaaccaucaacuuggcaaagcauuuaaaagucugaucaauaccagauccuggugcugggacagggaauagggagcuguccuccaggguggaaggcauagaaaguuuggacacaacuucuuauuugaagagugacaaaugucugcuagucugugggcuuaucuuucaguuucccauuuaugguguuuuagguucagaaauuuuuuauuuuaaugcaguaaauauguaucagucuucucauuuacaguuuguguguuuugugucuucuaagggaaaauuguauuuugcuucuacaaaguuguaaagauauggaaggggggcaaggaagugcugggaagggaagggugugucucuggcuagggcuccaccccugggccuauaccuaaggacccaggugaggacaggaauuccuguuuuccugcccaaauguugcauuucccaagaccacccuguccugccacaccccauccugugccuauaaaaccccugaggcccuagugggcagagacacaagcagcuggacguccagaggagcacaucagcagaagaacacacaagcgggauguugagaggagcacauugguugaagagcaugccagcaggcaccggcagacaccggcacgcugguaggccaucaacugguagaacaacacagaguuuggccugggagguuggaggagaggccgggcuacugagcggccagacuucaggagaaaacugucuccuuucgggcucccccaucugcugagagcuaccacucaauaaaaccuugcaguaauucuccaagcccaggugugaucugauucaaggcaagaaacccuaggauacagaaagcccuuuguccuugcuauaaagcagggggucugauugagcugacuaacacaagccaccuacagaaggcuaaacuaaaagagcauccuguaacacacccccacuggggcuucagaagcuuaaacauucaccccuagaugcugccguggggucaggagcaccacagcccacccaucugcauguuccuccuagggguuugagcagcagggcaccgaagaagugagccacacucccaucacaugcccugugaaggagaugagggaacuuuuccuguuucaauauucuuuguauguccuucuaaaguuuuaaaguuuugcuuuuuacauugucuucacuuuuccucaagaaaaaaaaauucucacuggacugugagaagaauuuauuccuugauauugugacagauacugaaguucuuaccuugccagaaaaaaaauuacacgaaaaugagucccuugaaccuacugauuucccauuuucuuuccuuagcuccuguccagcccuugaccccauugcauuaguggaaucuacuaucccagauuggauguagaaagagcaguggugauauaaugauuagagaagaaacucuggcggggcgguaauguccagcagaaggaugguugacggguucuggagguggcagcacugcacgcaggccaggcuuggggucagacgccagccagccagcccugccacacguucauuaguuugguguguuaccacacuuucuucaucuguaaaguguggaucauaaucacaccugauuucaaugaugguuuugagaauuauaugaacgaauacauguaaaauauguaacauaaggcuuaguaaacauuagucguuaucagaagguggaucaagcuaagaguccaacugaacauguuuacuacacuuccugaagaacuauuauuuuugaauuuauucauauguuuggcuuuaauaauguucaauuguauaugggguaggcaaacugaaagggagguagggaagaaagaaagaaaaacgaaggggaaaaaaagagaagcuucugcgacacacccauucuuacacccauuuugcugccucccuaucccucagcuccuguguuuauuugggaggaguggguaucuuuuaucacauuacacaaauaguauuuuaagaacauuauuaagcuugaguaauuaggugugugaagucgaucccagugcaggucuagugaguugacuucagaaaugucuuuucgauguagcaacauugcaacauggcuuguaagaugcuucuuuugaaaaguuuugagagacugcuuggaaaaugauuuaauggggauugauaaagcaguguuuuuacacuggagagcauuauaacaauaauuucugugguggaaguagagucaaauuugugaaguguuaaguagucuuucuucgucauauguuggaaaaauaaauuaggcauuuucucuuugguuaauaacuuggucucaguuauuuaaauuauuuguacuacccacccuuuuuagguaagugacuuuacuaauguggaaaacaagggcuuuacucucucaaauguuuagauuuuagauaaauagaaugcauuagcauugcugcagcuaucauuaaaucaaaaauaaaagugagaaaaauaagaacacaccuuuacuccuaacagauuuuuccuuuaucauugaugguaucauuuacuuguauauugagaacuuaaacagggauauuuaugggcccugcugagauguucagaaagcucugcagccuucaugggucugcuauauguuuggcuuucuuuagcugcuuuuauuaguggaguuuguucucaaagguguggcauagcagauccuuaggauuaggguagccuaaggaucugagccuaaggaucuaagacuuaauuuuacagaauauuaacauacuuauaauuuccuuuuuaguuauauagucucagcgaugacaaccccauuucuguugccuuacuguuagagaaaaaaaauucauuacacucucuagggaauguucucugggaaaaaaggaagaauuuuguuuucuggaacuguagugauagaugcccuguggacuaggaaucuuaaggguauggccaacuacuagaggaugcuguauuuuuuuuuuaccaaacccauuuggauacuaaaacaucaguguuuauuucuaggcuaaauuaucauuuaaaauaguucagaucauuuugguuguaugauguuugaaaaugucuguuuugugaauggaagggauugucccuucuccacagaguucuggcuccacagacagcacugaacuguucccagccaaguccugccagugggacagcccuuuugauuauuugacagcuuaucuuuuuaaguccuuguuucuuuuuugguguggucuacugggccagacacggugaagucuccuacucuuuuuuaaucuaaauauugggcccaagaaaaagucauacuuugccuaguugcaaagacuguguuuccagacuccugaugaauauuaucucuucagaaggccuguucucuucuacccucaguguuuucuuccaucucugugacguuuuauccuccaucaucugccuccauuauuccccguauauccucuugaugcuucuuuuagcucauucuuuccuuugcugguucuuuauauugccaucauccuuguucaugucuuuauugaaucucaccuggguuauugcaguaaaacccaacugaucucccugccuugugucuccccuaaucccuuuuucacacagcugcccaaguaaucuucccaaagcagugcuaggauuuuguuauuccccucccugaaaacacucgacugacuccuugaugccuguggaauaaaacagcucuucuaggcagcacucaggacuucugcuuucugucguaacagugguccccugcauugcgccuacacuguauccagacuucauucuuuggcucucguuggaaugcacuuucuugucuuugcguacgcaaauuaucggugucaucuucucugugacauggcccuugaugacucaugcagaagaguauguguuugguauucauuuaguaauugcuucuuacuccuucagcaaacagucucaaaggaugugcuagggauauuacauuaaugaaacacagacccugcucuuaagucaagucacuuguggaacuugccauauaaacaaugguuugcaauguaauguguugaaguauaaaauagaguuguguucaaaguacuggggucacagacucuacacaaacaccuuguauucaggccauuuuuuuuaaauucucuuuauaucauguuggguguuugguacuauuaguugcuuuuuuguuaagugcaguuauugaauuguucugcauuauucccuugcaauaauccagugacuuggucauucugcuuuucuuucucuaucacucuuucuuuuguaucuuuguuggauauauguauaagcaaggaaaauauuuacuugguuuaagaacaaauaauuuuuaaaucauauuucacacauuaugugucaccauuuugaaaauuuaguugucuuucauuucagauuacuuauauacggaaagaaaaguuuauucucuuuaacaaugguauuccaguaaaguggauuguuucacagggguaucagaaccaaaugcaguguuugguguauagcaggugcuuggcaauucuucauugauagugugaauacuagaaagagaaacuuuguuggcuccuuaugccauugcucagacugguuuugauuuauauaaaaggucccauuaguuuucugucuuaccugccaaauuuaguauuguaaacaaccauucaagacaucuuggggagaccacagugcaacuuguccaagguguugaucugaacuguuaagagaaauuuaacuuucucuuaguagcaguaggaugugggcauugcaagcucuggggaaaaugagcuccaacucuagauuugcuguucauccaccucacccuacgggacaacugcaggauuuguagcaucccggaaggugacuaucuuaaacuugaacgguauuucagugauuuguaagcucaauaagugcaagguucacauuuguuuuguguaccacuguguaucugcuauccagcacggucucuggcaugagaauaaaagagaugauuuguaccaaaagccuguuuuuuuccuuuuauugaaguaauguuuugaacauuucccagauugugaauaacugucuugaguacauagucacugucuggugcugugugcgagccaggcuucuaccauuguccgugggcuuguggcaggcacaggcagaagaugaaguuuaacaaaaggaaaacagcucaaggaaucagcaguaugccagccucuuaggaggcaaacccuucaaauccucccugugcuuuuaaagguuguuaggauuuagaaaaccaaugucuaucuaauaagucuucuguagguggaaaggccguuccgugccccugccucuguugagguucuaccguccuggugggugcaacagcggggugaauaucugagccuuuuaccugucagccaugcacacggggcuguuggucucaggcacagaguaggcacagcagccuaggguuuuaggggucaaaugaaguugcaaauggucauuuucuauggucucauaaguuuacagcauauaaaugcucuuaugggggagaugguuaaaaacucuugauuagaggaaaaguuaaggaaaaaagaagggauauuuuaaugaauaagcagagacugauuuauaagcauucucauaaauacagaaaauuuaagcuccauuguuaaacagggaugacauggaugggcaaaauuauuuucuuuccaaacaagaugacucuuccucaaaauuucuuuccguucuucacauucucagaugauuuuuauuuuuuuuagauuauuuccaagauguuaaaguuuaaucaaggacguuuauauucuaauagaguaauuuguuuuuaggucauuagaauggaaguuuaaguggcuaaaguuuccuaacaaguuuccuaacaaauuuaguuuuuucagucuauguuagaaguuagagaauauuagggcucuacggagauauauauaaaugaugcagucuguauaucuuaaaguaaugauuuuauauuauucacuuuaauuuuguagcaucagggcacagcccugaugaaccauaaagcuacuugaagcacugcagcuaguuugaaaucacugggaaggaaucgucugcaguucaauagacugugauauuuggggagcauuugugcacucuuguauuaggaguauaacagucaucaucucaaauaguagacauguaauuguuucauauuauuaaaauagcaauauugguaugacuaauuuuuagcuacuauguaacuuaaauaaauaccuuucgcuuagaaagcagcauugcuuauacauauaaauagaggugaacuuuuaaaaguauaaauauauaguagauaaucaguaguuguuuuuggaauaaaaggauauuucaaccacauuuucaugcaguauauuaaauguaacauaacccggccaugccacuuuuuaucacuuaccccuucugcuuauaaaucgcugccuuuugaauuuccuaauuauuucucaaguuggaacgaauuguuacugauaaggcaguuauuuucuuaucuguagaaacagcagcuucuguaaagaucuggauugucuugaaagagcuucaauuuaauauagucauucaguuuuuuuuuuuguuuuuuuuuuugagacggagucucacucuuucacccaggccggacugcaguggugcuaucucggcucacuaaaagcuccgccucccggguucgugccauucuccugccucagccuccugaguagccgggauuacaggcgcccagcaccgcgcccggcuaauuuuuuguauuuuuaguagaaacaggguuucaccauguuagccaagauggucucgaucuucugaccucguuauccaccugccucggccucccaaagugcugggauuacaggcaugagccaccgcgcccggccagucauucaguuuuaaaggcauagagucaucuuuaaaacgucauaagaagacauuuuuugcauacucauguuaauucugaaauauaauuagugucacggggacaugauugccgcaucuggacugucagcucuucaucagcuacuugaaucugaucaaaucuuuucaguugaguauugaaaaccuugggucccaaaagaacaggggcaugucagaaguuaacucuuuccauugaacuuaauugaggcuuuaucauccuuuaaauuuuuucuuauuuuuaagaaaauaacauuuuaacaaaacucugccucuguuuuuauucugcucuuuaguugucuuuuuauagagcuuuuguuuauuuauguauuuaccuguuuucucauugcaugagaugugccucagacucugaaugauugugguucuuguucccuugggagcuucaucgagcuuuucuaugccagaugcugaguuuaaaguagauuucugcucucaugggcucacaauuaagugccagagacaagcagcaaagugaguuauuguucugaaacaggaaugcuuggauagagacugaugugggaacacacaagagggguaugccauccugcagaaaggaaguuaggggccuucccauaggaggugaugcuugcauugaaucuuuuagaaagagcuggaauuugccaaguggugggcgacagaggcuaugcauggccuauacuaagccaaauauauagaguuaaagaaaacauuucaaaaaaccaggauguuuagaaucuugugaaucuuuugggucuggcuggaaaugagccugaagagauagguggagccacgcagugaaaaauggcuuuaucaguaggacgacuauauauuuuacuauucgaaugaggaugaaagggcagcucuuaauaauuauaccuggacagcagugauagacacaagggcaaacugggauguaugguuguucuguuuaaaagccauauuaaggaauuuacuuuaaacaggguagcaacauguguaauuugcuuuuagaagacugacuuugggauuagcaguguggaaaaugggguguuggagaagacgagcgugugucgggggaugugcuuguggggcuuguuuggggaaguggugucaauuaagagaucauuugcuacagcagugggaaaaggauggauuugagagguauuaagagagauagaaggauaggacuuagugacuuuugauugcuugugugggguaugagggagaaaaauuucucugggaugacucuuaguacucuggcuuagauagcuaaguggacugagagucauuaggugaaauugagaauacagaagaaggcacugguucuggaauugacaauuugacacagagcuguagaguaguuguugaaugugaauaugcagcucuaaagagaggccugagcuggauugaaaauaccgcuguuuaagaggcaggcugaggaucuacaaccugaaagggugacugagaaguugugagugaguagaggcugggugcaguggcucacgccuguaaucccagcacuuugggaggccaagguggguggaucaccugagguuaggaguuugagaccagccugaccaacauggugaaacccuaucucuacuaaaaauacaacaauuagcugggugugguggcgcaugccucuaaucccagcuacuugggaggcugaggcaggagaauugcuugaacccaggagauggagguugcaguaggccaagauugcgccauugcacuccagccugggcaacaagagcaaaacaacaacaacaacaacaaaaguugugaguagaaaggcaggaaggaaaugaagagaaguggguguaauggaagccaguggaguagaguuucaggugccagaaagccauggggacugaagggcauccacugacuuugaagcuaagaaagcuuuggugacccuucccccagccauuuugguggugucauucagguagaagacccauuucuugucuacuaguaaauggacauagggaaugaaaggaaauaggcagccauuccuuuguauaccuuggaugauugguuccuuggaaguaucuuuucucaucaauuggcaaaaaugguaacuugagcaagagaauagugagucauguguauauauauuuuccacauccacacucgugaggaaugaaguacaucugaggcuggccagccaggcuucuuuguugguugaaugacugugaugcaguuuaaaugguauuuguaacccaaaaauucuuucuuuuuuauuuuguagucugguucuggauucuuccuagguacuuauucaauucuauguguaguuauuaaaaaaucuacaacccucaaacuguaaauauuuuaacuugguuuuaaaugagaacaaaagggggaaggaagaugaguugcugccaacacaguggcaacucucagcuguucuggggcaggagagcuaggucaccugagaaacuuguguacuucaaguacaggaguggugaacuggacuagagagugggugggucugguccuuuucacuaucuguucccgguaugaaaacauuaaaugguuuuacuguuucaaugaaggaaguccucucuucucacuuuuaagcaaaagccagcagccugucugguaauuaauaugauauuuccauuugcuaauggggacugaaauuuucagcgucuuaauuuuugucucuuuuauuuuacauuuaauguuuauuuugcauuacuuuguuuuaauucugaacuaguuuuucauuauauguuuaguaaucauuguuucuguuuuuuauguugaacauuuaaaaaucuucauuuacuuaacauuuauaacauauccagaauuuaauauugcugugaagucagacuaggcguguauucauuauuuuuucuuguaggauuuuuguucagucucuuuccuaauauuugcgaugauuguucacuugagagcuaaagucuucucccccauuuuccuaaggggaagcauauuguaguaacugucauuaaauaauuuccccauaaacagugugcaauggguucauguuuuuauagccuauuuuuuggugggaaggaguacugaugugcuagguaagaaugauggauuucgcuuuugucguugggcccauaaauaacaaaaauauaacaaaaaauaaaaacauaacaacaguuuacuuuuuuuuacucaacaguguuuauauagcucguuguugucaaugcugagggaaaagaaaguuggaaggaagcaguggucagcagcgucaguugucacaaagcagucaaggaugggaaugcugaaagaauuccccguuugcuucagccucugaaguucuuggcaaccuuagggagagcaguuagcgauggaaggguggacagcagccagcugccaugcuacucaggagugacagugaugggaggccccggagcacugaguggauggcuguccuggggaacuggcuggagcccuuccaucuucccuuuugcauuuacugaaccuguauugugagacuuucaagagagcuucaugaaaguucuccaacuucaggauugcuuguuugauuaauauauucuccaucuugaaucaaagaaggguuuagugcuggagaggaaaucuuagagcaacugaaaagauuggagaguuuauaguuaaagaauauacuguucuggccgggcagaacgguggcucacaccuguacaguggcucacaccuguaaucccagcacuuugggaggccgaggcgggaggaucacaugaggucaggaguucgagaccagccuggcuaacauggugaaaccccaucucuacuaaaaauacaaaaaaauuagcuggacgugguggugcaugccuguagucccagcuacucaggaggcugaggcagaagaaucccuucuucugcugguuagcaggcagagguugcagugagccgagaucacaccacugcacuccagccugugcgacagagcgagacucuguuucaaagaaaaaaagaauauacuguucugguuuuaaaauaagucagugagaaaauaaguauuuguacuuguuuuuguuuuguuuuguuuuguagauguauagaaaaccugcgauuagguguguuuuucauaggcuucuuaaguccagauggaggucuugcuucccuccuggguguaucaucaguggagaguaaaauaagcaguaaaaugagcuuuucccaaguaugaaagaacagacguuugcuuuucacacauggaguguaaguguggcgugcuugcuaacugugacuaaagagcaugaaguugcauaggcaaccauguggauguugagauugcuaacuagugggucucugagagaacaaaaaugaaauccuggcuucuauuucuuauucauuccucucuggguccguggggaugcagcauuuuugaaggaaucaauuauccauuuguuagucagaggagccuuacaaauuauacauuaggagauugauuucuuggguucacuguugggggacugauagcuuaaggugggaugaugaggaguaucaggggaaaagaaguugccacaaagaacaccauuaaaagcagcuuucgaaaugaccgugaauuuauuccuaauugaagagcugacauaauccauacuaaguguauuuauuucaagcaucuuacauuagguaauugauuaucacaugagguguacauguugguaauuuuaccuuuucuuuaaauuuaagaacuugagaccaccuguaguggacuuagauuuagaagguaugugcugguccuugcccccuccugcuuacucggacuucuuuuuuuauuccauuaaggaaacauuuuuguauguucuauagugucagcuugacauuauugauuuuugaacaaacucacuuauauuguccagaauuccaaacaugucuccauuaguaauaaaauuguagcuaauggaaaauacagcugaggccauuuuucucuggucuucuuuucucucaucucuuucacuuucccacauuuaugccaguauuacaucuuugcaaacacacaccccaaauuuuauguuuagaugugaugguuucugcucauugcuguuaugguaaaagguuuaggaaaaucagucauuuuagcuaugcagaauccuguacuagaagguuucccucuauguuugggaauauccuguacccuuucucucuuuccauuuuuuuuuuguuuguuuuuuuuccuguuguugcuguuuguuucuuuguuuucaguguauagaaaugguagauguacguaaggcauuuguuucuuuuauaggauuauggaugccaggcuaguugcaugcaacauugacaguuguaauauugaaauccucuuguuuauuuguucuuuauuaaauguuauggaacuguuauggaaauggaaugugcauagugaugauacucaguuaucacucaaaaauaugcauguaaguuccugcaaucaugguuuuaaauauuauauuugauaucugguuucuuuuuguuuuuagauuaaugaauuuccuaccuugccauauauuaaaacuaucuucugauuagaaacaaaauaaauauuuuuuuuguagaaaucuaguaaagcauagaaaggaguaacccaaacauuaauaacuuagcacucagauauaaccaaugcuaauauuugggaguaucugcuuccagucacauaggugauauacaaauacuguaaguauaguaauauucggcuaaccuggaguuaaccaaacuucaagauuugagagcacaguucuccugacagccaaaucuacccaagacuucugacauacacugcaaguuguggggauucccaaaaccacccucauguuugauggguaggagacucacagaacucacugaaagcuguuauauucauggugcuuuauuacagggaaaggauacaggucaaaaaucagccaaaggaagagagaacauacaggcuacagcaugggaugguuucaaauguaaagcuuucauuguccucaggaugugcuacccuccugguauagaugugugcuaaccagagaagcucaccugagccucaguguucaggauuuuuauguagacucuauuacacaggcaugaucgacugaggguuauucaugugguuaaucucagcugccagguugacuaauaccacucugacccaaagcccccacccacuaaaugauuggucuuuuugcuuuguccagcucccaugcuaauacgauuggguauggcaggccuacccuaaugucuggucuggccagcccccugccuuuaaccuaagauguuccugucuauuacacagaagccaagggcaagggcuggacuucucacuggacaaagccaaauaccuuacuacauaauaccuuuuuguuaaguuaauuuuuaagaauuaucauuuagaugcuuugcuuuuagaaauuuagauaauuucuauuucuuaguaucuuacaaaagaaacuuguugugaaaagaccuuugugaaauaguaaucuuuuugcuucucuuuggucauaauagauaauguauauuuuaaguaauuuugauacacauuuucaaauacccuucagaaacauuuuccaaauuugaauuaucagcaguguaagaugaguagaguauccuuuuuugugcuucuuugccaaaacuacuauuuuaaaaaguuugcuguuuccaaagguaaaauauguuauuuuuugguuuucauuuuuuuuuguuaaauuaacucuuguucuuguuuaccuacaauuuaugcacauugacuguuuacuugguuugauuuuggugacuaaaaaauucaaauuucuucaaaaaucacuccaaauaaaaauuuaaaauguguaauaagguacaaagauguuugcagucugcaugacaugggguaaauauccuuuaccuauaauuacuucuuauaaaucaguuuaaaaauuauggacaucucaaaaguaaaauaguuucugcuccuggauucauucuuagaacuaauauagcuuaagacugcaguuuuuacugauguauuaacuagcuuuucucuccaauucucuuuaaagugacccaagaaaugggaaauauuuauacuuucacuuugaaacagagaagggaagacuguaguaaauaauuaaguacuaaauaaugugauugcauugauuuuggggaggcauaaaucaaguauaauuuauaauaauuuaaagguaauugcgaauaagauaaaaguagaucaacagcaucuaauuguuggauagaaaagaaaaagaauuugaguaauauagcaaauaauaaaaaaugaaauggggaaacauaaaaacuauaaaauaauguaacuaagccaaugcuaaauggaucagauauuguuauauugauuaaagaaaaauaaccuuagcuuugaaggacacauauuuuacaaaaugagaaagugaaaaauaaaaaugugagcaaaauacacaguaaaaagccaaacagaaaucaagcguguugguaguagaaaugugauaaaaacuagaauuuagggcaaaagagcauuaaccagcagaaggcauaguauauugauuacauuuacaaguuaaaaggaagauugaguauaaucauuguacccuuugauaugccaaauuauagggcaucuaguaucuggaccaaaauucauuugaaauucaaggauaaaugaacaaaacuacaauuggaguaugaaguuuuugaaacuuguuuuuaaucagucuuugauagaugaaagagaaaacaguaaauauauagagaaauuaaauaauauaaauagcaugauuuuaaaauacauauuuugagccuaaaauagagaauaugaauuauuuugaaauuaugucuuagguuuacaaagacaaauuauuaaauuucuaaaaauagauauuauacaaaccacauucucagaccacaaugcauccacacuagacuuuauuaauaacuagauuaaugggcaaauacaacaucaccauccuuggaaaugaaacaaaauguuacuuuucucaaaaaggaaauaauuacuguaauuacacauuaacuuuuguccuuugguuuuugaccaaugauaaaucaaaagcauuuuauuauaugacugacaaaugagucauuauaauuauuaggcaguauauuaaugucuggaaauuacaagauggugaacaaaauuguucuaaaguaaaaagggaaaaaauuaaggaauaauaguaagaaauuaauaaaauagaaaaauuuuaaaauaaagugaauuguugaguuucugcaaagaggcuaguacagcugauaaacaccugauaaugauaaucaaagaaaaaaaggaaacacaaguacuuauaccuguaagauaucuguauauuugcaaauaugaaauaggaaaaguaguaguaccuaccuuauagaauugauguauuaaaugauguauguauaaaacucauagaauagagccugguguauaaugaccguauaguaaauauuaacuuaguaguaauaguuuuacuauuuauucuuaguaguauuaauaucaucaguauuauuaaaacagugaacgaacaaaaaguaaaauaaaagauauuuucaucacugaugaauuuaaaaugugcuauuuuuuuuucuuggaaaauaugaaugaccagauuagaaugagaacauuugaguagcuugacaauuaaaguggaaaaaaaaugaaaaaaaaaucucaaaauuuaagaaauaacccauuaaagaugucgaucucagacauuuuccugggccaguucuuuuugaucuucuuaaauuuuuaauguuuauuugugaaauguaacuuuacauaaaacguguaguaaaacagaucaucaccaugcuaacagucacaaaacuaccacucuguugagaguaaaccaugugacucuuccuaaucacaguguucucucuuccccucagagguaaccacuauacugaccuuuauaguaauaacucucugacuucuccguuuuauuuuacaaccugugugugcucccccuacacacucugguuuugccuauuuuuguguguuauguaaauggaaucacacaauacuugucaggaaugaggaaaggaugcuuucugugauugcugcuccuugaauaaaacugucaaaggaauauuaagaccucucaggggaaacauauaaaacuuuauuuagagauacugaagaagaccuaaauaaauggagaaauguuccauguuugcggauuaaaagauucaauauuacaaagauaacaaagggagagcucucaacaucuuaccauuaagugcaauauuuuccuaaccauucagaagauauucuuuaagagacugaggaauuuuucuccuugugugcuaaaaaaguuuuuuuuuuuuuuaaauaccaugaauggauauugaguuucaucaaaaacuuuuuguagcccuugagauaauucuaugauuuuucucuuuuaucaauauagaaaauuagcguuuauagguuaaaucagcuuuguauuuuuggaauaaacuuggauuuucucuauaggcuggcuuuguuaauuguuucuuuaggauuuuuucauuuauguuuguggguaagauuuacuuguacuuuuucuuucuccuaauauucuuauugaguuuuauuauuauaagguuauccuggucugguaaaauggguugaggagcauuuccuuuuuauuuuuuuucucugcaagaauuuauguugaauuggaauuuuuuauucuuugaacauucucucaugaaguuaauauucuagugagugaguuugaaaacaaauaaguaaaagauacacuaagauaguggcaagugcuaaggagacaaaacaaaagcaaugaggaguuaugaaauguuuggguaaaauguugacuuuuuagauugguuggccagaucucacugagaagaugauuaccagcacagaguaggcagaaaggcauuccaggcagaggguggacaaauggaaaggccuuaaggcuggaaaagcagcaaaaggucaucaggacuggaguagagagaaccaggggaagaggggaugaggucagaaguuggagggagggcaaaggccagauaauuuaggacugucaggucguaguaaaaaucuuggcuuauuucuugagauaggaggccauuggaggguuuuaagcaaaggaaugucucuuaucaaccuguuaacauagugucacugugcaggcuugcugagaauagauuucuaguagaguuagggcaggagaaagucaccuaguuaggagaccauuaggguaauccauaugagaaugauggaccagaauagcagcuguagggguggugaaaugugguccgagucugaauaaauuucaucagaagaggugauaggaguugugaaagauuagauauagaguggacauaaagacaggaaucaaaaguagcuugaaaguuuuuacccagaucaacuagaaaaagguaagcagaaggcauuaacugagguggggaaaccaucaggaagagcccuuuccagagggaauauugggaucuugguuuuggauauguuuuagaugaggugcauauuaggcauccaaguacagauauaaaagaaaccaucuuagauacuggucugcaauagggagaggcccugccuggagauaaaaauguaggagucauuccauggccuggagaaaauacuauguuuugaguauagauguaaaaaagaagaggugcaaggacugaaccaugagauauggaagucaggaauuaccaguggugcuacgugcuccaauuaggugaaguaaguuaggauugaacaaggaccauuauguuuagcaacauuggggucauuugaucucaaaauuuacaagaauaaguacuugagaaaagccaaagaaaaugugaaaaguugugacugagacuuacuagauaucagaacauacuauguacacccucuauaauuaaaucaaugcugaauugauacagaaauggacaaagagaccacaacugaaaacucagaauguuaugugaaaauuagcuggacgugguggcacgugccuguaaucccagcuacucgggaggcugaggcaggaaaaucacuugaacccgggaggcgagguugcagugagcugagauugugccgcugcacuguagccuggugacagagcuagaaucugucucaaaaaaaaaaaaaaaaaaagaaagaaagaaaaugaauucugaaauguaaaagacuuaaauauaagaaauaaaguaauaaccaucaugcaaaaaaauaggagacuguauauacaauaucuggauaaauauaccucauacccuaaaaauagaaaagagcucuuauagauugacaaaacaacaaacauguuaauagaaaaaaaugaguaagagaagugaacaagcaguuuacagaagaucaaauuaauuggucaauagacuuaagaaaaaugguuaaguuuauuaguagucagggaaaugaaucaaugaauauugauuguuggcagaaaaaaaagugaaaaaaaacccuucuauugcuaauagagguacgugggaaaaaggauuaucuuaccuuagagguaugauuuuuuucccccauaauguugcuaaugugauggcacaaaugguuuccauucagugagaaacauguuguaauggaaacuucguuuauuugcacuuggaaugcuauugugugacauacauagcccuuaguagcacuguggcuuuagaccacucacauaaauucuugaagccucauuuuccucauugugagauggagauaaccagccuuagcugacugcuuuccucugggguugaauaacagaucuuguguaugccaggucuuugcaaaugauauaaugugauuuacagaauauuaggauaggccaugagcuuuucaauaccagaguccaagaacaaauuacauaaacguguauauagaaggaaaaucuacuaaguguaacuugcaguaaagaagagcuuuguaaagaaggcuugaugucuuaguuacuuucauuauuggaucucaguuuucugagcacagaacaacgcucuccaguagaacuuacugcagugaugauguucugugaucuguaugcuuuccaguacuagucacauguagucguugaacacuuggcauguguuagugcagcagaggaucugauuuaucgaauuuuaauuuaacuuucaguuuuaaaggcugcauguggacaguaccauauuggacaggaaaccuaggcugcacacacuuacuaaauuauaauuugaggcagcuuacaaccagaugccaaagaaauuacaaucagagguaggugcaguuuauauuugccaagacuaaaaucgauauuuaaaaaaauguaguuugaugaacucaagaucugaauaaguaaacuauuaacagaagauauucaauuugaggaaggaauuuauucaaagacuauagaaguugaacauuuagacuucucagccggaaguccagacaugcuggccuaggugcuuucccagaucagcuuuugcuuucuuuguagauuccuugcugccagugcaguauucuucacuccucccagguuguagcccuggcuccucucuuuucucuguuuugauucccugcuaugagcuucaguuuauucuucuacaaaauggaucaaauaucuaucuucaaggaaccuuuacucuucugacauucuaggaacuuuaaggagcuagcugauuuuucauggacugcauuucaggggugucgcucauguggugauuuagggaucaagaugagaaaggauuuuguagccaggagucucauccuccaugucaaaaugucuuuccauagcaucaaucaguggguggccuuuuugaggucugggagccuuggucugcccugaccuuugccuacuugaucugagauauuuuucaguugaagaucccacauucaacuuugcauauuuccauuuauuuuaucaucaagccaaaccauuuuaaggcuaaauauuuuuuaaaaacuacucugcaagcucauguuguagcugccguaggcuuacuuuucuucucauaguuucuacugugcuuuguguaagauaguuggaaacugucauuauuuaagaagaaaacaaagagcuuacuauuuuacaaagagcaaagacauugauuguugauauauauuuuccugaaguuuuacacaucuuuuugucuuuuucuuuuuagaguccugugaagauaaaucagauuagcuuggaugaaaguggagagcacauggguguguguucagaggauggcaagguauggcaaagauguggucaugcagagaguucuguggcgccagccccaggugaucggaacagcaccuugcuuacuauauaacugcauuaagacaaucuugauuauucuuucugaguauugaacuugcuucugauuggucauaauugaaguaaaauauauuuugcacaaaugugccuuaggaaaaguaauuacaagaaugucaauaauguaacuaguauuaagcugauuaacagcuguggcagggugacgugucaccuuaaucauuacuaccgugccacuucugcuucagugacuagucugcaguuccugcaagacaguaguuuaaugucuuucugccauaaauccacaaaauuggauuuugugggcaugauuucugugggccagugguuuucauuuucacacacaaguuaugaauguuucucuugaauuauagaaucuuuugauaagcaaucauaguuuaucagaagaauaaagugucuuacaauggccacauuaaauaaauguaaaaucaauauauguacaguuuucuaaaaaccuggcgccuacuuccucgaccaaggacauacaucauuugugcaguguauaacuaacaauuaucagugcuucuugcugauguugagcugugacauuuaaugguuguggugauugauuuuccacuuauaagaaugucuuuuuuguuuuuaagucgauggaaaucuuuucuaauguugguuugcaaugauaaaauccuaaugcacaguguauuuaagcuacuuuucuaaaauaacaguuugagagagugcauuaagaaucauuauagaucuuuacauauuccuuacugaguaaagcagauuuccuaaucuaauuuuguauuuauuaugugcccuaaagucagugggccauuaagauggguaaauuaaaaacaguauacccgguguaaaagagauauacccauuuaaucuguuaacaaaaagcaacaugaagucucuugacauacaagaaugcauuuuauauaucuaagccuaauguugcccaaagagucuuuugaaacaguaauuggaacacuagugcuuuucaaaaagcacugucaaauuuuacaguacuuucagaaauucugagauugucaugauuaucagagagagaugaaggaggaguugguuugugcagaaauggagaagaauuauccacaccgcugaaacauuuuuuguguucauguauuuguaaagaaagauaaucuucauuuuguuuucuuaaaggugagaaauuccuuuugggcuguaaucaguuuaaccgaacuaauuuguugaaagauaguacucauuuuuauuaaaaauuggaaacgaauuuuuacuaaauacuucaucuaggaauuuucagagcuuuaaauguugaagaauuguuauuuaaugcaccaaaguggaauauguuagcuacuccaucugguggauaagaugaaccucagauuaucucaugguacccuucuugucaaacaccuuugguuuccuauuuugguaaaauuuauagcugccuauuuuaguguggaaccaugauauauuuuuggaaauaaucuucccguauuuuuauuaacauugguagaauugaaaguaaaucuuuuaguacacauaauuacauguaagcuacccccuuaccauggguuagucaguauugugaaaauugagaagcuaguauagaaugaucugguaaagugguuggugaugauaaaaauauaaagacauuacacaaacacauuccagauaucuaaaucuaaugcaucuuuaaauagguuuuguggguauuuuuuccuuucuucaguguguuaagguuccuagauaaauaauuauuuauuaggguuauuucaaggauaaccuuugauauuugcauucaguuuucaagucauaauuccagcaguuguuuaaaauuuacaccguuuauucagcuggugcucauuuucaaucuuuuuuuugucaugacuuuucugcaguucuacauuuugagacacacauaucguaugugugcguguguguguguguguguucaguuucaguuuacuggcauauguuucuagaaaacuuuuaggauaaguacauacaagguuuauuuugggauuucuugcauauguugcuuucauauguaaacuauaguauaaaauucuggguuggaauauuuuuucucaaaauuuuggagauguugcucccuuuuuucugacauuuauuuguguagacaugucugaaaccagccuacuuuuguucuuuucuaaaaccuuuacaauuuuuuuuuugguccugccuuggaacuuggacuaauaauaauaauuacaacaagaacaacaacaguaauaaauggucuguguaauucaguuugcuaaguuaugucuaguucuggucucuuuucauuaauuuuuucuggaguaccgucaguccuuuugauccauacacugaaguauuguuuucauuucagaaaaguuuaguucgguuauaauuuugaugauugccucaguugcauuuguuuucauuucuucaaagaaauucaguaauauaaagcugaaggcaauaucgcuuagaggcuaggagcauagcucuguauuccagcugccugggcuggcauucccacuuggugugugaaguugggcauguugcuggccuggcagugccucccucuccccaucuuggcagugggaggccccugaggaguguugugaggugcaggggauaugguaagcugucaguuauguauuaauuguuuuuauugcuaaccauucauuuuuaauccauugcagucuggccucuuccugucucccauuauuguaccugaacuuuucaaggcaagagggugaaugauuaagcacuauuuacccuucuccuccuuuuggcaauacauagguuguauagaaaauuguucauucauauugugugacgucucacacauauacuuugcuuucucauuuuuagccuuuuauuucuguguagucagggagaguuccucuacuuguuuauucccuucucugauucacuuuucuuccaaagucaguuuugugucuuacugcuuccuggaguagauuuuuauugcauuuugcauuuuuaauuugucugaaaucuuucccaauucuguuuucauaucagccugauauauauuuaauuuuuuuaaaauuagaacuuuuuggccagugcaguggcucacgccuguaaucccagcacuuugggaggccgaagcgggcagaucacggggucaggaaaucgagaccauccugacuaacacggugaaaccccaucucuacuaaaaauacaaaaaauuagccggguguggcggcgggcaccuguagucccagcuacucgggaggcugaggcaggagaauggugugaauccgggaggcagagcuugcagugagcugagaucacgccacugcacuccagccugggugacagagugagacuccaucucaaaaaaagaaaauaaaaauauaaauaaauaaauaaacaaaaauuacuacuuuuuauaugccauagagugucagauggguguugucuagugguuagcaguggaauuauccugucacuucuuagcugugugaugucugcuaaguuauuuauaccucucucuaccucagcccauuuccuccccuguaaaauggggauaauaacaguaccuacuuaauuauuaggaggauuaaaugaguuaauauauguaaauuacuuggaauagaaccuagaacagaaaaaucacuuaguaauugugagcuauuauuauaaucauugucgucaucuuccuguuuuucugcuccagguucuuagaggucugaucuucuuguugugguugccaaacaguuuucuaguuuuuucuuugguuucugguuaauauuaagauauuucuuaaagcaugguuuuucucccuuugaaucuuuggaauguucugcaggacuuuuuuaauagaccuuggcuauguuuuuguuugauuuguuuauccauuccagaacaggcagaucucuuccucaaccuggguuagcaaacagauucaaugucuaacuugcccuuguuacuguuuuggguauuuuagaauccccuuaguucagcaacagggacccuaaaaugagcucaguuucccguaacuaaaugaaggcagcucccuggggggaacuagaggcuucugucaucacucucuggucucuguuagucagccuggguggagaguaugaaaaccagcaaucuugacugccagagucccuuuagcuaccacuggagguauaaugacaguucacauguccacccuauucugauuuuuaauguguuguuuggaagcagaaguuugagagaggcuguuacaagggaagucuaacugggaaggucauauaguacucuggccaccuccguccucauuucucugcaucagggcuguugcccaguguucugguuggcaaauacauagaguuucaugcuaaaguggagaaugauuacaucccuuacuguuucaugaggguagguuuccucuauuucggguaacaaaacauguaccacauacuucuaagguacucacauggcucucugguuuguagcuaaugagaauucucccaggacuuugcaggagcuugguucuauggcucauuguuaggaauuuucucuuuuucuucauuagguauuuuuuuuuagcagguucaggguaguuguuagggcuacuacaggagauaccguuuucaaaaggguccucucucguaaccuuuaauuaugugauucuuaucucagaugagcucuucccaaaagcggagggauucccuuuacagauaagugugauuuucacagacaaaauggcaaaauaaauaaagagggagagagaggggaaauaaaugagaauuguuuuggauuuuauuaucuuuaguaguauaacgugugagcagcuaguuuggcaugucauaguagugaaaugaaccaaaacauugaagauuuuacaaaucacccuugugcugauacugacaaagcuuaugagauuugucucgugaaguuauauguuuuuuauauugaaauagaauauaagaacacuugaggaaaauguugcucaguuaaacauaguaauagaaacugaccagagaguucuauucuugauuugccaccuucagcaguuacuccuccagccccuacuguggguaugacagugacauuuuugcuucuggcgaauucuuaaggauagugauguguaucggugccuguuuacuaugaacuuguuugauuuuguucucuuuuuuguuuauuccucuuuaucacuauacucuuaugccuucaauaugcauuuuuaauuuuugaagggacauuuauccucagcaauuccuaauuuaauuuucagcauuacauccacagucccaguauuuauccacacauuuacugaucugucagucuuuuucuacaggcuuaugcaucauuuguuuacaucucauauacuuuucugcauaauagaaaucacuuuuuuucuaaaauuucuuuauuccaucuauaaggcagaaggaaguuuauccauuugaaugaauaaucagcuucauuuaauuucaauuucugucauagaguguccuuaauucaaagucugauauucauguucuuuucaguuuggcacauauuuaaggcuuuugaauguuuuuuuguuguuguucuauucuacucuucuuacacuuuagguaaaaagauaucuuucuuuuuugcaaauuucaguuuauccuauauaaagauagcauguagaagaauaggauuuagaaaauccggguucugguucuaacucuucugcuuaugauuuuuaugaccuuaggcaagucauuuuucuauagaaucaucaguucaacaggcauaaugguauuugcucuuagaccuagcaguuuugcuaugaggaccaaaugaggaacagcaaaacauugccaauugugcagacuucaaaaauaucauuucgccucaccagaaaguuugaguuuguuuguucagggugggauuuggccauuaguuuccaggaauuuuaacuguacagguguguuugagaaccacuaagguaaagcauguugacacauuuagggauguaaguuaguagcaguaguaugagauuuagcacaagaccaugcaguacaugaccuuauuguacugaaaagaaauagauuaaguuaggagaaguucagcuugcuaguugagcagguauucauacugagguagcuucaucaagguggccauuuguugauucacuccauuaagauucccaugauucaggaaccuccuucuuuucaccugauuuucuuagauuuguugggguccaucaaguuaaacuuccccagguaaagugaaacccugaaugcagugcuuuccuuuugugcuuuuuagccauuauuuuauaagauguuuguuauauuauccuaugccuauauauuuccauaaaaguaaugacuuuauacccucugaacaaugagcagcaggugaugggggggacauauguguauuugccaugugaagaauacauuucaaggccagccucaggaaaaaugaaauuccuucuguuuuacauuauauuaucuccuguuuguagaacccaaauaacaaacuuggcacaaguauauaaaaacaguaguuacaaaaugaguggaugguccccaaaacuuuaacuuuuaaugcaugaaucuauuucccaaaauuauaacauaagugaauuuccugcuuggggcuugaaagaaugaaccacucagaacuuaccaagauuaaaauaagaagaaauugaaaguuuaaguaguccuauauuuauuuuucaaauagaauuuauaauuggaaaccuuuucacaaagaaacuaucuuaguccauuuguguugccauaacaaaauaccuuagacuggguaguuuauaaauaacagaaauuuauuucucacaguucugaaggcugggaagucugauuucaaggugccagcauuuggcaucuggugagggcugcucuccuugcuuccaagauggcgccuuguuauuguaacuucacauggcagaagggaugaauuaugugucccuguguggcagaaggcagaagagcaaaaggacuagcuagucaccucaagcuauagcuaguuaccccaagcuuucuuauaagggcaccaaucucaccuaugagggcuccaccuucauaauuuaaucacucacuaaaggcccuacuucuuaauaccaucaccuuggagguuagguuucaacacagugaauuuggggagaacacauacauucagaccauagcaaagccaugagaccuagauggcuucaccagugaauuccuacaaaaguuaaagaagaauaauaccacuauacuagagacuagaaagacagugaacacauuccaauguugggaaauaguucucauuggcucuaguacuauuuguuagcuccaagcauuugagaucucauggaauucuuaugcugagaguauaaauaaccaucacuuuggagguuagguuucaacguaaugaauuugggggaacacaaacauucaaacuuucucauggugagagcauaauuaauuugaaaccacuuugugaaaugguuugccuauuaaaugugaacaugcacauaaccuaugacucagcaauuccauuccaagguauacacccuucaugaauauguauauaaguccaccaaaagauuugcaaagcauguucuuagcagcaguauucaugauagccccaaucuggaaacaaccuaaguggucaucaauggaagauggauaugugaauugugauauauucauacaugaaauaauacccagcaguggcaaagaagcaaccucuacuauauccaacaguguggcuaaaucucacaaagaaaauguuaaauaaugaaugaaauaaaucagugaaauagaauaugauuccuuacuuacaaaauucuaacaccagcacaacuuauccaugccaguagcuuugaggguagugauuaguuggaggguguuauuuacuggaaagggaaacaaaggagcuuauuggcuucuauuucuugaucagagugaugguuacacggauauguucgugucauaaaaauucaucaaacuauaaauuuaugauuuguauuuuuuauagcauguguuuuauauuucaguuuuguuuuuguuuuguuguuguuaaguaaagcacucagaaaauauacuaaguaugaauaaaguagccuggaacaacuuuaagggagacacugauaagcaggaacuuaaaucuuucauuucuguauucucaguagauuuagcauaaguugugagugaagugugguucaccuaaucucuuaccacacugaucuacaugguugguuuauuuuauauauaugagagacacuaaaaaaaaaucuccccuuuccuuuaagggaugaaaaaauaguuccuuuagggacagcuuauggaaguuuauaaaagaauaguaauaacuuguucaaaucuguuucauuguuuuaauggcaugcauuuaauacaauuuguggugauugaagggaacucuauccauggaaugcuuaugaaagcuuaauugcagcaaaguacccucaaccugaugggauuuucuuuuuucuuuuuucuuuuucuuuuucuuuuuuuuuuuuuuugagacggagucucacucugucacccaugcuggagugcaguggcgcaaucucggcucucugcaaccucugccucccagguucaagcaauucuccuaucauccuccugaguagcugggacuacagaugcacgccaccaugccuggcuaauuuucauauuuuuaguagagaugggguuucaccauauuggucaggguggucuucaacuccugaccuuaggugauccacccaccucggccucugccucucaaagugcugggauuacaggcgugagccaccguacguggcugaugggauuguuuucauuagauauuuaauagaggucacggggccuuaaaauuauuaaauauucuacuuuucuuauugauaguauguguucauacugacucaguagccuucucuauugcugucauggugagcugauacaauccauuuucuuuguaggugcagguauuuggacuguauucuggagaagaauuucacgagacuuuugacugucccauuaaaguaaguauucagcaaguuuuacuuuuucuaaggguuuucucaaguaaggcaauauggauuacaguaauuugaacauuaccacuucuguauuaauuuugucaguaagugucuguucaacacuucagauguacuggauacuauuuagaugcugugaaagaagacagaauguguauuuugugacugugaucucagucugucuucagggguauuuuauuauagugagugagaucacucacacacacauacacacacacacgcacgcacacacacacacgaucugugguaaaagacucaaagagguaggaauaauauuaagcguuccaaagcugaaaggaaucacuuuuagcuguucuugucagugauggcuucauugguggagugauguuuaacuuggcuuuaauaaauggagaaggacugaugagagaagcuggcuuuccauguggaagaacaacauaauagaaauggagaggcuagaaaguucaccuuguguucaggaaauggcaaauuguccaauuuauuugguacauaaaagacugauuucacaagagaaugugaaggaagauugggcuggcuuuacauucaggcugaagaauuuggacuccauuugguagauaacuagaaauuacuaaauauuuaagaacaaaguaaauaaacugaacuaagcuuuaagaaaauuaauauggugacuguauacaguauugauugaaggacagauaagagucaagaggacuaguuuuagauaaaaauuaugguaguugaggugucuauuauaguuguugaaggaagaggucauuuauuuuuuucaccuguuuauucaaacauuuauugaccagcagguaaaggagagauagggucugauguauguuuuaaaaaguugaauuugccagaguggagggugauuuaaacaggagagugauuggggacaaaagacaauuuagaagccuaauauaauacucuaggcagggcauuacaggaucucaaugaaaagaaugauagugaguguucaagauggaaaggaugaaauuuauuuggacagccugugcuaaauagacuuagcgagccuuagugauggcuuggaugagggugaugaaagacggaagagcucagggucaguucagguucucgcuuuggggauggggugugggaugccaucaguugcaguaggguauguuugaguaaggacauggcuaggcuaguuugguccugaguuuagauaaguguaguacaucagguggggacguuacggagguuuuagaaacaugaauaugggccucaggauggagauuggcccuuaaacacaaacgugauaaccauaguugaauaaggugaagcuauuuuuaaagauauuauccaauuuagagcuguagagugagaagagaagacugauggugaaauucuggaacacucuaacuugaauacucaggcuguggaagaaaaaacagcaaaggagucuaagaagaagcaguuggagggacuguaaggaaucccgaagaguggugucagagaagccaggggagagaggguuucuacaaggaggaaguggucagcagugucgaaugcaguguggagauuaaauagggggaaggacugaaacaagggcauucuauguggugauuuugaaguuacuggugaccuugcugaggacucuuuucagagcaggagggucacuauacaugaaggaauaaauuggagaugaggaaguagaaacaaucagcagagacucuucuuuaaagaaauuuaguaauaaagaagagagaucaucugguagagagaggggccguguccugggaagguuuuugccgaccauguuuugguucauggcaaaaaccagugaagaggaaaagauuaaaaauaaagagaaugcuucuuggagcagcacuaagcaaugagaucaacagcuuagguagggaagauaaucuuggaagaguccuagacccucugccugugaaacaggcaugaaggaaguggacugagccuagcuauugcaaguuagacagugaaggaggagcacuugugggcaaugacccugauggcuuuauuuucuuacaucugaagggaagaaaaggguaacauaauguguuugaggagcagaggagauguuuggaaucagucccugaucuacaguuaugcauuacgagagagcuagggggagaguuuaagaaugugaaacaauagaaugugugaauccuucacuacugguauugaggauggauuaggaaaguguugaagggaagaagggcuaaccugggagguaggaguguuuagagcaaugaaggaucauaugcuaauccuuaaaaaugacauuguaggaagaggaaucuauuccauuguaggagggaaaugugucaauuaauacaaguauaaaauauguuuaauugaagguauauagaaguaaaauugugugagauuuuguguguguguuuaccuaaaaaaaauucucuauguuaaauuagaaaaacacaaaauuaguuaaguuggugauuucaugggugguuuggggauaaagagagaaggagguggagucuaugcaagcuuacagccacaacagaugagcuccaaagauggaggugcacugaguggagccacgagggcuuuuguuuucauccccuccccaagauguuaaugauguuauguaaucauaaagcccuugcaaaugaaggaaacaguaacaagggugguggagcaaccuuaagagaaaccuggguagcaaggggcuggagaaagauuggaugagugggaagcagaugagaaucaggggaacagguuguaucuaaaaagcuaaguccugaacgguuagcucuuugggccuguagcucuguucucucuccauugauggggucuugguguaagugggcuaaacgucugggaggcugcguugccacuuggugccgucuaucauugagagucaucuuggacaaggaguuaguuggcuucuuucuguuuuuuuuuuuuuguuuuguuuucuguaaauuguauccaguuagaaacaguugugacaucuugcuaccuugaccaaccucccuugaccucccuugcugccucuauacaggugacauccacuuauagggguccucagccagaaacuagaacugacuuauccuacucuuugagcuuugaccuggcuucagagaagaaaucuuuucacguaagaagaaaacucagaugucaucaguuguuguaaaauaugauuugaauauauuacuuccuaccaagguuucaggauaauuuuuagaucaugcugcuugaacugugucagggguuuucauucugugcauuggccaugacuccuaaaccagaguuggguucuguuucucuuguagauuauugcugugcacccacauuucgugagauccaguugcaagcaguuugugaccggagggaagaagguaagugcugugugucucuaccuugauauguagccuugagggguguugugugcuuacucuguaauuuauccuuaauguuuuuaugucuggcuauucauuaggagaaauucgagaaagacaaauguaaugaaaucugaugaucaucaucucuugggggaguuguggcuucaguguuucucacuacauugcuuuuuuuguugagacggagucuugcucugucgcccaggauggagugcaguggcgugaucuuggcucacugcagccuccgccuccuggguucaagugguucuccugcaucagccucacgaguagcugggauuacggaugcccacuaucgugccuggcuaauuuuuguauuuuuaguagaguugggguuuugccaugucucuacuaaagacauggccuggcuggucuugaacucuugaccucaggugaucugcucuccucggccucccaaagcccugggaugacaggcgugagccacugcgcccagccucuugcuacauuucuuugaaguagauauaggacaagaaaauaagagagcuguuacaucuagagcuuugaaacauugccccucccacaaaaaagaggcagcauuuaaaaauaacaaaagcacacuuaaacuacugauuuuuuuuuuccgauuuuuuuuuuccuuguagaaaaucucuugcgggccuugauaaacuuuuagagcaguuauggcuacucuucgcugacauguucauggcacauuuuauuaucucagugcuauuuaaaaaauaagagauuggacugggcauaaugguggcucacuccuaugauuccaacauuuugggaggccaaggugggaggaucacuugaggcugggaguuugaaaccagccugggcaacgagugagaccgacucuacaaaaaaaugaagaaauuagcugcguguggugguaugccucuaguccuagcuauugaagaggcugaggugggaggaucacuugaaccuaggaguuugagguugcagugagcuauaauugugccauugcacuccagccugggugaaagagcaagacccugucucuuaaaaaauguaaagagaaauaagagagaaaaacuuucauauauuaacauuuuucuguuuauagauguaguaaauucucaaauuaaagaaucugucugcuuauagaauaagucaaauuaguuuuuuuucuguuuuuauuacuuagagauauuuuaaagacuguuuuuauacuaaaugcuaucaccauacuggaacuccgaauauuauuuacuauucgguuuggagccagugaaaaggaaguagucuauagcuauuucuguaguaguauagagcuauggaauggcugcuuugaggcccagcuacugaaugcuuuuaaauguuuuaugauacuuaucugucauuuucccuugguucaauaguuaauagaaugauagggcgggaaaaccuucuggucauuacaugacucguuguaaugaguggcagguugguagauccugauuccauuccacaacauaaagccaagaucacgccaguucugauuucuguuagagagccccuccuucccccaucucacagcccauuguuauucuuaggcuguaguugcauucaccuuauguuaaaauguccaggggacuaauuagugggaauuacagaccuaaucucacauucucuagcuuaggucugcagcugauccacuccugaaaaaauaacuaccuuacuugucuuugucuuugucagccucaggaaagaguagcauuaacauuccucucguauuucuucacuaaacacuuuuuggguuaagaaauuuuguguaugauuguauuaggguucucuagagggagagaauuaauaggauagauguguguguguguauauauguguauauauauauauauauaguaguuuauuggggaguauuaacucacaagaucacaaaaugaggucccgcaauaggccaucucugcaagcggaggagcaaggaagccagucugaguccuaagcugaagaacuuggagucugauguucaagggcaggaaacauccagcaagagagaaagauguaggcugggaggcuaagccagucuagucuuuucacguucuucugccugcuuuuauucuggccauccuggccagauuagcugauuagauuagauugugcccaugcagauugagggugggucugccucucccaguccaccaacucaaauguuaaucuccuuugggcagcacccucagacacacccaggagcaauacuuugcauccuucaauccaaucaaguugacacuuguuauuaaccaucacagugauaauagcauaaguucacauagcugaaauuuaaacccagguguucuuauuaaaaacucaguaagaauaaauaauuuuucuuuuuuuucuuuuuugagacggagucuugcucuguugcccaaguuggggugcaguggcaugaucucggcucacugcaaccuccaccucccgaguugaaggaauucuccugccucagccuccugaguagcugggacuacagaugcccaccacccuacccagcugauuuuuguauuguuaguagagaugggguuuuaccauguuggccaggcuggucucaaacuccugacuucaggugaucagcccaccucggccucccaaagcguugguauuacaggcaugagccaccaugccuggcugaauaaagaauuacauuuuauuuaauucucacugggaauggucacugcuuuuuguuuuaaaugacuuaaaacaacaaacauuuauuaucucauacuuagaaaauucaagaguggcuuagcuguuaggcccuggcugaagguugcucaugaggguucaauugggauauugguuggagcugcuugaccggggcuggaaggucagguucuaagaugucugcugccuucuuaauaaucugcuauacacuuaaaauauugauaaaucacuuugguuuaaauauuucccuagcauguuuugaugcaguuuugauuuucaauuuccaauuucaagaguuagagauuuuacaguuguccccuauuucuugaagguauuagaauaaaagaacauaccagagauaauaugaguguugauguccaugugguaggacugaagauuuggaggagagauuuugcuguguugguuuauguuuuuuuguuuuuguuuuuguuuuuuuugagacagaguuuugcucugucgcccaggcuagagugcaguggcgcgaucucggcucgcugcaagcucugccugccggguucacgccauucuccucccucagccucccgaguagcugggacuacaggcgccugccaccaugccuggcuaauauuuuguauuuuuaguagagacgggguuucacuguguuagccaggauggucuugaucuccugaccuugugauccauccgcucggccuuccaaagugcugggcuuacaggcgugagccaccacgcccggccuguguucuuuaauaaucaguguauucgugaaguuuaauaauugcuuuucugcugcaagggauaccuguagucuuaucaaguuugccacauuaauucugcugcaugagugucuugucucccuguaggaugucuggguuaacugucaguaacauauucuucauccuuuuacuuagcauuugauaucauuugcagacauccguagaaaggacagugugcaugcagcagucugggucagaguccauugaguagauccaugagcagugcaggaacaacagaguaaucuagcaucuaauuguugguaagauaacaugggaagagcuuggaauuuauagaaaguuggacauugugauaagcaauaagauaaguagaauucaaaaaaugcugaacaggcagaacaucagggguuugguuugucucuuugguugucacugacuacuugacaagcuguucuauguucaguuuucuaugagagaguaauuuuuuuuuccuauucaguucuccaaaaaugcaucuguugacaucucguuccaagcauacagaaaaaaaguuuauauguauauaacaugagaguaaaauaaaaacaguuaaggucaucuggugaaaaauugaauuaaaaaugauuuuauuauuaacuuagacauuugggacuaaaauaauuuaaaagaaaacauacacugaagagcuuaguguauuguauguaaggcuuaguauauggggcaugagaaaagcacauguaugauauuuuaaagugaggaaucccgugauuacccaugucaguguaaguaauugguauuaagucauuauuuuuuuagcuguuuuaaaauaguuuuauugauacauaauuugcauaccaugagguucaccagaugauagugugcuguuuagucguuuuuaauauauuuacagugcuguguaaccaucaacguaagcuaauuuuagaacacuuccgucaccccaaaaagaaaccuugcaccuauuagcagucacuccccaucuuccuuccuccccuccucucaucccuaggcaaccacuaaucuauuuucuuucucuauaaguuuuccuauucuggauauuucauauaaauggaaucauguaauauauggccuuugugucuaacuucuuuccuuauuuuucuagguacaucaauguuguggcauguauccguauuucauuccuuuuuauguccagaugauauuucauuguauagaucuaucauguuuuauucauccguuugucgcuugauugacauuuggauuguuucuacuuuuuggcuauuaugaauaaugcugcuaugaacauuuuuguacagcuuuuuguggcuguguguuuucauuucucuugaguauggaauuguugaaucauauaguaacucuauguuggacauuuugaagaauugccaaaccguuucccaaagugauuguuccauuuuacauucucaucagaaauauaugaggguuuuaauugucuacauucucaccaauauucauuuuauuuucucuuuuugauuauaaucacucugguauguguuaagugauaucucauugugguuuugacuuucuucuaaugacugaugauguugaccauguuuuccugugcuuauuggccauuugcauaucuucuuuggagaaauguuuauucagauucuucgccuauuuuuuaauuggguuuuuuuaauuauagaguuauaaacuucaaaaauaaauucuggguagauauuccuuaucagauacaugauucgcaaauauuuuuucccagccuaugaguugucuuuucacuuuauugaugguauccuuugaggcacagaaguuuguaacuuuaauaaagucacauuuaucuuaauuuuuuugauacuugugcuauugguguuguaucuaagagaucacugccuguugccucuuccaaggucaugaagauuaaugcuuguuucuuuuaagacuuuuguauuuuuuacucuuaaauuagguguacaauauauuuugaguucauuauguaugauguaagacaggaguccaaauuuauucuuuugcaugugaauauccaguuggcccagcaucacuguugcaaagacuauucuuuucccauugugugggcccuuuguggaaaauugguuaaccauaaauguuaggguuuauuucuggauucugaauucuaccaaucuauauagcuaucuuuaugccaguaccccuuuuagguuucaaagccacuaauuuuucuguaauuaguuaugggauggcagaugaacuacaaaugcuccucaauuuacaguugagguuguccugauaagccuauuguaaguuaaaaauauuguuaagucaaaaaugcauuugauauacuuaaccuacugaacaucacaucuuagccuagccuaccuuaauuguagucagaacacuacaguuaggcaaaaucauuuaacacaaagccuauuuuauaauaaagcauugaauauauaauguaauuuauugaagacugaaagugaaaaauuuaaucauuguauagguaccaucauaaaguugaaaaaucauuaagucaaauaaucauaagucaaagacugucuacucuuaaaacuuugguuugggguucuuucccuuuaaaaagccauuauauaucaucauucuuuaaggaaaaccuguuuuuauucccaguacaaucaaagcacccuaggguaauacaagcaaauuauuuccacuuacuacagaagauauauauauauaugaaugagauauaucuaucuaucuguauauauggagggguguguguguguguguguguguguaugacaaaacaagucuuuuaaaagugugauaauaguuugugauuuagaauaauuuauuuaaaaaagccauuauaauuuauuuuacuuauguuaaaggcuuuagaaacauguaacuguguccgcaauuuaaugacuuguaacauacaaacuuugauuuauuuggauccauuaaauuuuaucauguaaauauguauuuacuaaguacuaaaaaguaccauuuucuugauaaacuauaaugaucuguuugcauaugguuaaauggagauuuucaaaauguguaucagcuuggugugguuugcagaaaucuccagagaauuuccuuuuucuacauguugugugguauguacuuguaaagauuauuuaugcuucauguuuuugacauuagcguguuuuguuuguuuugaaauagauuuauuuaguugagguauuuuaggauguauuuuucuaauuucauuaagaaauauaucugauguuaaaaacuaaaggcauuuagaagguuacauuaagaaaggaggacuugugaaaugaucacuuucauuuugaaaguguucgcaaauuuuuaggaggagcugcucuuuuuguaacugaguuauagagguuuauaucuuugaaaaaugagauaacuacauuggcucaguagcuacuucaauccuuucagcugcaauuuuaaacuagcagcagaaacuaggcagaacaauuuugaaaagcccaacauuuagcaaaugguuauaaccuugcaauaaucauguuauagauaucaagaucccuccucuguugagaacagguggcagaucacauagggggaaaagagaauaaagacauaugucagauaacugagagguuaugacuuucugccuuuaagaaauaauuuaaucuucaaaaaauuggagcaaagacuagccaaaugaagguguaauguggaauaaagacauucuuaacccuuaagaacagugaucucuagacugacagccaaauaaaucguuggaauuauaugccaccuucuacaaacaauggguuaaaguggcacagagacuagaggaacuaaguagaaaaauagaggaccacuaugagauauucgugaagucauaagaaaauuugagagagaugucuauuaauauuuaauaguucuuuaaucuuauuacaauuuuugauuccuauaaaaauuauuaaaguaauuagaacauacuuuucaaaguaugcaacauacauugcagaacauagcaauguaacagaagaaacccugaaacuguaguuugacagcuauuuccuuuucaaaguucuggcuucuuagguguucagagauagcucuuuauccaccagggacuaggacuaggaggcuauaguucugucuggcauaaacuuuuauuuuagguuuucaagguaucuucuuaguaguugaaugccauagcuggauuuauggacuccagugcuugacacaugagcauaaaaagcuuauuccauauucuguuuuguuuccaucuugaaaaaaaaaaaagagaaagcacaucucuuaaaagugccauuggagagagcuuucaaacacgugaaccaaugaauuuuuuuuguaaguguaaccuucuuuuguagcaagaauuuuaauacaggagcauggcaaaugaaguuucuauuuuagaaauaaaucugucaagugaauguugucuggauuuuuuuuuuuaauuguccagcuuucccugucagcagguaagcuuuagcuucauaggaccuuuacuuuugaacacugaaauacacuuuauaauaacugguucuacuacuuugacaaaucauuaaauugucgcgaugcuguuugcaguggaguucauuuuuagaaaucagauagucagcuguuuggcguuacggugggauagaaugaggggaccuggccgcaggggcaaguugcuuuguaagcuggaaaaugucagucagcaaacaaggaaaggacuggagugaaugaaaugaggaaaauuugaaauggcaaauuuuaccugaaggacagagaugguagugucagccagcuucuauaagcuuccagcaguggucugcaaauaauaaauuggauuuugaauccuuuuugagggaggauucaauaugggaagcuuuuuauaaaacuguaaauauuuaaaaaauuauuauuaagauuguuuuuaaauuuuauuucuuuugcccauguuaucaacauuuuuauuuuuuucuagcuuuauugagguauaauugacaaauuaaaauuuuauauuauauauauauauaaaauauacauauauauauauuuuuguauuuuuaguagagacgggguuucacuauguuggccaggcuggucucaaacuccugaccucgugauccgccugccucggccucccaaagugcuaggauuacaggcgucagccaccaugcccagccaaauuauacauauuuaaguuauacaaugaugauuugauauauaccaaauguauuuaguauuuauugugaagugauugccacguucaagcuaauuaacauuaucaguugccucacauaguuaccauuucuuuggggaugagaauacuuaaaauccauugguaaauuuuaaguauuuaauauggcauuauuaaauauaguaaccauagcguacauuagauccccgaauuuauucaucuuagaacugaaagucugugcccuuuuggccagcaucugccaauagcucccaguccccuggcuacaaaucuuuuuagaaucuagauaauccggugagccuuuucuuaccacugccaucccuaaacaugaaguguaggagugcuuccucguguguuuguucaucuuugggucagauuggagcugggguuuugguggcuagaaggguuuugacauuagcaguuccucucugucuccuguccaguguuuggaucucuaggauaguauuuccgcaaguuuucagaugcuugauuguagccuucuaccugaaacuucuucccacauuacuuaccauuguaguuuucaagugaaucgucugaacauuuuuaagaauuaaaauuaaggcucccuaguuaauucacaguuacaccacaggcagccaccaaucuaacgguugcacguugaggcauuguaaauacauaccuuuauuuauucuagguacuguguuguaaauuguggucucauuccuagaaauguauuucaugcugucaucaauguaccaaaauugauuaaaaaccauugauuagcaggaaguaaaacacaaauguaaccuucacaagcauuuuuuuagauaugaaaaaccaagcaauaaaauagcucuacuguuuaaaguauuuuucggugaguuuuccuauguauacuaagcuaucugaggcuaaaaauagaaauauaaugcuuaaauaaaaaucauuuucagucggaaaaacagguguucuucauugcugauugcuuuuuugaugucaauauguaggacucccagaguauuugaaugguaucuacagcggucagggugggagaguuggguccauagcaacuucauuuuccuuuaugauucccauugucucauauccaucaaaugccuguuaaaaaauauacuuuuuucuuuaaugaguucagcuaacuuuuucauauauuuccauacugauuguagcuuuccccugaacucugauguuaaaacuaccaucucucuuccuuauaaccaucuuuugcuccuugcugauaauaucuucuuuugcauauggagaguccugugcuuauucuuaaguauuuugagcaaggacugcaagugucauugccaguucagagguguucauuagauauucuugugggauuuaacaucagcugauucauuaacacagagguucucuuucucucuuuugcuuuaagagaaggcuguauaaagcaaggggucacaauugcagucauuguuaguuggugucgugguacaaacuaaaucacagucauuucacaggaguauuugguuugaaucugcuuccugaauacaaccuugugucaugcuucauguuaggugcuguguguacacaggaucuugauuucagaaauggugguaggcuuccaaaagcauauagauaggaugguguagguagaauauaguuaauaagaccauuagucagaauagugacuugacaggaaaaugaguguauuuguauauucacauacaacacuaugggguaaauuuacaguccuuuauuugucuuuaagccuuuuggaucccccucgaccuguaugguuuguuuguuuuccuuuuaauuuucuaacucaguuucagccaauuuucuugauauuuguaacagugaaaauugguacaagcugucuaacaauagugaauuagcugugucagugcccugcggccaaagaucaccaggaguaccccauaugguuuuaggaagauguuagaagaauuguaggauuuaggcuggugugaggugauuuuggggagguuuaaggcaucagggcuuugcucuagauuggaugcugucaugaagcaugaguaauucuacagcugggcauuuugauaaaucuuaucuagaaggagaaaagccuaagccaaagccaaagucauaacugguaaagaagcagcagucugucauuuuagccaaagugggagguguuuggucauugccacgacuuggaaaauguucaugucuuguuugcauucagacaugauuauggaguggucuugcuucuguccugguccuucauggucauggaguggccucggcugauguugguuuugugugaaauuguuuauauucaucaagagaacaucagagcccugcugugggugccaggcuagcuucugguugucagcuuuucucuuucucaguuggaauaaauaaaauucucaacauuuguuagauugcuucuguugagguacuuuucuaaaauauauguauggucugauuauccuuuucuguagaaauaaaauuauguauguagauguauucauggaaggcuguacaccaaauuauuaacaauauuugugucugggcaggauuaugaauguucuuucugaccuucauuggcuuuuauuuacuuuuuuguaguaagcaugcauuauuuuuauaauaauaaaaaguaaaggaauguuuagaguaaucucaauuauuuuagaucuuguuuuaacuuaucacuguacaucauaugaaauucccuacauuauugaugucuauucuuagcucaguguuauugaauaguugcauaauauucuaucuuauggaucuauuugauuuucuuaaccauucuucugucuuuggaccuuuagguuauauccaguguuuggcugucauaaaucaugauguggugaaccuugaaaucuuuggccuuucaucuguuccucugaauguuuuccuaccauugauucuuaggauuggaauuacugaaucaaagguuaugauaauuuuuuaggcauuuaauauguguugccaaguaaaauuguauuccagaaaacuuacaccaguuuacaucagcuaugugugaguaccuauuuuaccacaugcucauugccaaucugauauauaaagauacuccauuuuucuauuuuauaguauauuugaauuuuuagugauuuugaacauuuuuauuuauuagcuaguucuguagcuuccuuugugauuugucugauuguauuccuugcucagggcagcuuuuaauauuaccauagaagccaggacaaugaaggcuguccacuugauauuuacugucaguuugagcacaaauuauugcugcuuacugaacagccugcagccuuuucuccaauuuuggccaaaucuggaauaauuauuguuguucccagggaggcauuauauaggagucuaaaugaggcuuuagaguagacccugaaguguguagagaggaugaacauauguuaccauguagaugugagucugccccaaaaccaucaguucugccacuuccaugaaagcuaucaaugcugaccaguguguccaguuaaugccaguuuuucauagagaugguaagaaaguggauuauaaugcuugaaauuggguucauuugacucauuuucuucugcagauagucuccugauuuuuuuuuuuuucaacuuuugggcuuuacuuuguuuuuguuuuuguuuuuuugagacagacucucacucuguugccaggcuggagugcaguggcgcgaucucggcucacugcaaucucugcuucccagguucaagugauucuucugccucagccucccgaguagcugggacuacaggcgugcaccaccacgcccagcuaauuuuuguauuuuuaguagagacggagcuucaccauguuggccaggaugaucuccauuucuugaccuugugauccgcccaccucagccuccugaagugcugggauuacaggcgugagccacugcgccuggccuguuuuacuuugaauugugugaagggcuuguucaaauacauaaacccguguuuucagguaacugucugcauuauucaagacuuagcaauuuugcaucucuuuuugauauacucacugugcaaggauuuucaccagucaucagugauugagauuauauguaguuaaaguuagagauauuuguucauugcagagaacauuaauucaaguuuaaucacccaguggaugacuuuucuguuaucucuacccugaugcugaggguguuugaccuugggcccagcccggaaaauguauccucagauagcugcaaacugaaaaacagacucaacguguuugguaugaacagccagcucuauuaaaucugugggauccauauggaagauuuuuuuuaagugguaaaauuacuuagaaaguguccuagucauuucugaaaucgcacuuguaauuaugugcuugcauuugcagcaauugcagauuaguagucuaaauaggggacuaccucacaugcuggcuugauugccaagcccacauagguguguagguagauacugcauagguggguagguagaucuuuaucuagcugucaucucuaguuuuuuaaugcaaagaaagcugcuccuaaauggcacguccguuguuuaacuuauuuuguuuucauggaagcuuugcuuggauuucuugguugcugaauugaucguuaccuuauguugauacaguguuuuuuaaauuucagagcauuggucugucuauauagguuucgcagaauuaacugcaagggcauguccaaagucuguguugcuaaugcaggaacggaaaaccaaauaccacauguucucauuuguaagugggagcuaaaugaugagaacacauggauacauagaggggaacaacacacacuggggccuauuggaggauggaggaugggagaagggagaggaucagaaaaaauaacuaauggauaguaggcuuaauaccugggugacaaaauaaucuguacaacaaaccccuguggcacgaguuuaccuacauaacaaaccugcacauaaaccccugaaauuaaaauacaaguuaaaaaaaaaagucuguguugcauaggaaugguguuuacuaaaauauuguuuguaagcaaguggcauuugagugggcucuaggaacccuugugcacagagguuuuccgucguaccaacauuuugucuauacugaacugguuuuaaacauguuaaauucagauaaaggagauugaagcauuauaacuuguucagaaaauaaccacugaauuuaaggaaauaauauauuugggaaguucucuuuuucuucccacauguuuauauucuaucuugauggacacaguagagcuguuggugguguuuagagaagcugcguguuugaaacuuuggcacuaagccuaagcacgaagcaaaacaaagacacuuaccugcuccauauggguuccuggucauucauuccugccuccuucaggguucaagaccccauuugccaucaguagccagccaccauccuaggucuucuccacacucacucauauuuuucucacuugccuucuugacuuuuaaaauuuugcucaugaucuuuucuaaucuugaauauuuaaauccuuuuguaacaagacuuucccauuguuauccccuuuguuuauuuuuauugagacaguuuuauuugcuggguuuuacuauucucuauuucucuauuuuauuaccuggaucuucugcaccuuccugacguagcacagguccuccuuugugaaauauuuguuuucuucaagccccuugguucuccccgugggaacacacaugguaucuaagccuugacccucggcugaagccccugcugaaucuugcccacuuucuugucugccucaaagcuagcaguguggucaguauuuaggaagccugaaggagccaagugauuuaucaacuugaaagaucacaaggugauuaaaacagggccaaugauacucuuuucaacuccaucagggaagagugagugacaaguaaugaugggcguuaggugaccagaaucggggacuucauuacagccugauaagaaucuugccacacaugugggagauucugggcuccauguccuuauaccacucuguagaguaggaaagcacuagauagauuuaucagcacaaaacagaggagaauaaaguauauugcugaggaugugagggcucauauugaaauauaaguauugagagugcugacugccagaauguggauuuaugggaaauaaagcccuaaaauacuuuuuccaacaaaaaaauagaccucuuggaaacagcuuuuccucucuauguacuuagcucccauugagcuuaaauugcucuuaguauugugauaaugacaauucaauauuacaggguauggaagaugaaccaaauaaauuaaccagcugcuuuuaagcguaguuuuuuucaauggcuuaccccauaaaaugcuuuguagaacauucgugcucaguaggucugugggcaguuuuaugacuggaaggaaaaaauggauauuauuaaaugucagugaaguacaggcagguaguuuugagguaguuaaauuaguauagaauguuuguaagaaaaggaguucauguuuucuuaaaucaccaaagcaaagcuuuccuuggcauucuugucagaaaauauguuucugcuugaaauucacagagauuaggauaaaaaagccaauggagaguggaucauuuggccauucucccuucuguaugaaacucuaugucaaaucaaagcaaauccugcaugagaguuucagagauauagaaaugacuccauaauuacuagcaggcauuuaagguuuuauacuauguaggauaggaaaaguggacucaugagugaagaauaaaguaggguggagaggaaaggcagaaauaaauguucgacggggccaggcagguaacaucaaggagagaagcaggccacaugcgagagagccuggagaaguaggcgcuguggcaauccagagagccuucugcaggccugcagacacauuucagaaauuaccguucaggccaaacguguggccaguucgugucucugaaauaaaagagcugcaauuacuuaaaccuaauagaggaaggcuaaccuuaaaagcagcuuucaaauuuuuggcaaguugugcacaaauucuaucugcuggccuucagcaaagggaaauagacugacauuacaugccuggauaugggauccauagaagugagcccuuucuaaaagcaaggcuguguugauugugugaauuagucauuggguucuuuaaauuuuugagauuggaguagauuccauuguguucaaaauauuuuaggaguauuacuaacuguaaagauaggcugaguaacugaaacguuuugggaaaucguguagcuccuccuguagcaaacgcauuguguguauggucagagaaggaaagaauuaagacuaguagacucggauagccuacuuaguauuuaauauuuauuaugccuaugggucuagcaaaguauaagauaugauccuuuuccccaaugcacugguuggggaaaugcaagguaaacacaccaaucucagugaacaagauuuaauaguuaguugugcagugagaaaaccagugugaccauaaaacauauacagaaccaauaaauugggggaaaauuauuugacuuacaaaagaauucucuuaaaugaugacuuuccuuaguauguuuaugaugaccuacuuuauuuaguauuuccuuaguauguuuaugaugaccuacuuuauuuacagauauuuucuuauuuuucauccacaaaauauaaagugauagggacuuaggcuauuugaaaaacauaagaaaauaacgugaauccugucaaaacuuguaauauuaauuaguuaaaauuuguuucauuuacagagguuaauuuuuagccccccuccauuuuugagcacacaucaguugcauagaauggcaugugccugucugcauuguagaaaugucauugggagaagcuucuuugcucuuuuaauugcaugucagagcaggguccacaagguuuuugggacucaauccugagauggccuggauucagaauucgucuguccuuccuuugccuccuccccucugcuggaaguuuuuaguuucuuguuuugggagguagaguaggaggcaaaaggaggccagaguucugccaccucugcuuccucccauagcucggagcacaccaaguauaacagaaaggguccauuggagugagcuugcauuuugguaggaacugcaacaagauuuaauuaacaguuuucugaagaaguuaauguuuuauuugaaaaguauauacaguuuauguaaauucauucuaauacauguucaauaugccucaaacauuacuucuuuaaguuccagugaauuuuuauuuauuuauuuauuuauuuugagacagaguuuugcucuuguugcccaggcuggagugcaauggcacaaucuuggcucacugcaaccuccuccuccuagguucaagcgauucuccugccucacccccuggaguagcugggauuacaggugccggccaccaugcuuggcuaauuuuuuuguauuuuuaguagagacgggguuucaccguguuggccaggcuggucucaaacucccgaccucaggugauccacccaccucggccucccaaaaugcugggauuacaggcaugagccgcugcacccaaucuccagugaauuuuugauauuacuuuguuguuucauuuuaacuauuccccuaaguuuuccugauuguaaaaauaagagaauggauuuucauucccauuaauguauuaacauaaaaaauucauauauuuagugcagaauaauuauaaaauaaaaauaauauaaaauuucagcacgcauuuaucgaauuaggauuacuuugucauguaucuuuuagauuuuauaauauaugugaauacacauucacauuuuauuuuaaggacauuguauugaauacuauuuugucaucugcuuuuuuauuuaauaugcccucauagcuuuuucuguuaaugaagauacaugcauaaaauaauaauggauacauacucauugugugugcuccaucguauuaugcuccgucauuccucaguuguuaguccauuucuggcuguuauaaauagcucuacaugcaucuuuacuaacuugucugaucauuucuuagcguaaguuucuagguagcaacuuccuggugucauuuuuuuuaaaagcuuugaguccaugaugccaaaugauccuccagaaagacgguguccaagaccgcaguucaguaguuugaagauaccucuuucucugcacauacuccacuguaccccccaccccacauacccaugccugaucauaucauuuugauucgucuuuaucaguucauucuuuuuccuucaucuaucaauucuagaaacauugcuguauuguuuugaguguugauuuuauaaaauguuuuacuaucugucuggaugaauccauuccucccccuaaauuacuuaauuuuuuaaaaauuccuguuauucucucauuuuuuaaaaugaauuuuuagcauuuuuugaauuucuagaaauaaucccuuuggauuuuuuuggacuugcauuaaaauuauagguuaauuuaaugagacuuaagcucuuuagugagaauuggagucuuacuauccaugaauaaugugccuuucuguuuauugaguucuccuuucguaucccucaaugaaauguuuuuguuuuguuguguagcgacaugucauguucauuauuaacuuuuaaaucuagauuuuccuuuuuuuuacaacuuugauuguaucccauaaaguuuagguuuauaguauuucucauuuucaaaguacucugguuaccauaugaauuccucuuuuacccaaagauugagaauguuuuuuguaccauuuuuguuuuguauuguucuuucucucauucuucguuauuaauuucuuaauuuuguuguuacaugagaauuaugaugauaagaauuagauuuuacuuuuaaguucuuuuguuuuuuuugaaugucuuguuauucauauggagucacaaguuggggauuacucccuggauaauuuguauucuuuuaaaugcaggauuuuuccauaggugccugccuuuugucagagugccugcuuuccuuccuaccugggacagcuacagugcuggcuacaugcuuggggacccaacccuuuguguuucagaguaagacuggccacuccccuucguuccugccccauuacacugaguguaggggguguuguggcauucuaguaccugccugacuucccaggcaggcuuuuucugggggaaugaguuaaaucauggccuucacuggagucuuauuauuagcauauuuuacauaauuuuuagcuuaaaauuuggagcauauuuaacuuuuucaacacaggugcagacuguucuccucuuaguacuacauuggucauuucuaggugggaauuggugagggaaaggaauucgaugcugugucccacccugcuguucucccggccauccugccaacccuucauuccagcaggugauuauugagcacucacugugcuucacccauuucggacgaucaccuccaucagauccaggccacagauagaagauagacauuuugaucuuaucaauucaucauguuuaauuguuguggccaggcgugguugcucacaccuguaaucccagcacuucgggaggccaagaccgguggaucaccugaggucaggaguucgagaccagucuggccaacauggugaaaccccgucucuacuaaaaguacaaaaauuagccagacaugguggugcaugccuguaaucccagcuacuugggaggcugaagcaggagaaucacuagaacccaggagguggagguugcagugagcugagauggugccacugcacuccagccuggguaacagagugagacuccaucucaaaaauaaauaaauaaaaauaauuguuuuuagcugccugucuuuaguggggcauaaucuucucuguagcaggaacuguaugcucagccuuucucccccuuuccuacauuucuggggucuguucucuguuuucugcaaaugggaggaagaggcugaaucacagucuggggacacucccgaaggccucuaacuguggggguaggaaggcaugguaguagugacuucugaauuggaaccugggauaggagaggacaggguggguuagaaggucucugagaauauaucugaugggaagauggggcuaaguauggucagaagaaucccugccuccagucucccuguggaaguugugaagucacacaacuucaaacugucguagcauuuuaaaguaacuguacuuugcuuacuugugaugauggacaucauauuuaauuuuagggauuuuauuuugugcuuccucugccuguauuagucuauugagaaagauauacaggaaauacaaauaaaaugugaauuuacucucuuuccccuguuaaccuguuuccccugccucuuuugggguggguagaggacauaaaauauacuaagguagacugaaauugcuuguagugguaggaauuuuaguaauucuguuauggaaucuguugucagcauuugcuuugaaaggauaaacauguguuucaggauugcaugccuuaaguuacauacuguauaaaugucuuuucuuaaaggauuuaaauggaauaugucaagaaaaauauuuauuguguucuuaauaauguaugacuuccuagaauuacaucuuuauuaaucguagagguuuuugaccaguuauauuuuauauuaaaauuuauccagcagguuuuuugaaugauagaaucuucccguuaaaauaaagacccuagauacuaugaaauuucuaaagaagcuuaauuccaauuguuuuuuuauuuugugacaugaauuacuguucaaaagucauuguucaauuauuugagucaaaugaaaaacauagacuguuucuauuacaguuuaaucugugacuaauaucuuauuuucagugaaaaacuuaaaagagguuuugauuucccaauuuacaaaauaaauuaguucccggacaaucauuugaagaacuuuugcgauacaaaucuuuugauuaacuaaugugcauuauuuuccaugaaucuugguguuuuggugccaccuuguggcuuggccuuguaguaacuucaacacucauccauuuuaaacaacuuccuggggagaauaugaugugcuaggaauucuuuccaagguacaaauaacauacuacuguaagucuacauuaaagacgucgagagugacuuguuuguuauuuggucacgaggauagguaaaacuaguaaguaaagaaccugauacauuauuuucaguuucuaagauucuuuguuuaugcuuuuugucccuagcugcuacuguuugaacggucuuggaugaacagauggaagucugcuguucugcaugaaggggaagggaacauaaggagugugaaguggagaggccaucugauugcuugggccaauaauaugguaaaaaauaugccucugucuuccuaaugcuuguucaguggcagaagaauggccaacuugauagggcuguaaugaagggaaaagaugccacuugcugugguggugauuucuaaaggguguaaggacgauugguaucauaccuaggagguuaaagaaauuagauugcuuuuggcuuucauaauauaguaauucccaacauauucuggaaucuauuuuagaguaagaaaccugaggcauggagaguagccaagaaaaugaaaagcuaucuuaauaauugaaggacugcauugggaaugggucuugaaaauaucauuugccuguuggccaaaggcaaguaagaguugauaugaaacaagugcagaauauugcugauuucucuuuuacucccaguauaaucauagacagaaguauagaccugucuguaagaaaguggaucguaauuuucagugcugcauuuuaacuuaaaguuuacuugcuaugaauuggggcuaguaggaaguuuuaaaaauggucuuuuugacaucuggcauaucuuuugaaacaucaagguauaauuuaguaaaucgguucuauucaguuuuaaaugguagaaaucugccuagacucuaccuuuuuauucuggacuuuucuuacuucuccugggucacgaugaagguaaaacaaagcuguggucucuugguucauuuuuaguuagcugcuugccugauguuuucauuugagaacuuuaaaaugucagauguaguuuucuuuauauagguggcuuuucagacucaaagccuuucuaaaaaacaaacuucauuuuucaugguggaacgauaaaauuagaaauguuacuugucugucaguuuggaaaugcagcuauugauguuuguacauuucauguuucuguuggguuugagucacccaugccaucuaagaaaaucuccuuuguccagaaagaaggguggagguuuccuugugguuuuaguucccacaggguuuguguggagcaggagcauuuuccuugcaugcucaguaaacacugcuaauauuucuccgugcugguuauugguaguauguagcaggggcuguuaauaaguuuucuguuacuuuccuccugaguagaggaugcuuacugcuguauuauuuuccagggugugaagauuuuugacaucaucucaaagcaaagaaucaccaaugugccccgggaugauauaagucuucgcccagacauguaucccugcagccucugcuggaaggacaaugugacacugauuauuggcugggggacuucugucaaggugguuuugcuugucuuuauaauaaguccguguuguuauagauccacugagggugguccaaaggacugugagucuugauuggcuucuaggacccaaaucuuuucacuuggauguuauugugacgugauuaccauuuaaugcucaaauuauuuccugugcauaaguuuuaagauguauucuuucuuuuccauggcauguaaaacuauuugugaacuuuuucguguugagaauggugcugucuuuuucaaucuucuuuuaauuucucacaucccagcuggccuuagcuauuuacagaacaugggguuaguuuuguuguuuagucagguuuucuucucuuuauuauucuuuucauuuucccuuagcuuugacccuucacuucuucauuagaguuauugauaguggagagagaagguuaaaauuaaaucauccugcugcuugguaauaauuugauagaguagagacccagacuuaucaucaauaauaagauuugggcauauuuucugaaguuuaauuaucugacccuuaugcgccuggguaaaugaaauuuagcuguucugugaaagggggcccaaagcucauucacauuuauuuuaugccuacuagugcuucuguuauauuagauacuucagagccaaaaguuguuucccuuuaaaaaauagacagcuuaauucgaacaaaauaaacuaaaaauuaguggaaguauaaaaauggcaugagagaguaucccagcaguagucucauggaagagcucaggcuuugaggccagacagaccugggaucaaguccagcuucuccauuuuccuuugggauccucugugagccuuacuguccucaucugcaaagugguagugcuaauuguucucacaucacaaguuuuggggagaaauaaaugagccaaugcauguaaagaguuuugcauagaaucugauguaauugcuuaauaaauguuagcugucauuauuauauaaaguucuagcaaugucaugaaggggacguggcuauuuaaaauguacucuucucuggaaagggaaaguggaaaauuauuaauguaaugauuguuauuagcaaaacaaacauuguuacacuucaggcccucccagcccucauguuguuaucauucagguucuuuuuucuucauguguuacaugaacacaaccugauuuauauuuaggguaacaggaaggaaacugugccuauaucguaggauggaaaaagggauucccugggcucccugucccacgugugugguuacucauccaauaaauuuauauucuuaguauuuuaaaaaucccuuaaauggaccagguugcuuguuaguuuuaaaguucugauuuucuuuucuuauggugaaagacaaggaaaauuagccuguagaaauauguaacaaguuuacucauuacucccagaaauucuuucucugguaugcugaauaauggccccaaggauagcaagcccuaauuccuagaaccuauaaauguuucuuuauaugacaaaaagguaaauauuacuuuauuuagcaaaagauaugauuaaguuaaggaucuugagauggggaauuaaccuacauuaucugggugggcccuaaaugcaaucacguuuaucuuuaugagagggaggcagagggagaugcuaacauggaagagaggaggagaaggcaguaccacuguggaggcagaaauuggagugagguggucagugaaugguggcagccaccagaaagcuggaggagacagcagauuguccccuagagccuccagaggaaguacagccuugccaacaccuugauuuuagcccagugaacccaauuucagacuuguagccugcggaacuguaacagauguuuaaaacaacaucucuguuguuuuaaaccaccaaguguggcagucuguuauagcagccaugggaaacauauacccuuucuuuaugcccaaguuaagauccagcuucuauacaauuuuuaugucaaauauuucauuuuauuggagguuccuuuucuucaaacucaguucuauauguugagcacuucucaguguagacucuuagugaguucuguugaaggaagaggagauaaggacguggucuuucuucagagggacagcaaucuuguuggggagaagcaaccagaaacaguaaaauaaagugugcaauuggaccuuaccauuuacuucauucauucauuugcccaacaaacguuuaccaggugccugcagugugccaggcaguguucuaguguugcagaacacaaauauacaaaugaaugaguuccuucccuugggaaauuuauguucuagugaggaagguggacaaaaacaaguaaguauagcauguugaagguggcaaauaaaaaggagaacauuuuaacaggauaauaggaaaagggauugggguagguaccauuuaauauagggugguccagggauggccuguccaauaacuaauauguuguuuggucagagaucuggagagaaaaguuauacagcucuaugggggccugggguaggagguguuagcagaaggagcaggagugcaaaaauucuugaagcaggagugugauuggugugcuuuugaggaacagcaaggaagcuguuugugucagagugaguggagcagauguggaggagagggauguaagugggggucggggagggugugguggaggagcaggugauguuggagcccaggggcccuugagaagucuuuggcuuuuaauuugacugagguaggaagccagcacagggcuuugagcuguuguggagucaguuaagugaucuaacuuguauuuuggaaggaucucugguugcuguguggagcuaaacggcaaaggggcagucaagaggggagaccaauuaggcuaccgcagucaucuccauaaaaaauaauguugucucaggucaguguaaugcagcuggugagaaaugaccagauccuggauauauuuugaugguagacucugcaguauuuguugacaguuggaugugggguguaagaucacagucaccuaacauacuggaaggugaaacuaccuuuugcugaaaugggaaagacuguugauaaagcauguuuagagugaaaaaggcaagaguugguuuuaggugugucuacuugagagaugccuguuauccacccauguggagaaguggaggaagcagauuagaguucaugggcaagaacccaccuaucagugguaaagggcucuuacagucauugauuugugcuuaugcaagacaugagcuuaagguagcacuuaccuauucacccaccuuuaccugccacuuccuaccuaugagacaggugcugggugagcccagaccacagagcugaggagugcaguagagccaugcccagcuaccaguagugcaaugcauccuuguucucaagcuguggcaugaccagcgagauaccagucaggccuuggugugaauuccagcucuggccaggcagucuggcaucacucacagagccucaguguccucaucucuggauuaaacauaauaacauugucuuucaggggugucugaguguuggaagacugucagcccucaaguucugucaaugucucucaaaucucugcacuucaucuuccugucaagucuuuuuggugcugguuuuacccccccuaaaccuauccuaaacaguauagcuagaauaaucuaagugcaggucagaugaggucaguccccuccuugcccauaggauaacugaucauaaacaugacuuccaagguucuuugugaucugccucuccguuacucuccagccucaacucuguccccuucuucccccaugcccuucauuucuguccgauugagcuuccaguugaaggcccuaugcugucauaucaccguguucuccuguguugucucuccugcuucaacuuacaugucacuucuuccaggaagucuuccugcccuagcaggagaugccccugcucuguacuucccugucacacuucaguaaagugccuuauuuuugugucucccccacugcaccauaaucuuaagaaaauaaugauaucuauuucacaaaggccuuaacucaggagcacugccaguaacugcccaaaaaaguguucacuaauauugccgauacauuugcuuuuuuauuauacuucaaaccauuugaaagacuguuccucauguacuuauaucagcacauuaaaacaguuguccauuuggcauuguggaaugugccauuagaugauuuaguaguuucccuaguaagugugggaagaagaguggauaacuuauaagcucaaaagucuaccagaagggaagaaaauuggagaaguggacaggcaguuauaugaaacggacaagagacaaauggcaaaaagcaaucaaggaagaagacagccggucacuucuauguggaggcuucuaccucugcagccauggguucaagccccgccugagggaaagugggcacucugcauucacugagucgcugcaguguugcugggcagcaacucaguauacuacguauauuaaaaaacaaaaccuuacaaaaguuuauguacccauugguaucaauucuacuucuaggaauuuauccuaaguaaacaaaaguccuaaaguuuuauauauaaguauguugauugcacuauugcuuacaauagauauaaaaacaaaaaaauaugcccccaaaggggguugauuaaguauaguacauucauguaauaaaaggcaaucaucccucagugccuguggggaauugguuccaggaccccuguggauccugggcuccucugaugcuuauauaaaugauguaacauuugcauauauaaaaugaugcgguauuugcauauaaccuaugcacauccuccuguauacuuuaaaucaucuguagauuacuuauaacaccugauacaaugccuacacaucacugcauuugcauagacuuaaugaaguaguugguguacagcaaggucaaguuuugcuuuuuggaauuuuguagaauuuuuuuuuuuccugaauauuucugauccuuguuugguuaaauccaugaauguagaauucauggaugcaaaacccauggauauggagggcucacuguauuauaacaacuuuacagaauuauguuguagaagaaucuuuaaauaacauauugaauuacuuguauuaaauuguuagguuaauaaaaguagcuuucauaaaaaagauuauuaaugguguucucuuugugcuggaacaaugacuaaugcuuguuuuccccuuugaguuuuucuauauuuuagaauuuuccauaccauaguuacaguuaaugguagcagcuauaaaagaacacuauguaaaagaaaaaggaaaaaucccugaucacugacagaaguuguacuuggauuaguacuugacuucagguucagucucaccaggaaagcugaacuuaugugaaucaggcuuuauugaggaauaaaguuggugaauauaaauagugauugcuauaugucauuuacauuaauuucugucauuuaagucauaggguagauuguacuccaucugcagugcuacaagguuaauuuaacaaagauaccauauacugaauaaaauguuaugaagaauuuuccaucaaaugaauaaaauaaccugcgaacuuauuuuccaggugugcucagugaaggaacggcaugccagugaaaugagggauuugccaagucgauauguugaaauagguauggcuccaacacuugccuucuguggauguaaaacuucauucaaaauuuucgucuucauuaaucucacccagacugccauagucuuuugccuggaucccugcagcagccuccuaacugguuuaucuucuuccacugugaauuacugucaucugcuguccccacugcugucaaaauacagaucagaucuugucaucauccuucaguuccuccacaucguucucagagugcagauggaacuccucaguggaucacggggaucuguguuggccccuacccaccucuccagcuguagcuuaugccaagcuucuccuuggucucugugcugcagccacacugaccuuuuaccuguccaugccucucuuuccccuugucuagcacaguauuuggcuagaguguugcuuuccagggaaagcacugggaaagccacuggaccucccugacugagucaggucuucccauuuuaggcacuacagcacugcaggccuccuccccuuucuagcacuugucacggguuccagugauccugugauuauuugauacauuucugucuuuucuaccugacugucaccuccuuuugagcacacacagggucuguuuuugcucaccauuuguaucuugaggaccuggcacaauacuugcacauagaaggugcuuaauauugaguugaaugaaucagugacucugggaaacagcuguucaggagaaguaugcccuggaugauguaccaugacuuuuauaauuuaguuugaaaaaauuaaucugagaaaaaaaauugccauauuaugagucagcugaaaaguucauuugcccauuugcuugguggauggguaauaucaauuugauggguuauucugccaaggugaaguugaaauaaauuauuugcacaugauuguauuucuguaaauagaaagacauacauuacccacaugacuaaugugguuauaacauuuaaaucugggcuauuuuguacuugaagucagaaguuggugguagaguuuuaaucuuuuuuuuuaacuuuaggaguauaacuacauaguucagauugcuuaguguauggacaguagguauaugaagaauguagcagugcugagaaaaacugaggaccaagauaagagacaagauuuaugacuagacuauauagauaauuguuucaauaucuuuuucuucuuuccuugccuacuagaaaauaaaaagaaaaacaaaagccucucaacaucucaaugcaauguccugagagauuaguauuuggauauuuuuaauugccagagagguauaaaaauguagcaauugucaucuucuuuccuuagcugauacuuauugaucauguacuagguggagggcauugugcugcuuacauaaacugcaguaacucacuuuauccucacaggaacucuuuaagugcagguaguuugcuuuuuauucuauagaugaagaaauugaggcuuaggagguaaaugacuuguccaggaucuuacuacuauagcguuaaaaauggauagaaucuaacucuacagaaccaccagaaagcuuccagggaggcaaggaaguuugcugaagugugugaucuugaugagguuacuuaaccuucuugaccauccuuuucucaccuguuaaauggaggugauaauaucuaucuuuuaggaugggugugggaauuagacauggcauaagaaaugugccuaacaugguacuuggcacacaguagaugcucacuaaaccaugaugguuauuaucacuaugcagacuuucaucccaacucugugacugcugauagcuggcucagugguggcccuauuagccuagaacccugggaucacauuauugcagugugguucaucuguacuguaauuuacgugaaauagaccauauguggauacuaacaguaucacauuacugacauuuuacuacuaugguuaaugguuaaguaccauuuuuuccccucuuaagaguaaaccuuuaagaauauaagccauuuccacagcaggaggcaaaauaguuuggauaagaguccuuaaguaggauaacagaaagggaaauauuaggaggucuggauuacaauuuccuuuagcccugaauagugugagccacuguucuuugguaaaugaggugaaaauggcauuaagauuaaagaaauacguauggcuguacauuucuuagaagccaauuguuuauaacucuuucuguuacaacucagacucucaaaaauagcacgaaaguuauuccuaucacauaggcuguugauuuauucuguuaaaugaaaaauaauaauaauauaaugaagauuaagcuucuuggccaaucaccaacacaugaagagauucucuauacauagggcuuuugggacaucauauuuucuuucaaauugcauuguuaaaaauagauuaugguuugugccuagcauccauguuuuaacuucacuugcaucucuuguauucucacaggacucccugagccucugguacuuuucaccaaagucuuccaugaucucugugguaugguaguuggagagcugacaucaugauguugggaaaugaaaccaauguuugugugucauuuucugggaguuuucugccagggguaguugacuuacaugcaaggaauuaaugauugacuucuuggucuuaauuucauguggaauuuuguuuaauugagauuaaacaacuauaugagaaucuauauagaaugacaagucaggaagaaagggaagagaaaagaagggaaaucuuuuuuacuuucaguauugucuguaucuucauugaucauauacuguggucuuagaauuuagcacaucauucuuuuuucagucuuuuaauugacugaaaaaacagugaccugaaaauuggugaucuguuuucauaguggaggagaguugugagauaauucuuuccuagaucuaaguaucucucuuuauccaccuguuaccauuuugauucagcuauauggguuacaguagugggaucuuugugugugugugcccaggagugaugugguuucaucucuuagucugagucucaauagaaaugaugacagcuggcauucuucaagguguuuuuacuugaggaucuagguauguaugguuuucuguucuguuauagauaguucaguauaaauuucuguaauaaucuguucugcauugaauuuuuuuucuaacauuuuguuaugaaauuuucauuaaagaaaagaacuuuguagugaauagaaccuccaggauucugcaguuaagauuuuacuauauuugcuuuauuacguaucuguucaucuauucauuccuccuuuugggagggauguaacaacucuuuccccgcucaguaguguagacucagguuuuuguuguuaggaguggaauuaaugaaguuucuccauaauaaguaaugguaagaaaucugaagcaccugaaguaacaaauauauauuguuccuuauauaacaaccaccaccaagcacagugcugaauacauugcaaacagaaggucaucuaaucuucccaguaugcgaguggguagcggcuacuauccccaugguguaagugaagaagcugauguucagaaggguuagguaaccugcucaagauuauucauaaacaaggcaguuuuugcacuuaggugugccuagccguaaaguuguugcuuguaaucauggugucacacagugcuucccauguuuccucuacccagccccuggccuuuguuuacagagucuuguuccagacauucagauacagaccacugcagaaaugcucuagaaucugaagacccuuuuucuauaucagugaugauagcugcucaccuuuucuaggaacugccagaugaaauggaaaugcaguagauuuguuuuuuuauuuugguucagagaaauaucucauuuggagacuuagaaauuauauuuucacuugcuuuauccugagauugagagcuuuucuucauugcuucuccuccacauuuuuagauaauuuauagaaccugauugccuugggugaccuuuggaauuguuucuaaggaaagggaaccaaacuuagauuaugcuucuuucagcccuuuuaaaaagaagaaaagcccuuguuugcuauuuuuuaguguuuagcuuaaguuuaguugaugcaacaagguaguuuuauauuuauaaaauaaaguguaacauuugguuugaaccuugugauuagcaggucauuggcaaugccuuuccuuuucuuuugucuaagcaaugugcuguaacauacucacuaaauauuccucaucagugcuguuucaggagacuaaaauuugguagaugagauaauccuaucagcuuaguguugucauuuaauugacaauaguuugcugaauauugauuauaaaauacggaauuaaauugcaaacuaaauuuguuuucagcaguuuuuuaucuguguguacuguucggcuccugucugauuugaauguuuuuguuauuuuguccauuagccauucuuuucaauuucacuucauguagcagaucuucuccauaauuugcugauguaaagcauugugaagucaguuuuacuuuaaugugucugcuucuuagcacagccugaagcuguugaagugccguuauuuccaaauguauuuucagugauaaguggucaugcugacagaaugucuaaacuuauugaaaagucuguggguauuacauccaguugauuauaaaauacuaauaucuggugacuaaggggccagaaucucuugggaauaagacacuaucuaucauaaagggcccucaaugcauuuucauaaaugaauauaagacaaugaaggguaauuguucuuauuuguaaauugcuugacacacauuuuuguuuguuucuuuaagaaucauagaagcuaagaucuaugggaugucaccuuauuuaacuucaauaaagaaaucuggguagcauuuagcuaauggacauuuggggaccaauaagggaauaagaaaugggggaaaagaggcagugcaaguucuguguacugcagcgcuuuagcccuugcagcagcacugcaaauucaagagaggggcuggggcacccugacugcaugcagcagaaucaccagagagcccucacuucuguucuugccaacugcagugugcuuugaaucuaagcaucucuguauucuuauauucuuccccuuccccuccuccuucccccuaacucccccccuccuucuuucgauauagggucuugcucuuugcccaggcuuuagugcaguggcauaaucacgccuuacugcaaccucagccuccugggccaaagcgauccucccaccucagccuucuaaguagcugggacuacaggcgugcaccaccaugccuggcuaauuuuuuaauuuuuuguaaagauguggucuccuuuuguugcccaugcugguaucaaacugggcucaagaaauccucccaccuuggccucccaacaugcugggauuacaggcgugagccaccauacccggcccugacuuacauuuucuagagugacuuaugguugggaaaaauaggacuucagauuccuacuucucuuaucuuccacuuaagugacuuuagucaaguuacuuaaccccucugagccuccuucccucucuaaaauaaccauagggugguuguggugaaaagcaauauuguauguaaauauuuagcauacugccucacagcauaguaauguucauuaaaugggagcuauuauuaauauuaguauuauauuuaguuacagugagagagaaaaauagugguuucuuuuaaaaucagaagaucugaaaauuguguuuuauaaaauuuguaauuuaaagacaauuuggggaagauguaaauaaggguuuacugaaugauuccgaggagauugauaauguuuuauaauugcauuucucaauaaaauguaucuauaaacauauaugacagagguacaaguaauaaaaauauugauuuaauguugucucauagguuugaauacacagauaagaagugagauaaccuaguugggaauuauuggaggaugguuuuuuacuuuaaacaaauuuugauuuuuauccuuuguaaucuaauauccauuaggguuuuaaacaguuuuuuuuuuaaaugaaacgaagagguuguuuucucucauguuauccacaccauuucuggcuuaaggggcuuauggucaugauuauugcugcuguuuccacccucaucuguaccuccucagaagcuaaauuuucuugcgcugugcuauuuuuuguuuuacaccuguuccuguuuuugcacauagcaugugguauuuuaauuaucucuuuuuuuuuuugagacagaguuucgcucuguugccuaggcuggaguacaguggcacaaucucggcucacuguaaucgcugccucccagguucaagcaauucucugccucagccucccaaguagcugggauuacaggcgccugccaccacgcuuggcuaauuuuuguauuuuuaguagagaugggguuucaccuucuuggccaggcuggucuugagcuccugaccuugugauccaccugccuuggccucccaaagugcugggauuacaagcgugagccaccacaccuggccuaauuauuucuuuaaauauucagacucacaaucuccuuuaaguuagggucaggucuuagucaucuugaugcaucuagaagacugucucguguaauugauacucaguuacucuuuuuucuuuuuuuuugaggcagagucucgcucuaucacccaggcuggugugcaguggcaggaucucagcuuacuacagccucugccuccugggugcucgcggguucaagcgauucuccugccucagccucccaaguagcuggggcuacaggcacguugucaccacugccagcuaauuuuuauauguuuaauagaggcgggguuuuaccaugguggccaggcuggucucgaacuccugaccucaagugauccguccaccucggccucccaaauugcugugauuaaaggcgugagccaccgcacccagccucagucacucuucauugacuuaaguuguaacccucagagauuaugagacccaaggaaugagaaaguucuuucuuguuaauuuuuauaccaaucauauggcauucauuaugcaacugaugguguguaugcuaucgagggccagacacuguugaucuauuugugacucuaacccugaccccauugcccugggcaauguaagguugauguauuaaaacauguauaacagcaauaugugaaaauuuugugguuagaagauucugggaauguaguggcaguggcagcauaauuuuucaaacuaccuaguccucccauaaaagcagaacaacuaggucacaaaaccaaaaacccacagacaacauuuacaacaaaacuuagugacaaagguaguccugagagccccaagacacaaauuaaugggaaaauaaaacacugaucgcugcagggugauaucagcaucugugugagagaaagcagaggggagcaaguggucaucuagcagacuugaggccaggggaacuccaagauagccaguuggcauucacuggaaaggccaagaggcugcucugagaacugggcccaggaccugcaguuaggugugagaggcugggcagcccagcuaccccuggcaacucacacuguggagcagccaggccuccucucuccacugaggagacacugcugggagcagaauaaagccugaaugagacagggacaauagaaacaaaagaaacagguccagauaacaccagggaggagcugagccaggaaaucucagaaagcaaucugccauauuuuucauaucaaauggaaacagcagaagagggagcucuaagaguucaauaauggucauuucaccuaaaaagcaagcaacguuaaauccauaauaaguuuuaagaaaaagugaguaagaagcagacauaccagaaagacacaccuacgcaauagauuacaacuguaauuuccaguuucagaggagcuauaagacaucuuuaaaaagugauguaagaaaucagaauuugaaaaucucaaauuaggugacaggcuucaggaagaauuaauaaauaaaagcucauuucagaauugaagacugaaccugaaggaagacaagaacaaauagaugcaaagauaauguugguaagaggaauagaaggggagcaggaggaaaauuguaaaaaucacaaagcaauaagaacaaaaagauuaagguuaagugauaaauacugaagacaggcaaagauaauucagucuaccaauaaagagucccugaggaaaaaauaaaacuagagaaugggacaaauacuauagacaaugucaagaaaaauuucaugaaaaugcagagaaacagaaguugaaauuauaaauuaaaauagcacacuguguauccgaaaauagugacccauaaugagcaacaccaagauauguucuaaugaaauuauuggacuuuaaagcgaaaaacuugggcaucuagaccugcacugucaaaugugauaaccauuagccacuguagcuguuaagucuuugugguauggcuaguguggauugauuugugcuacauacagaauuccaaagacagucuagaaauaaaagguaaaauaucucauuaaucacuuuuuauauuauuacauguugaaauaauauuuuagguauguuauguauuauuaaaauuucaccucuuuuuuugaacucuuuaucgugguguaguccauucuugcauuccuauaaagaaauuccugagacuggauaauuuauaaagaaaagagguuuaauucucacaguccugcaggcuauacaguaagcaugaugcuggcaucugguuggcuucuggggaggccucaggaaacuuaaaucaugguggaagacgaagugggagaaggcaccucacauggccagggcaggagcaagaggcagggguagaugccacacacuucuaaaccaccagaucuugugagaacucacugucgugaggacaguaccaagaggauugugcuaaaacagucaugagaaaugaccauucaugagaaauccguucccaugaucuaaucauuucccaccaggccccucguccaacacuggggauuacaguucaacaugagauuugggcagggccacacauccaagcuauagcacguggcuacugggaaauuuuaaauuacauaugucauuuguguuuuggcccacauuauauuuccauggggcagcuaaucaaggggccucuagccucccuuuuggaugaggaccguguacagaaucguauucaucucauccucauucuggaucuagaagaccuugcugaauagaauuuuccugugaauauaguccuuuugaaccucucuuucuuacucugcuagaaucucugucuuuuuucuugaguuauuucuagcaugucuaggaaugcuuuuauccuccugaauaaagcagaaugcagaaguccuuccaccuccaucaggaggaggaaggcugugccucagcuguaaugcccaccauaguauaaggccaucaucuaggugaacauagcgcacucccugcagggcccgcgagcugagccucagcuggcuuucuagaugaccuugaucugaaguaaagccacugucuuuuguggcuaccuuuaggaacucugccugcauuuuucacuccaaaaaaaaaaaaacaaaaaccaaaaaaaaaaacacccuguccagcuuuugcucccuguuuucauguauuuccucucuagcagaauuuauguuuauuuucuuugugauuuaucuuuuccagauaaucagguugaaaaugagcuucuguaguauuagaacugacagccaccuguauucaaacugagucuccuuuaggagaacaaaauauuuuauuuaaauuaauagagucauuuuuacguggaauagaauagaauuuuagugaaaguaaauaaacugaaacuuccauucguccacugaaaauuugaaauauaaagucuguaauuacuugaauauauuuuacaaagucaguccauaagcuuuuauauauuuuaugugcauuuuuuacaagaauauauauugucauucaacauuucuuucucuaaaucuauaugaagaauauuccuuauaccuucauguucauuuugacaccacugucugcagccagcccuucugggacucagcaucgcuauaaaagauaaacagaaucuuguuaaaucuaaaagcaauuauguuucgcugcauuaguaaagacuaauggaaaaacaagacaccaccauuuauucuaaaaugucuuacuuuguggcagaauggcugcagacauuucccuaaaucagcaacucacauuagaagugaguucuuuuuugcaugauaucauuaccaguggguauuaauggagaugaauugcugagugggagaguacucgaaaccagauaaauggccauuauuuuggaauucuuaauuugagaaucaugcugaguauuacuauaauugcaauuuuguuuucuauaagagauuuuuguugguauaagggaauuacuuuaacaaaaagaaagacauaauuuaguuucaguuuuauccaaauguugauuacuugcuuaccugugcgucuggaagucuugacaauauuauuuucauguaccacaucuuuucuuuaugaauaacauuuuugucagcuugugauuuagccacugcauauaguccguguccaaauuauuaauucucaauuagcaaaauuuggcaagguuuaguacuuaacaaguaagcguuuauuacaacaucuggaauugagaagugaaauagauaugugcaccugcaauuuuucuuuguuuuguuuuagaacacauuggaguuucuaucauguucuuaauuagagaacaggaaauuuucugucuuacucauacaagcuauuguggacuggggaguuggcauguagaggaggaaagauuuggguaggauuauuucguaguuucucuguucuguaucuuggagcucauucucaagaaccaaggccuuugauguauauuugguuaccuuuaggagaaacacugacagugucugucagugagacuaggcagccuauuuggcaucccaaguggggagaauaccuccuucucccaccccuucuuuugugauuaggagacguuuucccuuaggugucuguggcagacaagcacagcaaagccugugauuucugugagaaucucugauucucugcucuucacccaaguugcugguaagggaacuguauguguagcauuucaaaaauggaaugugauuuaguaaaacagaaugcaaguccauuucuaccagucagagauuaguaaccucaggagugaugacaaccaaaaccucuuguuaauaugucuucuaaaaugugaaacugccaucucuuucaucacuggguccuuuguggccccauacuguuuaauaucaucuguacauuccggcucuccccugcucccugcuucaccgcccacgugcaugcacagcacugugagcuucucuagaaccuuccgcagccugguuacgcuagaaacacugucucugcacaugugguggagguugaggugguucuccauauaagcucuuuugugaacauuuaucacaauuaccacuuuaccaaaacuauucuuaaguaucuggauaaacacauuugguucaagcccacagagauuaaggaaaaaauguguuccuggcagaacugggaccagagcacuugcccuuggacuuccauuguaugguacuuuaauugaggacaaagcagaugaaauauuaucuuuuuauaaguuuauguugcuaacuauuacaucuuuuuggucauccacaauuuuauuuuggugcgaaaauuaaauugugauaacagcugcguaaggaggaucauuaaaggucagcagagacaaggaacacuaaguaaucugcaagggaaagaaagagggggacaaaggaaaauucaguauuucaucuguauuaugaauuuuauuucuacugucauuccuuucucuuauaguugggaaauguuaaaaugacuuguucaaguucaauuuaguggaaguuauaacccaaauuuccuuacucagcauucaguauugguuccaguaugauacauugagguccccucauugggaaaagaguguggaaguuaacuaaaucugcagcuaauaccacagaaccguggagaugaucugaaugaagaaacuuagaaaauguggugggucagaacaagaguuuacucccaaaugaaucugugaaguguagaguaugauuucuggaaggaucucuguaauaccacuacuguaucaguuagcuucugcucugaaacaagccacucccaaucucagucucuuaaaacaaugaucuuuuauauuuuauagcagcuaauaauuagaaucauauaauaauaauauguguacuucugagcuuucugucagaucuuugggguccagugcaauuaaagucacauacuucuuaagugaugcaauaugucuucuugauuuuaaauggauuuuuuuuuaaaggaaagagaaauuuauuauuuuucucuagccuuuauuucacuuaagaaauacugauguuucaucauaaaguaaucuguauuuaugcaucuuuuuuuaacuucaaguucuuuaaauaauaucccucuucuccaaaauaguguuucauaauuacagauaacauucuuugugaccuuuguacuacuauaaugccccaauugagaaaaacgaacucaggaauuuuaaaaaauuauuacuguuacuaauaaugguuuauauuucuuuuuauggguuucaaagcaucuucauguagucuaugucauuuuaaacuaccuaagcacagugucacccuugaccauucaugcugcuauuauuguuggauucauuuuuguuugugaugggaauuugcaagucuacuuucccacauauucguuuccaggauugaucguugugaagcacuugcagugcugaguuaugaaaguauguucaacgguguccccuuuacguuagcuuuuaaaaagggguccacuagcauucacagucauuguguuccuccagaugugugcugcuguuugccccuguugaugaugacuccuguaucccuuuuguuugcagugucucaguuugaaacugaauucuacaucaguggacuugcaccucucugugaucagcuuguuguacuuucguauguaaaggagauuucagaaaaaacgguaauuauuuucuccccagauacaaaggcauguggggguucacuuuuagcauuacacccagaucagguuguucaucaguagcauacgcuauaaucugagcagaacuuucugaccuauaaaauaagguuggcagagauuacccuuuagaccugacauauuuacuuuccggaaacucuacucauugccugccuuuguuccuauugcugagccaaaaaagagucuuuuuuuucgaccucucuugguauauuagucaaaaggaaugaaggauuccucuugcugaaaggggaagaaacuaagcugacacugugcauuagcagaaaugacagcaaugaacuugaucagcagcaacaacaggggucccuguggucagagggaauuacagaaagggcauuucauuauuuucuuugguccagacauauuuguuuacuuccuagugggcuggugauucuaaguagcuugauuauggcuuugaaauggauuguugugaaaucucaguuaucagugcaaauaaugguacaucaaaaucuguggcuaauaaaaagcagcagaugaucuaaauuuuguugugcgugucuuuggaagaagcuuauauauugcccaguggauggguauccacacccagucucccuuugaagcugaggacggccccauucccagcuugucuuuauuaugagaguccagggguccugccagcacaagaauagggguggcuucaaggcauaaagaaggaaagcauacuguaaaggauuuucuuuuggaugcuguauauagaagaaauuguaauugauucucuaguccuuuacaguaaguaggcaaguggacuauccuuguuuguauccuuuuuuuuuuuuuaaauggcaagaaauaaaaugggggagaaaaacccugggagcccugguuuugaagugguagcugcucuugagcguuucucugagcaagcacuugcauuaggaagccaucacuauaguaaccugaagcucugggugcccauguugcuaggcaaugaaaugcuauagacuuaagugaacacucagaccuacuaaaaucaauaggguuggcuucuagcccuauugcaggacaucaguuugcuauuauuuuauuuauuuuuugaaaauaaaagcaguggcuccugggggaguaaauagaaugcuuuuugaggaggaaugcaggaaagauugagaaugugauuggaagaaauaaagaagcaguaaaacgaaaaaggagaagccuaauaaacaacugagcaaagaaagaaaggaaaccuuuguuaauaaaagaguauuugaagggaauaaaugccaaagauaggccaaccucauagagcacguagaaaauggacuuuuuccagaagaagaagcgaggguuuuggagaugacuggaacauguuuaugccaguguauguagauacucauuuuauagaacauuaaaguacaccuuaaauccuuaaacacagaauaaacucauaaaauuaaggcaaaaggaacaaagagguaagcucccuucccccuuuauuuuuucauacugaaaaggugguuuagcgacauugaauacaauuuguuuuauaucauucaguauuaucccccaaauagcccccagauauccacgugauaccuuucacguacaugcauguuuucacauaguugcagggauagucacaugcuacucugcauugcccuguuuucaugggcauuauuccauuuucccugcguaugucuguguacuugccaccaucauuguguuuagugguuguguacuauuccaucugcuugguacacuuuaauuuauuaagguguucuccuaguauuuuacuuuucuuucauucauugauaaagcacauguguguuagaaauugugcugggcacuggagauccaagaucaacaaaaccagauuucugcucuuagggaguucacaggcaagggcuguuuggccagggaacgaaaguauaaaaugagauucacauugcugaugcuuuucuuauacauauaaaagagccuuuucuauggucuagugaagugauuuucuuuuuauuuuguucaaaauauuuuuuuauuuugcuauucugauuuugauauuuuuauuguuacaguggucaauuuuuaaauauauuucaguuuucuccauuuuuuuucaguuguuucaaaguuuagcaauuuguaauuucuccacagaucugauagauuuuucuucacuaguugaucuuuuauaguugcuauuuuauuuuuggaauguuuucugauuguaaguuuccugaggccuuucccaccaugcagaacugugagucaguuaaaccucuuuccuuuauaaauuacccagucuuggguauuucuucauaggagugugagaagaaacuaauauguauggcuaacuagaauuaauuuguaugauauauagaaauguaauuuaaauuaauguuucucucuuuucccccacuaggaaagagaauacugugccaggccuagacuggacaucauccagccacuuucugagacuugugaagagaucucuucugaugcuuugacagucagaggcuuucaggagaaugaauguagagauuaucauuuagguaggagauaugaaagaucuggcugauaugcuuuuuuaauguuuuuuucucccccuuccuacuugcaauaaauggaauuuaaauuaaggugcugaaagaaucuuaagagaauaccugcguagacugugugugcugaaaacaaggacauuuggaugcagagauguugcaaaacuugcauaagcuccuauaguaaaagggaaggcuagaguucagaccaggacccgggggaggauugggccccuuguuuuuuguucuuguauuuuuucuauuguccuaacuauuuaaugugacacauaauuuaaugucaagcugcauggcuccaugguugucauaucacucccauuuuaugugucaggaaaguucgcucugggguggcagagaaguugucuuucuuguuuguaacugagugcucagagccugaaagacuucuggcacauuuuagguguucagugaauauuuguugaguggacggagaaauacacuuagucacugcucauaaauacagggagaaccauuaauauuuagucauaccagagacaucuguguuuggcuguuaucauacccuuguaaaauauauuaaugaaaauagaacaguucagcuuuguaggaaugcuguacuacuuuaaacacaauugacauuuguugagaauauuuucaguucucauuguggccaaaggaaaugaagaaauauucuauauauguuuaaacuuucuuauaugaagacccuaauccauugaaaaacauaagaguauauucuagacuuggcaaaaagcaacugugauucacaacugaaaaguguccaaucuagguauuuggcucagagcaaacucuccugcacacuuagaaacccuucagaacagguuuuauaauugaauucugcaggaaacccucagauuggcauugugcacaacaugcugaaaugauagauuaugucccuagggcuugggcaucugucauuuaugccuuagguggccuugaccuugaugaggaggaaacauuuaucgcugaccaugggguguaauuguucuguaaaaguagaacaaugcuguaaauggccacaaauaaaauuuauauacaguagaugaauucuaauaugcaguagacauagagaauuuuuaacacuuuuucagcugaagucagaguguugauguauuaaacguagaauuuuaaacucaccuuauuuuuuuuucaaguuuuuuaguaugucauucccucccuuucuguccuucuccuucccucucuugcuuuuuggucaaguauuuuuacacuuaaauauuuuuaaaagcacugaaauacgcuucugucauucuuuacccugucucccacacuuaccuuccagcagagccaaacacacaacaaagauagacacauuuucuguucgcucuuggguuggguaaccuaaccagguccucugaaaccauugccaaguuuucugcuguucagucaccaagucguuccucucuuuucucaccuacagaauacucugaaggggaaucacuuuuuuacaucgugaguccgagagauguuguaguggccaaggaacgagaccaagaugaucacauugacuggcuccuugaaaagaagaaauaugaaguacccuugauuuuacuucuuugaaaguauugacucaucuacagcauagagagagaagauaaaauguuuuuguaauaaaucuuuuauguagucaaaguagaguuucccaagccaaaaauauguaggaaguuaauaacuuucuaguacccccuucagaaauuagggaaccaaaagauugcaauggauugacuggcuuuccuguuaagugggggaggaguugggaguggagggaggaggugaguuagaucuagacuguuggaaguuucauuuuuugauuuuguucaaagaaauuagagauaguauuucagaagugucuauuuagauuuaaugaaaucguuuauuuuauacuuaucacauuuuuacucacuuaggaugguuugaacuaucaguuuggauagaaugauguuguccacuucauugagguuuggcuuagauuaauuugaauagauaaugcccaauaucgcuuaaaaaaaaagaaaaaaaccauuuuucaacuuuaauagcuacaaaguuacguucuuagaugggcuuauauacuaauuuaaaacaacauccacaacaaauagucuacguauuuguuguacuaaguuugucaccaucugaaaggauuuggaaaaaaauuuuuuuuuucauuuauaaacuauuuaaaguccagguaucgauaccuaguucauaacccaguaauuaccauguuacuuuaaauccaguaguuucucaaagaaauaauuguauguuuuaaauauuuauguuaaaguaguauuuguaaacuuuccaaaauaaaaacaaaaucagagauuuuucaaagacuuaauuuuagauauacauaaacaugcguauaguucacuuuuuuauugaaacauaagggaaaaugcuccuuuaucaauaugucauaaagaucuagaagacagcugccuuuuuuuguauggagacuaggagacuuuguuguauuuugauuugugucugaaaugugauuccauuguccuaaugaggaaaugaauucaaauggaagugggagaagucuucauuuugguugacugccuuugaguuugaauucagugagguucauucaaccauagcauuaacaauuccaaugcuucaagcaaaagccaugggaaaauggagcuuuauucguguagugcagaaugcuaaaccauaauaacuauaguguuuauaaccucaauaucuuucucucccaccuucucccauuuucccucccuccuuuucugcuuuuuuuuuuuuuuaaaucauccuuauguuuggaauaaaggaagcauugauggcagcugaaauuagccaaaaaaauauuaaaagacauaagauucugguaagugugcaauuuguuauuugaaacauaauuuuaucuuucaauaaguuauagugagacugaaaauaauuugaaaagaacagguuuuuccuaucuuuugagaauuuauuuuaaacuaauucccuaaccuaugagaucaaaauauuuuaucaaaucaguuucugcuuguaaacaagagacuugaacaccugcuaggaggcaguuuuagguaauuuggaaacuguaucuguggaaaacacuuuaaauacagagcuuucuaguuauguguaugaaaguuucccuaaaucguagguaaaaaucacauuaucacaaaauuuaucaaaaaaagagagguuuccuaaaacugcauugcuuugguguuuccauaauaacagacucaauugauuuuguuauggaaacuaaucuagagcaucaaauacauuuuuauuacauuuuggacucaggaaaaauagaaugacugaaagccccuuuccuuguuaacugugacagugaaugugcagauggagagcagaggaacucacauccugcacaugugaaggguccuuggagaccaucuagccgaguucccuuuuuuacaggugaaaacuggaagcucagucuuuuaugccuauuuggguuucaguacaaauucuuucugccuacauuuucccuaccguaaacuucucuguaaaacuccacaugaaagccugaauugucaaagagugcagaagcaaaauaauuuaggaauaacaggagaauagaaaaccagagcaucuuaaaaaaaaaaaaaauccagccaaaauuguggagaauaagcaaggauucucuagaaauggaagagaaugcauuccggcccuuagaguaguuaacauaugugaagaggcagagaggugccacagcuuggccugcuugguuaugugggcaguugaaggcuuuuuuuuuuuuuuuugagacggaguuucgcucucguugcccaggcuggagugcaauggcacaaucuugguucaccgcaaccucugccuccuggguucaagcgauucuccugccucagccucccgaguagcugggacuacaggcaugcgccaccacaccuggcuaauuuuguauuuuuaguagagacgggacuucuccauguuggucaggcuggucuugaacucccgaccucaggugaucggcuugccucggccucccaaagugcugcuauuauagacaugagccacugcacacagcaguugagggguuuacuacauagguagcaaaggucagauccugaagugccguucguaauuaagagcuugcuucucucuuggaacaucuagaagucaauuuaagcuuucagacaucagauuucccuguuagaaagauucucugauggagauggggccagaggagggccagcugagauggagaucaaucaggaggcuuccuaauccagguggaaggucaugagacuuacacagaaucaauaggauuggagaggugaagauagauggaagauacaguaaacuuuuaaucuuugggaugugguaacugacucuguguggaugaaagaauaagaguaaaaaucuaggcugacucccaggcuuugggcuugggccucugguuuggugcugccauuuacugauugauagagauacccuguggaaggagaagcaggauugggagaaaugaugaauccuauuuuaaacacauuaguuuuaggaaucugugggacaucguaguggagcccaggaaagaaauuugggcugaaaaguugagucucaguuucugcacaggacacauuaggguccuauuagcacuacugacuguaaccuguuuauacucuuagcuugcuuuauguaauuaugcuugcuucuuaagcauauucauauuuaaauguauuuauauuuucauacauuuuagagugagugucaugaacagaggaccaugaauggaaccaucaggaaugcugucauucaagggaugaugcauacauaguagauuuggaacagccagagcaaggucauuucaugggagcugagagaggagagaauuccaggguaaagagaauuaaaugcuugaguaguggagguaagcaggucagaaggguaagacgaggucagcuggucaguuguacacuggauuuggugauaugaaaguagugaauuuucuguauguguauuauuuauucugaacauguuguagggagugaaaagugaauaggagauuauaaaguacgguucugaguauagauuaucagguuagcugugaaggggaagagagugaaggcuguagcugaggcuguagcuggggcuauggcauccugggaugaugguaguuuuuggguauuuuguguaagagaggcacuuaaacaugcuuaugcugagggaaaagagguaaaauagaguugacauaaaagguugauauaaaaggaagaggaggagugcaggauaagcuccacaguggagaagcauggacgugaggagaaagguuggaaggauugacucugaaaaggagacauucuuucucugaaccuugauggaaagaaccuguguagaauuguuacgugugaucuguuuccagaaaaauaaggaaguuagacacucuuucuucacuucuguuccuauagacuugaaauaugauuucucacauaguaguuauuaaaguaaaaauuuaauauacuaaaaaugauggguauuuugcuucacucuugaaaugggcauguccuguacauuaguccuauacauuaguuaugaauagauuauuuuucucuuagcaugauguaauuucauaccaaacaugcagagaagaaaugggcuccugccauuuuuuuuuuugccauccaagaagguauuucuuaugcaccuuuuuguacauaaaguagaaaucaacacccaacguuucuuauauauaucaagcuuaagcuucuggugaaaauacuuuuaggugcaaauaguauaugagaagaugagucauggggagaucaagcaagagcuguccucccaugccucuggugauguuggccaccccaaauccuuucagaacccagguagaauaagcgaauaaacaugaauacucugaagccagucacuucccugcuuucagcccaauuucuucuguaaacugauggguuugaaucacagguuuuucugagcucauaucaacuuuaauauucccuauuuccuuuaguaugauagucauuauuucauuuuucuuauaacuucucuucagacuugggguagaagaaguagguagcuugcauucuacagaugaaggcacaggaaacaauuuuauauacauuaacaguguggaauuguucgaucauguuucuaauaucgaauaccuccuuuaugaaaaaaugucuuaaagggggcagauuaggagccuuuaaaauacuaacauuauuuacuuuuuuuaaugaccugaccugugaauucuaaaauguaugaaaauauaaauacauuuaaauaugaauaugcuuaagaagcaaguguaauuacauaaagcaagcuaagaguauaaacagguuauagucaguagagcuaauaggacccuaauguuaugcccugugcagaaaccgagacucaacuuuucaguuguuucaguuaaauuuugacauuucuucauuuggcuuucucuaggauauuggcuuggcauauauaaaucaccugguggagagaggagacuaugacauagcagcacgguaaugaugacauuuucacaauuauuuguuaauauaaauagaauugagcauugcuaacaguaaaaauaagccauucuuugcaguugacauuuuauuuuuguacaucuuucuaacgaggguaauuuuugaauauuauuuuuaaauuauaauuuuugaauauuaaugauuccaagcacagaaucaguuuaauguuuauuauuuucccaacuauuucauuuuuaccgaaggagaauuuuuuuucucauuauuaaugagaaagguaucaagaaccaugaaggaucucagacuuuaccuauuuacagucuaacaaguuagccugucauuucccugguugcuggcagaagacaagagacucccaggucagagcuaaaggacucugugagcaauaguaccagccaagguacugcuacaacaauaguagucaaauagagugucaacauuugccccgauccccaaaccccaauucccacaaugcaacagagggugggcauggagauccugcccaugcaguggguugugauacggaagaggaccccugagcuuaggguaucugaaucuuuucuagugaccaagaaccccauguauuaguccauucucacacugcuaauaaagauauacucgauacuggauaauuuauaaaggaaagagguuuaguugacucacaguucagcauggcugaggaggccucagaaaacuuacagucauggcagaaggggaagcaaacgugucguucuucacaaggcaggcaggaaggagaagaacaagagcccaaugaagggggaagcuccucauaauaccaucagagcucgugagaacuaacucacuaucaugaaaacagguugagggaaaccauccccaugauucagguaucuccaucuggucacucccaugauguggggauuaauguuaacuacaauucaagaugagauuuggguggggacacggccaaacccuaucaccuugucugccuuuuguccuaaaggcgucauuuuaccuuuauuguacugggcaguaagaaaccuucccuuuccucaggagggagacacuauuugugucgucucauuucuagagcuguuugcuuuauaagcauccuuggaagauaguccagaagaaagugccucugcuuaugauucaaagagaauuuucccaaccuaaggauggcaguuaaauagaagugacuagaccccaggauccuggguugcagaggucuguggugggcagaacacauaaauguuauguaguggugugcaagucugugugagggguucccacuggaacuggcagugcccgcugcaugacugcauggcaguccuggaagagugcccucaagccugcuucucgucuccugagguuauuuaagaaaauguguuucuuugauguguaaaguaagguuucauucauacauaagcaguccuccagguuauauaguaggauaggauucuaguuuucugaagucugauuuuguagugcauaauuuaaagccauuuagaaagguucuggcacuuugggguaugacaaguuuucuucaaggcaagaaaggucucccgaaaccagcagugcuccucuggguaaaugggaaacuuagaacaggcagauaguugggaaagccccuaguuauagucuucugaagugauucaucuuuauuuauaagcauuuuauauuaacuuuuauaaguuguguuaauuuauguaugcaaccaaaugaguaacaguaauaucuuuauguucguugguacuugagauagaaauucaucaaaacucugagaagagagauuucucuaaaccucuggggaaaaugucuacuuauucugucucuguuuguuuuuuguuuuuuuaauauauacuuucuuucugccugggauguuuuuacugccagcaaaugccagaaaauucuugggaaaaaugcagcacucugggaauaugaaguuuauaaauuuaaagaaauuggacagcuuaagguaagcaaagccuuauuuuuaacucucaguuucugcaaguaguauauuaauauugcaguggaaacaaagauaauaguacucagcucuuuuuuaggacgugauuauuaucucagauggaaagaaaaaucaaacuuuuagagacaguuucaaaauauaagccucguguaaaaaaaaauauauaagauuauauauuuauuacauauacaauguguucacuuaucucuuuccaauucucucuguguuuagaugaaguuuucaugcucuuuuuaaugacuuuugaaaauagguguaaucucauccaguagguuauaaagcauaagacuuuuuuuagauuuacugaauaauauuguauuuuucaaguaauauuuuaccugcugaaagacagauggaaaaaauugaccaccuagcucuaaugaauaauuuugauguuucuuuuuuuaaaucuuucaacuuagugcacaacauccuaaucaaucaauaaaguauuccuauauuuguuuuaaacauuuaaaaauuuuucaguauuuguggaccuuuugaaugcucucuucaaguuauaaauaugcuuuaaaaauucccaguuacucaucuugucaaccgugugacuccuccugucugcccuguaaauguuacacuucucauuggguuuauuggaugguuucuggaggauuuuauccagucgugccucccuguuuacuuuaauggcuguguaacuuggaccuuuuuuuugaauaucaugugauggccguuucuccuuguauauacugcugaugaugauaauucaaguuaauauaaauccauuccuucccaaauucaguccuuuuccauugagucuguguuugugauacacaauauacccauuccccagaguguauuagcucaaagccacuguucuugauuagaacauguuacaccccuccucauucuguuuaaucuccacuucuugucauuuuuuucaugucaauaccaaucggggcucuucucuuccccugugguaccauugccuuaacuuuugccugagccauagcaaaugccuucugauagaucugugggcagcccuagcccagaguuaucugcauaaaaaauaagucuggacucucacuucccuaauaccuguugcuucccuccugccuauagaauaaaaucagaauuccucucaagaccccaccuccccuuccucuccagccucaccucccuucagugacgccaucucgcaucucugggcuccucugaccucccugcacacagaugcauguucauggcuccacgccuuugcucaugcuauucccccugccagauguccugccccucucuuauuuuuuccugagaaacccagggcuuuagugggcaugguucuccucugcugcugcagcacugugcugaccccucuguuauaacacuuaccacacaauacaguuauugucuguuuaauugucugcauaucuuucuucuaggacuugugagcuccuuggggauggugaccuucucugucuguccccaguaaaaaguguggugauuggauuguagggcauuauagggucauugaacaguauuuguaaauuugacuuuuaacacaguacugaaaauaucugaagaacacaagauguauuuuuccuaauuucaaaagaugauuaugaguuggugaagguugguaaacuccaguugaaggaaggaaagaugaauagauuaccuguacuccucgauuacuuaagaagucgacuuuuuucaucucugugacuuucucccuccuauuauuuagauuucuauuaacucaucaggaagaacagagagauaaagauuaaccuaggcaauuuuuaaauucauucauacauguauauacuuuugaaaauauauuauaauuuauuguuagaaaguaguuuucauuuaaauccuguucaaaacauuuuuuucagaguacuguauucccucacauuuuuaaaguaaaaauauacuuuauguuuucugcauaauuggaaugcaguuuuguuuuuucauauuuuaauggacuuuuuuuucccuuuuccuuaccuaggcuauuaguccuuauuugccaagaggugauccaguucugaaaccacucaucuaugaaaugaucuuacaugaauuuuuggagagugauuaugagguaugguguucugauguggucauauuuacuuguucucgaugggagguguuaggaaaucuagaaaggaauacaauggagcaaugccuguaaaggaaacagauuuguaguuugcauguggcaggugaaacugagcuagagaaacuccaguauaacucauguuuauguagacagugaaaacacuuaguccgugugcauuuuaaggaauuccuuaaaguuaccuucuuucuagaacuaaagaaaaagagcuaagugcuauuuuguagauuucauaaauacaauagcagcugcuauuccaucuuugauaucaucccagaagaaagagaauuaugaguguucugugaaaaugauggagaagaguacaaacuuccuuuacaaaugcugaaguauguuauaauuuuccuauuuuuaaaguaauguaauuuaagcauuuaaaaaaauuuauuguuuuuaugauucuguuacaguuauugcacaugauugaacucuuauuuuuucaugaaacuuuuaaaaauccuuuaucgucaaaguuacccuguugauuucauaucuggaacacuuuuuauugagauggaaagaagcaugacuuaaccuuagagauuguagauguuuucuccugaauguuuuaggauguaugucuggucaguacuguuaaggagguuguaaauaauuuguuuuuauuuucauaagcucuuauaaauaguucauguuuuaccuucccuuauucucagcuuaauuauuuaauuuugaauuaaauugucacauuaucagucaaauagcuguguucccuaacaacacuuuugaucacauauuauguggagagacauuuuguguugcuaaacagagcacugaaggucagauuacaaaaaacaaacuguacuucucuggaauauugacuugucaauuuuuuucucccuaaaaagacaugaaguaauauuggagguaaagaugcuucaugacuucuuuguaugggguuucuagucauaugccuguagcuuugccuauuaauuuacgacccagcagaguuaaacaguuaagcuuuguuuaauauuaacgacaaacauauaagcauguuaaaaauuggaugauuucuguggcauuucauuucaugaguacuuucuagacuuuuacuuauuaugauagguacugagguuuucuauaacuuugcucauucaaucauaacaggucccuuguuccuguguccucuaauuaguaauaauggccacagauagauuuuauaaauauuucuuggguagcacauuuauucaaggguacacaaagccaguugaacagagagaagccuaacaugaaauaugauagauguuuauuucaguuuaugguggggucaucaugcuuuuaucauacaagaugacugguuauuuugucuuuauuuuguguucgaaguuggcaguaccaugaggcuguugcaugauagggaaaagaaaaaaugaggccaaacuuucuucuuucccugagcauuauuauuaauggucuaggggcuacugugagcugcugguauugggguagaaaucuuuacagacuauuuuaucuuauauagucuuaagaaaacagggcugucacgguggcucacaucuguaaucccagcacuuugagaggccaaggugggaggauugcuugagcccaggaguucaaaaccagccuggguaacauagugagaccugucuauaaaaaacuaaaaauuagcugagugcugugacauaugccuguacucucagcuauucaggaggcugaggugggaggaucacuugacccuagaggcugaggcugcagugagcugugaucaugcuacugcacuccagcuuaggugacggagugggacccuuucucacaaaaagaaagaaagaggcugugugugguggcucaccccuguaaucccagcacuuugggaggcugugggaggcugaggcgggcggaucacaaggucaggagauggagaccauccuggccaacaugguuaaaccccgucucuacuaaaaaaaaaaaaaauacaaaaauuaaccaggcaugguggcaugcaccuguagucccagcuauuugggaggcugaagcgagagacuugcuugagccuaggaggcggagguugcagugagccaagauagcgccacugaacuccagccugggcgacagagcgaaacaccaccugaaaaaaaaaaaaaaaaaaaaaaaaaaaaaagagaggaagagagagagagaaaaacaaagaaagagggagagagagagaaagaaaaggaagggagggagggaagaaaggaaggacaaggaaggaaagacaaggaaagggaaacagagaaggaagaaaagaaagaaacuugaucugaaauauuauuuugguucuacaaacauuuuaauguucugauugaauccauucccaaauuucugaaguaaaauuucaaucauauuaauauauaagaaguuuguaaucuaaauggaaaauauguggucuuuuguucuggucucuugccauccuuccaggggcuacuuugguagaaaucggguggaacuuuaaugaaaacuauauuacugauucuuuugcacuuuucuuaccaaauccuggugcauuacagaagcagcuucuaucacauuguuuucauuucuaaguauuauuuaaacaaauucacaguaguucauuaaaguauuaauggaguuauuuaauaguaauaauguacuauuuuuuauauaaaccaaaaagugacugagacagaucucaaucgacuuuaagguuuauuuugccaagguuagggacauacuuggggaaaagaaacagggucuguguccugugcuuuuuccaaagagauuguugaggacuucaaaauuuaaaggggaaagagcaagcaggaggcaaaggagcaaauuuuaaaaauaaauaaauaaauaaguagggggagaguaagcaaugaggcacuuggucacauuccagugaugcucugauuagcucaggaaaucuacguuuuacauguaaaaagagagaaguggggaaaaagucaauuaugcauucaucucuugcucaguagaucuagcuuugacaugagcuaaaggaagcaugugaaaugacagcucucuguuugggaacaaaaggaaggcaauuuuugcaugacucaguucccuuaacuuucccuuuggcuuagugaauuggagguccugagaauuuauuuuccuuucacauuuaauaacguggauguuuuuaauucucuuuacugucuuaugaacauguuuuuguucuaaacauugucaaggaucaguaaguaaacugcucugucauacuuugaguuauaaaacaugaagucuaaagucgggaaucagggaguagagacugagcaagauacuggcccagaaucagcugugggacggaaacaggaucaaaucggggaaccacaaaauuugagaucuagagauagccaggauaagagccaggggauaagacuugagccaaagucucaaauuccaacauaaaacuggcauuagaagccaaaguggaaggaggaccaagauggugacuuguuaaagauauagaaugcuggacaguuucacugugggagcagcccugucccaagcagacugccacggucaguugugcuggcuauacagugcacaacugcauaaccaguugcacccagcagcccaggccuaagugcauuagaggacucuuggugguggggaaaguagcugacuuggguaauaucuguaagcuguuaaagcugucauccaaauguuacaguuaguccagaauggggauggggcaaguccaaccuaaacucuuguccaugcacuuuauagaaggaacaagauagcuuucuuaguuguacauuucguaaaacuaaggacagaaguagauggcacgaccugccucccaggaaugcuaaauggagauuuauuguacaauaauauucccugcaacucuucaccacacccagacccauagucugaaaauugaugaaauauuuauugaacaaacuuuuaaucauauaauuguuuggucuguuaugugacuaaaagugaauacuuuuagggaugguuuaaauuguuugguuuguuuugagaauuuaggagaaaccaaacucaguuucucaugcuauacucucacaacacaacacuucugugaccaaauaucuggguuuuuccgcuacacaccaagaaagcaauuaguucugcaguggacaccagcuggauguccucuaauucaguucauucugacacugucuacaugaagauagcaucaguuccugcaggcugagggcucaggcccacaagacugcccccacuucagacauaccaaucacaaguuauaggcugucaccuguacuuccgacuggucaacuauaaacuggaauucccacuaccaccuccuuagauuugacucauuugcuagagcagcucauagaacucaggggaacacuuuacuuacauuuacugguuuauuauaaagaauauugcaaaggauacagaugaacagccaaauggauuagaugcagagggcaagguaugugggaagaggcauggagcuuccagguccucuuugggugcaccacccuccaggaaccuccagguguucagcucuuggggagcccuccaaagccacuccuuuuggguuuuaaugaaagcuucauuacuuagacaugauugauuuaaacacugggccauuggugaucgguguaaccuucagccccucuccccuccuuggagguuguggggcagggguggggguagggcugaaaaguuccaacccuuuaauccugucucagucuauccugugcccaaccccauccuuaaguuaccuaggggcugcuagccaccagucagcucauuagcauacaagaagacacaucauuuuagagauucuaaggauuuugagaguuauaugccaggaaacagaaggaggaccaaauguauauuucacaauaucacaacuauuauucuguugaaugaguguucuuuuucuguuuuucaccuuugguuaggguuuugccacauugauccgagaauggccuggagaucuguauaauaauucagucauaguucaagcaguucgggaucauuugaagaaagauagucagaacaagacuuuacuuaaaacccuggcagaauugugaguauacuuaaguguuucuuuuuccauaucagucuguguugaaaaguuuuucauacuuuagauuuggcaaacuccaaguggagaagauguauuuuauaccauuuuccuacauuccuucuuaguaaaaaccucucauaaaccucaaaugaguaggcgauaaggacaugugugaaacuguacaauugcaauguaaucuguuucccagagaagagaaccccuaacgcacagcgcuugggagaggcagugguuaggaaacaaaagggugccaaguuuuagaucacucaagcauaacaguuucccaaugagcaaggcucuggauucugcucuucuagggucuucaagucaguuaauuuaaucucucaaaugucaauuccuuaugggaaaauuuuaaacuuuaaaagagaugucauaauagaggacucccugacccugagucagggcucagaaaauggcagcuugguuaauauuuuucauauuucuugggcacauucagugaugcaggcuuugugcgagacgcuuaugauacagagauagauaagauaugcucucaaguacuucgaucuagggaaacaagaaguauacugcaggucuagccaagacgaccaucccugcauccaccucuccucagugcccccaucaccucaggccacuccucucccuuguuuuuucuucuuuugcccaaaaccaaaaaagguauaccaaaaugaccuagaacucuggacguguuggauuuuccacaagaggagguuguguuuauggcauucuaaguugaaaugcuaaucauuuucucuuggaaacguuguccuguuagauaccccuuagagucugcagcacguucguaauggaccaacaguacagcuucaguucagugagcucucaagagcugacuuagggacuuaaugugaaaaacauuguuucaauggaaaaacacauuucaguuagacacagcccccuuaaaaucagcuuuuggaauauuagccauuugucagcugaauacugcuuguaagaauuggaacggauguuucuguuacuaaaaugagaacuucauccuggauccuaguuucuuugcuguauggauguuuguaaaacuuuugagacugagacccccaauaaagaccauuuuuauuacuugaauauugugaauuuucuuaaauuuuggcaacaugagaggcaaaguucugagaaagaaauacuuauuggucguguauaguuaaauccuauucaaaaauaggaauauuuuuugaaauaaaguuaacuuuucucucuaaaggaguguuuccauuuuuaauauugugaaccaugaucucucuguguguguuuuaauuagaacuguugaugaauauuaauguaaaaaauuuguauuaccagguacaccuaugacaagaacuauggcaaugcucuggaaauauacuuaacauuaagacauaaagacguuuuucaguugauccacaagcauaaucuuuucaguucuaucaaggauaaaauuguuuuauuaauggauuuugauucagagguaaugugcuuuuuauuuuaguacugucaauuauuuuuacuauuccaaauauuuaauacuuagauaucuauccaaaugcuggauuggugaaugaaucacauaacuuggcuuuaugccgacaaucuuuagaacacucugacccucgcuagauguuguuauucuaguuguuuggcauucaggaauccuuuucauaauguaguuauucugugaaagcaauucaaaguugauagagaacuuuuaaaguugugugugugcgcauauaaaguaauuucuugcuaaaacaauucauauaauuuauagaaacaaaccacguauauacuuugacucauuuaucccuccuaaccuguuuuccagaauuuuaaaauuaagugaacuuccaucuugaccgacuuauuacuauuuuauuucuugguguucacguauccagcaugugggguuuccccugguuugaggugaugcucauguccaggacauguggaauguuauuuuauugugugacaaauuugaauaaccuaauaauaaauuuacgcccccuaaugaguggacccagccacagcucacauuggugcuugcaaagugaugcaagcuguguguguguguguguguguguguguguguguguguaaaagaaaucuaauuacaagugcucaugacagaaauaaugagguuuauaaaacaguguucuuauucaaaaaauugaaauuuuagauaaaccuaaaaguagaacccuaaaggcuccaaaaggauuaaugcauuuuucaauuauauuguacuguauuuagagauauugugugcuauauuaaucuccaccaacuuaaacuuaauuuagauaggagcuagagcuacgucuuuuucucaaagaugcuuuagcccuuuuuaaaauacugagucaagucuuuagggacuacagauuuacgaagaauuacguagcuccaaggaaguucagguagagaggcucugcuugucuggcagaggaugagaugcuuauguaaaaauuaauuacauuuuccucauaucuagucuccccucaugcacccccuuccauuguucuccagagcucguuuugcauauguuccuguggaaaaaagaugaaugagcugaaacuaauugcuauucuagaaugugauccagauguaaggaaucagagucuucugguuagaagagaccuuagggauaaucuacuccaacacccucguauuucagagaacaaaaguaacauuuggagcagacagcuaggucguagcagagucuagaacagggcccccagguguuccgugugaggcucagucuggugugcugcuuucccucuuccucuugacauaaacugucuaguuuguguuuccugaaugauaaaaguggcuaaaguaaauucugaaaguccaaaagcuuuaugucauuaugaaacuucagguaucucauucucuuucugacucuuauucccuucuccucauaaaaccagcuccuucugucuguggagucucauagggagacuaggucgagguugaaguagcuggaagaaaagcucauuuucuugauauacugguaaagagaugcucuccauaacuacugagagucucaugagaaggugugaagguauccgagacaucggagggcggggggcuaggauaugggcagucaagauguuuuguauuugggaaguuauagcaaagcaccauuuuaguagugugcaaaacacauaggcuucagauugagaugcauuugaaaaugcaguucuucacaaaugucauuuuccauaagagccauuguaaagccaagggccuccuuaaguauacaaaauaagccuuccaccugugaacugugguagguacacugcauuguguuuagucuucucuucuuaaauaacggauuucauugacuguggcuuuucuuauauguuucagaaagcuguugacaugcuuuuggacaaugaagauaaaauuucagugagugucauuuguuuuuauauguguuaccagaugaacgucugggacuccuauagcugugaagaagagaguuuaucagauaauuuuguagcugucuuucuguccucaugacuccaccuugaaacuuuucuuuuuuaucuagauuaaaaagguaguggaagaauuggaagacagaccagagcuacagcauguggugagcauggcagucuccuccuuuugcccuuuugauugaccagugggugaaucaccuuucaguauuggugcgaggaggauacuggagugaauucuucaaggagguuaauauuccaguuggagguuucaccacaaacaauguucuguaauuaccaaaaugcagcauaugcugugaauucaaggucagggauuaauuguagaucaggcaguugaauuuugacccacaauugaauugugauggaaaaaaguuaccaaucuaucuauuauauuacuauaauauaaauauauguaacauaacuauauauuuaacuauaaugaauguuuuuguguuauguugugucuaggaauaagcacucucccucuguaguugccauuaaauauaaccauggcauauaucacaguaaaggccaguauggcaccgcagauacuguaccaaguucuccugcuaaggaaaugucagacaaccauuccauauccagaccacagagcgauaaaagggcagagucucauuucuuuugucccucaccaugacaauagcuaauuccauauuucuugugugcuauuggugguuguguaauuaaggccuguuauucuagauuucuuuggggggcuacuucaauucucugcauugcaucaucaugagaguaaagcaggaauaguuguuuucuauguccuuuaaaaguuauacaagagaaaacuuagcacacuuagggauuauaucaguaggacuauggguaucagauacaauaagugcacuuguaucuuugcccaucucauugcacccuaggaggaggcuuagggaauagagcauuuuuuucaaaagucaguuuucugcuuugaagcuuuugaagacugcaggaagggaaugagaggcaccuuuuuuucucuuuugcucagaugcuacugcugcauuguucaugauuggaaaucucaagauuaucugcuucccaagcaaggcuccacauugcuaaccaccuuaggaauucauuuauaaagcagugauuucugacuuacuuaagccaggagacaggauuaugggcaguagcucucugugcgacaauguaaucagugcaauggugaagugguggcacagcccacacuaacauggcucaucuucccugccaggcaaugucuuguuucuauauauauaaauuugacucagcauucaugugacagggccucccuguccuuuuugcacucugggaaacagcaccacauauccccgcuaacacacugaccccagugccaguggacuggcggugguguucaucagaccucugccuggcacaugaguucagucuacugcuuguacugcuccguuuugccuuaggaagaagugaacaggaagccugaagauugguuucuuaaggugcauguguccaugguuaggcgucauugugacuagauucaacagcaauaacaaacaucagcgcauuuacagucucagcugcagggcggcuggugcucuaugucuguuauaaaccaauccacuuggaaacagcaacccaagguguuaaugcucgugggauuggugauuaagucuuccugucuucaguagauugugggguuuuuguuuacauuuaauauuaacuaaacauugaauuguuuuuugacuucugaguacuguauugauagacuuaaucuugccugugaggagaaagugaauuacugauuuccugugaaguuaacuuuuuuucagacagcuaagguaaggaaucaguuuugaaaacuguuucagaacaccugcauucuucuugauuuuuacuuuguauuuuuguuuuugauguuaccaguuuaggcagcauuucauuugaagagucaacaaagaggagaugcagaauguauggaaaugaguuuagugcccgcuacuugaguuuuuaagaauaugugcuugucccaggacucuacccucuuuuguguaaaauaauuuuuaugaucugggaagaccacucaucuuuuuauuucugagccaaagcagauaccaaugaugauauugacaacuacugucauuaacauuucuguaguucuuaguguaugcuaaguucauugguucugagugauuucguaauggcaacucguuuaauugucacaguaacucaauaaaauuuuuguagauaaacugagucucagagagauuagugacuugccuaaggucacaguugguacguggcagagucagguuuuggggcccuucuagagaaauuaucggaauccuuugcucucccaaaggguuuuccuuuccacuucuccaucaccuagagguuuucccugaagacugcuucucccccaaccuguccaugggagguguuuagagcuaaaaauagcaauguuagccagguauugcuuuucucauuuuaaugggucacggcuuaucuuuuguuccuuuuaguauuugcauaagcuuuucaagagagaccaccauaaggggcagcguuaccaugaaaaacagaucagucuuuaugcugaauaugaucgaccaaacuuacuucccuuucuccgagacaguacccauugcccacuugaaaagguaaggcacagacuccccgacuuguacacuuuggaugaagagguugucauugaugguaaguuguuugucuuucuucucuuucuaucucuguucaucugucccuuuccagggggaagacuguugcucucaaagaaguagguuuuuggcugggacauucugucaagaaaaggagaucucauuggauuagacuuuggugaagagcugaagcauuucugugacagguuuaauuggaagaacagcuuaauccagggucuaggacuuaaucaaccaucaggcaaaaaugauauauuagaagucucaguccaucucccaggaucagagugacaccucagagucaagagccugggagggagacacagacuguccuaagccagaagcaguugcuccagucaggaaucagguuugauaaacugaggucauagcuuagguccugcauccuaucuucuuuaagugucuacccuauguuuuucuuuguuucuccuacauccuacauuccacuauaauuaucugcuuacuagucucugucuccuggaaauucuucaaagacaaggaauuugucuuacucauuuugguaaaucuaguacccaccacacauuagacauuuacuaaauguguguugcaucaugagugagagaaugaaugaauaaauuauauacaugcaagauccuaguucgggcuaaauaaggacuaguaaguuuuaugagacugcuguuucaaaauaaacugaaguacuuaacuauauaugugcuaacaacugggcagccuaaaagccaacaguauuauguccuacaguucucaauaccaucuaccacuaacaucuacaaaugucugacuaaauuuggauggccagauacuuuugaaagucagcuguguggaccaacaaaauaaaaaacauauuugacccauuagagauaugugcaaagaagcuggaugauaacacaguuuauguacacuuacaacuuccguguaugcuuccuuagcccaugauuauuaaaugcauuggaguacugugaaccaauuuagcucaauggauuuuuaaaguccacaauuauugaaaaaaaucuugccugccuguuaacuuauaaaacgacauuagcauuuuauauuuggggcccuaagacauuuucugaggacuuaauuuggaaauucauuaucuuacucuaaaaguaaaaacagauacuacccucuucucucaacauaggacuuuauaaccuggcaauagagugagaaucuuauucuuugaacagugcuccuucauuuguuucucacuuuucaagagaacauuguauauuucagagaggauguggcagucuccugaagucucccauugaccucugagacagagaggucacaugugggugauuaacagcccuucccauucccuaagcacaagaugcagaggcgccacccagguuccaguaucucuauaucucucacacacuuuaugcccaccugguuuaaaguuuucgggucuaguaguacucaguggaagacacccugcuucacccaguagggagcagcagaauguugcagaccugcaugugaugcuuccuacacauauggcuugcuuagagcauuuguguagaccuuguagaauuuuucucucugguccacuggaaacaacauauugaauguaaaagaacucagcacaagcauaguaaaaccaauuauguuuuagacacaguuauuuuuaaaaauuuaucucgugucccacugaaagagaauuuugagcauggauuagaggugguaauggugaaacagaccauuauaagauaaucaaguaguaauccauauuuuuaggacucccuaaauggguuuucauguuucagguuacugagacuucuucauaagagauuaucuguuugucaggaccuauugugggaaaucuguauauuuguagaaaacauagcacucuacccuaucagguacccaaagcugucuuaaaggagagguucaugacaguauuacuaacucaagauucucacuccguuuuccuuaaaguaaguucugguugggugugguagcccacaccucuaaucccagcacuuugggaagcugagggugggaaaauaguuuugggccaggaguuugagaccagccuggugaacauagcaagacucugucucuacaaaaauaaaaacauuaguccaguguagugguacaugccagucaguauucauagcuacucaggaagcugagggaggaggaagucuugagcccaagaguuugagguuacaguaagcuaugauugcaccagugcacuccggccuaggcgagaaagcaaaacucucuuuaaauaaauaaaaaagaauaauaagaaagaauucuguauauacucagucaucuuagaaacaaaucccuuuuauguuuacaugugacaugaaaagcuaucguauguaccaauuugcgaaugacaaaguggauuucuccaauuaaacgcaucccaagcuugcuaguaaagggcacggaauaccugucugccuguuuuguauaaagagcgacucauagaaaaugugaucucuuuuucuccugaauaugaaauugagaacuuugaaauuauaaagccucccuuuccccaaagaaauuucugucugcuuccuuagaauuuagagauuguugaguccuauugguacaagaggauuuuuuguucuuuguuucuacuuuaaaugagaaguguuuaagcuuucaaaggcauauucagaacccauugauccacuguuguuuauaauuuaccucuggcagaacacuauaucuuucuaauuuugguugucuuccuuuacugggaagacacuauaucuuucuaauuuugguugucuuuccuuugguugucuuccuuugccaacaauuggcuaauuguugagaggaggugauuucagauuggcaacugauugaaaucuucaagaaucuagguuaaccuuauuuugaauugauugaaaucccacaaucaauaguauuuggcccaaaacuuuggaaagauccugacgucacaucaaaagcccuaguuauaguuaucaaaggccagaguucaggauuuaaaaucaccacgacucugaaauucaaaaauuaaucauaaacuuuuaugaaauuguuuguucuaaaggaaauacagaguuugugggaauuuauaauaucuacagcaauuuuuaaagauaauaaaaauuauuuguauuucuuuugugcuuuauaauguauguugugccuucauguauauuguuuuauuuaaucucuacaaaagugcaguuagguggauagagucguuuuauacaugacaagccaagucuuagggagcuggaaaaaagccuaaagucuagagcuaauaaguugagggaccaagacuuagaaccuggaugacuuaauuuuaggcucuguauuuuuuccacuauguuggggaaucauuuucagguuuaaaaaguuaauggaaauaagauauuuccuaguauugcaagaaucaugaaagauuauuuuuuuuaacuguuaaacuguccuguaauuuacagauguggucaucaggcacugguuuucauuuugcaaaucugauuugcuugugccuagagugguuaagagcagaucaucaguuuuauaguucagcagauuuauaccggaauuugugaucgcucucauaucuaauaguauucacaagguggcaguauuucugaauucggaagaauaaagcugagagaugccaaguuugcagauuuucauuaaagaaauuuaaagagaagauuggauaaaagaugacgagaucaaggauagguagaaauaauuauuuaauuuacauuugauaagguucuuauuaguuacccucaguuuucuaacuucauucuuuaccuucauacuaaaucagaaagaggagaauuaaaauauuauuuuugcaucauuuuuuacucaaguucuauuauuauucugauuuuucacuucuauuuucacugcauuguccgcgugugugugcgcgcacgcgcgcgcauguguugugugugucuacuuuaaaaaucuuaguuucccuacuguuuccucuagagggagcaccaugguccaggaacauucaagaaucuaaaugcuuucuuuuuauacuuuacucaaaauuucuagagauuucuaaaguccauuuucucauuugugagaagaggauaauuuaagauacuguuagaaacucaucaugaaacaucuaaaauuaugugaaauugaaauuucagagacucaaauuaucuuugaacuuggugauacucaucugcuuacauuccgugucauuccuaacuucagcuuaccuucagacauuucuucccacaugacuuccuuuuugaaaguauauacaggaucuuauagccuugcuauucuauggcauauucuacagcaauggaaauguuuuauaaucuacucugucccacauaguagccaccaaccacaugucacaauugaguauuugaaaucuggcuauugcuaccaaggaacugaauuucaauuuaauuuaauuuuaaucaauuuaaacuuaaauagacacauagagcaaguggcugcugucuuggauaacucaggugaggcuucaaacugcaaacucuuuugugguuugagacuagcauguucuuaagcauucucaugugcagaagaaaauggguaaugguucugucugaaaucuugaaugguauuuuaaaguguguaagugaauuuccaaguacagaauugauucauggauaccuuuuaauaauaaauuauuuuaagcagcauaaaugcuuaucauuagucagacuaucuuucucuaaacauucuccuuauucaguuguauuacaguguucuauuuaucugugaauggcagucccacucaacuauaaacuaucuguaucuuaacacccagaacaaaucuaggcacucaguuggcuucucagugguuuuuuguuugaaucccguguccucugauguauuugcacuauuuugcuuuauuauuuaacuucuuacuuauguuuuuugucucugcaguaguaucacugcaggagagugaagaguugguaagaaaguuucaucauuuacaauggugauugacaggcaagaccauauaggaauagguaaaccauauuuuuaaucaaaauaaaggaagauuuucucgguauuagcuaggauuagauucaacugugagugauaaaaaucccaaaauaauuguggcuuaacagagcaacaguuucuuuuucugucacguggaaguguugguggaguggcccugcugagagcaccaugccgcggggucagagaccggggcuccuuccucuuguucguccaccuugggugaccuugaccucaugacguaagguagugccauccaauaguggagagucaggguaagggaagcauuucaggcaaggggacgcaauggagaggugagcagaggcaggugaagcugcacagaaauuaagggcuagguuguggaugccuuguaagucgugguagagauucucagcuuuaagucugaguggagcgaugcaauagaaaguuuuguaggcaggguaugagauaagguuucccaggugcacucauucaucauacugcacccgguucagaugccacuuccccuugaagcuucucacaagaggaccacacaguuucagugucccuccucuguacacauggcccuuuguucauguuacucuaaucguggaauaaugcguugucacaucucugucacuuccuggacccugagcucccggggguggacucaugcugcuaaugcuccuacuaagccuccuccauuauucucuucuuuguuuuccucuuaccuauaaucaucacuaacauuuuuauuauugucaucuuugcaucucuaucuaaccugacccucuagcacccagcacagagaauauaguaaauguauccugauuaauuuagaauuaguaaguaauuuaucaauauauaguaggucuuuuuuuuuuuuuuaagacuaauggaaaugcucucaucugcauaguugcuccuuuuuggauccuucuugaucaucaaaaguguuuuuuccuucucaccuuugacagauccuugagcagaguucucuuucagccccugugaucuggcaguacaaauauuccuaguaaauucaaucauucauucguucauucaugcagcaugaauucauauuuccugagcuuaugguaugcacaauacuaggaaaaguucaaccaugagcaacauuccuuacaucuuaauggagggaaacagagcuuaaacaaaugacuacagauuuggaaggaagcagugcuguaaggaaaccugaaguaguguaaagagagaaagcuuagugggaaaggcccuuucuuuucauuuggugucuuguuuucuacucuugcucaugaaauguucugaguagcuucaaauauguuuuaaauugaauuguguagaguccaguaccucugagagguaacugagugcagcuauucuagggagauguguucuuuauuuguuugcuuuguuuuauuuuuaaagaagcuguggaaaaauucuuucaaguguaaguuuaaaugacuuuauuacuguuuguucuuauuuggucgccuauaguaacauuuuuacccugcuuuaauugaaggcucuugagaucugucaacagagaaacuuuguagaagagacaguuuaucuucugaguaaguagcuuuuauucauuuugguccccauaaacuaagaaaugggaugacaacaugaaguaaauuguguaagaaaggacauagguuuuagaccaacguaacacagaauaugagccuauuuuuacaauaauuuaauauaugaaacagacuucacagcacaguaaagaaggaagaguuguuucauaaauguugaaauaacauauuggcaauguauaaucaacauaucaaaauuuaucaguuuauaccucacaacauagauuaaguuguagaugaguugacaaguuuuuucauuuucuaaaaaauuauaaucagcuuauauuaccaucauauugguagaaaauaaauaaucacuuuuagaaaucacacccuaaauaacuagaggaaaugcaauugaauaccauaguuuuggagaaggaggagagcuuuuuaauauaaucuaggugucaguguuccuggucuucuggcuccuaccuccacaugagucacaauuuuuguaccaugcauaccaagaaacaaaacuugucaucuuuucacauucuuccaaaaugagccacgugcaugacaacaauguggguuguacugaggauugcauaauguagcauauaacauaacauucauauuugguguuucuccauugucacuucccugcugaccucaguaggguuuuuccgcuuuacgccuuucccuuauacagcacucacucucauuggccucuuugccucuguugaaaaauaauccaaauccucuauucccuuuuauguguaugcagauucaugggugcucagccacaaacccagaacuguccaguuauagcaccugcccuucuuaggagaagugcuuuuggggcugcauuuuguuacuucagcauguuccugggguucuaaucacaauuuuagguagcucaucaauucacuaauuccaaacaguguucuccccaagaaauauuuugguggaauaaauuuuugucauauugucuuagaagcaguagaggacuuauuagggacauauagucugauuuuauaaaaacuugauaauccuguaaacauuuuuaaauaacuaaccauuuuuagagacauaaacuguggaaauaauauuuguaagaaacacaaaaugcuguggaagggguaucaaaugggauaucauuucauucacaagccagcuuuuaucaguugauaauggccgugugcagggggaaggauucaagauccuuuacuaguuccugcaagcccagagacagggguaagggugacaaccuacaaccaggcaguuguugucccuccacugaguaaggcuuucuuacaugcacuauauuaaaaacucauggaaaacuuuaaacuauuaaaaugccauaggucagugagcaaaguauguaaagacaauuagccaauagaaggcaugguugauaaauacuuucaucucaugaggguuauugaaaggccuuccccugaacgugggagagaagaaaaugaggaagcccucugauaguugaguuugcaguuggcacaaaguguaucagaaaagcaguaugcacagcuaccucaugaggcagaaugacuuuagggccuuuaaacauuuuaaguguaucugcaugugaagguauugaccuccagaauauauauaagucuaucaaaaguaagucagaguaugacagaccuggcuucaaauucacaguguacuauuuaguagcuguaugaucuuagcaagcuacuaacauuucuauuuccucuucuauaaaagaggaauauuaguagaacaugccucauaggguuguagugaugguuauaugaugucauuuauaugaggcacuuaaaugaguacucaguacagaguaaauauccaguaaauaggagauacuuauuuugcuauguuauagacaguaaauguuggugucacaugagaaaauagccuugucuuagcuuuccaccuauguaaacaaauuaagagauaugcaauuucuuuaaaaaaauuauuaaaauaccuuaaaugaacucuuucucccaucuucaccccaccaaggccgaauggguaauagccgaagugcccugaagaugauuauggaggaauuacaugauguugauaaagcaaucgaauuugccaaggagcaagaugauggagagcugugggaagauuugauuuuauauuccauugacaaaccacguaagcauaaaagccaucucugguuauaacuuuuuuuucucucaguguaaccaguuaugucuagauuaaaaacuauuucaagauacauuggguuaagaaaaugguagcguaccuacaauaaaaauaggccagguguguuguaaugauuuccaauacuccuccugugcuggaaaaccuggagccucaucacuuugcauuaccugcaugugaugaagaacagguggcuacacaguuuauuaauuguguccccaugaggcauauuuuuaccugcugcaagcaaauugaauaaaugucaucuggguuguguuggugugguuuuuuuuuguuuuuagcuuguauaugggaguguuuauaguuuaaguguauagaccuuaccagucuuuuuuggaaacauguaacuguucuggacauugaugauauuuggauguuuguguuguaguauuuagccucuuuccugcacuauuuuuaucaguacaacacccagaguuuguauuuguugguccucagcuugacuguuugcauugggucucccauuuuggaaaggaaaaaacaaaagcagucaccuaacagaaacccaacucuuuugaaaauaacuagcaguagugauuugaaauuuccucuuuccuuuuuuuuuuuuuuaaguuugguaggaagucuuuguguucauguaacuaccuuaaucugaaauugacuuuaauaacuauccucuugacaauauaaagaaucucacuuguaacuagcaagauaaaguaguaguuuaaggaucucaagaggcaaagugauguggcagaacauaucauaaacuugaggcuggccugagugaauuugggcacauuacuuauuagccgugugacccuggaaaaauuaaacaccccauuucccuugucuguaaaauggggacacagcauuccuaccuugcacaguauuugaggaaaguguauaugauaccugagccauagucaguugucaauaaauauuauuuacacccauuugaugcuaaaaacuguauuuugaaggcaaguaaucauuuguucaacuguuuuaaaacaguucuuauuuacuuucuccuucaugucuuaaggagcguuaguucuuggaaguuuagaagauuaauucuuaagaguuuagaaauucaaaugguuuuaacacuuacuuugaaggaaauaauuuuuucuuugaguuacuuuugaucuaaaauugcauuauaugcaaauuaugugcaaauaaaauugcauuauaauguugcuuauauguucauuguuuuaugugguauuuuguagcauuuauuacuggcuuguuaaacaacauuggcacacauguugacccaauucuacugauucaccguauuaaggaaggaauggagauccccaauuugagagauuccuugguuaaaauucugcaagacuacaauuugcaaguaaguauccuuucuuggacaaaugagcaucugaauuaguugacuuaguacuggauaaauauuucuaggguuuauguuagguaucaguuaaaaacuuucgauuuuaugguuacauuuuauuuaggcccagauauuuagaaaacuguucaaauagaguaauuagaaacaucaccuuuaaaauugcguuguccaguaauaccuuaaaggccuuaagaaggcuauuugauucuuuagccaucuccaauuuucacuuguuuuugagcagacauucuuacauuuguaugguuaauauaacauggaaucgaggcgaguaugaaagcaguuauaguggccauuagaucgggccaccccaacauuuuuagggagaauaaguauuguauccguuugagggaauuaacaaaaauguuuuucaguaagguaauaauuuuucuugaagccauucaguagucuguugccugaaagcuguuaaaauauaggauuuuauuuaaccuuuugucuguuuucuagaauagugcaacuuuauuauccuuguuaaaucagaauuugucauaagaacaguggaacucauuauuuucauauaaauuauuauacuaauuacaaagcaucuuaaucuuuuccuuaaaaagacucuagcaauuacuauuuuucaggaugcugguaacuucuauagaacuugaauuaaaacauuuccuuaaaaauucggacuguuguucuuccucuaauuuacuugaaaaugagguuuuauuaauaauggaugaaauuacuuuccuagaaacaauuuuugcagguaaagccaaaagaaaaggcuauuagcugaggagcauuaugaugugagauccauugggccaggauucaccaugcagguugcaaaguagaggucugccugcacucagggugacagccuuagguaagaggcaggguggaaaggagaagauauugcaggaacauugguggcaucaaaaacagauguaagagaugaaagggauggcagagcugcagggacaagagguugugccagagagugugaugucauuaauguuucugaagcggagucaugguguauacguguucaaaaagugggaugaugguaaaggucauuuguguagaauuaguagagaaacugaggccacagccuuucugagucauccuaauggacaugaaggccaggaggaagaaacaaggugcucuaagccaggcuccagcuucuccacaggggacaguaguauuaacuggacaacacgacuuuaaaagugaagaagucuaaagaugggggugggggugugagagaucaugcagccuucacuccggagagcuuugugggaaauuggguucaugggagagaaauugguauucguuaagccaaagaaguagauuaccuguuccgcaaaaagcuuaacgauauauaggcauauauuuccagugggauuuggagguuugcagaugacccaggagaaagguuauuggaaggagaaugagaaagucaagaaggaaauaaaaauaugggaauggguuaauaggcaaagagaggugaggugaggagcuggcuuuucaugccacgcccuaggaauccagaaaggugacgucccugccuggggaagucacuaauuuugaaggucagauugggcuuuggugaaaguguuuucaguaucagaacuuauaagccucugagugugagugagcuugauaaugaccuuuacuucauugacccuuaccaaccccaggcaugccaggauaugcucuagguuucaaauccacauuugaugagaagucauuuaggugucucugaacaacccucccccaagggaaguaguaaauaauuaucccucugccuuucagcuguagugcaagaagcuugcacuagguuaaaaguugugccuuucuuuuucgccagccuccgcaaugacugcaagaccacauagugcaucccuaugacuaggucauucuuccagagaaccaagcucaugggcaccacugugaucucaguguucauucauuuuuaauaaauaaauuugcaucauucugagucagcugguaauaaaaaugaaauuauuauuagaugcaaaaugaaugccuaacauaaaaauaucuacuaaagaagcuacuaaauauuuuuucuuaauuagagcuuuuccuuaagauauguaaguauguaguucgguaauguguuaaggagguucagaauuauuuagcuaguggguccaaaaagcugugguugccugugaaucccccaaccaagggguggcuucucagagggugagggagagaugaacagggaaggcagcagagccuguggaagcugcugcaucuggaguccccacuggagcucaggcaucuuguuggagaaugcagucagaaaaugcucuccgggggcaggugguucaaagaauuccaggcauuauuuuucccucacagauaaagaguuuaaaauauuuuucugcucuuuuuacauaauguauuaaugaccgcuuaauguguuuccuuucucuaggcaaccuauuaggguucacuguaaaaauaaaucuauccagagagcauuuugcaauuuccagaaggauuucacuugcauguuuuuauuuuauucuuuuuuuauuuuguauuuuauaaaacuauguuguuuuucacauacucucaccuagcaaaguaaaaaauuagcaacccuauucaaucugaaaauuugggagaaauuuugcauguucaucaauuuccaggaaucuggaagugacugugugugugauggggcugggugggacaguaaccccaggggcuaucaagaaccauucaguaauguagggaucuauggucagauguuggggaaauguucucacagggcuucucagcaccuuuucuugcugguaugcauugggaaucucuaaagggagauugacaauagaguauacagcauuuaaaacuugggcacugcuuugggagaucauucauuagccaguuguuaauuggaaaagcggguuagagaauguugugggaaaaacuugaaaugaguaacucuucugcuuuuaguuucacguuuucuaaaauguaacagcucucuucaaccgaagguuagcaucauuagguuuguuagaugccuaugacaugacauaguuuaaggaaguaguauaaucaacuacaucagcaguguuuaauuucuuuaacuuucuauguuuuuauacccggcuaccuuguuaguguaaucacugcacaaauuuuaaaagcuucaugaagucaguaagaugcaaguggcauguauugcacuucauaagcuuuaaauguuccuaggccugauuucaaggacaaauagcacuuauuuugauauaacuuccaaaacaauaugguaucaauuauacuucaguuuuuauguaaacugaccaguuuccaguuuaugcuacaaauuucuaauguuuuuacauuuucuauuuuuaaaacauuauaaauuuagcauguaguuguugagcguuuauguccauuuuuguaguuggaggcuuuuuucccuugagaauuucagcaucuuuguucuuaaagacuucuuuugacgguuuuauuugacaaacauuuaaucuucacaacacuucuguaggaaauaucaucuuuguuuuacagaugagaagguugucucucagaaaaguuaagugauuugccagucugggaaggugaugaacuggguuugaacacagaucacagauccucugacuaaaucucaugccuuuuuuaaaucagugacuacauuaccuuuuacagccacaaguaaucucuaaaaaaucugcuaauuagaguggggucuuaguuuuuuucauuauggguaacaccucuugggaaaagaaaauagcaagcauguuuaacuugcuucuaaagaggugucauggugcaguggaaaucucaccaggcuaagccucaugagucccuggugugagucuaacccuuaaggaaaguuguagaugauccugaagaagucauugcacauccuuggaccucuguuuuccccagaaaaauaaaagggagcaggggcuagauuaaacguccaucuuagaugcuuuaggggcugcagacauucuuaaggcuaacuggaucuaaggcauuggguacaaagcugaauugccuuuaggccaacaccugccuaguuagguuucucuacauuucucucuggagcaggauguucagcuuugggcacugguuugggucacaggauuacaaaacuuucaaagaucacuacagaaacuuagccuuuacaagauggacacaacacucaggaguuuccacugugauggaaacuccucuggacuuguguuauuguggugaucgacccccauauuuguauccuuuuacacuuggcagaaucaugccacgugguucucccagcaggcccucgccccugcuuugcagaugagaaaguugaagcuagaagauguugcaugauuugcccaugucaugcaguagagccaggauuccaagccugugcacuuggugcugcucugccuccuacaauuuggcaguuuuaaguuuucuuuucauggguaaugcuugccauuacucuugcuuuugauuuauguuuuauuuugucuguaucuaugaccaagacuaggguuaugaaguuuuguuuuuauuuuuuauuuuuauuuuuuugagacggagucuugcucugucgccaggcuggagugcaguggcgugaucucagcucacugcaaacuccaccucucuaguucaaacaauucuccugcaucagccuccugaguagcugggauuacagacacgugccaccauacccagcuaauuuuuguauuuuuaguagagacaguuuauccauguuggccaggauagucuucaucuccugaccucaugauccgccugccucggccucccaaagugcuggcauggcaggugugagccaccgcgccuggccuguuuuuauuuuaguuuuuuaaagauagauaauucucuccccagcuaccaaucuaagggaggcauugcccaacuuccuuuuccaccaacuuucaaaaguggugcgaauguggaaucucugcauauugaaaauaaggucaacucaccugaugagggagggaaaauccacccuguacuguucuuuuucuugagauagaagcuuuguagaugagauuugccacucccuauaauuagguuuaacuauuugugaaugcuuuuguuuuuaauccauguauaagacaaauaugugccaaaacuuuuuggugcucaugcuuucaguuuuacaauuaugauucucauccuccuuucuauucuagcagugucugugaagugccuugagguacuucauuuauguuaucucuggauaaaaagggacuaucuacauagugcuguuguguggucuuccacaucauauccuguguaucucucacugcugggcccauuuggucucuggagaugcauucauuguacuggcaguuuaugccagagucacauacagaauuggcauggaagacaaauaggcaacuguugucuuuuaaagagcgguggacaugguauuugcagacgugggcuccuguucuggcuuugccauuaacaagccuauugagacuuugguaaggcacuucagcuuucuggagcuuggcuucccaguuagauuaagccaguguuugugaagucuggcugcacaccaguaucaucuggauucuuguauacguuacauaguuucaggcacccagcccagaucugcugaaugagacucucuugggaaggacuagggagcauguccuuaaaccaccuugauauuucuuacacaccuagucuggcacuagucuauguauugaaauuugagaaccuugagauuagaugaucucuaaaauaucuuuuguuucuaaaguucuuaacagaggcguuuuauaaauaucucuuuacauauugaauacagcugcauauuuaauguuaacuuaauauuuuaauguaagccuuaauauuuauuuugggaucuaauaaagcagcuuagauuuuuagguauaauugggguuuauuuuucacgguuuuuucuuuugccucaaaaaugacauuuauuuaaagaaaaaaaaugacaaauuguccaucccuugacucccuucccuccccugcccuguuccucccaacugccccuuggauugaacccuggccggggcuagguagcaggacagcccuucucagaugaagucagcaacacugaugggugucuucuuaacagaggggcugucagaggccuuaaugucucauggaauaguuguuuucaaagugccauauacuugaugacuuauaaacacauuuauucagauacaugaguaccuccugugucagacaguauguucugugcuaacagggccuccauuuggucucauagaccuggggaugagcgagacacagcccuuuguucaugcugcucaugaucuaaauugauguuucugggagaaguaaaaugccuuaacacuuccauuuuguuaaacuacgcacaccauacacacagacacacacacauacacauauacacauguacacacacagagacacacacauguacacacacauaccucauccaaacugauaaacugauuucagacaucuccaugccuuccaaaguuauuuucccaaauuugcauuugcugcaguccccauaguccuuuauuucccauaucucuauuuugcaauccaaaugggauaagaggaaauaauggcuucuuucuuacuaaccuuuuuuugggccuacguggguuucuuuuugacucucaguauauaagcuccuaauuuucuucuaagagagaguuuuugaauuuauauguucaugaaauaaacuuuuaagaccaaaugagauuuguuguuuuccuuuugaaauuauuucaguuuugccuuaucacagcuuuuaggugacauagguggccugugacaaccagcuguagcuuuuaaaauuaauuugguacauccauacuuugugcuauuagaaauuuaaauacaauuguguuuauaagauuguuucugaacuccaacauaagaccuuaggaucucuuucccuucguauuucucugcaguucaucauuuuuauaagaaucccagccgaaagcaaagcuuuuucaagaagaauucaagucccauagcauugugaccuaaaggaaggauuagaaaugaggggaaaaguuucucagucuacccugugucauauugggggcuuuuaaaaccagguagcugucugucauuugcaguucuaaugauaagcauugcaguaugaacaaggcaaugucagcaaaauguuuaguguucgaagaaucuuuuaaaauaaaaauuucagaaacuuggcaacuuuugauggcauuuuucgcauggccgcuguuucuaaugaaccauaauaacuuugcugauauacaguucuuuuauugcuuuauaaaaucucugugggucugguguuuugcuuuugguugggauuauuaucaaugaugaugaacugcagagaaauaaggagaaagggggaagauaaggcaaaucuaaguucucauguugauuuucaacagucguguuguaaauucauucuuauuuaaauuuacaguagcacaaaauauaauauguaacagguuguuuauagaagccauagcugguugacuucaaaaugacgaaaagggaagaguaaaggucacguugauaaaauauguaauuuagaaaaacuuagaacuauggaaggaaacaaaguaauaucaagaaaacaagaauccuggaguaggauguaagaagaaauugaccccuagauuugaauaaucuuggaaaaauauaggaaaguccuguaaggaaaauaaaucucugaaagauaauauuguacuuucuaagcuaugccuacaaguauuuuuugagaugaaaauuaauaccauuaugaaguugaggaaagaaaagacugguuuauccucagugaaauucuuuuuguuuuguuuugagacagggccuuacuuuguugcccaggcuggagcauggcaguggugcagucacagcucacuguagccuugaccucccgggcucaagugauccuuucacuucaaccucuggaguaguuggaacuacaggcaugcgccacuaugccuggcuaauuuuuuuuauuuuaauucuuuguugagacagggucucacuauguugcccaggcugggcuugaacuccugggcucaagagauccuccuaucacagccucucaaagugcugggauuauaagugugagcuaccacaaccauccgauugucagugauacucuaauaagagacauagguuacaaagcaaagguuaauaauggugcuguuuaauuuaccaaguagagauauuucauagagauguuucaaacuaguuuuaaguucugaaagugauaucagaggcuguccaacacagagaauaagaaaccaggguaaaacaggaggaaacaggugagaaaguuuuuaguggguuaaaaaugauugaucuuugaaaggccaguuagacauacuuuggaaaacaaaaacuacuuuuggugugaaggaggacauaaucuucaaaacugcaugcuuauaagcuucuguagucuauaaaccuucaggaaacaucacaaaauguauuugcaaauuccauaaaguuuaagaaaaaggcacggggaaacaaccagcauaaccguaaaaaacaaaguccuugcagacuaaguuuucaacaccugaaauaaacaaagaauacgaguuuauaucaauaucuucgaaaacucagaagaacuguacaauuuucuaggaaaauaauaaguuguaaaaguuuacucaagcaaauagaauagaccuauaaucauuaacuaaauuacauugguagucaaaauguauagcuacaauaaaggcacuuauuccauagacaguuuuagagacaaguuuuauccuuuuaaaaaauagcuggcuggauacggugguucaugccuguaaucucgucacuuugggaggcugaggugaacggauggcuugagcucagcaguuugagauaagccugagcaacauggugaaaaccugucuguacuaaaaauacauaaauuagcugggcgugauggcucaugccuguggucccagcuacaugggaggcugaggcaggaggaucacuuaagugcaggaggucaaggcugcagugaguucugaucaugcuacuguacuucagccuggguggcagagcaagaccuugucaaaaaaaauuaauuaaaaauaauaaaacuaaauaaaaagcagcuucuguguuacauuuacuuuuccagauaauugaauggaaaaguuccucaguuccuuauggaaugcuaguguaacccuaauaccagcauuacgugagggcaguaugagaaaauuauagcccuaucuuuuuuuuaaaaacacaaaugcaaaaauaauacauaaaucaauagcaaauugaacuugaccauuuauuuaauuguuaaaaguacauccauaucauaaauguuauuaguucucccuaaaauaaucaucuguauguucaauaaaauuuuaaucaaaauauccaaagaauuuuucauggaaauuaauaaacugguccuaacucuuaacauaaaaauuaagaguaagauuauuauucaagagggaagauauuuuuauuagauauccaacuuaauaugugggaguauaaaaugcuauauaaccacuuuggaaaacuguuugucauuuacuugaaaaauuaaacauacaccuacuccaugacccaggaauuucacuccuagguauuuacucaagagaugaaaaucaguuccauaaaaagaucuguacaagaauguccuuuggauuuccuuaguagcccuaaacuggacauaaccucagcaugcauuaacaggagaguguaccucaggguuguugccucuuggugacaaaguagaugccguaucacuaggcuuuacauccacacuucauauggcacaugcgggaagcaagggguuuuuuccuaaugaggcuuugcuuuuugauuugaaagggcugcuuucccaggcuugauguuuaucuuguugaccagaucuauguuacaugagccccagccagcuguauauuucagcuggacacacacuaaaugaaguuggaguuguguuugaaaagaaggagcaggaaugguagagggcaagaaagugucagcugugucuguaauacuuuauuuucuggaaugagaucugaagcacgugggaaaauaucaacagauuuguuaaaucuaggugguagggacugggucuuuuuuuguuuucaguuuuuuuuuaauauuucauauuuuaaaaagaaaaauagcacaaaauaaugaaagauagugcucagaucaagagcagcagugcucagugccauucuggucaucgaaaccugaguaacagaagagugugcaugugcccuaaguauguaaagaacaucacauuugcaaguuagaagggagauggggaaggugaugauagucugugguugcgaagauaggcuggguaagaugaccuugaaacauagcagucauccaaaaucaugagugugaaggucaaaaagaggugaggaugaccugcuuacgccaacugcuguggcaucugacuuuuggccaucagugucuuuauaaaaaagacacucaugggaaauugcaaguaugaauuuuugagggugaaaugaaugugaacaacagcacauuuuucaugagucacugauggaguugcuacuaggaauccauagucaacauaaugccuuguccuaugucugauguugaaagcaauaccuguagauuguaguacauuauaaucuuguacugucuuccuucacuuaucaccuuuaauugccuacacauuauuacagauguuauagaauaaaugauuacauucuauagaggauagucucauauuuugaaauaccugccugggaucauauaaaugaaacuuaaaauguuuuccuguuuuucugauugggagccuugaauuuugaccaaaugaaguaggagauagcaguaagcuguauuuguguacuuuccccucuccuggcuguuugccucugaauaaugaauuuuccuagaaaaugcuaucugcaggcggacagauuguaccuguuuagaaaaauguaauccugcugaggauauggcuccuuccugguuugcauauuuugcuguuuucuuuuuuagcuuguagacacaguggccucugucuagacugcuggcccugccuuucucuuauauaauucaugccaugggccuggagcacccacgagagucagagccauuuuuuaaaauuguuuuaucugagauguugugguugaaaccauuacucuuaaguuuuuuauuuuugucuuggaggcuaagcagcuuuauauguuugcuuuuaaauuuauuuaaaguuuccugacauccauauuucuuagcuaucuuucuuacuguauuuguuauuuuucucuucuaccuguauguuuuaaugcagucuguuaaaauuuuaauguauuuuuuuaaaaauccaaaaaaaauugauuccugguagaauuuuaaagaauaaaacuucauaggcaguuucucaauuaauguaggaauacuaaaaucauguaauuuccuguucaucaauacuagaaauggcaggcauagaacuuuaaucuagacauuaguuuuguuuuccugaauauuaauuugucuuuguauaauuaggggaaaaaggcuuucggcuggauucacccaaagccagugcucuuugggauuuucagaggaacacguggaccacugaggauagagggcugcaguuggcugcucccuuacuuuucuuccccaguggcaugaauuuaaaacuuaugaaagcaaaaugcccaucuagcuugucaagucgagagugacuucaguaugaagaaagccaaagugcccccucuaaacaguggcacuugcccgugaaagacacaugcuucucagccucagagcugggcuguggugagacagcgcugucuguuaaugugaacuucuaugaugugacauguguaacugcacauaacugcguaugauaagacacauagggcccaaagggagaagccacaggcacagccccagagcgucucuguccuucaggccuugaguuucucccucugaaaaagcagcaacaaguucugguuaaaaaaaaauaauaauaauaaaugaaaugacaucuggcuuaugcacaccuccuggagccucucaguuuccuacuaauaccuaagaaaacccagcaaagggugggagcucacacugugccccacagaauggacaugaaagguaaagugucgccugucccugcuguguccccaccuaaaagcaggggaggaucuuggaccccaucgugccuccaguucugaaauacaacauugguaccagccagaaaugggcaucauccuccacugugugcuucugacuucugaggcugccaaagcauugugaugucucuugucauucuccaggcaggaagggaggaaauaguaaaaagccugcaggggaauaagaaaaauguguaaagaaacaaaagcuauaaugcugggaugaagaauaaagaaaaggacucuuaugagagaauauuuguauucauggucauuuuucaaaccccucccaggagucaccaaauuugaagguuauuauagucaguuaauaccacacacacacacacaccacauucauagcacuaugcugaaugguuuggauuagauuuggaaagaaaaagauagguugcauccucaaggggauuuaagacagagauuguaucuguuuaguuuauuaucuauacccaguacccuauacgugauagggacccaguacuuauuugugcaguaaauagauuaauuuaugaaauaaauugaugauuuuggaauagcagguuuucauucuggguaaagaucugaagaauggaaugaacacaugauguaggagccaaagucugcccaagaggaucuguauaaggaagcccucuaaaguagcaauaggguuaguuaauauagggccuucuuugccagacuuuggaauuuauguuugauuauacaaaugcuacaggagcccguguaugguuggaagaaaugaugaaaugacgcacagaguaaugaguggauccuggcuggccaggucagccuggcagugguuuggcaggaagaggguacugagggcaagagaaucagugagugccccuuuugaguauuucaagcaugccagcuuuuggaauccccaguacagugucccuucaccccucagauuugagucuacuuaagauggcuuuucuuuuaaaauguaugcauuagauucugcuucgugaaggcugcaagaagauucucguagcugacucuuuguccuuacugaagaaaaugcaccgaacucaaaugaaagguguucuuguugaugguggguaaaauugaaauaaucauauggaaccacgugcccugcuuucagaaauggccaagcagguauaaacagggcauaauccaaaguauguguguuuucuuacagaggagaacaucugugagucgugccuuuccccuauucuuccaucagguaagaagguuuuccccaaaaaaaucccaaacauguauuuuaaugaugaguggaaucaaaauuuuggaauuagccaacuaccguuuauaaaacuauauaacuuucagaauaacccaguggagagaaguguuguggcuuccauccugcucaguggaaugcuggugcugccauugcuuagagcugagguucucaagcucuagggugagucaucgucaccuggcaggcuuauuggaacccagaucgcugacccagucagacucccuagagucucugguuccaaacuuccagggcaggaacugagaauguauauuucuaacaaguucccagguaauguugaugccacugguucaggggcccuucuuuuagaacugcuagucuaggguaaaaacaaaaugaaaacuaaccaucagcauuuaaauuucaagguagaagaaccauauacaugucugggaaaaaaaauuuauagguagcauucccuuuucuuuaguguuuuucucugauauaugguucuacaugcccaagucaucucacauuucaguggaaacauacauaaucccugccaucuaauuggaacugugagucuuuaaaagacauaagcauuuguuuauuucuaguucuuggcagauagauauaugucuucaucuguaaugaaaagcaccuucuuaagguuuauuaugacagaagaaauuugcauaauucaaaagcggaaacuaacaaagcauuguuaggaugcuaacaaaugcuuuucaaauauaaguucagcauaacaaaguacuaaaagaccuaguugaccucauguuuacuuaggauuaaaggauuauuucauggggcaguccaugagaaguuguucuacuuagguucuuuucuagaggaauuagauuuggauguuuaagugcuucuguugaaaacugcaugggcucaggugaagaagugagcuuccauagcauuucagacaguguugcagcaaaaaggaaccacauacauucccacucuacaguuagauuuaacuccaaauuuacucugcugaugacacuaaaucuuaccaaaaauaagcuggccacacagagcaggaacagaugaggggaucugcccaagcacaagugcaguaaaaugcaaggucaccacagccugggcuuguaacccagguccgccucugagucaguguguggucuuggcaaagguagcagguggacuggcaaagcauuuuuaugaagccacagacucaacuucagcugugguguauaaugauuauagggguuaggggcgcauuggcacauacacuugcugguuuuccuacaguuguccucaauguagucuggguaagugacacagaggcuaagcaaguaaccugugaaucgcauagcaacaugauuauaauaccuguuuugugucugaucauaccaccccucaggaaugcuuuuguaaauaagccauucucuaaaggcaccuuauugcugaaaauuaaacugcaacucgacuuucagucgggauugguuuaaaaugaucuugcuuguugcauuaaguucuccuccuuucucugcccuccucgccagaugcagcuaagcccuucagcgugguggucuuccauugccggcacauguuccacaaggagugccugcccaugcccagcauggugaguuggcagcuuggcaccuaucaacuagagggaaauuaacacacuuagaggaaugugcuuuaaacuguaacccuucauccuuauggcuguauggguuaaaaaaaaauuacaauguggauuuauaucacauaacaaaaauuaaucuaguuuucaaauguaaaaauauuuagaaauguucuauguacuauaguaaacauaaaagcauacccauuugaaggaauucauucaggcccaguugacagcugucaugcuguagagaugagcaacaacaguagagagccauuguguaucuuauguguuucucagccugauuuguguuccaugaugcuaucauuuuuuuagugucauauuccuccaggucacauuagacguauucugcuguuggguguccuuggagucacagaguaacagcugaucuagacuaaauccuauguuaaccagaaauaaacuccagagaaaggagugccauccuauuacuuccucuccacccccugacuaacgcuaccuuaguguuucugaauaugagaguagaaaaagaagaucauuuuuuaaauauguguuuuuaaauugcauuuuuagaacucugcugcacaguucugcaacaucugcagugcuaagaaccguggaccaggaagugcaauuuuggagaugaaaaaauagcucauuucuccuugucagucuccuugucaccacucuuuuugagacuguuuuugcaacaacaaaagcauuuguugacacucgugcuguuaagagauuuguuuauguuuauauuauacucaaaaacaauuucuucaucuauuccuguacuaaugguuucucuuugcaguucacagagaauuuggggcucucuucaugccuugaaauuuugggguccauagugaauauuuuguuauuuauuuguuuggcucauucuuuauauaguaauggaaacauaagucuaggaguuagaaaugaauuuuuuagaccuuaguaaaaccauuuaaccauaaaauggacaacugagaauucucccagcugccugaaagcgucgccaacugugguuauccugcaagcugcuaccugcaacuuggacguuguuuccacgugcucugcuggcuacgauucuugcauucuggguuuggcuuuuuucugugucaucaacuaugguuauccucuaaauaggcauuuaaugaaacauuguacaaauugucacucauuugaugacaccugggaauaacauuagcaggcugauguccugcaccauuauguuuacuaaucacauguucugugugcugugacgacugucaaagaguaucuggccauggcggacacucagcauuuguugauugaauaaauguuagcucuucucauugugaaggacucacuuuuacugggauaaacaaaugcaguuaagaauucuggcacccuuguaaggaagaaaagagaguucaacaccuucgagucugagcgcuuguggcuagaguuugccaggagggaggaaaccagugacccugaaaacugagggugccucaggagcagugggaccaccugaugcugaaggacggacuaaugauguuuccucuugccuucucuggugccuccauugcccucauggaacagagcauaucauagagggagaaaagucaaacuuguaauugugucuuacaguuacuggcuucaucuuccuugggauauauggucauccucuaaugaguguaaaagugcgcaaaacacauccuuauuguuccugaucucuuagucccauaaaugggaacaaauacagcuuucugcuucuuucuuuuuggggaaaggacagggugcuagugaguacugacagcaugccagcuaccgaagucacccagccauucccaugagcagcaguucauuuaauugucacagcgucgccaggaagaagaucugauaaaccuagguuuacagauaaagaaagcaaaauguagagauguuguugaggucacagaggugacugccuaacuucagagcagggcuucugaucccuuuaagaaauuacagggccagccgggcaugguggcucacgcccguaaucccagggcuuugggaggccuuggcagguggaucaccugagaucgcacguucgagaccagccugaccaacauggagaaaccccaucucuacuaaaaacacaaauuagccaggcguggugguacaugccuguaaucccagcuacucaggaggcugaggcaggagaaucacuugaccccaggagacguagguuguggugagcugagaucgcgccauugcacuccagccugggcaacaagagcaaaacuccgucucaaaaaagaaaagaaaagaaaagaaaucauagggccaaguucaaaggaaaugcacagaacauaucuucacauuagaguuaagaauucucuagcaaacaacagauuuuuuuguuguuguuagucacaaauacuuagaacuggaaggcucuuuguuauuauugaauguaccccucagccuucucagcauuuccuuaucccaagacuagugugcuuucugcuacacugcuaguuuucaguuuuguucuuacccaauuguuuuuucuuuucaacauuaccaauuuacagauucaguuuauuacauuuacauuaauccucacuuaugauuugagcaagcucauuuccagaaaaguuuacuuuaagaucaucaauaggauuugcuaauuucagugaagucauuuugcuucagggguaaauuauccuaguuaccaaguccuauuuggacauaaagaaaauccuacuuauagaaaaggagaaaauaauuaaacagucuucauuuuuaaguaacugauuuaaaaggaaaauaauaaaauauguucguuuaucauuucagaaauugcuguaacacacuggaaaauuccugaacaauauagauuuuaucguuaauaaaaaacacuagcuuucguuccuuagaaugucuuuucuuuugaauaaacaguauugggugauuuauuaaaggauauucaauccuuuuuacuuuucaucaaccuauaagggcuuaaauauggcaaaauaauccaaguguuaguca

SEQ ID NO: 17199 - RNA, 596274 nt, Homo sapiens
gaucugaggcaugcaugguguuugacauuucugucuuuuaaguagggggacuucaaaaagucgugggcaucccccuaggcaaagugcagugggcagggaccaggcagggugcgggcgcaaggcgaacgcgcagaccacgaguguccuggcgcaggugccgggggcggcggcugcaacuccgcagcguccgcucgggaggagaguucgcggcugaucuccggaugccuugcagaugcaaaaugugucucuggccagcaggaggaaggaagaggaagugagagcagcggcagccggcggugcagcagccggccgacccagaguguaagugcgugugcuggggcgagcgggagcgggcgaggaugggcacaggauagaggcagagccacccacgccgccgcggccccacgcugggcgacagagccuccaguuccccuucaaugguggcgggucgccggagcucugaucgccgggaacccuugccgcugcuguccugcgaccccaagcagguucguaaaguuuccugggcuggcgccgcgccccgacucgcugaccucggcgcggcaggggagggggccgggacuggggccgggaggaggcguccugcuccgggggacuccgggcgccgcggagacacuuuuguuuccucccugggggcgccgcggcucgggcggggguggccgccgcgcucggcagggugagggcugcgggcgcgucggggcgcucugcaguuggggaagucugagcuccggggauggcgggagugggagugggagcggagggagggggcgcuggaggugcggcgcccgcggaugaagcgcagggcccggggcccgggagcccgccgagacauuucgaccagggucugcgggagggggggcgcgggaggguugcgacgcuggcgcgggguuacuggggacgggggauguggggcugggaucuuggagucaagauuccuauagagcuagagaagcggcugcggcucagacucggcgucuucuccugcacucggggaugggagggaaucccccggcgagcgcgcucgugggagggggcggugaugggccagaggaaugggggccaggagggccggagagggcggucugggcagccgggagccccugagguucugguuaguaaauacucuccucccggggacacaccggggucuccgccgagaccgagagaggcggcggggagcuuuguggagcuucguggaaaucucggcuucggagaggggacgcaccgggcgcgccuucagagaagggggcggcggcaugccagggggcccgggaaucggagcggagaguggcgacugcgaucgccggagucgcuuugaggaagaggaaauacagaacucagcugucccgggggugcgcgcguguguuugggguugggaagucggugcugugccgcgagcgcgcgcgaggcggcguguguguguguguguguguguguguguguguguggugugugcgcgcgcgcguauguauguguguguggugugucgucggugugugugugagugugugugugugggggggguguugugggugugugugugagucggugugugugugugugaccgcacagccaggaacuccccgcccagugacccucucccgccuagggggccauuugaaguuggaggcgggucgggaccugccuugaccuaaaggaccagccucaggcuuggucccagguagugacccagcucugagagucccuggacggcucccgagacucagugaauauauuugggaugccccccgcgcuggaucaugggcuucccaacaccgcuggccuugaaugauucgggccuaauucguuaugguuaagauuucagauaaucuaagacggguugaggccuccagaagcggaggcuuccuguugggcgcugccagugacuuggggaugaagcuauggaagaauaucugaguguuucucuuuugcuucuauaaaaguaauuaaugaccuguauuuacacaccaaaacccugcgagcaacuuugggacauagagggauauaauccuucucagaaucacuuugagauugcaaaaaccggcagcagcuauuauuggggucuccucuggccaggguucucauauuaucucaccuccaugccuacuuuccaagguuguuucaagcauuaaugucccauaauuuacagaucugggggaaaauaaugguaaguuaggaggccagauccccugcagaaacaucacauauuuuuaauuuuucuuauagcugaccuuuugaagcuuuacucuuuauuauuguacauuuccuaucucuggaaggcugugguuaaaugugcaugcugccuuguuucuacucuguuuuguuuguuuuuauuagguugguaaauuuugagaaaaugaccuggacugcugggacucuuggggagggguugugucaggaggguacugaacuggagaacaagaaguaugguagguaucagggaggggcaggcucggaggcagacccggaugggagucuggggaaacucagggccuggagcagucauugggcaagaagaugggcaguucuagugauggucaugcuuacuguccuugguaacugcaggcacccucaccgucuuacauucuucuuuuucacugaguucucucccuagggccuuugcccaugauauuacaggaggagcuuuucucccacauguccagaugacucacuuccccugcuucuuucaggucucuguccaguugucagcuuauagggggccuucccuggcuaccccauauaaaauagcagccagacacucccugggccucuuauguuacucaguuuuuugucuuaguaccuuuuacucccuggcauuauacagucauugguguauuuugaguauugucucucucccuguuagagcagaaguuccaugaggguagugacuaccuugucuuguuuacagcuccagaaccuggauggauucuuagcaugaugucggugcucaauaaguguuuguugacugacuaaaugagagguggcuauacugggagagauccaccagggaaauauaccaggaaaauguugcagcauuagugcaagugagaagcccagguaaugggcuuuugcuuuuuucgcuguccuuucccccaugccaggccacucuucuuuuagacucuguucugccuugaguagacuccucccuuuuucugccugaagaaaggaacagagaggugauuccuugggagauuagauaaccaguacacuuaaugacacauaaccauuccagaucugguguuucaucacucuccuuggagaaggucuuuuaaagaagucuguguugcuuuagccuaggaggaagggcaugauuguaaggggauugaagucagaggcaucuacugugucccauucugcucuccuacaauauggaagugaagacaggaggcuguaagggaggcuguguggcagaugcaggggagaugagaaaugccuaggagaagaaaaauaaaagugagaaaacauuaagguguucugcaggugcagcuaagucuugaacauuuacuaaauuacuauauugaaaagaagcuaacucuugaguguuucaaaguaauuuaaccccuuuggguguuuggugugaguggguggggcggguggggaaagggcuuugaagccuuugcugaaggauguggcugggggugaggcaaggagcucaccugaucacacacugugcuuacuucaucagguugccuaaugcucaaggguuaaaggugaucauuccuauggagguaacauuucccuuccagaucuaagacaguggauacaauuaagguuuguaacucaagcuuguaaccacuuuuuggugccugaaaccauccaaguagauaguuugguuuauaagacauucuguugaaucuggaaaacgugguggauuaagaaacccucucugcaucacaaagccuggaguguuugcuacuaauugugcaacuuuaguucugguuccuucuagucaaccagagaagugcuuuuuaagcuuacggcuguaacccaugagcggaucaugauaucacuuuaguaggccaagaccagcaguuuaaaaugugaaagagaagagugguguggaaaacagcauuucauaaaacagacacccagucuuaaugucaaaguauugcucaguguagguaacgauuuuaaaaagccuguuucaauaauucuggggaaaacuacauuuuuaaccaacuugccagggauucugaugacgacguucuagagggcuacaagaaauacuuagcuaucuccuuuuaacaaaauacuguugguuuaacccccugcaggagaugcuauuuccaaauguugaaccagaugcaguucugucggcuauugacuuaacuuuucaaaaugcuacuauuggccgggcgcgguggcucacgccucuaaucccagcacuuugggaguccgaggcggguggauugcgaggucaggagauccagaccauccuggcuaaggcggugaaaccccgucucuauugaaaauacaaaaaaaauuagccgggcgugguagugggugccuguagucccagcugcucuggaggcugagguaggagaauugagugaacccgggaggcagagcuuacagugagcugagauugcgccacugcacuccagccugggcgacagagcaagacuccaucucaaaaaaaaaaaugccacuauuuguagaacuugccagugcgcuaggcccucaugcugccaucuuggaggaacuagaaacucaagugacaugcuuuucacuuuagugaugcagaaaggcaguagcucccuuugcaauaacucuuuaaccuuacuuagaauaaaaucgacagacuauccccuuuucucaccaaguuuuaguuuagaacuuuugaggucuuuggaaauuuacucugcucaacuucuccuuucauauuuuacaucuaguguuccccacaugaaugauucuaauuacaaagacaguuguaaucucuucuggaggcagccacacugcugggaugcaugauuaggugaagcauuuuagcugaccugggcuuggauuggcuauccaaagaagaaagucaaaggcugacaacucagccugggcaacauagcgagaccacaucucucaaaaguuaaaaaauuagcuggguaugauggcaugcaccuguagucccagcuacuugguaggcugaggcaagagaauggcuugaguccaggagucugaggcugcagugagcugugaucucaccacggugcuccagguugggggacagaaaaagaccccaucucuuuaaaaaaagagucugagaacuucugcacuguccauaauaaaaggaucaugaaggccagucauuccacaggguguggcucccaggaccauguguguggccaugaaagccuuccaguaugccagcacagcauuuuuagguucagcaaagccagccugcauguacaaugcacacacugguugcaaugcuuauuucccuggauaauuuggguuguuugaguguuaacaauuggaacuuaucuauauuagccagaacuaaagccugcaaagccauaucaugauuccugauuacauuaacuacuugugucuuagugcuguauuuucuaaccuguuacaauauaagugcagguacgguacgagcagaauuuggucauuggccuaagguggggugaacaguuaaguaucagauaggaauacgugugggagaaggaaugcuagcucaucaaacagaauuaacuacaguaacaaacuggcauagugcugagucgagaaauuagucacauguauaaauagaaggagacgauucucaguguuccgggcccccacaaacacugauuuccagaaucugaacagaauuauuauuggaacuucaauuuuaggaauugaggcuacaguuuugacuguuuuaguucuaacaguuaagguagaaaacaaaacuuuccucaguagaaaacacuggagaggcacaacuugcuggacuaaggacugagauguguucaguggguuguacucuggauagggaauggugguuugagggaaugaaaaucagguaagcccuauaaagcauucucucaguggagguggagucauaggaucaaugcgacauuuuucucuguggccugacacacccuuccucuggggaugcuguuuuggaaaugauggagaacagucagaauaguauuguuaucccauuuuacagauguggcuuggaggaaugaaaugucacaagcauacuuagagagugcaucugagccuuaaacccaacuuuucugacucguuuuacugcguuguuucuuucuccugcaccaugaugucugcacugguuaguuccuucuuuuguugguucacuggacuugccagccucugaggccaggaugccauguggagcuaugcugcagugguguccagagaggcucuucacuccuguauguccugcagauggaugugcccuggguugccaugguauccagggaugucaaugcugccacugaguccuaguucuucagagucaaucccucucuuuggguaucucauucuaaaguugaccuuaguuuugagagucaauggauucuucucucagggacaguauguccaucagccaaccucaugauauugaagcauaugagcuagaaugcaauuuauuaauaaaaaaugagaacaguauuugccaagaagaaugggcguuuauucuuuagccaacauuuuuccucuguggaugagucauggugaaggcaaaagcauggaaccaccugggaaggaaccaguuggaaggggaauauacuugacaguguuuuccagcuccucauaacuuuugcuaauucucuuguugauagauucauaccaacuaagaaaaccagagacuggaguccuuugaccgugaugguuucuccuuugggcgaugcugaggcuacuuguacgguucuuuuucuacuuguaggcuguuggccauuuuacugacccauuauuucaggcagugucagccucagugcuauugacauuucgggcuggauaauccuuuguuguaagggcuguccuguguacugucgaauguuuacugccuucccuggccucuguucacuaaugccaguacauuagucguuugugacaaccccagaugucuccagguauugcagauuguccuaucaauuuuccuguccccaagcugagaacugcugcuuugucuuccuguguuagugagaccaguuguguguuaucagauagucuagacuuucaacagcaguuauaagugccccaguuuucuccuuacugguuauuccuuagagucuaaggugguguauuaauaaaugagagggcucacccuuuauguucauuucuuuccuccagcucuccaaguuuccuuucuagcucucuucucucuuauacugcaguuguuucucuaauccaaauguuuuucaaguuuccuuuccaugcauguuucuuccuaguaccuguggcugaaaaacacuguaacuagugaguuuuugucucaguuucuuaacaacguuuugaauucugaccacugguuacugccuuaacuguaaccuuuacauaauggcaauaagauaaaugaaaugagggagguggguagcaaagcucagcuuggcuuguucagaggccuuugucacaagacaaaggaaaugucugugugggaaugaguuaagugaguucagugccuccuccuuugcuugucaaauccaccuugacuaguuggauaguaaugguuauugauauuccauuagugcgaccaggacauuguagcaggucagggagaagccuucaagguacugcuuuaugcgaaguccuuucccacuuuguauauuagauuucuguccuaaucuugccauguuaacuuucuuauguaauuaucugucagccuuuuauuuaccuucucugcuuggcugcugucguaguccagaacaccaucgaguggcuuaagugccguagaaauaugcuggguuauagacuagcuaugacuccccuaggcagccgccuucuuacaguucaccagcccuauagcaacccuccacccuuccuuccgcccuuugugucuuuuuuuuuuuuucaguucagaauugcauuuagaacgccagaguuuugugcugugggguucaguggcagagcuggaugagcuguauuuuccaggcugcuacacacaauuacccuuaauuuugaagaguaauccauuucaaaauaauuuuuuuuuuguuuuuggucucuuuagcccaaaugcguaaccacagcuggcuuuacccuuggcccucagaaagcauguggcuugggagguagagcuaguggaggaguuuggucagauugcucauuuuuggucaagugaggagugaauuccaauaacacucaguaaggcugguuuuuauuugacucccguccaccccuccaacucuccccaccccacaguuuccuagauuuuuuuuuuuuuuugagauggagucucacucugucacccaggcuggaguguaguggcgcgaucuuggcucacugcaagcucugccaaccgaguucaagcgauucuccugccucagccuccugaguaacugagauuacagaugcccaccaccaugccuggcuaauuuuuguauuuuuauuagagaugggguuucaccauguuggucaggcuugucucaaacuccugaccucgugauccacccgccucagccucccaaaaugcugggauuacaggugugagccaccacacccagccucuuuguuuuuucuuucuuuuucuuuucuuuucuuuuuuuuuuuuuugagcuagagucuugcucuguugcccaggcuggagugcaguggcacgaucguggcucacuguaaccucugccucuuggguucaagugauucuucugccucagccuccccaguaacugggacuacaggugccugccaucacaccuggcuaauuuuuguauuuguaguggagacaagguuucaccauauugaccaggcuggucucgaacuccugaccuugugauccgccugccuuggccucccaaaguguugugauuacagacaugagccacugugccuggccccuagauuuuuuuauaguggacuugugccucaguuauuccaauugugggccacucugggaagugaccacuacucagaaauuuugguuugggggagugggaccgauucuuugauauauuaaauaauaagugcuuuguacauauaugugugugugagagaaagacacacacacacacacacacccaugcagcucuaauaaugaaaggccuuuagaagcaaagaaacaauuauaucagcugcuaaauccuguuuucuccagugcugucacuuuuauaguaagucagcacaaaucacaugaaauuaaacauuuugucaaggaaugaauauguuuccaucaucucuaggcuuacuccacugccaggaagcgacuuugacucauuagaacuacuuucucaauuacuguccauucuccaacugaagguuuuugagaaacauuugcuuggguuuauaugagagaagcacaguaaagcuuuauuuauuaauuguaguauauuuuaaaaacagauguugagcuuauccuuaaaauguauauaaauauuuucaagcuaaacuauugcugggcuuauagcccugaucauaaugcuucauucagucauucaagucagucaacagccacuuugcuuguaauuuguaugcuguagccugggcacuccauauguggagaagggguagggagggcuguaacaggcaaaucuguuuagagacagucauaacaguaugcuaaagguauguuuaccgugauugcagaucacagagguagguguucacaaaugaggugacuuuugagaaagaucuggaaagcugaguauuaagagaaagaauaugauacauccagggaauauagcaaucagggugauggaggacagucuggaaggggcuuuaugucagcaaucccaggagcugggcauuuggauucagcagaaaggaaagccaaaggcuuuuaggcaaggaaaagaugcagugcauuccagugagagcaaccuggaggauagauuagaugguacagcuggagggaggggcagaggaaagaugggagcuccugcuaggccugcucaaauaaauacauggucuuggucagaugaauaaauaaacaaagcagugugcuugcugugccaaugcaacuaggagacagguuguccagcccccgccuuccagcgggugccagccagagucugagcagagguaaaggaggggaggccagcacucaccguguuugccuguagauauugaugacaaaauuaaaugauuugcuaagugauuggauuugggaaaaaggagaaggagucuuugagguuuaaagcgccauaagcacauacuuguuaauggaggguucagaucuccuguugaguacagcagaugggugacuucagguaaguuagugaucuuccuuagccucaguuuucacaucuuucaaguguagguaauauaaguccccaccucuucgaguagcugagaugauuaaaugcaaucaugauuguaaaguagaguacccuaaaagcguuggguuggauuugcuauuauuauugagguuauuaucacugauucaguaguguuuuuuuuuuugagacagagucucauucuguugcucaggcuggagugcaguggcgcgaucucggcucacugcaaucuccgccucccggguucacgccauucuccugccccagccuccgaaguagcugggacuacaggcucccgccaccacgcccggcuaauuuuuuuuuuuuuuuuuuuguauuuuuaguagagacaggauuucacuguguuagccaggauggucucgaucuccugaccucgugauccuccugccucggccucccaaagugcugggauuacaggcaugagccaccgcgcccggcccgauucaguaguuucuauucagguucuuuauuaaacuaucuugcugaaaucauaaaaagagaugcauuuuguauuuaauuuucuucaagugaccuagguaacugcuccuaaagucuugacuagaauuaguuugcuuuauaugucuuuucuucaagaaaacaagaggaaaggugggguuggcagggaaagaggagauguuggucaaacccagauagaaaguuucagucagacaggaggaauaaguucuggugauuuuauuacacagcaugguggcaauaguuaauaauuauauauuguauauuucuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuuuguauuuuuuuaguagagacgggguuucaccuuguuagccaggauggucucgaucuccugaccucaugauccacccgccucggccucccaaagugcugggauuacaggcgugagccaccgcgcccggccuauuguauauuucaaaacagcuaaaagaggggauuuuaaauguucccaccacaaaggaaugcuaaauauuugaagugauagauauguucauuagccugauuugaucauuccuuagguauacauguaucaauacguccaauuguaccucauaaauaugaaugauuacuauuuguuaauuaaaaaugaaacuuaaaccaguacaggagaaguaccaacuguuaaaauacagacggggaugaguuaugauugacugugaauuaaaauaacugauguaaugacugaaguuagcaauuuaggguccucaaaugaaagcucuucuaauguguauccccaguuccauuugaacuaaccugagauuuuacuguuuuauuguauuauuaauuuuuuuuuacuuugaggggagagaauggagauggcuccauuggagcucuuucccuuuucuugauuccagcuuuugagguuguuugcauuuguccaagggugcacaggggcccugggagaaaccccaugucauuggaguaacagugaaggagcaauugucaggaauuucauucaguugaacuggguuucauaugauuauguugcauauaaaggagguucaauggguccauucaugcuuuggaaaugucccuuuuucaaucguuuggaaccuuccaccaaguaggggacuguugaaauguucauuggcaggugggugguuguaaauuguuaaauuuucuucuuuaaucugagccagaugaucaagcugucaaccagauuagaaauuauccugggaauaaaaauagaaaaauaaaagaagaaugucuguagucccaaguguacagacccaguguggccccauugucccagcacguucaauuacaccagcuuucacuuuccaagugcaguggguuggacaauucauuuuauggccaccuaaguggaagccaccugcuuccauuuccaaucgcucucucuggauguggccgguuuguuugggugcuuuuucuacuuauugcuucuucagaaaggcagcaacuagcuuacaggcacaccagcucauuaagcaguagcucauguacccauuaaacagucacuuaguaacagcuuuuaaggaguggguugaaaagagagaaaccuucaucuagacacuaaaaugcccuggauagaaguaugggugucagagagccaugugccaaacagaaacugcuucuccaaauuagugcuuugaaagugauaacuuuuggucuccaccuugacuuccauuacuauagucaugaaaaucacuugucuaauggcuguaugcauaucuucauuggaccugacaaauauacagucuucagugugaaaaauuucuggucacuuuauuuuaccuaggagagugguaaacauggguuauucagcaacuacaguguccgcuguguagcaacgccucuuuucuauauaucaggauugguguguaccuugaaauagaauccaaugguaaauauauguuuaaagacccauaagaagacuuagauaaugaaauacagaucuacaguaacucacuggagaguuauguucuuaccaaaauaucuagcagcuuaaaagugauuucaaacauguacccauuuuacagaugagggaauucaggugucagggaagcuggcugcccaacuucacauagacucaaaaccauacccucuuuucugcagcauaccauaugguacauaccccugcugccaaguuuucaucacuuuugccucaguugaaccugcuacacuggaucauuguguugaguugagcuacuuggugaaggauggcgaaugauuugcugccucaggaguguguaaaagagcaccgucggggcagcaaaccauuaucccagcuguggcuaaggaugguagagagaagagcguguaauagagauuccuuuaaauacccagugagacauccuuccagucauaagcguugucauauaauuauugucaacugguuuagggccauguugaaucuuuucaaauguguugcuaaccauucuagcaugugcaaguguguaaugaaacagucugagacucggcgucuggaccugggaaugauaagacaggcagaugagggugucugaaaauacaagaaguugugaaaauucucagauuuguuuuuaucucaacauauaucuuuaagacaauuuuuuaugacuagaucaaagcaaggcacagagaaauggcauaacaguaguuuuaauguugaguuucacccuuucgaaauccagaaguuguauuaggaauaguuugguccauccauuagaagugauaagugcuuugaagaguauuggaucguaugcaggggguggaaaccacccuaggacuuuaguccuuggcugggaagagacugcugccuuuaacuuucaggaaagggauaggaguauuuuaaauucuuaauugcuacugugugccuggauuuguuccagcauuugauuuggaaauauucuuuauuuuucuucuuuuucuuuuucaaggcuagucaagugaaguagugggaguggagaaggaacaaagaaaucuguaaaugguuaagaucaauuaguuguaaacaccucggcacuuggaccaaacggaaauauucauuuguuaauucacaaauauuuauugagcgccugcuguguaccaugugguguacuaggugauccauaaacaauggugagccuccuuccaagagaaaaauaggccuguugauuucaugggcugggcugcuuauacauuagaggaggaaguuugcauugaucaaaggaucacacaaauaagugugauguuuaaacucugcuaagggcuguugaagggggaguuacugaugcucagggcgccuacaacagggagauuaauguagucagggaggucagggaggagggugaaagaauuuuacuggguacagacaacuagcacaugaaggcuguguaaaaggcugaccuuggauguugcaggaacuggggagcagagugccugaggcagggagcacuccagcguggauuagacuggagaggaggccugauugggaucauggggcugagcuuuuaucaaaagggcaaagggaagugacugaagaguuuuacccaagggagugacgugaucugauuuaugcuuugaaaagauccuucuggcuucaaccuguaaauuuuacaucauuuaaaauuggucacaaugugacuguacaaucacuccuguuagaaucuaaccauuucuaaaagaaucaauuuagccacuagugucuucuuuaaauuuuaaacagcaauuuaaaggagugauuuagcauggguaaugcaaccacuuaggaaugaugaaguaccuaguucugugguucucagacuucagaaugcuuaagaaucacuggggacccaggaaacagcauuuuuagcagccucucaggugaucccagugcacguggucccagacuucacuuuucuuuucuuucaagaagcaucauccuacaaaguggugacuaaaaaaaauuauaaaccucaagguaccaccuaaugaggcaaccagaagaggauggaaccuccuuaucgcccagguuugaaccuggaucuguucucccaauacuggggggauuuucuuucagugcacccaaaauggauucuaaauccuuugaguuacuuuuuucauuuauuuucuaauccuuucauaugcagcuguuuucucagaucuguggcucacucucugugugucucugauauuuuacuuuucaucuuugucaccguuuaauaaaaaucuuguuccauaagucccagaugagguucggggacaggcagggguucugaguggguggguuagccuggccugaugaggaggggagaugagaagccccucuguagauuuuacuuauuuugcccccugcagcaggagacagcgcauguacaggggagaaacuaguucaugacugccaaaauagggaauuguuuucagggacauaaagacucagagacaccaggagaauucguuuuuggggggcuuuccuugaggcacccugcucccuggggcccguguucaaguacugcucagaagccagcagugagggauaaggugggcucauguuucuucccuuacaagugagcauaagaccccagaauuccuaaucaggugaaaucggguugaagugaauauuaaggggaaacaccaagcaaaagagaagucaugccagaggugucuggcaguuuggugggcugggagauagaggccucuggcuuccuuugugagugaagugccuggaccauaugauauguguggauggucaccuccucugagaaccuuccgugacuucuagcauuugcuccuuggacacaugaagugcuucccucugcuggcauugauugugcuuucacacucuguuucauguccuucucucuuaguagccuggagggcucacggcagguguucccaggcugagcccauaagaaguacucaguguaugucugcagacagaagcacuauuuuccauguaugugagcacuguguccuuuuaacaguccuuuaaaaugguuccuucgucuuugaguaagggcccuggggauauuguauuuagggaugccuggcauguaacucucgcuguccucaauuuugcugaagacccaaggucacuuguugaggagccucuggguguuggagaggcacacggccaugcaaugcccuaacccuaggaggcaacaguuacugccuuagugucauuccacugugccaaaauccacucuagauauaacgaacauuacagaagaagaaaccaacauuuugucauugcauuacucucugcagaaguauucuuacuugcuugucuacuuauaauucucuacuagucacccaagagccuacagggcauagacauuugaagaccauaacuggaaagaacauagaaaacguuucuuggcuuuuugucccuucauccacgguucagccaguguugaauuugaagcgucuguuuuuuccucccucccuccccagugccugugggugacgaggcaucugugauacacauuggggguugggauuuuuaccacaugugugguuacccacauuucguuuauuacauucugagagcaccguggccuugauaauauacguuucuagacuauaauugcauauuauuuuucuagcaguuaucagggguuucagcuagcaauugaaacuugauagugucuuggcucuucaucucuggaacaauuuauccugauguucaagugcagagcugagcccauuucuuauaagccaaguagcacacacaugguaaaaccccaacuuaaguguucucaguucacucuggaaauggagcauauucaggccuuuggaaccacguucucagaccuuucauauccccuuucucccucaauacaaguacaauaaccaaacaacuccuugcuuccccaguguggagaacuuggcaguugcugagcauaccuauuccaauuauucauuccagaacuuaagaaauguccauaggcugaggugugggacccacuggguccacugugagguggaccugaacuaaaacuucauagaucaggccaggugcgguggcucacaccuguaaucccgacacuuugggaggccaaggugggugaaucaccugaggucaagaguucgagaccagccugaccaacauggagaaaucccuucucuacuaaaaauacaaaauuagccaggcgugguggcauaugccuguaaucccagauacucgggaggcugaggcaggagaaucgcuugaggcugagagacggaggcuguggugagcugagaucgcaccauugcacuccagccugggcaacaagagcgaaacuccaugucaaaaaacaaacaaacaaacaaacaaacaaacaaaaaacaaacuucauagaucaccuggccuccauaagucccuacuaacugaggccacagugauguuuugaguauucugaaauuaguguuaguucagagccauuguccauuaguucccaaaacaucucauuauuccuuuuuccccagugcacaguuacccugguaaaagguuguacauaggucuucuuggggaaggcugggagaaagauuaacagaauacauuucuggcaguguaccaggguccuauuucaaagugacccagccuuccuuucauucuaguugagccaguguaaacucacuauaaacugacucucaagucugaggauugguugagggaccaugacuguuuuuaugauucauauuagacuuuuguucacuugaccuagaacuuuuccacuuauacacaucaaguagaaauuuaguaggcuucucaucuauucccacuuuuagaaacacuaugaucaucuagccaauaguauagcccugugugcaaguuauucuuuuuuaaauuaauuaauuuuuuuuuauuuuagagacagggucuugcucugucacccaggcuggaguacaguggcauagucauaacucacugcagccuugaacuccugggcucaggccauccucucaccucagccuccuaaguaacuaggacuauagacaugcaccaccaugccgggcuaaucuuuuuauuuucuguagagaugggguuuugcuauguugcccaugcuggucucaaacuccuggcuucaaguuaaccuccugcuuuggccucccaaagcacuggaauuacuggaaggagccacugcaccuggccaagguagacuguucugauugcuguguugaccuugcuguccauuaagguaacuaugccacacuagaaagugcucaaucaggcuuugugccuguugcgaggcuuggucccauuuguucccuuagacacuucccugagcugccuugugggauccagaccuacacagauccauguugaaauuaaucaccacccacuugcucugugacuuaggggaaauuuauuaaguucucauagcuuccguuuccucuuguauagauggaaaugaugccagugugugguugucaagauaaaaugaaaaaauguaaucaacaaacagcagaauucuuuggccucggccggcauacaguagaugugagaguauguaugaguuuugaaccucuucuccaaaauucuguggccagaggccaucgcggguugaaagggauggaauuaggagacaccggugagcucagagaugcaaagaaauuucacagcauuuucuguuguuugcauuaagacuuaaauuucaaguuugcuguguuuuccaguaucgcaguuugauuucuggauuuugguuuuuggucgguucagagaaaauaaggucugucugggagaagcgaccauuuuuauacuucccauacccucugaggagugccuuuugugagcccuauuuguggacuucauucauuaacucauucuuugggcacuugaggccaggaaaugacgauacauguggagugccuuugcccucugcaggggaagaugaggucgcagugggcacagcuguaacgcguggcugauacucucaugcaggcagaaacccagguggggauggcagaagaggccuguguccuguuggccaaaaaugugcuucauggaaaaugauguuccugguggagcucuucgggaacuggugguccagacauugaauuuggaaucaauaggccagagcccuauuuuuggggcugaaccuaacuguugucugugcucuccgucaaugccaaauuuuucucagcuauuuauaaauguggagggagggugcuaggugugauugauggaucccaaacacaaaucuguaggucagucagcugcauucagaaucaucucagcagcuugcaaaaacuagaaucugggaucucaucacuagaaauucugauucuggaguaauuuccuaaaaucucuauuuauacaaagacucugcaccagguaauuguagucugaagcccccuuagggaugcccugaauaucuucuaugucccucuucccucuaguuccauuccucauccuucacauccuaaugccaucuuaaaugucucuuucagaaaaccuucuuggccucuaacugagcagcccuccauagaggauuauuaguucaugccucugugcaagaaagaaaaacaaaaacaaaaugcaugaguucauucacucucccaucuccccugcuggccugagagcaccugaacauagugaugguacuguagccagucaucugugcauccucugugcucugcccacugccuggcauguagaauaugcccagcaggggauuuucagagcugaccagaugggagaguggugaaacugaagaucagcccuuuucccugccuguaagcaccucuaggaaaagauuuaagagauguugcaaacaaaucacuccaacguauuugggauugcucauugugaugccugaucugugccagccucuuccuaccacaucuaugacuguuacagggguaacuguuccaucccuuagucugcagcacccggaauggauguggaaucacugaaggaggugaguggggaagaagacaaguuggauccugacaguuuaaacccagguguuuugcaaauccaucccuuagucugcagcacccggaauggauguggaaucacugaaggagguggguuggaaagaagacaaguuggauccugacaguuuaaacccagguguuuugcaaauccuuccaaaauaucacuuggcuuuuccucuccauaccuccucccuugcccaguuggaaaaaauaacaacaacaacaacaacaacaacaacaacaacaaccugcaguacgugugcccacauccuccucuggaugaaauagaguugcacagagaaaaggaaaguugauuuccuaguuauucucccacacauggaguucuggguggcaccaucccacacuauuugcaucacugagcuacacacucugccaagacugccucuuaaauuuaaacacauuuugaugaaaauagagaaaggcugaggaagaaagguuaacacuuccccauaagaggugcguaagcacuauacaucguauguuuuucuucuggcucuuggauuaggacagaauguuaauuaaaaaguaaaaagcugaucuucugagcagcaauuaauuucaggauugcucuucuuucaucuguugggucuuugcauuucugaagacgugguggaaaauauuuccuaggggucuuucuaauacacauuuucauuugauuguuuugaucuuuaggcuacauguugacuuaaaaaggaaccaauauuacaaaaagaaaugucauuccaagguucuggauucugauuaucgcucuggugacacagaugagauuggcuccaggcauauacacauugguuagcugguucugcccaaucccugucuggaguugaauguuccauuuagucaagacugccaagcagcaacauaacuggauucauuagcuugaguucugaaagcuccucuuaaaaguuguuuuuguauucauacuacuuuaauauuuagggacaggcugcaccauuuucuagguugcaaaagugaucacucaguuuuuuuuuuauuaggugcuauuuuagauucaaaaauauuuuauuuuuuaugaacuguuuugugccuuugaccuaguucucuuuucacugggauauguauccuaagaggaugagguuuaugauauuaauaauaccugcauuauuaauuccuuucaaaugaaaccagcugucucuguuccccuccaacgugugugugcacacacagacacacacacacacacacacacacacaccccaagcauacauccuucauguagauaaaaagauaaaaugccuuugggguaucuauggggauaacuuauuuuucuccccuauugaucagaaugcauggaggccugggaaacucugcuggaguacccaaagccuccaagcuggcagacuugagcacuauugucuuuauugcuucuuuuagcaggauuuuccuggggauggugaaugugccauaaaguagggcccacaggccuugcagaaauggaagagcaugccauucacugaagaaaugagcugucagcucccuucuccucuuacuauaauuugcuacagccuggaaaugaaaagugacagcuauuaaaagggcuugggaauaauugcaguuaaaagcaaaaauagcgauauuauccacugccacuuaggcucacuuuuacuuuugaaaaggcucaauguuuggaguccauaaaauguuugcagaauaucauccugagucauuuuauuuaugacuaaucuaaaauauuuuuauagguuuucagccaucccauagugguguugguuuugguggcaucugaaggagggugauauuccuaucagagugaucugugacacguugcaguguuggucacugcugacccagacugaggugacaggauucuuccaugcagagcugcaagaguucuaaagcaaguguuuuuccuggagggagagcaauggcuuuuugugaauuuuaguuuuagaauuugaaaaagucuuagccugaaacauaucuuuaaaaaugccuccucauaucucagcuaacguagcacaucacagagaugucacuguauucuggaaguugaugucauucuuucuuuggaaagccauagagucaucuccgcaccuucugugaucucugauguucagauguuuagccuagaaacuagauuugaaucucguuucuaaagaagacccccuuguggucugaacuacuguauugucuuagggggcucagguuaguguuugcaaagguuaguuugugauuuuuuucuuuuuuucgggaaaaaagacguagaaucuuuuuagcagaaggaucuuggauaaaaauccugaguaaauguuucucgguguauggcauugaaaaugaguuagguauaaugcuggcuuuuagggaauauuuaaauaguuuuuuauucauuuucaugugucuuggaaaaagaauaacaaggauauccaaccugugauuuccuagauuuccuuguuuaggaugagacuaacaugcaauaauuguaagagaaauacugaguaaaauagggcugggaaauggucuuugaagaacuagaguuugggaaacacugauguaagccaaaaaccuggauuuugucugugacacuucugaggcgagacaaggacugacuugccagaguuuaccuguuggugaccuugagacuggaauccaaacgagaugcugguauguuugugaauaauaacaaggagagcugaccuuuacagagcgucucuugugagugguaccaagugauuuauauauguuaucucauuuaguucucacuucaggccuuuuuugaauuaauuacuacuaguauuuuauuuuauagcaaauacaagaugggugugguggcucacaccuguaacccagcacuuugagaggccaaguagggcggaucgccugaggucaggaguucgagaccagccuggccaacguggugaaacccugucuccuacuaaaaauacaaaaauuagcugggcuugguggcgggcaucuauaaucccagcuacuuuggaggcugaggcaggagaaucgcuugagcccaggaagcagagguugcagugacccaagauugugccacuguacuccagccugggugacagaaugagacuccaucucaguaaaaaaaaaaaaaaaaaaaaaaaaaagaaagaaaaaaagagggagagagagagagagaacucuaaguuuagagaggcuggguaacuugcccagggccauagagccagaaagagcugaggugaaggaaggagcacaccucuguccaucuuagcucccugagaauaguucacaucaaagaagauguugaagaauggauccuuuuguugguguuaaacugcuaggcaugaggguccagagucuuguucuggagacuugcaaaugaugauuuuuauagccucauuggagugggggacucugccuaggacauccccugagaaguucucaguauaucagcguauuacaguuggagaagacucaaguagaaaucagcuuucuuuuguaauauugaugguuuucaaacucggccacagguucccuuuuucuccaauaaaacccaugacauuuugcagaaccaauacucuguggagcacuuauuuggggaaccuaacguuuuaaacucauuuuacacaugggaaaucugacguuugugauuacuuggccaaagccaaaacuagcuguuggcagagcuuaugucauuaauuaauuuauucauucaacggauagacauccagugccucccaugugccaagcaugcugggaauuagugguacagcauugaaccaguggacaagacacagauauaaggagacacauguaaauaauucucgauaacuaucaugaugcacugaauguuugugcccacacccccacgccuccaaauucuuauguugaaauccucauaccuaauaugaugguauuagaaaguggggucuuugggagggccuuagguccugaggguggagcccucuggcauuagugcccuuauaaaaaggacccaagagagcucucugcugcucuuucugccacgugagacauaacgggaaguugucaguccacagcccagaagagcacccucaccagaacccaacccugcuggcacccugaucucacauuuucagccucuagaacuaugagaaguaaauuucuguuguuaauaagccaccuagucuaugguacuuuguuagagcauccugaauugacuaagaaaaccauaaaucuaugaagacuggaaacccuagcauuuccugggucuucuuaaggcagagggcuugccuuuuucaucuuucaucuuuguuuucccaguuucuaguaugaggcagugauaacacagccucaauaaauauucguugaauaagcuguugauggauuggaaucuuucccauucuauaacaaaaugguuuauuauuauuauuauuauuaaaaauauauaauaauuauuaguuuugguguggguuacucuuugggaaguuuaaaacaaaauguuccaagagguccccagauugaaauaggucucuuggucacccuugcuaagaaacccaguucugaacagcauugaccuugaacacucauuacaggacagauuauuugugaaaugaguaauguuugaaaaucaucucuguagguuuuucggcauugcuaaauugugucauugguuggaauuuucagaucacaaccauauuuugauucccaggcuuuuggccauuuugcuaaugugccagaaucucuaaggccuagcccaauugcuaauauugacaaauucuugaggaguauauaugguuuguucaggaauaaaacggauaggacucagaaucuuaucagcucauaccuguagguauggggcaauccauccaucuagcaauuuucuaaacuauguagccuacugugggauacugaaucccugcccaugaguacugagaaggacucauggaaggaugauagcuuucuuugcauuauuuguuucuagcauaggaaaacuggcuaauguucguacaguaugagaaguuuuuaguccacuggacuggagauucggagcugcccagguggucagugcuggcaggaaaagguaaagaagaucaaagcauauggcuuuucuacuuugccuaucuuuuucuugaaagaauuuauggcugaugaagaccauuuugcucuggaggaaaugaugaucuguugguggcaugcaccuggccucuuaguuugcuuuguuguccugggaagugggcaagugccccacuggaccuugaucugcauuccacaggggacucccugcuuuagagggaccccuacccaugagguccaaggaugaccacccagcguagcccccagcaaguacucacacacacuuccuccagagcagaucauuuaguuuaagggaagggcaucaucacuuucagagauggguguuuuagugauuagacaugcgacuucucugguagagggcauuuauuuuuuaaaaaagagaaaggguaaugaaucggacacuaucugucaaauucuuugcuaggaguggaaaccuaaguuuucccaaguccguauuucccugagaagaaauugauuuugguaugauccauaaagccuuguacagugaaauaaacuauuggcagaaaagagacaaacacauauauaaaaaaaauaagaaucaauguuucaaaaaugaaauacaguagaauacugugagguguuuguuuguuuguuuguuuguuuguuuucuuugagacagggucuggcucugucacccgggcuggagugcaguggcaagaucucagcucacugcaaccuccgccucccggguucaagcgauucuccugccucagccucccgaauagcugggauuacaggcagccaccgcugcgccuggcuaauuuuuguauuuuuaguagagaugggcuuucaccauguuggccaggcuggucucaaacuccugaccucaggugauccucccagcuuggccucccaaauugcugggguuacagguguaagccaccacgcccggccaacugugaguuuuauuuagccucagaaguaucuuuagacauuagguaaagagacacagacuuaaucaugucuguaguuuacugcagguuauaagaugaaugucugaugaaauuaugacauauguuacugaagggaaauugugccauguuuuucccuauauauuuuagggugauaaccuguaacacagaagacacuggugccucacuaagagcauggcaccaggagccugaaggagugggaccugagucccauuuucuugguuuaccagauaggaaaauuuaaacaaguuauguaaugcuucugaaucucaauuccccaucuguaaaaugaggguaacaauacagaccucuagaguuugcugugcagacuuaacaggcuuggcucaugggcugcggccaauaaaugguagcuuuuguuaugaacucuagguagaaaaguaucuaaaugguuuuccccaagcccagagagucugaaauggccuuuggagguaucuucagacaucaugacuucuuuuaguguggcaucaugcuugucugauuuuuagauuuccaaagaagucuuguagugcaucaugacuagaaaacauuuuggaguuuacacaaucaguaaaugaguuuuaaaacgcuuuuuuuucuaaauaggaaggcaaguguugccugcuucaucuauuuguagaccuguuuaaguguuuuaaaauccaucaaaacauuuaaaauuaugaaagccauuugcuucaugacuuaacaaaauuccuuaaaagucuuguauauuccugcgaauagcugaauccucuaagagaagcaggaaaaccacacgagcuucucuauuaauguugcugauguguugugacuuguaccaggucccuuaggccaaagcgaagcacagauuuuuugggggaaaaaagcugaugaauuaagccaauaacuccgaccucuuggccagagaaauguaaauucuuuuucuaaacucacagaaauaagacucuuccagggcuggaaaagacuuugaugaauaacgcaggcucauuuccccauugaauuuauuccucgaugcuaugcauauaauggguagucaauaaauauuguuugcccgcuuuuuguagcuguuucaaauugggaugaggaugagucugugguguugaaauagaggaaagcuaauuuucuuauccugggauaggcuuuaaucuuguuagccagauguucuaaacaugagagcuaaccagucagaugagaccacaaauaucugaguugcacaaugcaauuggcuugagaacugcauucuuuaaaggucauccuuuguauggggacagaggcaccccuugucuacauuuugggaggauagguuggcuuccuggucccacucaggucagaaacaccacugcccaucacuuuuggccccagcuucuugugguucagucccacugcauuguaaacuccaagcagaggggccaguuuugaccaaugaaaaugguuaacccuuuuggccagcccucuucugccgaagucuauaaugcauggcuguuuuuaucccugucuguuggaagaauauucagaaauccauugcaaucuaguuuugauaaagccuuuaauuuuccacuccuuccuuuugcaacuucauccaugugcugcauauucagccccuaagaacccaggaaugaauugaugugcugccuucaaaacagccuggcguuuaggaguugugauuauauucgagaaucuccaggcuugacuguucuuagcuuugauaucaugaggacuauccucacagggaaagauuuauagcaucuggggugagaacuuuaaucguggcccaaaggaacuugugauauuuugauaaggggcuugaggaaguuguuggauauagagcagaauguauuucggaagggugcaagcaauuuugagcccuucuggcugaucauugcaaaaugggugagcacugggagaucagaaaauauguggugggcaagguagaaagaacgucaaacuggaugaaauaagaaaacgggggaaagcuauuugagaggaaacuuggcauauacuuaguauuugugucuguuuuucucuugaaaugggcuguuguguuggcagaggcuucuggcugcugucagagauaugaacaucugugcuccuuugcagaaaacucaggauucuaaaguguuugguggaaauuguuuaacucugccacuugcuccaucuccucauuaggaagagguuagucuguacugcucagagugugcuuuuaagaggaagauguggcuuaggguucugggcuucacuuuuacauacugcauggcagaagcagguuugcagcagugaaaucugaggccaucagauacaaguguguagacuugguguaaaucaguuugcuugcuuggguuggaaguaagaaugaaagaugccaaauuaguaaggcaguugugauacaggcauccgaagagagccagcaagauggacaggucacguguggcuaaguuuuggaaggcuuugcuuuagucacuguaguuaaugcuaaaagcuguuauaaaugaccccaaaauaucagugacaauacaauaagagugaaguauuugaucacuuuaaaaugcauucuccuauuccccuaauuaauucugcuguucaccaagucuucuaacaaaguggucaguggaguuacacggggcaucagugucuagccagcaugccaccuuccuuuagccaaaaccuaaucccagcuguggcacacgcaggaaaggccaggcaauguaguuuagcucugugcuuguggaaagugucacugguuuaucgagcacagccucaaauguucuuccuagacagugauggauccauccacauuuuguggagcccccuuuaugaaaauaacacaaaaucagguacaaaagugaaugguuuauuuagaaugagaaugggcagggcuuagucaaguggaaggcucugaagauuacgguuucuuagcuucaugguaauauaucucugcuccuaauguccaaguauaaaauguguuuuuccccuucuuacuaccuaauaaaaccaucuuugcuaggugacccauggagcacuucgugcuguugaagugugccagggcagcuuauuuucacauugcccuuggagugaacagugcugcagccuugcugggaggccauuuggcuauugguacugagagcacaagacucguccugugcuuugacucaggggccuuaccucucagccucugaaagcccccagugauuuguauuagguauguguaaaucgugaaaacauccuccuucuccaaagaccgguaaaugguugaauuauaucaccaugcaauggaauauugcagcaauuacaaaugaugauaggauguuuugugcaagggaaaaugcauauaagugaaaacagcaugaugugaaauagugugaacucaauuguguaaaaauaaguaaacuaaaaauuacugaaauaaaugauaugaaaauguugccacuggucaucucuggaugauacacauaugaccaaacuuuauucaucuuuauaguacuuuuuucuucaacuccauuucccugcauuuacaauacagaccaggcacacacacagggccugggcugaggugcacaugguauagguuuacucugcuuccucuuucucugcuucagucaguguaagaagacagccuugguaagcaccaggaggccucucaucuuuauaguuuucugcaucuagcaaauuguauacaauuauuuaaauagugauaguucugacaccucuauguaaauggcaauauugcagccuuaauuugcccuaacauuuuacuguuuccaaaguguuaucacauauuaucauaucuaauuuuacaacaacccugagaggacaacaaagaaaaaaaucauacauuuuuaguagaaaacagauuaaacaaaacaaacccauccaaucacaaacggcccaugaauauauugacauuuccagauagcaucuccaucuucuuccuccuguucuccuaauuaauucugcuguucaccaaguacucuaacaaagguaaaaaauacuacuuucuucucaauuaucauagccuucuauuuagauuuuuaauuacaaauauuuuaagaguauuauuuuggguuuucuccgagcuuggaaaccuagccuuguucuaccagaaaaugcuuucugcauuucagcuaaggcauuuagaaguccacauugggucagagccugccugcauccugagcggcuguuucuguucucccugccagcauccuccucugcgggcucaguccugggggguaggagugggguuaugggggagucucuaggacccugggacccaacacuggagagaucucaaucacgcugggugcucuucuucccucgacucauguuccguagcugcuuagucuuguugcgaguacccgacuccuagccucugcagcacccugagagcugggcacuugacucuuaccauccccaucucgccucacugccccuucacugcagaagcugcaguuugccucccacgcuuaaccugaugacugacaccuccuuauaauaccugcgagaugacuucugugauucugccugcccgcaucuguguguuucuggauuuuccaucuccacgcuuggcccugccugagacuucugcaggucagcaucugaccgagguuaucugagcugacucugacgcauccaugguguugcuauucaccagauacagaguugcacuggcacagcacagucccuucccacuacugaagcucuuucuccuugccagaggucuugcucaccccaggggccugggcagauccaguuccagauucuggaaucucccuacgggccuuaccuuauugcaauguacugggccaggccaccagauauugcacuuugaaaaucuguuuugaaguugcuaacugcuuggaguacuguggugcugcaggcugcugucagggguagagguauggggagcagagaugccugagcugaucuagaaaauacuuagggguagaaugcucuaaugugaaaauuaauuuuaaaaaacacacuguuaaagacaguucaaaaugugcugcacuuucuaucuguagcaaucucaaguccagaaaaagaagguggaaugaaaauuuugguuucugucucuuagcagauaggucaggucaaguggaaagaaaauggaggcaggaaagaguagcuggggagagccugcaauguugaguuuguuuccuggggcucccuuaacaucuuuugaugaacuggguggcuuaaaaccaugcagauuuguucucucacagcucuagaaacuagcaguccaaaaucaaggaguuggccugaagguuccaggggagggucuuuccuugccccuuccagcuucugguggccccaggugguccuuggcuugugcaguaucacuccaagcugugccuccaucuucauauggcugccuucuugugugucuguuuuugcaugacguuuuccucuuuuguuuuugagacagagucuugcucugucauccaggcuggagugcaauggugccgucucgacucacugcaaccucugccucacagguucaagcgauucuccugccucagccucccgaguagcugggacuacaggugugugccaccacacccagcuaauuuuugcuugugugugugugugugugugugugacggagucuuacucugucucccaggcuggagugcaguggcgugaucuuggcucauugcaagcuccgccuccuggguucaugccauucuccugccucagccucccgaguagcugggacuacaagcgcccaccaccaugcccagcuaauuuuguuuuuguauuuuuaguagaggcaggguuucaccauguuagccagauggucucgaucugcugaccucgugauccucccaccucggccuccgaaagugcugggauuacaggcguaagacaccgcgccuggccaauuuuugcauuuuuuuaguagacaucuuccucuuuuuauaaagauaacaguccuaguggguuagcaccugcccaaaugaccucguuuuaacuugauuaugucugcagagaccuauuuccaaauaaggucacauucacagauagcaggaaaggacuucaacgugucuuucucaggggacgccuuuccaugcauaacagcugccucugguccagucuuucuauccccucuucagugguguguccaccagcaaaacuucugugccucaguuuccuuggcuguaaaacggugcccucuucuaggaucguugagagaauuaaaugaaaucaugcuuggcagaguaucacgcucauagaaagugcucaguagggguuuagcuuuuacagcuaguugcuugcagucauuugauuucauaagcuagguuuguggagaaacugaggaagugaaugagccaaacacaaaaguaaacacuguugauaggacaggugguuaacucuuucagugccacaaaacacauucugacucaccugcacacaaauuuugcuuacaagauuguugucagcacuaauuuugcuccaaguauuugcuugauuaaaaucucuuaugcuacucuuugcagcugaccuauaacagaaauaaaugaacuaacuagagauacuuucuucguugggcuuccaucuagagcuaagcuuuacuuaggcuuucaaauuguaagcaaaugcaaaauaacucucuugggaaaauuccagagaaucuaggccuugagcuguuguaagcaaauguggcccuccuuuuagggcgggaaucuaagaaauggagauuaugcauuauccaguuccaggggcaucauucauacuguggucugugcgugugcauggacaagccugcuccucugggugagguggccauagguccuuucugggguucaguaaguucugauaguggcauugucauggugugaaaccucucauucucccaguuuaauuauucagugagaaugggauuccugagauucuaaaccauauuccauaacuuuggaaaauauauguguauauaaaauuuuccauacgguuaaaaccugagaguggacugcaagucaaauugcuauuuucuucccugcuucgucuuugugaacuucguauugucaguuuuccugacaguugacaaaagugggcaguuuugguggcauaucugauuuaggaaguaagugcaacaauuugaaagccuaaguaaagcuuagcuuuagauggaagcccaauaaaggaguuaucucuaguuaguucauuuauuucuguuguaggucagccgcaaaucugaaaacacagguuugaauuuguaugcucauuuaauguuacugauaaucugaaaugcugguuuuuaggacuguagauuucauuauggaauauguuuuuaacuuaauuuguacaugggucucuuguuguuuugggaauuuuguucuaagacauguugaagcugugcuguaguuauuggguuuaugaguuguugggguauuauuuauuuuuaauguacucuguuccuuccucuucccaaagcaaauaaucaagaauuaauguuuaacuuuaaguuggauccacucacuuuauauugagaguuauuauuacuuuaauucacguuucuuuucccugaagcccugauauaucuuugggaagauacauuuuuucaugcauuaauuauuuucuuuuccaguaucaauugcagauauuacaaucacagcaagaaacaucuguuguaccuuuauuaugugccagguacugugcugccugcuuuauaugaauuauuauuacgaucauuaaauuuuuauauccacgcuagacuuuacauacugucuaucauaacucacauuuuauaauaaggacuugagacuggggaaauaaacuugccaagucgacacaauuuaaaagugguagagccaagaguugaacucacguagucucugacucuggaacuaugcucuuaaacccuacacucuugauguugaagauguagggacaucuuugcauuugaagacagaaaugcacauacagcccagaacuuuucagugauuccaaagaccucuguauuuucacguaacauaacuuuggaagccacagauucgcuuugcucaaucuauuuuguucaggaguacaugcaugcuaauuugcucaggcaguagcugaaagcagugagagauauuccaacaaggcuccagauugcaagagaaaugaguguggauuuaaaaauuaacaggcuuuguaugcauauaacuaagaaucagcuuacuugccaugaagaugaguaccaaggccccaaaguauguaugucagaagguaggauauuacuugguuuuguguaauugguaauaccaaggucaaaucaacuuagauaacugguuuaaaccauuaaauagcuuuuuuggcuuuagauauuucucaagauuuuuacugcaagcuacgugcauugcagucugcaggaagaaaaaaaaggauuauuaguguuuuugcaauguuccugcccagcguuuacuucuuuauuugcucuuguuuuauucccacagggaaagguucauuguaacauacccagggaugugugguagauuuuuccaaugcagcagguagaaugacuuugaugguaagaaacagaaaauugaaugccgacuggcuuaaacaauaaaagcuuauaucauugaaaagauuagagguauggugaguuacagaauuagauugauucagccacucucugggucauuuaggguuucuuuuuuucugucucugccaaacaggauuggacuuuggaguuggccacagggcagauucccccaacacaccagcaggguggcgaucagagaaugccagaacaaacauuagauaauuuuuaagaagagugacuugguguaugugugccccaacaaguauccaccauagccagugaccuggauaugcuuaauuuagauuaaugaauuuauccguccucucucuucuccaccuuguagguguuaauauucuacauguaauguacagggguuuucccccucggauauuuuuggugaauauuucuguaguugucccuaaacauagaaagauuuuccagcaggauacuaagagguacuguuuagcauauuucaauuucccauuaccaaucccacagaccugauaagauauggauguuggcugcuaauaucaaauaauguuuucuaauuuucuuaguggaaaaugaauggaaugaaucauucaaaugaauuccaugauucauuauggaaucauucacucaauauuauuuugauauuaaaugauauuaauuauauuaaaauauuauuuugauauuaaaguggagguaaauugacuucugucauauaccuuuucacuuugcuacuucacaguuucccucuguucuugccaugcugaaguggccuggugugguggcuaacaucccuaaucccagcacucugggagggcgaggcaggcagaucacuugagaccaggaguuccagaccagaauaggcaacgugacaaaaccccaucucuacuaaaaauacaaaaauuagccagacgugguggugugcgccuguaauccccgcuauuugggcggcggaggcacaagaauugcuugaacccaggaggcagagguugcagugagcugagaucacgccacugcacuguagccugagugacagagcaagacucugucucccccacaacugcccccaaaaaaggaaagugcugaaggguguuuuccugagugacaugcuggaacuuuagauggcaagaaaaagagagcuaagggcauacuuugcauguuaccuggaugcucauuuuuggccaaggggauuucuucugagaagugaaaaauaucuucagacaguuugguucauuuggugauuguccugcuugccagguuguaccaacugguauuuucuucuuuuguucaguaaaucaaccaaaagcccacuauguguaagguauuuucuguggauucaaaguugaacaagacuuccuuagccuuccuggucuuucagucuggucagggagaugagacagacacacaaauaaccacaauacaaaggacgaagaggaaagcuaggcuuggaaaaagggcuguugggcuuggaggaggcaaggaaagauuccuggagagaugaggaaagucuugugugcaaggggaagggagaagagggaggauuucagacagagcaaguauuaagaaucuugagccuaaauguugugaagcaguuaaaauuaaaaaaaacaaaaaaaaaauuuggucaaguuaugucuccuauuagugacuuauuauuguuuaacaaaucaccacaaaacuuaguggcuugacccaacaagaauaauuuauucucuuucauaauuuuagugguugaggaacccaggagcagcuuagccaggugguucuggcuaaggguccuuugugaagugguggucagaugucagcuggggcugcagucaucugaaggcuggacuggggcuggaggacuuguuccaagaugaugugcuccuguggcugacaagcugcugcuggcuguggaugucucuuagggcugcuugaguguccuuaugacauggggucuggccucccccagagugaaaguuucagggagagacaaucauguggcaucuuuuuucucugaccuagccuuugaaaucacauagcauagcuucccacacacucugcauguuagagaggagucacuaaggugggucuaggggaagaggguucaccuuuuaaggggaggagcauccaaggauaugcacccauguuuuaaaaccaauacauucuugaaaaaaaaugacaagcuaaaaugaugguugcauuaguuuuucuuuaguuguugugucugcacaguguuuaacuacaguaguuggcacacuguaguuuuuugauugguaaacuaugguauauaugaugucuucaucuguuaaacuagucauuuaaaguagaaauuggcaauuuauccaagagacaucuuaccacagaagccuccuauagaagacagauaaaguagaagucaggggcucaggcugaggugguggugaagggggcuggcacagccuuuccucaguguccaggaggaccccacaaacgcccuggcuccugagaauagaacucucuggaagccauuucauggacccauccauuccuuccugugauuuuuuucuuuuggaguucaguuguuccuuugaagaaagaacaaaaggauuucauguuguuuugcaaaauauaauuguaagaauuauuuucugaauuauaaacacauaguuugaaugaugauguguagcacugaaugaugguuagaauaauuucuuccaaaacauuuuguguguguguguuuuugugugugugugagagagagcagagguaggaaguaguugagcgugaggaagggacuuuaauuugaacagaauuuucuccucuguggagcauauuaauuaaauauguacuuguacugaaccauaacacuguguuuaaagcagugaaagacaugagccaccauucucagcaguaucaaagcugaagcccuccaugaccaugugaucugacaugacguuccugcuggagugggaggcagaguucugagaaguggagaaugugaugcuucugaauuaagugucuuugauaauuaccagaauaacggaaaaaguuuaugaaccagaucaggaaaaaauaugcucauuagucauaugaauauuaguuuucucaacauaacaauacacuucugaggcucccccuucuuccuuggccccgcacacacacaaaaaugccauuucuguggacuguauggccauuucuguagacuguaugaaaagggacccucuaauacaauagagaaguuggaaaagcugaauacauucucucucucuaacuuagcacacuuaaagggcaauagccagaaaauuaaauuuuauuuaaagaauuuugaggaugaaaagcacgaggauauuaauuuuucuccacugucacuuuccacuuucaucacugcuacaauuuauuguacccacuuguuccuggaaaagaaagagcauaauagcuuguuacagugauuucguuuuaaaauaaaguguuguaggauguugaaaaacuagaagaaaccaacggcuagcgguaaaugaaagagagggaacuuuguuugcuaagauguggacagggaauaauauugcuccuugaauuuauccacuaacaauccaguauuaauaucugugggacuucccauuuagaauauugguaagguagaauuaguugcuacaucuccauaauuauuucuuaaaaugguuuucugagaaccaggaaaauguuauacuacuucuuguuccuacuuccuguucuugcuguuccggguuuuauuaugaaaauguguaagugggaguaaaagccaaacucuuacuuagcagagugccuggugugcaguaaacauuaauucucuuccuccucuauccugaugccuucugcacugaccccaggauccacagagggagggugacaaaaagugucacagcauauagcucaugaauugcauccuuuucuuuaguuagcuaaaaacucuuuccacucaugucuucuucccuuugcaguuuuuuucuccaacaggaaacccacuguuuuuuguuucucuaccaaaaugugucagguugccuuccuuuagggguaggccagcaggcucuaugaugggcccuaguuuuucucauuguauuaguuuucccuuguuugaauggagaaagugauuagaaaucuggauuacuguucauuucauuuucauccauguaugucauuuauucauucauuuguucauuauaacauuuguagaagacccacuguguagggcuguguguguguuaaggggugggaggggcuagagcagaagguuacuggaacugaggcaucuggcccucugucccugcuuuuuaguggcucacaguaugggguuguggggaggguuggagagaaagacaugaagacaaguagauacauuucaaauaagcauuuacugaacccuugcugugaucaaggaacugaauuaaauuuuauguggauaccagguuuuacuaaacuuguuuuuuucuuucaaggagauuauacuuuaguagaggagagaagacacaucuaauuuagcaaaacuuuagggagcuuucuaugugucagucaccaaacugcaauaguacuggggaguucauuuuuuuucaugucaauuacauaaaauaauccugccuaugcaaagaaguuagagacucucugagcuagagcaauuacagcaggaauuguaaaggaagucggaagcaaaauagucauaguaguuaaggguucugacuugggagucagauauaucugguuuuggauccuggcuucguugcuuaauagcuaugugacuuugcgggaaggagggagauaauuaccuuuucaagauucaguuuuccugcuugcaaaauggggauuauaaugauaauauuuacugugguagauuguauuguccaaaauggucaugccaguaucuuuuaucauacaugaucuuacaauaucccugugaaacuccugccaucuagcaauaggguuuauguuccuuccauuugaucuugaguggaauguugugacagcuuugaccaacagagcauagcagaagugauacuauauggcuugcaaggcuacaucauaaaaauguuauucaccuccaucuugcucugcaguguagcucuuggaacccagccaccaugcugugaagaagcccaaacagcccguggagagucccaagugggaggaauugaggccucuggcccacgggccuggcugaguucccaucuaacaauuagccucaacuuuccagccauaugagugaccaucuuacaaguggaucccccagcaagccccaguugaguugcccuggcugacugugcauggagcauagacaaaccauacuuacccaacccugcccaaaugguaguuucaugagaaaaaugaagugauuguuguugugugaagccaguaagucuggagauaguuuguuacacagcaguacacagccaggacacuugccauauaaaguugcuaagaggagucgaugaaaugauacauauaaaucagcauaaaacuagugacccguuaaugauagcucucuucauuauuaucacuaguuaagggaaguuauuuaauagaugucagcauuaguucaaaguaaggucagaaccuaaaaagcuacccacgaacuuuuggcauccaguagguuuuaggaauuuuguucacuuuuuuuuuuuuuucacuugcaaaacucugcugugugucagcuuccggaucaccuuucugcugauauugugcugaguuuguucugaacucugugcuuuccguuguuucagaguuucacuuaggcuuucggugccauggcccgauguguaaacaauguuuaaacuuccagauuauucugugaaagucaugcucagggcuguuauuuuauuaaaacaauuuuuuugcaugugguaaaaagcaacacaaaauuuacaacuucaccauuugaaguauacagcacaauagcauaaacuauaugcacauucuuacgcagcagaucucuagagcuuuuucauugugagugacuggaaaucuauacccacugaaaaacgacuuccccuuucccuucuccccagccccuggcaacuaccacuguauuuuauguuucuaagagguugacuacuuuaaauaaucccuagaaguauaaccaugcagcaugggucuuuuuguggccggcuuaccucacuuagcaucauguccucaaaguuuaucugaguuguagcacaugacaagaucuccuucugcuuuaggcugaauaauauuccauugcauguauauuccuaccguuucuuuaucccuucaucuauuaaugaauauuuagacugcuucucccuccuggcuauugugacuaacgcugcaguguacacaguagugccaauguugcucugcgguuauuuuuuccacuuccuaccaacagcagaaucucguugaaaugcauuggaaagacagagcguaggggcuuaucugaguucuuugucaucuuuuuuccaaugugucuuagacagugaugcacaaucagguagccagacugcccagauucuuccuggggguuucaacuucauuauguauaucuauuguguaaccgguugugauuagaauuaaaccucugccaggcuuucuauugcuuucagagcaguuucacaagcauuauuuuauugaacccuugcugcaugauagcuauuucuuuaguauggggaacacaagguuacaaauauaguguggauauaaaauccaaugcuacuguauauguuuauugugguauucaauguucuuuaccaauguaaaauucacuuacagacuugacacaauuuuuugaaguuacuauuuuuaaaauuaauaaauauuuuaaaaauuaaucaauuuuuuucuaagagaaauuuuagguuuacagaaaaauugggcacaaaguacaguuuccauauccucucuuuccccagcagggcuucccucuuauuaacauuuguuacaagcaaugagccaauauugauacauuauuauucauugaaguucauaguuugccuuaggguuuacuuuuuguuuuuuacaguucuaugagauugaacgaaugcauaaugccguuuauccaccauuauucugucauacaaaagaauuuuacuguccuaaaaauccccugcaguccacaaaugcaucccucucucacugcauauugcuggcaacuaccgauguuuuuauugucucuauaguuuugccuuuuccagaaugacauauaguuggaaucagucuguggccuuuuuaggcuggcuuccuucacuuagaaauagcacuuaagauucauccauguucuuuuuuuuuuuuuuuugagauggaguuucacucuuucgcccaggcuggaaugcaguggugcagucucagcucacugcaaccuccgccuucugguuucaagugauucuccugccucagccuccuguguagcugggauuacaggcacccaccaucacgccuggcuaauuuuuguauuuuuaguagagacgggguuucagcauguuggacgggcuggucuugaacuccugaccucgugaucugcccaccucggccucccaaagugcuaggauuacagacgugagccaccgcgccagacccucauccauguucuuucauggcaugauaguucauuucuuuuuaucucccaauacugugucauuguguggauguaccauuguuuauucacucaccuguugaaggacaucuuaguugcuucugaguuuugucaaguauauguuaggcuacuguaaacaugcgugcagauuuuguauagcuguaaguuuuuucaacgcuauuauaaauuaccaaaguguucuccacacaggcuauauuaauuuacccuccaauucagcaguguaugugauucuguuuacuacaaauucuuacugacaguuaauacugaugaauucuuucaucuuugccuaucugaagagugaauguggguaucuaucuuacuguuauauuaauuuauauuuccugauuauuagugagucauaccauuuuaaucuuggaaggaccuuugagauccucuagcuaaugcuauauuuuaaagaugcaaaaaacaagacuaagaauauuuucuuggccuggugcgauggcucccgccuguaaucccagcacuuugggaggccgaggcgggcagaucacaaggucaggaguucgagaccauccugccuaacacggugaaaccccucccccgucucuacuaaaaaaaaaaauacaaaaaaauuauccgggcgugaugguagcugccuguagucccagcugcuugggaggcugagacaggacaauggugugaacccgggaggcggagcuugcagugagccgagaucgcgccacugcacucuagccugggugacagagcaagacucugucucauaaaaaaaaaaaauuuucuuacuuccucacuuucauuuuucuuuccuaagaauauguuuuuaguuucauugcauuaugccccucauuguuguggcuacugaguucagugucucauccaauggaaaucuuucauauuugccaugaggguggaauauauacaaagagagaaaaaaaaaaaacaaaagaguaauauugcagauuucucccuugcaccaacugcagauuuuucacuuguaccaucuuuauuuucacuaacaagaagcuucuguuucccaaacuaauuauacacagggccugaaccagcgugaguacucaagcauucccaugaaugauggaaugaacccuaagaugcaaggagugggagaugaggucugcuuaacggcuugaaaauaccccuagaucccagugguaucucagcucugcagcuugagcuugacuucugauucugccuguagcugcgguggacugggaauuacugauaagggaagcaaguguugacauuuuccauauuaggauggguucuccagugaauucugacccaugcucucguggucagcucucuugaggccaacuuuccagaggcuagcuguugggaccagcggaguugaccucuggggcgggacagcauaugcacuguccucugaggcuagcaaguucaagacacucugguuuccccuggaaagccuuuggaguaucggaggaggauuggcugggcugauucagccagucuguauuuuaacugccagggaaugaauaagccuaucuuucugacucccuccuucccauuaacaagcccgacgccuugagucccaggaagcaugccacacaugacuucagugucccgugcacacagaaguuuaauugcuuugugauugccuaaaaugugaaaugaaggaacacauugccuauaaggauaacauuugcgauucugugcauuucauuucaucacacauauuugugucaguuaaagcacacggaaguguguuugcuguacuuaaaagaccuaucuggauuuuguguuucuccgugauuuggaagaauaacugcagauaagcaagcucugggugugacagacagacaugggggcagaggugagacaagguggagucuggggcguggggagggggucggaaacauugggcauuccaggaggagggaacaauaugugcaagggcugggaccugcaauaaagccugaccuuuuuggaggaauucuuaggguuuuuuuuccccauuguuguuguuuuggucuugaaguauaaaaagcauccaugccuuauucuugggaaagauucauucagauaaaaucccauugucacucaaaguuaugcuuucucacacgaccauuucagucccccagugccgguggcccacauuaccacugcuucauuggucuggccacagugacuucucuccuggaaaugauugcucagcaaacgccuuauucuggcaaauuucagagcccauaguuacaaugaggacuccugaucaugagcuguuugcauuuuauucagaaaaaaauuaaaaauggggggaacaaagaggggaaaggaugugagccaagcaauagcugaauguuuuuuaaaaacuggauauuuuguuuuucaucaaguaacgauuacccaguugcgaccacaaucuauuuagaacuaaaaauuuaagccagccuuccaagccccaaagaaaacuauggaaaaaaagauccaggaaacuuuugguacugggguguaguaucuccuuuuuaugcuaaguuugcaaaccuugcuacauugccacaaagaggaggaacaucucaacacugauuggcaucugggccucgcagaugggguguguuucuuuaaacagugucuugguuauaggagaaccuuuauuggaacaaccugaagggcccagggaauuuauuauauaccagguuguuacuuccguuaacauggagaagcaucuaaaggauacauuguuugucagauaugucaauaucaaagguuaaaaauagcgugggaccuagggaugcaccagaaagcugugccaauggcggggaguggccaugauaggaccaaaugagaaagagcauaagauacccauagaaaucauggcgcacagucaccuguaugagacagcaugcagugugcaugggagaggccugccacacggagugaagguggaagggggagccaccuagacauucagagaugggucuuggugguaugggagagggaguggaccagugaggauggaaagugcuggcccaaaccuucccaugcauaccuuaaaaugaauuucuuucuggacugauuagagagaaaaaaugauuacaauuuuagggauucuguuucccaccccucauuuucucuugcuuuuuuuccccauuaauauauuuuauuuuuuagaaguauuagauuuacugaaaaauugacuagauagcacagugaguuccaauauaugccugcuauccacacaguuuucccuauuaucagcaucuugcauuagugugguacauuuguuauaauuaaacuaguauccauuauuaugaaugaacaacaacaguucauuaagauucacuuuuugugucguauguucuauggguuuugacaauugcauaaugggcugggcaugguggcucaugcccguaaucccagcacuuugggaggcugaggugagaggaucacuugaggcccggaguucgagaccagccugggaaacauagugagacccccaucucuacaaagaauaaaaaaaauaguuggguguggugaugugugccuguaguccgagcuacucuggagguugaggugugaggauugcuugaggccaggaggucaaggcugcagugagcugugaucaugucacugcacuccagccugggugacagagugagaccccugucuuaaagauaaauaaauaaaugagaaagacaguugcaccgugucauguagcuacuguuacaauaucauacagaauaauuucacugccuuaaaaauccacgaugcuucaccuaugcaccccccuaccguccuccuggccuccaaaccccuggaaaccagugauuuuuuuucagaguuggggggauuucacuguguugcccaggcuggucucaaaccuuggcuuccagugauccuccuaccucacccucucaaaguguugggauuacaggugugagccacugugccaggcaaaccacugaacuguugacugucuuuauaguuuugccuuuucuagaauguuauauaauuggaaucauacagguauuuaggcuuuucagacuggcuuccuucacuuagaaaugugcauuuaaaacuuauccaugucuuuuuguggccuaauagcucauuuuaaaaauugcugaguaauauucuauuguguaucuauacuacaguuuauucauucgucuauggaaggacaucacgguugcuugcagguuuugguaaauaggaagaagaaugcucuaaacauuugagugcagguuuuuguauggacauacauuuucaacuuguuuggguaaauaccuagaagcauuauugccagauuguaugacaagauuacguuuaacucuguaagaagguaccaaacuaucuucaaaggugguuacaucauucccccuugcuuuuuuauuuuccaugugacuguaguuugggaacagaaauuaaagauaauauguggaaaaaugcagguacuacuuuuaagguguaauacccugauucugaaauauccagagaaguguguucuacugggugagauacagacuaacaguguccuuuaguauaaggauauuaauuguuuacuuaaccagaagucagggaucagauggcuucagauucauuaaauagcucaagacuguccucaaggauccagacucucucucccucuacucuuccauaaguauguuggcuuucugucuucugcucauacuucauggucuuaagauggcggcuguagcaccaggcaucaaguucccaaacacuuaggaagaaagaggaaggggaaacaccaagagcuauccuuccauuuuguuccuuuuuucagaaaagugaacaccccuuuaccccacgaaaaacccagcagauuuucucugauguuuuacugaccccaaauggguucugucgucacucuagcugcauagaggccaggaaacaguaauuuagagucucucuaauuucugcucaugguuucuuccuguaacgauauucucacucacaaccuggccucauccauuuaucaagcagaauauugcuggagccacuuguaacuuuuuguugcuguaggggaggggaaauagcuucuucccacucaucaacagguucaugacugaggccccuauaacaaaagacagauugacaauagaaaaggauacacauguauuugauguaaguuuuacgugccacaggagucuucauagggaacgaaagaccugaagaagcggguaaaccuguguauuuuuaugcuuagguuuggugaagaguagacagucuuagagauguaugauuggacaaaggagcuaucugugaucuaauuguaaugaacugugagaaauuuagcaaggccuguuugaucagguucuucuucucacuucuaugucuucaacuccuuuccuuuggguauagggaaggagucucucucauauggcuugacugugugcccacccaaaucucaucuugaauuguaguuccuauaauccccacaugucaugcgagggaccuacuaggagguaauugaaucaugguggcaguuacccucaugcuguucucgugauagugaguguauucucacaagaucugaugguuuuuuaagggauucuccccugcuuuugccugaauucuucuccuucaugccgccuugugaagaaggauguguuugcuuccccuucugccaugauuauaaguuuccugaggccuccuuagccaugcugaacuguaagucaauuaaacuuguuuccuuuauaaauuacccagucuuggguaugucguuauagcagugugagaacagacuaauacacugucuccugaggcucuuacaaagugcuucaaagaaaagucagaaaauccuuccucgauuuuaugaucugcuuuaggagaaaaggggugaggggaagguaagagugaccuuccugcuucugcuguuuucucaaaugccaaggugccauguuuuggggugguagguccugaacccaucccuucaauguccuuauuuuaucugugcaugagggcugaauuauuccaucacuuucaaacuguguuuuauggagccccauauuucugacaugaguguaggcaucucugcagggagagugaaugggauuugagagggcagggcucuggcuucccacuucuuccuggacaagcuuaccuucacuuacuuaagcuuccucccaguguaggguuccuagggguuuuccuuugaauuaaacuucugcagauaaaauuaagggugaaagcauucagucaggcggaugucucuuucaauucuaagagucaaacuuuuggaccaagaugagacaaggcuauuagucuuguccuaaguccuuugcaaaaucccuaggauuuuuugccuugaaaacuguaccaaauacccauauugugcacagguuggaagaaaauuguuuuuucuucuguccuaaagaaaaaggaauuucuuugccauuuaaaaagcaguuuaaauccuagcucuuccuugucaaguugauggucuggagcggggagauaagaagauggccaucagucuaaguguuauuccuaaaaaguagaaguuuugaucuuuccugguaucucuaaauggaauuuaucaaauauucuggaguaacugaaaggggugaucuguauucucuuccaccguuuccuaaagcucucacauguuuaugugaaauuuguggacuuuucagaugggcauuuaauauacgauauaguauuaauuuggguuggaaaauguucugggcuuuuaaaguauaucuuaguuaaaaugcuuuguaauuugcauauaugcccugaaguaauuuuauggaauagaaaaauacaugaaaacaaaaacagaaacuaggucugugcugaauuugcuguugggugaagcugacuuuuuuuuuaaauuuugaaauaacuccaguggcuucaugguccacacagcacauugugaucuauggacaguguaccgaugcggauucugccugccugauccuggaaggcacacuggcuuuccaggcuuguuggugcaguauuuaaauaaaugagcccugcugugugcgagacaaagggccucuguacuaacugagcauaugcuaucugauguucuauauuuacaugugucaucucauuuacaauguauaacucccuccaaaauaaguguuaucccauuuugcugugaagacagugacacaucaaacuuguaccauauuaaauagcuaggaagugucagagcuggagcuaaagucucccagaagcuuguacauuugucacuaaaucaguagcucugccucacuaaaauuaacuggcauucuucacaaaaaugcagggggaaaggaacuaguaaauuuuggaaugcauuuuugugccagauaauuugcacauuucaaguuguuuaauccucacaacaauccugggagaaggagguuuaugccguguguggagcgggagcuauaguauuacucccacuucaagucacgggaaauugaggauugaaauuauacaggaaauggucccuugaagaucauguaaucuccccuaaagauauagcaguaaugaugcugcagaugacuuuaggugguggaacuucuggccucuuuaccaaaacagagucacucagcguauucugaauacuggaggccgaugucaugcauuauccaaaagcauguugcauguugaauguucuacccgaagaauaagaugaaagguucugauuugccuccuucuccauguacuugacagcagcuagugggcaagugcuuggcuuccccacccugcgugugcugggcucguguugggcugagguagaggaauaacaugugccuggugcaagguggcuaugcccagggcuuccugagaguggguuuaugcccuggcccugguagaaugcaaaauugguggucccuucagcaagaacucacuggcagaaaauccuuacacaaaaccuaaaacuuaaauugaucugcaacaaaauugcccaggaacccacugccuccacuccagucccgggagagauuugcucccaucucugucucccuucugcacgaguuuguugaaugaaggacguggucccagcccucaugggcauuuccuggcagagccugggcaggcuaugacaucacagcagggggcagaucaaggaggagccagaaccuggaaccccuguaccucuggauccagguggcuccuggaugggaaggcagagacucagcaggagagugaggaucgccguucacccaagaggcaggauguggaaucugaccagagggcucagugacaggugccaggaaggcauuggcucguugggcugguacagguacauaaaaguacauaugggauacugcuccaugccgcacuaagcuguaauaaugcucauggagcuggguuuggccugcaggaacagggugccuugaaagaagccuuccugugcuucuugggggcgaaggagggccccacauuguagaugcagaccuggcucaugaguccagcaggggacugagucuagcagaagggucaaagugcugccccagcugaaguuauccuucucuccauuuuccgagaggaauuaauggguguuggugcagcagaaaacuuaggaugagacgauagcagcaguacacgugagcaggggguguccucccaucccgcauucuuucuugugauuucccuagggaaggaaacuucagcccguuaguuuccuugcauagaaagguugacuuuuguuucaaguguccaggaaucuaacaucaggaaguaaauacaauccuggaaacaaagcagaaagauaaacaagguuagugaauccaucgcuuucugguuccucccugaguugccuugucuuuuuucuugaauggagcagugaagagggcuucaaaagaaagacaaugcagugauuaauugaauguuuacauuuccaugaauauauagauuggguuuuuguuugaaggaaacuuugauguuuuugaagauaggaagggaaaauaaaaguuaguacaucuuuacuagcauguuaugugucagggaggcucugugcuagagcucugugagcucuuuuaauucucacaacagucauaaugaaauguguauuauuggccauccuuuuuaaaauuuaaauuuaaauguuaaauucugggauacaugugcaggugugcacguuuguuauauagguaaacgugugccauggugguuugcugcaccuaucaacccaucaccuagguauugagcccagcaugcaguagcuauuuuuccuaaugcucuccuuccccauaucccaccugcugacagguauguuguuguguguguuuuucuucucccuguguccauguguucucauuguucagcucccacuuauaagugagaauaugcaguauuugguuuucuguuccuguguuaguuugcugaggauaauggcuuccagcuccauccauguuccugcaaaggacauaaucucauuccuucuuacggcugcauaguauuccaugguguauauguacuacauuuucuuuauccagucgaucguugaugggcauuuggguugguuccaugucuuugcuauugugaagagugcugcagugaacauaugcaugcauguauuuuuguaauagaaugauuuauauuccuuuggguauauacccaguaaugggguugcugggucaaaugguauuucugguucuagaucuuugaggaaucguauuguccaucuugaugaggaaacugaggugcacagaggugaugcugcccaaagggaaaucacagacaaauagaucugagggguccagcugcaucuucacaggcaugcuguccauaacgccuuuugugcauggaugcugcccaauggggcugucuuacagaugccuuuuaugacccauaccuuuacccuauguauuccucauagaguugguccaaagaugggcuugagccuucuaucaauuuucugucaaaccuuugagaacuaaauauuucucuuuugagcaugagauauuuuaaguguuguuauucaaaagagaagaaagggaaaugacaaauaaaauuaacaaagucuaauuugagaggucaugaaaaaaguauuuuuaaguuuuuugugggucuuauguuguuccuugcuuugauauauaaguaaauuaaauaagguucaguugacuauauauuuugcagacauucuaaccuguucauuacaguuuacgacuguggcugucuauauuccagccaguuuauuucuuucugagaaaaauuccuaucuucagucuaccucagucucucuuuggguucagcuaucagguagacagguaguccuuuauaacauaauauagucauauuuaauguucuuuuucuuagugcaagcacuugaugcuaccaauuguccucuuauuacuccuuugccaauguccuauggaauuucauguauaguaauuucagaaucacuaauuucuggcuaacacuuauugaacuccugugaugcaguguaaaggaaaaauauaugcaucuaacacuuggaaauaggcaaauaggcaaaaguauaacugcaugucccuucaaugucauagugaauuauuguccccacucaagauuauccaauucucuagggguaggugccuuucucugcuauucuuuaauuuacuguuugcuguugguugggauauuuuacaaucuauaaggguaaaugaauaccuauagaaaauggacagugaugcaaaggauuccugugugauagcagugugaaugauucuuguccauuagaaaagauagcccccaaauugccauuuuaaugcccuauaaagcauuaccuagguuuuuuaucuacuucagcaaucuuauuuuaucauucuuuucuuucagggacuauauuaauggcucugacaugcauuauacauuuuuuuugccuuuuuuguuuuguuuuguagagacggagucucgcuauguugcccaggggucuugaacuccuggacucaagcaauccucccaucuuggccucccagaguagugggauuacaggugucagccacugugccaggcugcuuuaugcaauuuaaucuucauauaaauccucuuaggugagcuuaucauuaugucuacugugcuuaggaagaaaggaggcucaaagguguucaaguggccugauacaagauggauggcuaguaauuuagaaccaccaagagagcaaagguuuaucugaaucaagguccacuguugauuacacuuugugauguuaccaugaaaacccacauuauucucaccaaggagugcaaugaugaagugcagcugaggaugacucaauaaggugcacaaaagaauguagauuaauaaaaggaagaaauaaguaaaggcgaaaaagcugagacugccuacaaaaaacuaugacacuauugcauuuuuucucacuguuaaucaaaaauaaaguguacaaaaugucugugcacuuguuuuuauuccuuguagcacuacacaguuuuacuuggaaagucccuaucuccuaccucagcccugaauguuugcuuacagugaguauauagagaagugguuuaaaauaagaaguaacagaggugcuugcuuuacauuaacaaagcaaaacaaacaagauguugagagagaagaagagccauaauugcuucuagacucuaaccaaacccuggguuuucaucuuccaucauguaaauguacaguuccuaaguucagcuuuuuauuacugcaggguguuuucacuuuuucucaaggaucucaucaaguucugaaaacaaaauugguuauaacuuacuuuccuuaaaaguaaauauaucaagugugucccaugaaauuaagucaaugaugggcugccccaauucuagaauuacuggaaaugauuagggaagcauacauacaugguagguggcauugagagaggcaggaugaacaacucuuuuuuuuuuuuuuuuuuuuuugagauggaguuucacucuuguugcccaggcuguagugcaaugguguguucucggcucauugcaaccuccgccucccggguucaagcaauucuccugccucacccuccugaguagccgggauuacaggcaugcacuacuacgcccagcuaauuuuguauuauuuuaguagagacgggguuucuccauguuggucaggcuggucucaaacucccgaccucaggugaucugccugccucggccucccauagugcugggauuacaggcaugagccaccgcacccagccugggaugagcaacucuuaaaacacagcucucucucucucuuucuaguacugcaaaacuacucccagcuaugcuuaugauaauuacugcaggagguaacacugggaacuaaaauguaauuaaaauacucagccuuccaugauauucauccaugacugcaaacuuugaccuugaaacauuccgguaaucaggauaaaugaaaauuugcuggggucucaaguuuaagauauugggaaauuguucucgugucuggaggugcugaguuaccaacaccugcucuucucaucuacauccugaucaaagccacccccacugccaugcacuuaacccagaagccccccaggcccuccugauaacucucagcccuucacuucucacauugaugcaaaauucugcagaucugguguuucuguggaaucuggucucuguuuccuccacacuguuccugcccuagaugaacccucaucagccucucugcucuggaagacacuuccauugucuccucauguauaugcuuaugccccuugcuucccuucuguuccccaauuauucuccuucugcagauggguuccuuagguuguuguaagaaugucuucaugaucuuggcacuuggcuuccaacccuucagagauuccuguuucuuaucagcccagguguaggcucuugcugaccgucugaggccugucugauccagcuccugucuccucguucucuagucuccucccaccugucacucaacuuagcucacagucugacugaggucuuauuuacagcuucuuucagguuucugaacaugccagacuauguugagcugcuccuuggugcuggacugcuucccccuccaccuggucaagcaucuccuucucacugcuguccuguagcuuucuaguaagaguauucugugagagaccauucucuccuuuggggcaggguauuguccaacauuauauuagugucccugggccuaacagggagaggcuccccauaaauauaaguggcaugaaugaaugaaugaaugaguaaaaaggggguuauuucuugcaucaaaaaguuaaggcagcuuaccucuacuuagcuauggaaaaauugugugaguaggacuuaaaguauucugcuauuuguccacaaaccauaucaucucuccuuuccaccuauuuaucccaucuagggggcagagcagggagcacuuauaccauacaaggcagagaagauacagaucaagauaugcccaaggcccuucuaguucagccucuccuuggaguagguaggccaaucuuuaugggcuuguggggaucugagcauaaaaaagcaagcugaggaacaaaugaacagugauuuugguuuuuggauaaaccaaaaccaggcaccgcuugauagcaggcaagggaaaggcugcagcuucacuuuucugugauauuuccaccaaaaaugcauaaccugaaucuaaucaguagcagcagcaccagacaaacccaaauugaggaacaaaauaaccagucuauagucuucaaaagggucaagggcagaggaaaacugagggaagcacuuuagaaugaagagacugaagagacacaacagcuuaaagcaaugugugauucugaauuggauuuuuuuuaaauaauguacuauaaaguacuauuauugggacauuuggugaaauaauuuacuauaaaguacauuaucgggacauuuggugaaauuugaacgaggucacaagggcaaauagaauguguauuaaauguuaauuuucugauuugaaugcuuguguggugguuauauaggagaaugccauuguuuguuggcaaucuucacuaagguauuaguggguggugagccacuggguuggcaaguuacucucaaguuguucaggaagaaugaaauuuauuuauauuauaucugcaauuucuugugaauuggagauugcuucaaaauaaaaauuuuuaagaaagaauaaaaauuaaugaacaagcuuagacuuuuccucauggacaaguugcccaggagagauguuuuguauuauguccugauggaaaugugugcagaaguggucuugguagaccuuggaaugaguuggggguggggagguggugaagccaaggggcacaaccaagagaaaaccugcauccuuucucagcaacccucaggagguggccuuaagugcaaacaggcucagaagacagcaggcuccaggggagcacaguuaccucccagggcagaugcaauuagcagguuuuuagugacuggggagccagaggccaauuugaugauuuacuguaggaaauaucaucaagaccacugguacucagacuagcagauuuccucccuguaggcagacgucaagggaaggaguuguaaucaggagagcauuugguaaacauagaaucacagugagaagagcuagccagugugaucagaaaguccagaggccuccagagucaggacagccccaucucuccauucuauagggaggccucacaccuggcagcagauguggaagagagaggcuagaguggggcugcccucccuuguauagagcugggguagccuagcagcgccaauuugcucagauuucaugguuggccaccucugcuucugacugacgugcucaugcuuuagauaugcgaauggccucagcuagguugucaccaaguucugccaacugcaaagccccauggacucucgaauggcuuugcagaucugggaucuuguguuccuucuuucuggguugguuuuauacguuaacugucagaggcauaugccacuuuauucagguuccuuagagcuucuccuugcuacccuguacugccucagagaccacuggccaugugggaacuugaguuagagauaugcugaccucuagaguagcaacuucccucuuucuguuuuguuuuguuucgaagucuggagccacaucagaggaaggaaagacuuuaaaaaaaaaaguuuaccauccuggaauauuuuauuaucucuagaguucuuuaacuuccccggguugcagacuuccuuucgaaauuuagccagaauaucuauauuucucauuugagaacagugugucucccugcuggaaacucaaguucuucaauuucugggugcaaaguccacgcagggccauugcauguguguggagauuacaguucucuuucuacaacugaaugcuuucuuagggggguacacacacuucccuacaggcuuugcugcucuuucuugcacagauggccacuucuccuguaggccuucuggguacuuagcccuggaaccuguggucccaaaucguuccuuguauaaaagccagcucuucccuggugaguguuacaugggggcuugcccaaaucuugaagcucuugaguagcagaggcuguuucugaagagguuccugaaaucaggaauguggcaugcaagucggcccccaacuggggucucuggauggcucaguggcuagagacccaccaugaagguguggguccuuccaugaguaacgaaggccgugugcaccuccugguauaaacucuguuuucuucaaagaauuuuuagagaggaaguacauauauagacuggcuuacacuggucgaacauaagaguccucaacuuaguguaauuuuauauuuuauauuuugucauaauauuauaaggccuugcacacaaaugccuuuauaaauaacuacuucugggcugggugcgguggcucaugccuguaaugccagcacuucggggggccgggguggcagaucacuugaggucaggaguucgagaccagccugggcaacauggugaaaccccaucucuacuaaaaauacaaaaauuagccggacauguuggugggcaccuguaauuccagcuacucaggaggcugaggcaggagaaucauuugagcccgggagguggagguugcagugagcugagaucgagccaccacgcuccagccuggacaauagagcaagacucugucucaaaaauacaaaagaaagaaagaaguaaagaaagagcgguggggggaaagagggagggagagagggagggagggaggaaggaaggaaggaaggaaggaaggaaggaaggaaggaaggaaggaaggaagggacuacuuucccagaauauaccugauuugggcuugaugugaacauugaaccacuucccucuaucacauauucaguuggggaugggaaacagugucuacagggucaccaggucaauuugguguccugccccagccaccugugugcccuggcaguugucuauaaccagauuguccucucaucuaaaagugcaaacuccugauaagcucauggcccucaacaccugguggauagaagcaauagcaugggggcuggggggugguaagcaccuauaagucucaaagagcggagccuugguuuccauuugcaaacaaacccauaagcccuauaugaacucugacauuagucuuugauaucuguuugauuuuuuuacugggucagggacugugaugaguccuaaccuaggggaccaugaaaaggauuagaaauagaauuacuggaaacacaugcuauucaaaacagguagggccugagucugcuuaggaaccuguagcuuuugcuuuuuuucugucccugggccucugugcgucugggagucagaagaaaaaaaaaaggcagaguguaauaagaaaugugcuccuuggggcacccuacugaccugugucuuugucagucagauuuccuacuugaugggaggaguucugccacccuccacucugcgagaccuucccuugcacagugagugcgggcuucaugugaaaccguucauacuccaugcaaguggcgcaagccugacagcugugaagaaaugcuucuuggguuccugcucaguuaaggggcugacuuuaugcucauagcgacagcugcaaaauacagauuuaggguggaggcaccaggucuaaauuccaguuaccguuuguguuuuuaaaaagucugcauuuuuacguccauggugcaguuuuacaacuugcugcugugauagccuauacacagacauuucuuguucuuuugauuuuuaaccaaaugauuucuggaaccagagcaugggugacuucucaggggaugaaagcgcuagagaaucugaauuucaagaggugggauagggaaggcuaugagauuuuggaaguugggcaacaugggagagacugugggaagcgugccuuucugcuuacggugauuaauuuuuguuucaaagagcagcucucccuaaugaggguugcacaugcuggagaauuaguaagaaucucgggggaugcccgugcuucauucuuuacgcauaccccuagguagagguggaaguauuugguuccccuacacuccugacagccuauuuccuaugguuaaaggagaacuggauuucccagcaaaagcugaauaucagggucuggagaguccugugucucccuacuaccugugaccaagcuauuauuccugccucuucaugcuccacaguguggcaggauggaagguuugucuucuaccuggacgauucgagacucucgcuugccugagguguuuuagcaguggacugaaguguacacauuucaggugacaacuucauugcuuccgcuagaggaaauagacauacuggucuacaugugcaucaacacaauggagggaaaaacacucaacuuuuuaaaauagacuuuuaaaaacauuaccaagacugcuuaacaaaaaauccuuuugaacuuggaaaguccuuucuuccauacauaaaggaaagguuuuauguggcuguuuugcuuaaugugggcugguuuuauuuuggacucuuugaaacccagcgugaaggcuaaaauucugcucuguggaaaagucaaaaugaaaggaauugccggguuuggguugugcugaauuaaagugacaagguacagauaacagggcacagccaugcccacaaauuagcccucucuaauuugcugcuguggaaaguagugcuuugguguugcauuguuauuucuuuccuugaauuaaaguuuaaaaaagaaagccuaguuugcucaaaggaggaaaccggaaaaauguaagcacuucaguauugaaauagcccaugguucccauguucagggaauugucugaggaaguucugcuucaaaaacauggaaauuaugugguuuuauuuuuagaagccucacuucuaaaauguguauuggauuauuuugugugcuacuuaaagcuaucccucccaaagcucuuguugacaugcagaacgucuuuugugugggucaggugacggcgguauuuuuauuuuaaaaacuuuuuuagagacagggucucucucuauugcccaggcuggagggaaauggcacaaucauaguucacuguaaccucuaucuccugggcucaagagaucuccuccuaccucagccucccaaagcacugggaguauaggcaugagccaugcccagcugguggcagucuuuuguguguuuuuuuuuuuuuugcacaugaugugcccuggcaucauggagugacugcagcaucuuucuccaagaugguauggggauccagaaagacauuugguuuucccagccagugugcccugcuccaaauuauaauacuccuuuuucccaauuacaacuucccagaaagcugaaaugucauucuuugaaauguggugguacaugauuauaauauuaccaaaaaaaaaaauuaguuacauaaauuguguaauaaaugucaggauuacuuauuacaacacuguacaaaaaaaugcaguauuuuggucuugguaagucuuguuuuguucuuaguauuuguguauguuaacucaaggggagaccuguugucucuguaucgaguugucugcuccucugguggugggcacuuucacacucauaggaggcuuucauucaucugucuggauaauaauggcuaauuucacacucugacuuuuaaggcauuguuucucaaaguguauuccacagauuguuacuagauggugauguuuaaaggguuccuugcacuuugggaggcugaggcuggaggauugcuuggggccaggaguuagagaccagcuugggcaggcaacauagggagaucccaucucuacaaaaaaaauguaaaaauuggccaggcgugguggcauguaccuguagucccagcuacuugggaggcugaggcgggaggaacuauugagcccagggggucaaggcugcagugugcugugauugugccacugcacuucagccuggguaacagaguaagggccugucucaaaguaaaauaaagggucccaugguugaauaaauuugagagacacuaggauaaauaaagcaaacagauugauuuccugaaggauuuuucugagccuuuucuauacaaaaguacaucaugacuuuucaggacagcgaguggaacagacaucugguuucccacaggaguaaguuccuaagugccugcuagggaaacacugccucaaaguuuggcucuauaugccugucuggagugaauuguguccccuacaaaaaugguauauucgaguacuaaccccccaggcccuuagaauguuuccuuguuuggaaauaggaugguuuuagaugcaauuagcuaagaugagaucauacuggaguagggucggccccuaauccaauaugacugguccuuauaaaaaggggacauuuagagauagaagcacacacaagaagaacacagcaugaagauuggaguguugcugcuauaagccaaggaacuaccagaagcuaggagggaggccugaaacagacgcuucccuagugcuuucagagggagcagggcucuguugacaucuuggccuuguaacuucuagccuccacgacugugagacaguuagugaugcuuuguuaaggcagcacucggaacuaauccauuggcacucuuggguugaguuuaguaccucagacuucuuuucaggauaggccagggccauauccuuugugcuagaagcugcauacucaagugcaucucugguucuuucuuuucuguggguuuauucuuuaugcuauuugugauguuuucacuggggccugcccuuacuucccauugaccuggaacagagguuucuuacucuugcuauauauuagagucaucuggggagcaggaacaaaacaaaacaaaacuacugccugggccuugcuccaggccaauuaauugagacucucugggagugaagaucaaauauuuuauuaaaaacucugagucaauuacaaugugcaugcaaggcuaauaaccacugaaggaagcagacaccaggccgugugcagggaagggcuuggggaggaggcuccaaccaaaauucggcaggggaugggaggaucuuuguugaaaccgagaacucucgggcugcacgccugacugacaugaguuuggacccuggaucucuacuuacccgaccugacuguggacccuggaucucuacuuaccugacacgaguguggacccugaaucuuuacuuaccugaacugaguguggacccuggaucucuacuaaaccugaccugaguguggacccuggaucucuacuuaccuuaccaggaccaggugcagguaguuuagcugcucucuccuguggcguccugauuuaacacuuagggacaauaacgacucccuaggaaggcugucgugagggucugugggaggcucuguacaagggcagugaguccagggcuguaaggacuauggggagacagacuggagaccugggcuccccccuccagccccugcccccuuuucucuguggucucccuaggcaggaaucaucuaucucugucaccuucugcccauuuuccaaaccuaguccuugauuccucccuccagcccucccuccccagcuaccugcucaaaacaauugcaacauccgauaggcuuccaaauccaaggcgacuuucuggcugcacaccguuucuucacaaagaaaacacauuuguugaggaaguaugcuaauuccucaaggaaccagcuccagggcugggcaugaaaucacuguggcuugcaccacuguggguugcaggcacuuccuuaaaggugaagucauucuggguaaaaggcaggcaacuaacacagcaucugaaagacagcccuggagcucuccgguugaggaggggccuagaucuugguaaaauuucuggcuccugccuggaucacagucagcuguggagcacguaacacuaggacuuccuggggaauuggcaucuccggaagcugggccuggcacugguaguuucccauguucuccaggugguuccucaaaagcucuaggggcgguucugccucugugaaggcagauuggccgccccuucguauuuugugugugugcaugcauuuugccaugugggaagcuagcgcucgcucagcuguucacucaacaaaugcuuauuaggugucaauaucuaccagacccucuccuagacacgggauacagugggaaaccaaauacucaugcuugcaugaagcuucuuuucuauucagggauccagaaaauaaacaaguaaacaaaugucugagaugauuucagacccugagaagugccaucaagaaaauaaaacaggggaguggagugggaaggacagagagcaccauuuuagauaggagccaaaucacucuucucuaaggaggugacauuugaauggaaaccggagugaagaaagggagugagccacagggcaguucgggaaauguugugggcagcugaacagcccugugcuuggccugcuggggaauagcagggccaguguggcuggaggggagggggagauggaaugaggaacagaaaaggggccagaggccagaccauagaggcagauggaccauagcuggggcuucgaaugcuuuucuaaacgugauagggugccuucgaagguuuugaguagggcagccacaugaccugacuuaggucucaaauggaucauucuagagcaucaacuacugugggcaagaguagagucagagagaucagcuagagguggacuuuucggcacuguccagggagcagcuaggagagguuuaugcauauguggcagguaaaauauuacagcgaggcuuuaaaguaauuccuagacaguguuuacgauucuuagaacuucaaagcaaaguauggaauauauacuuuuugcauauugucaaauaauucugcaucuuuucaaaugugauauuuacaguguuaccugaacauggucacaagcucaaacgaauucgugugcauuuuuacucaugucuuuuuuuguguguacaaccguugcuaguuuuauugcagauuagagugaaagaaguaauuuguugaggucagauuucugaggcaaccucucaaguagaucuagaacuuacuguuuucuugacaaauaaacaaacuggaaaguucuuuuuuuuuuuuuugagacggagucuugcucuuucgcccaggccggacugcaguggcucuaucucggcucacugcaagcuccgccucccggguucacgccacucuccugccucagucucccgaguggcugggacuacaggcgcccaccaccgcgcccggcuaauuuuuuguauuuuuaguagagacgggguuucaccuuguuagccaggauggucuugaucuccugaccucgugauccgcccaccucggccucccaaagugcugggauuacaggcgugagccacugcgccuggccugacaaauaaacaaacuggaaacuucuaauuuuucuucaaucuaauuauuuugcucauuccuguuuauaaauguugugccuuuucuaaugguuugcacuuuuuauugcaucuauaacaccucauuaaucuuguuugaguccagguaauuacaugugcauaguaucaucuuaaucgugucauuuguuuucagucuguguuacuaaaagagguaauaaucuguauuaucaaaauagguaugacuaaaauagaauucaauagacucucuaagcaacauauucuauaccauaaguaaaauauagaagccaucaaaaccuguauguuucggccgggcacaguggcucacgccuguaaucccagcauucugggaggccgagguggguggaucacgaggucaggagaucgagaccauccuggcuaacacggugaaaccccgucucuacuaaaaauacaaaaaauuagccgggcgcgguggcgggcgcuuguagucccagcuacucaggaggcugaggcaggagaauggcaugaaccggggaugcggagcuugcagugagccgagaucgcgccacugcacuccagccugggcaacagagccaaacuccaucucaaacaacaacaacaacaacaacaaaaagcccuguauauuucaaacuuuaccuaaaacguguauccuuuuaaauguugccuaaaauaaucuaugauuagacucuuuucccguaacauaguuacgacauuaaaaggaaaugugcuagaaauauuauacccaauaauagaaggaauaauuaaaugggcagaacuuaaagaugaauccccaaauaaaauuuccaaaaauguaacaaaauauguaagcaguagacacuuauauaagugugcucauuuaugaaauguuuugaaauuuuugucucaaaugccguguaacauaaaugacaaguaaaauuucauuaacucaccaggaagauaacaauuuuaaccaaguggucaaaguuaacgucucuguuaaugggacaaaccaacuauauaugcccucugauauagcaucacucccgugauaggucugccaaaaaugcauaaccugacucucacugugaggcgagauguuagauaaacuuuugugauuuuuucuguacucuuaaaaaaugucagcgucaugaaaggcaaagaaagaaugaagaacuaucccaaacuaaaggagauuaaagacacagaaaaacucaaugcccuaagcaaucuuggauuggcuuuuaguccagggaagcaaauucauuuuucuuuuauaauaaaggacauuauugggauaauuagugaaauuuaaagagggccuguagauuauauaauaguguguaucaauguuaauuuccugauuuugauuauugugcugugauuaucuaaaagaauguucuuguucuuuagaaauauacauugaaguauggaggggaaaaguggcaucacaucugcaacuuacucauaauacaguugaaggggaaggagaacuauucuguugucucuacccuccuagguucugggccuggggcccugcaaauuagauugacaaaagacagauuaacaagagauagcaaacagaaguuuauuaguacaugcagcaugcauacaccugggagaaacucagugaugaguaucucuguggagugguuagaacuugggcuuaucuaguaucuuaacaaagaaaaauaaauuugcagagaagugauaagacaaaggaaaaggguuuuaggcuucccaggguggcagacugugggaaaguaaauacguggggaauacuaauggcagauaaggguuaauuuaguaagguuuguuugugcagguccauccugaugcagucucaucucaggugauaagguuguuauccccuuccugguaugggaugguggggacaccuuuacaagaauuuaucuucugcuuucaggcagauagugagagggccaagagcauguccuguuucugcuuuuaaaaaaauuaccuucagcucaaaauaauucuuacgccaaaguggcguauuuuugaauggcauacucugaaccccuucacaguucagaaaaaaauaauacaagaaaaagcgagauaaaguuacugugauaaaauguuacuauuugggaaauacgggugaaggguauacuuuacauucaucuuggaauauuuauguaugucugaaauuauuuugaaugauugacucuaaacugggcuuaggagaaaacauuuuauuuucuccaaaauugcagaacacccucuauccuagugguuucuaaguaguaggaaggaaacuuuucuuuuuuaaagguaaggcaaguguuucugagauugccuuaaauguauauaaaauagcuaaaauauuucaaaauuaucuuuuauccagagagucuugacauaccagaagagugaguuagaaugaaauggaccaguaggaaguauuuuucuaauguauagauugcugaauucuuaaagaaaacuacuauauaauuuuuuuucuuuuucuuuuuggcuccuuaggagucaacuugaaaguauauaauuuaaaauauuuuauucccauuguucauaaacuugcagagggauccuaaccuuuguuauugaauguguuuuagaagaggaaaugaaauuuuacuaagaagugagaaauucaccauagaaaggauuuuuggaauggugggaguggucaauccuggaacccuguugaagacucucuccaucccuauggacugggaagagguguggacacuggauuucucauguucuagagauaaauuucccucgacauugguuuguggaugguucaagcuuuaacucugaaaauuuuuauuuuuccauaaguuuacauuuauguuaaucuuauggucuacauuccaucaugaaaccacccauuguuauuguaaguacucugggauugccuugugaauugucacuuaagagguaguagccaguucccagugguuucacucuucauuagugcaggguuguauauuacugacuacuuucguacagaauuaaguccacuucaugaaguucugcuucucaaacucugccuuugguacuggaacuuuaguaaaccaguaaucuaggggguuuaaauaauuauggucacccagauuagagaaaugguacucugagaaagguugguucuuuucuuaguaauaguugucuuaugaaugacacggacugugaaguuggacauuaucugggaucaguucucacucuacagcagcuggguaaucuuagacaagcuaucugugcuauuggcagauucuguauuugagaauccaguuacuugcuaguaucuauuuguaacccccaaaucagugcuuaaggcacuuuuguggucauuuguggaugagcagagcaaugaaaaauuugaguugccugacgggcauguuucuagcccugucuucuuguuucaugucucauacuguaaacaaguacucuuuuuguggucuauuuaaugccacguuuuucacauuuuugugcuuucuguuggugauuuagcuuuuuaaaauggcccuaagagugguacuggcgugcuaucuaauguuccuaagcacaagaaggcuguaugugccuuauggaggaaauaugaguguuagaugagcuucguucaggcaugaguuacagugcuguuguccauggguucaaaguuaauaacucaauaaaauguaucaaagaaagugucuuuaaauagaaacacacauaaaauaaaguugcacauugauauguugacaacgauguugugacauuacucucagagggaccuaacucuguauuuuccuucaggagcgaucauuuaguguuggcaaauucaguguuuguggugacuuuauagaacacaacuacuucugauagugagaaugcauuguauucagucuuucugacuaucagcuucggaaaguaacauugagacauuaucagucauuaugccagggcaacacauguaaacaaaggcuaugucaagcaaacugggucauauggucauccuaucccagguaaaauggauauuaaaauaccuccuuucaguagcauucagcaaauaauuguccauccccuauguagccagguacuauacugggaaaugggugucagugauaaacaaaaccaacaugugcucuuucugcaugguguguauaguguauuggaauaggaagacacaaaaugaauaagcauacaaauuaucauauugucugucauucaaaaagccaccaggauggcuaaauaguagaaaggagagcuuuauuaguaauauggguuugcaagccaggaagaggaagucuguacauggacugaagguacucuaucuuggaagaggggaaggacagcuuggauuuuaugccucacagaauucauacuacacaagagucacgcauauucagcagguuugggggaaauccugugcauauucaugagaggauccaagugcaugcacaauggguaaacauauaugcaacauacaucccacauucacuuuggggcauaguuuuagaauuaaaacgagguggaaaaggcucuuuacauccaaaggugaacuauaggacacaaagacaguuugugugcauccucuauaagcugcugaaacuggccuaaggucugcaguaccuuauccaaaaagaauguuugugaggcccguccucuguccaaucagaguugcgguggccuggguuguaaaucagauuuaggagaagucugauaucuccuauuguuuagaaguuuagagccacaggaauuuggaaguuugccaugccagcuggguccugacaccucaauacauaaaaaucuuucuuuucuuaaccuuagaguccaucuuaauugauaaagggguaucuguuuugaucucucagaucacaaguuauaaauuaugaccaguucuaugaagaaaaacaauaagcuuuuauugacaagaagaaguauagaauugggaagguggaauggugaggcaugggaggccucuuugagaagaugaaauuuaaagcaagaucaguagaugagcuucauuuuaccaggagaagagcuucccagguggagaaugagguagucuagagccugaccccuucaaggaagaucuuaguggcugaaaaguaaugaagaagaagaaugugaugaggccgggcgcgguggcucacaccuguuaaucccagcacuuugggaggccgagguggguggaucacgaggucaggagaucgagaccauccuggcuaacauggugaaaccccgucucuacugaaaauacaaaaaaauuagccaggaguggugguaggcgccuguagucccagcuacuugggaggcggaggcaagagaauggcaugaacccgggaggcggagcuugcagugagcugaggucacgccacugcacuccagccugggcgacagagcuagacuccgucuaaaaaaaaaaaagaagaagaaugugaugcaagauaaaguccuguuaagaauucuaggagcaauggggauccacugaaggauucugagcagggaaguaauaagauauuuuacaguucucuggaguguauggaauuggaaguggaaggaagagcaagugaaugcaaaggaccaguuacgaggcuacugcaggaguccaagcaaaagugaugguggcaguagcggugaaaggagaagauagguuuggaagagauacucacaaggucggaucuguuaguuuugaauaugaauguuuaagauaaaaaaaaaagaucaggaaugauuuucaaauuguuugaacagagguaccauuuucugaaaggggaaauguugaaggagaaguagaucuuggggcacagagucaagaauauagcaaauuaaaguucauuuacauagaagaccaucuguaaauauuaguuuuuuuuuucguuuauaccacggcaguaggaauuuuuaaaaugacauuuguuccuuuuaucucccucuuuuucuagagggagauuuguagauucguguuuaucagaguccagauuugguaaccccucuuucuauuuucguaucaguuuucuggacauucuuuugcaugcauuagguggacagugaguuaauacucaucuccucaguucuaccucucuccacaaacuucugugguuuuccuggugcagguuucagaucugcuucaggaugccaggaagagagagaacggggagcuuuaucuggucuagauucuuguacaggccacacaguaccccagcacuggccuucugaggcuacagcucuucaguucacucccaagcucagcugcugucccagggcagaguccccaucccagcauggcugggaccauagaagcuucaguggcagccaugccaucagcuggaccaacccauccauagggaccuccggauuuuguuucugaacuuggguuguacuucugacuucuccucccaucuuugggaauugccuugggaagaaaacuuuucuucuuaggguugcauggucugagggaugggggcugugcauuaacugucaauagacagacuaaaaggagaaaagacaaggucgauuuccauaugcugaaguacucuuugaugagugcuacacagacagguaaauuuauauaccaauuuaacaaauaagaguagugcagagcuucaguggggaaguauagcaggcccuguugugcuuuuugaugcuuauggcaacugauuuuguacuuccuggugccaaggcgcuggcuucucccacauagcaaacagccuuggaggaggggguucaaugguggcugaauuucucagagguucugcuuaaauucagaauacuacuuuggugggcuguuaaucccuucagacccuaaauuugcuuuccucucugaagaauccuggcccaucagagagucuaaauugaaugccaggagaaaagggcuccuggaggugucuccuauccacaugcaaguauaucuaccuucuccccagugaccugcucugucuaccagagagcguugagaggggugaccguccucuguucacagaaaggugguauuccccauucuacccuuguuggugguacuggcgcauuccauuuacguaacugugugaggccacuguguugacucaucccugaacccagaagaucugccucaagugacuuuucacuuuggcuaccccgagacacauggccuggcaccuucacuuuccugaaacuugugagacauaccacauccuaugguuauagagauuuuuaacuacagauggucccugaauucaacuuaagauuuuuggggguucaguggugcaaaagcaauaagcauucgguagaaacuguacuucaaauuuugaauuuugauauuuuucuaagcuagcaauauguggcguaauacucuccaaaacuugcagucagccaugagaucacaugauuuugcccaccuguaggcuaauguaaguguucugagcuccuuuaaaguagacuaggcuaagcuauaaugaauguccuguagguuagguauauuacaugcauauuucacuuaugaucuuuucaacuuaacaggauauaacuccauugaaaguccaggagcauugguaauggauuauuaagggaugcugugaguuaccaguucacagauuucuugcaacuuuuuaaucucugauaaaugaaaauguuacacuccaguggguucuucuugccugcuacacagauaaagccaaaacgcugagacggugguguugaaauagggaaugaguuuaguuaucacaaggcagccgagcaggaggacaggagauauuucucaaaucugccucucugagagcuuggaggcuagcguuuuuaaaggacaauuugguggucaagaggcuagggaaugagugcugcugauugguuguagaugaacucacaggagugucgaaaacugucuucaugcgcugagucaguuucuggguggggguuacaguacuaauugagucaguuccuugagaugagucaggucccugaggugguagucgguucaccagaaugcaaaaaaucugaaacguaucucaaagaccaaucuuagguuuuacaaucgugauguuaucuaugaaaacaauuagcgaaguuauaaaucuuuuaacuucuggcaacaugacuucugagcaguaagcaagcuagggaacaauagcugguuaucacuuaccuaugcagguacucaggccccucccauaguuagcuuugucuaugcccaggaaugaggaagggcuguucgaagcaagauggagucagguaugucagauuucuuucacugucauaguuuuuugcaaagacaauuuagaaaaauguuuaaaaacagugggcacuaggucaggucugugaucaaagguauaauucuauaccuugcuaacugaauugguucaucacuuccuucaagagcuguaagaaucaguguuuuuuuuguuuguuuguuuguucauuuuuuuaaaguuuuuuuggcuguaaguuuauucaaugugaaauaauccucuccaguuuuacugagguggcugaccauguucacaaccaaauccuccucuaaacuggaauucaguugcugacccagccccagccucuacuuucuuguuggcaccaggaggcacagcagcacuaugucugcacguaucucuguuggcuuccccucuugugagucuugcagguugcucagucuccagaccuuuaggccgaggccugccagucucuggacggcugcaguguacaguggcaggcacagucuccagggucagaugaagguaaucacugagauacuggauacccucauugguaagguaccaguagaagugucuccaggcaaacuguuccuucacacagccucgggacuugagagacugcauggccuucaugaccugaagguugggcacauucuugucugccagcuccuggugcuuaggcaugggggacauccuucuuggccaccaugacucccuccuuaaaaaggaguuuauaaauggcaaucugguucuucuuaggcaucaacaucuugguggcucugggguccggggccggggcuugaaucauaccugacuccaucuugcuucgaaccucacgggcugacugcccuugcuauuccugggcauaaacaaggcuaucuaugggaggggccugaauucugcuaagaccugcauagguaagugauaaccagcuguuguuccuuagcuugcuuacugcucaggagucauguugccagaaucagguuuuugguuaggaaccauuuaauauuuguuuacuagauuacaaaaacagaaauauuuucuuuuucuuuuuucaguuaccaaguguuuagcaagggaaauguaaucugcuacaauaugauuaugccuucucuugaacacuguguugcuucuagggagaggaaauacuagaggaaucaggaagaugggaacaaagagcaaaaaauuacuuuguggaguuaagagauuuuuucuuucuuuucuucuuuuuuuugacagacucuugcucugucacccaggcuggagugcaguggugugaucucagcccaccgcaaccuccaccuccuggguucaagcaauucucugccucagccucccaaguagcugggauuacaggcaugcaucaccacgcccggcuaauuuuuguauuuuuaguagagacguaguuucaccaucuuggcugcacugucuugaauuccugaccucaugauccacccaccucagccucccaaagugcugagauuacaggcgugagccacugcgcccagccaagauauuuauuuauuuauuuauuuauuuugagauggagucucgcucuguugcccaggcuggagugcagugaugcaaucuuggcucacugcaaccuccggcuccuggguucaagugauucuccugccucagccucccaaguagcugggacuacaggugcgugccaccacaccuggcuaauuuuuuguauuuuuaguacagauggaauuucgccauaguagccaggauggucuugaucuccugaccuugugauccacccgccucggccucccaaagugcugggauuacaggcaugagccgccacucccggugccaagggauuuuuuuaaacgacuaacuaauguucuuuuuuaucuggcaaccaguaaugaugcauugguuauagcauauauagguuuuagcaagauuucaaaaaaauuauuaauucucggacaacauggagaaaugagagcuggaugcuaauauaguuagacacgaugguugcauaacaacagcaaaaccucagccuccccucuccuucucucccuguggguacuugggugacccugagcugauguucagcuaggacucacuggcauacugguguuagggccagcauucauuccgauggaucauugugcacccuguauuguuguuaaauauuuuaaauaugcucucaggguguaauaaacuagagcucuugggaaaagcagaccaaagcugggccacagccacguuagcucucugggaacuucaugcauggugcccacacccuaccucuaguuaaaaugagaaacaacaauaaaauaaguaacgaaauccaacacuguacauuuuccccauaaugaugacuucaauauaucuuuagaaauauuaaguaacaaauuauguuuuauuuucucauugauugggugcuccugcuuugcuggugccuuaaacaugagccuuuguugagcucagaguaggccucccugaggcagcaggcaaaggagagaacugagaauuaaggauuuguucuguuuauauuuugagcuuccauugguaguuguauugguuuaaagugagugcaaauuguuugcacagccauuaagcguuuaugauaauguauugaguuguuuaaaauaaaagcacugcuaaaauuaaaaaauuaaaauagcaccauaaacaaauaaggcuuggauuuuuuuuuuuuuugagauggagucuugcucuaucauccaggcuggagugcagugggaugaucucggcucaccacaacccccaccuccuggguucaaccuuuucuccugccucagccuccugaguagcugggauuacaggcaugugccaccacacccagcuaauuuuuuuuaauuuuuaauagagacuggguuucaacauauuggccaggcuggucucaaacucccgaccucaggugaucugcccgccucaagcucccaaagugcugggauuaccggugugagccaccaugccuggccaccuuguaauucuuuuaauggaaaaauaaagcaaaauacucaacagagagggauuuacuacagaaguguaaauugauuaaacuaccgcuuuugcauauuggauuggugaaaugauuugcuuuucacuuuagguuaagugugccuuucccagaaccgaccucugcuagcgccgucuucaguguuacaccugauuccgucuccugcugcaccaugaaaugcugacucucaaggcagacaaugggacaggauuucagacagaaccauuuaccugccugugugauguuucccuguaggugacacagcacgggugccacuuccguaccagcuguggaagucuggcucuucccuuuaguagccucaggauacagggcugguucuggcuucauuuaccaucauuaagagccugucugacuggaagagauguuaucucaugauaauuguucccuucugcucauugccagguuggaaaaauagauaauggugaaaaaguauguugagaagcaccaauugccagauccccuaaugagugagguauuaaucuagaaauauaguggaaaauuuccuuuaaauauguaaacuagacugaagggacuggcagaaaguagggugacaguuguuuaugaaauuauugcauuuuuauuaguuugaaauacacuugcauauguuucuguuagcccuggggaagagagaaaauuuuauuaguguaauucaaaguuauaaaaagcacucauuauuaaauugcuauaacuuuaaaaaugagauacguaaguuaggagggauaaaaagauaaaugccuggaaaauuuuauuuugaccugcuugacuuugugaacuuagaaaauaauaaugaucauuuauugagcauguaguauauaccagggacucauuguaaucauuuaaucaucacagcaacccuaugaguuauagcaguauuauucccauuuuacaaauggggaaacugaggccugucaagguuaaccgauuuacccagaaucaccuggcuaguuagugcuagauccaggguucuagcccuggccuucugaccucagagguuauggucuucauucuucauauuuuaaaugccucagucacuuaacuuuuuugggguaguuuccuuauuuuuaaaaugugggggcaagacuagauucuuuauaauaaauuagaguuuuggaacugugcuaucuuuuuuuuuuuaacugaaacugagcagaggcaauguucaucacauacucacugcaaaaggucaagagaaugacuaaaugguaauuaccggcaguauuuguagcaauuuaagucauuucaggauuuuaccuuugacaguuauuaguuauuaguuuuaguaacagggacacugagagaagguauuucuuggucuacaucucaguugcuuccugauuucucucugaaccaaccucccccaacccaucucucccuggagcugccaaauaaucacaccucaagcaacggaaaucggcugcucuucgcaacucaucaggggagugaugacuaaaugcaggggaugagugagaagagggaauucaggcaacgauuaagaagcaggccacuaauuaggagaaccaggagagucugcuguuaucuugugcuauucaaucuggaaguuacuaaacucuaccuuaguagaaaaugugcgccugacuucuuuaggaaagaaaagaaacguucguuagcagauccuagauuccucuagauugcuuggagauuccuaagacauagccaauugaaauauauauauauguacuuucauauuuauuacugaaggaacccccccauuuuguuacugugcuuaaguuugguguuucacauaaguuuuccgaguaaaugaaagcuaaaacuaaauaguucaaaauagauuauaaugaaauguuaaaccuuuauuaaguauaugauacaagcaaaugaugcuuuagaacaucuaugcauuguuuagugaagaauuauaagaugaagauccauguacccaucaugcagccuaagaaauagaaugcuagcaauacuuuucaagcguggaucccauucucuucccuaacucaaguaaagauugcucugaauauuuuauuaguaaucucuuuguuuuauuuuaggguuacacaaauacaaaugauuuuuuuuugcaacuuuauaaaaacggaaugauucuaaguuuuucaguggcuuguucaguauuaacauuguuucugagauucaacuaugagaauguaguucacccauguagauguaguucauuuuuauucuucagaguauauuccauuuuaugaauaugggacaguuaauuuuuucucaggagagauagacauuuguuuguuuccauuuucuugcuauuaggaggauguuguaaauauuuuuguccaucucucuuaguguagaugagcaagaguuuuuccaggauauauaccccaggagaggagaugcuguguugaaggcuacacacaccuaaaauuuuacugggcaaugccaacuuguuuccaaaguaguugugccaacuuuaauucucaccaggaguacaugaaaguuccuguugcuccacauacuugccaaaacuugggggcugucagauuauauacauuuucuagccuuuuggguguaaaauggugucagcuuggcggggggucucugcauuccucugauuacuaaugagguugaccuucuuuuuauagguuuauugaccuucuuguuuuuucaugaaaugccuggauaugccuuuuggguugcuuguccuuuucauauugauucauuggaguucuuuauauauuuuguguacuaaaucuuuguucauuaucgaugucacuguagaggcagaaauggggugaucccuuuucuccccaucauaagagucauagcccacaccuuuauaacaaaauauagaucaacaagagaaaaacguaacaaguucauuaauguacuuaaacacgggagccauacaaaacauaugaaaacucaagaaggaaccagaugguugaugcuuaaauauacuggggagaaggagguggagagccguaaaugaaugggccccaaaaaacacaccagugguuuguaaaugauucucuuuggacucugaaugggaccuaaggauaaauaguagcugcagacaaguuacaggaagguaagggcagagccgcauugugaacaaaggucuuauuaugcagauaacagucuuccaggucuucacuuggaauugcccucaggagagcagaggcggaggcugacugggcgugguguccugagcauagagacuucuagucucuucucuggugguuaauguuuccugguuauuuaaugagauuccuagggaaggaguuuugaggcaauugcauuucuuuuagaaguuuucucaaucagauaagggaacuuaaagagagagccaguccuggugcuucgaauaguaaggaggaucagaaggaguagggagacgucagagggagaccuugaggcugcuucauuaguucagcaugucaaagcaccauauuucagggcguuuucugagccccaccauugaagauaucuucucucaauaugugguuucuauuuuuuuauuaaaauuuuuuuguuauauuuuuucuuaucaaaccuuuggauaagcagaaauucuuaauuauauuguagauggauuggucagucucuuuuuuuuuuuuuuuacauuuugggcuauauauagcuugcuuaagaaauccuucuuacccguugguuauuaggauauucuuguauccuaagauuuucugagaugucuguuuuucuuuuucauucaaauaguuaaucucuggaauuguuuuguuuaauguggauuguaaaguagaggcugauuucauuuugcccccuacauuguccccaugccacuuauuaaauacagguugaguaucccuaaucugaaaauccaaaauuugaaaugcuucaagaugcaaagcuuuuugagugccgacaugacacucaaaggaaacgcucauggaagcauuucagauuucagauuuuuggauuagggaugcucagccaguagguauaaugcaaauacuacaaaaccugaaagaaucugaaaucugaaacacuucuggucccaaguauuucagaugagggauuuucaucccuuccaucucccccagccacuggucugcacugucacuuuuggcacauaucaagcuuccauaugagugaaaguccuccagacuauaaauguuacauaaccuuguugacaucuuuauaauauugggcucucuuaaucuuaaacuuuauauguuuauccguuuauuuugguguucuuuaauguuuuucaauaacuuuuauugcuuuauacagaaauaucuuguaaaaugccgagagggaaagcuucucccuucaucuccugaagguuugcugaaaauauacugacaaaaggccaaugaaaaggagagaaaggcauacaauguauuuaaugugcacaaugcagggaaucacaugagaaugauuuaccaauagcccaauguaguccagaugcuuauauacccuucuauaugugggagagaggagacagagaaugugcaaauaaguaacaaaguuccccugagcucugagggaggugucaggaaggugagggauggaacuucacugugagcaaaggucaucuuaugcagauaaagccucccagguaaucuaugagaguugcccuuaggagaauagaugaaaagccuguccagauguggugaucuucuuuuccugggugguugaucuuuuugggcuauuugaugagauuccuagggaguggggucuuaagaaauuccaaagagagucccucccgguucuuugggaaagaagaucagagacagggagguggaagcaggucagagagaaaccuugguucugaggcuuauuucugaggcuuuucacuuuucaaagcacuuagcaugccaaagcuccguauugugaugaaucauuuucugcacuccaacacuaucuucuuguuuuauuauuaucaugaaauguauauuuaagacauaguucuuucugaugcuuuguuccugguguauagaaaugcuaaucacuuuaauauauugauuuauacucagaaaccuugauaaagccuuauuaauccuaauaguuucugauagacaauaauaucaucugaauaaugaaaaauuugccaccccccuucuuaaaauguuuagaaugagauuuccaguacaauauugaauagaggcagugauauuugacuuccuugccuuguuuuugauuuuaaaggaaaaguuugauggcucacaguugagcaugaugauugcuauagacuuucuguagauauccuuuaggaaggaagcuuucugccauuccuaauuugccuacguuccuaagaugcuuuaaaaaauuaugauugacuuguguauugguccuguuuggcgauagcagaaaggaguuacauuuauuauccgugauuguuuucgaugucugccauggauauuaguggggagggaaagauaggaggagguaauauaugcuuauuauauacuuauuuucugauugcuuuauaugcuauaaaauaauuucaugcaaauuaccucauuuggguuauuguuuccagugucuuuuguuuguuuguuuguuuguuuguuucugguagggacuuagaggauucugauuccauaacuguggcuggucuuaugcccaccaguuuuuccuaccacacacgggugauauucaauuugcacuaugcuuaauuaaccuauucuuucuuccuuagucuucucuagucuuccaugucacacacuuagugaauuguaccuguagccuguuauuuuucacuguacuccugaagaauuuucuuaaaguaacuaagaaaucaauggugcccuuccauucugauccuuuucuuccuucauucacuuauucacuugccagauauucauugauagcauacuaugugaccacagguaaaauggugaagaaaacaucccugcccucauagaguuuacacuccagaguggaauuaggacaauaaacacauagaccgguguguaacauugcaagguagugaugcggugaguaaaggagugagugggagagagaaagagagggagggauuacugggaaugugugugugccaauuuuacuggcauuagguuaccuaggaaaggcuucccugaggagaugaccuuuggucugagucccaaauacagugagaaagucagcugcgggaaguucaggaacagcagaugaaugacaguguggugugucuggggaacuugaagaagucagguguggucaccagagagcaagacaggagaaacugguaggggacagagaaagagacagaggccaggaaaugcugggcuugcaacauucucauuagagagauuuugcuuuuauugaugugaugaaacuauguaaguauauuuuaguagcacauaauaucuuuguuuacuuucucaaagaauucaucagucuguuaucugauuucugggaauaagaacgcauccugggcuucgcucuugucucagaaucuccaaacucagugauugaugggaagaagcuucuuguuaauauuuuugaaaugaauaaagaaucucucuuucuccguuagaggaguucggagaaugcuauugcugaaguuggccuggcucacugcaccauguugggaggugaugcuacaggggggagauuacagaggaauaagccagcauugaguuuccuuugugguagaggcucauugugugaggacgggagauucucagucugacuuccuucuccagguagaaacaucuaacuuaaccaaguguaaaugauucaugugugacuccauaacuuugucuugcuugugcuccuguucuaaacucuagguguugggagauuggaauggaucucauuuugaacuggaucuuaacuucuuugcuucaauccccuguugauaaaaugagauuauacagcaauauuugcugaccuuccucacagagacccuacgugugaugaagugauuuacauguugaaagggugguuuguuuucuuaauauaugagaaauaguuaaugcuaaagucugauauaaaacgauuauuaauaauaauuuuuauuuuuacuuuauguaauguaauuuaacucugaagaaaaaaaugcuggauauucuuuugagaccaccgaaaggauauggcgauaguuucuuccuuugucuuguagaagaauacaugcuauagaaaucgaggagcaaaaaucagagcauucuuucugaauuuucuuucucaucuuuuagccccuuugaauauggugugauuuuagaaacaacuuagaauuuagaaacaacuucuaggucauuuuaauaaacuugggaaccuccuugguggagaggucccuguaaguggugaauggaagugaaaucuuaucuugggcauucaucuaucagauauuuucuuauuaauguaguggcuguacucuuuaguagguucuacaauacauauuagccauuuuacauuuucuuacuugugaaacuuaaaaacacugcacacauuugauacuacgacaguacaagagggagaauggcgcuuaugauaauacuuuacuaugucucugccucgaaaaaguaaauagugaguuggaauaauuguuuaagugacugaaagaaaggaaccuacuauucaggaaagaagacuuuucagauugucugcguugauuaaugcauugguuaguucuucaacuccccacuuuaccucagaagccacauuuuuuccuguguugucuucacccuggguuugaacuucuaugauggcugaaaucaaguuuuggucauaagaaagaaugacugagaugaguaguugguguuugagagcuggugcuuugcccaugauggguagaagaaggcuucucuucugcuuuuuccagcgggagagcuucuucagguccacuguugagcagguguccugcuacccguucuguucugcagugacuuugguguuggcccacaccaacuagagggagcuuggguacaggguugacucuguggagcucggaagcuccuggguccacucuuaucuugcccauacuucaguaggauccccugcagccagccugggaauugaucggugcucagcaaaacaaccucuuuuauuuuccaguguccuuuugaaagacccuucucucugugaaguuucacagccuuugauugcugcaagaauuuaggaccacaucauagaauuuaaaacacaaaguggaaauguggccugguguuagaaguuauuuccguaaggcggaauggcuguauuuuccauucggugggaauggacaggaaaacugcuguugcauuuccauucuccgcaggcucagauggaaacgugugggggugaggagcuuucuguuugauaaaagcuaaaaagcccacucgcauuucuaaccuuucaaguuaugacagucauucacgacugucaaauauaauggcauuuuagacaucauccaggaaucguuaacagguuccaagugccuuggcacaaagaguuuacaaaaacauucugagcuuuguuaagaagacacuucugacccaccuucaauaggauucacuuuuuguguuaucuuucuaucaaugguaauagaaaagccgauauccuuaguugucugguaccugaaaaacaggauauauccacaaaagcacuugaguuugcucuccuuccucaagcaaaacuugccaaauuuuaaaauggugaaaugagaagaagaagaaauuugguuuugaguugaauuuucccuaucuuaauuacagaagguaaguauucugaaaaaaaaaaaaauuaagccagcauuaaagcauuaaagcaugccuucuagaaccuacaaguuauuuuccuauguguuaaagguuuugaaaacaagugaagaagucucuuucucccauuggaugaacauuuagguauuuaggugaaagcaaaaaugaucaagugugaauaaaacucuucaggagaucucuaguuuaagaauaaauauguuucaauauucuugcuuguugucugaaacugggaacaauuuuagucauagauuuaacaucauauuuggcagaauacauauuuggcagaauacacucaaccaugggaggguccccugugucucucuggagucucauuuuauauuaauaaaggcauagaugaaaacugcuuagagucuuugguucugagguaaacacugauugaggauugaaguuuggccugcugacagcauggucagccuuugccuguauauuggcccagguaugggguaugguguuggggguauugucugacuucuguggggagaggacuccuuuaugucagagaggccuaaggcccuggcagaguguuagucagaaaugaauugagagagggauuccugagggauuugcauuagucaaaugaagaagcaugggugagagugggugguguugccugugggggguuagaguccuucuaggccuagggugugauuuucuacugaacucuucccuggcuucuuugguuuucuagucacuugguuuaauuuuucuacccugauuccuaagcccuggaggugucuuccuucucuuucaacuucuaccaauguuuagaucuuauggucacgugauuucugagaauuuaacuucauagcuuauccucuugucuucugacucaaaggcaagcacauucaagauuuauuuuuccccuucuagcaaaaaaugaaaggggagaagugaaaggagguaggugugcuuuagagugauuucaaguagcugggcguagaaagggaaaauggagaggaagagagacuacauuucaucguaggagcuuggcauguuugggcaacugagagagggcuggagccacugaugugggauggggauaggagagaggaaugaggugagggagagagagauggauggaugcgcgggaugaggucuggacaguugggcccugguuagaucacacaggccuuugcgggccauguuaaagacuuuggauuugagcuugagagcaguggggagccauugaagggauuuaaacagaggagguguuugaaagucuuugugguuucgacuuugguggcuauguagagaauagaucuaagggcucuugcaagagcccaggugggaaauguugguuuggccuagggaauguuugugaggguugaguuggauuggugguggccuggacauggaggggagggagaaggacugugaaggacuccuuggucuggcacaagcaccugaagucaucagagggcccugaaguugucagagggccccgaagucaucagaggaggcuaguucaugcucugacaacagcaucuucaacauuucagguuacugcaacagaguuugcugucuugcaaaaucugcucuaaguccaagugacccuccagggcagcuguccucaaacucaaugguuuagucugccuuccauaucaguacacguucuaccaaauucacuguggcaagggaagagagaaccuggcucuccagugccucugucacuuccacucacaugucuuuagccacaagagucauauguauggcuguggccuuauccugcaagggggcuagaagugcaguccccuagagugcucagaagaggggaagcaggaaaucugguguaaagguguaccacaaagccauuuucuaaugugaggaaucugaaggaaaaauagcuucuggaggaaagaguucaguuuuugauauguuaaauuugagaugcuugugagauaccuaaguagcuaugucaaguaggcaguuggcuauuugagggagggagggaagaaggaaggaaggaaugaaggaagguugguuggcuuggguucaggauauacauuuaaaauguaucuaugggauuggaugagacuaccuagaggcgaugccuggagaaagacaaggacucagaaaugagcccuguauuaguuagucuaggcuaaacucugucguggguccaagcaaucuuaaaagugcuaguggcuuaucacaggcuuacccaugccagauguccacugggggacaguggguggcccugucauauuauaacuguaccaucugagcagaaacuuuguguuuuguguucaaugucuugugcucaauaccuagaagcauaccuggugggagguaguaccugguaauaccuggcacaaggauguaacggagaaauuauauauauauauauaucauauacauuucuauugagguacaauaaaaucaauuuucauuuagugauacugaccaauguauguagucauguaaccaucacaacacagucaagaaacagaccauuuuacagcuuuauuuuauuuuuuauuuucuucaugcuaccucguauaagagaaauagaccaguuucaucacccugaaaaguucccuugugcccccuugcagacucugcuuccaccucaccccugguaaccccugauaggcuuucuuuuugugugugugacugggucucugucucccaggcuggagugugguggugcaaccucugcucacugcaaccuccaccuccugggcucaagagauccuuccaccucagccucccaaguaggugggacuuacaggugcgugcuaccacgccugguuaauuuuuuugucuuuuuuauagaaacaggguuucccuguguugcccaggcuggucucgaacuccugagcucaagccauccgccggccuuggccucccaaagugcugggauuacgggcuugagccacugugcccggaugacaugcuaucaauguaauuuugccuuuucuagaauuuucuagaaauggaaucauauaguauguugucuuuuauaacugacuucuuuuauuuagcguagagauugguauacauuuucuguaaagacucagaugguaaauauuuuaggcuuacaggcgggauggucuuuguaggaucuaccuacucagcucugcuguugguaguaugaaauguguacugaauggguguagcuuuguuccaauaaaacuuugacuacaaaaauagggagagggccggauuuggcccauaagcuagagugugccaauaucugaugcagcauaauucacuccggauuuacuucuauuguuacauguaucagcaguuuauucuuuuuuauugcugaguagucuuccauuguauggaugacguuuuguuuauucaucgauugauggacauuugaguuguuuugagcuuuuggcuuuuaugaauaaaguuguuaugaacauucauacaccuaucuuuguuuucauuucucuuagguaaaucccuaagaguagaauugcugugucauaugauaaauauguacuuaauauuuuuaaaaauguaccaaacuguuuuucaaagucuuacuauuuaucagcaaugugugagaauucuaguuguucuaaguuuuuaucaucauaaugaguguguacugaaguaaauacuuauuaauauucaaaugucaauggauguaaaugaaucauugaaaauguugugaauauuguccagugucacucauauuuuaaugugaauuuuuuacaugacucuuauucucauaguuuugccauauauuauuaaacuauuuucuauucuuuaaucuuaagguuuuuauaaaauuuuccugagaacaauguagacaccaccuuuguagauggcaguuaauucaguguuagacuuacugauaagggggcagagcgcaauuucucuuuacacuuugcaguuacugaaaaccacacaggccuuacuacucaguugggcugaguauuggguugaaaucuuugaaaugugagaagccuaauuuaaucucaccucugaauaggcagccacuuuagcucuuccuggguauaccgaggacuacccacaggcagauucuggauuuuucucuaaaaaguuaugcaucuguuggaccccuagaguuuugucuuuuaaguguguggcugagcuaauuuuuaccuggaaaaacuuuauguagauguuugaaaugucgaccuugguguuuuuuuuuuuuuuuaaaauuucaguuaaguuucauaaacuuucauuuuaagccguguuacuucccagugaacucucuugcaccuaagugaauugauuugcuauuuagguucuuugccauaauaagcucauuaaaugcuggggccuguuaccaaaaagugauucuuucaguuuugaguacuuguucugaggcuguacucugacagagcaagaugucaauuaagauuauuccuuguuaguggaaauaaaaucaccuuaucugcuuauaaaagaaucucucuguucuuucucuaaggggagggagaguauauucaacucacacaaaguuuauccauucaugaagugaaaagguaaaagcuuagaggucaugaaaagauccccguuuuaccagaacggaaauuaugauccgagccagggguauuuuuccgcagagcugacucucagagguaguaucaaguugcagcuucuaucacagcaucaaaaauggagucucuguggagcuugaaaaucucaggccauaacugauuccuguccacagacucaaagucagaagcaaguucaccgugucgcagucaguauuacacaaguacaaagugaaaaggugugaccgugaucaauaauggaaaagugcauaaagccuuuuucuucccugugaaccagccuggauuuggcuuucagagucagggauaaugugccacgcucuuacucggugccgggcacuguucuaagccuugugcauauuaagguccaaggaaguuuaggguaaugguucagaacacugccuucggaugggcuagauugcugacuagccaaauaagugaccaguuuccucagugacuccaucuacccauguuuaggguggggauuaugauagcgccuuugucacggggcuguugugaggacugaauguguuaaucuauguacacucuuuaauaggguaccuggcacaggguaaguuauauagguguguuggcuauuacugucauuuuaguacucauccuaagaaauuguugacauagguacugugguuugcuccauuuuacagaugaguaaacugaggcacagagaggaauuuucccaaagccacaaggcuaggagguagugaaacuaggauuagaauacagacagucagaguccaaucagugguuguuaacugcuguauucugcugccuuccugcuuauuaggagaaaauggcugugcauuuuuagauguaaucugcaguaaagcagauaguccugcaaggaaggaguaggaaggcuguauuuggcacugacggcuuggacuuuaccacugguuccuccagaugagucucuacacccauugccuugauacaggucaacaaauuggcagagaguccaucuucuauuuggaguaguccuaucucaguaaaugacaucaccaccuauucuguuauagaagccauaauccugguucgucaaugacuccagcuucucccuguuugucuauuaucaauuguuuugauuuuuuaaauagcuuauaaauccaucaccuuuucugucuccacgaccacuccagcccaagucacugccaucagucacuuucuuaccaaccuaccccgucauccuugccccaugccagucuguucuucauguaggcaaagguaaaaugcaaaucuggucagcuugugcccgggcuuaacacauuaccugcuuuuacauuccaguccaggucugucugccuccaaagccuguucucuuuuuuuuccccauauuuccucuauaaaguuuguaggaguuucaaaucaaggccgagaaaaguaagauuugaaaggcugagaaaaguaagauuuuuuagguguccaguggaaucugguuuucuuugaccuuucucaucaaauucacaccucagauaacuaggccccagaaucuguacccauuaccagaccugucagcagaacucaaguguuccagauggguuuauaauaucugguauuuuucugggcaauaagaugcaagauggccuucucuaauuuuuuucacaauugccuucaucagucuagcuagggauuugugugucuguauuuguguacuuguuuuuauugucauuaguuugguuuuggcacaauagaguccuugucaaaguggauauuauuagcagguugaguuucaaguuugcuagaacugaaugcagauacaagcauuugaaauuaucaguauacuguuaauggaggcuagaggagaaaucaaaguaaauuuucagaaguaugaaauuagcaaacugccaacacaggguuggaaguuucucuauuuuccucuuaccagcuuuuaaucugguaauuucccagggaguacagacaggcuguggggaagcucucugcccaugcuaacuugaggggaaaaugagcauuaaaaaaacaauucauucagaaugcccugggauaccagugagcagaucagcaacccuaggauguaaucaauaauauuggcuuucagaauagaaccacagaccacuuuccccccaaauaugcaccacagacugccauucagcaccucagaucuuauuuaucuaugcauuugagcaggaacaagucuuuuuguucuuaagcauggcccacuggcuccacugucaucuugauguuugugugaaaagcucucacaguauggccguauggccaugcugauagcauguacccugacuguguuuuaucuuaaaccaaacugcagcaaacaugugaggcagcucagauaaaaacuagaaggaagagauuuuaucauaaaauccagggaguuuuggcagagccuccuaaagugaaagagaugagaaggaaaaaaucuauagguuuguuugucuuacuagugaggguagguuuguggcuaauaacuagagagauaaaauaucuacagcacugaaaaugggggaaauuuguuuuuuaacugcaucuuuccugagaaacauucugagguucugcuguuuagagccaugauaagacaacccuaggaaugaagcugaguaaucauuaugucuuagucuccacuaaaaccacagcuucuggggggcagcugggcugaggucucgccagcaaagcucauuaggccccagguggauuaugccuacuauagcagggaagggugugauaccuguguucaaccaucauaugggccacuguugacacuccugaaaccaaagacagguuagcaagcgaaaagcauaacacauuuauuuaauauaaguuuuauauaacaugggagccuuuagaaacgaagaccaaaagccccagaaaugaagacccaaagccccagaaacaaagacccaaagccccauaacuauucuuauguuuaggcuugauaaagaauggacagccauauagaacuaugauuggacaaagggugugaccuaauggcaguaugacugaggaggaaccucagcaagggcuguugguucagauucuuauuggucugucuguguagcaugucuuccuccuggauauagggcaggacuccucuggaaagagggucuuuggggagaaggaagaaggaagagagugaccuuccuagguuucaugguuuacuuugguggagauagguucuaguuucuaugacccacuuuguggaagaggauuuuuuuauuuauuuauuaugcuuuuauuaagaaaugcuuaaaggauuuugugaauuugucuuccuauccauugaucauuuuucuuuucuuuuuuuuuuuuaauuauacuuuaaguucugggauacaugugcagaaugugcagguuuguuacacagguauacacaugccauggugguuugcugcucccaucaaccugucaucuauauuagguauuucucguaauuccaucccuccccuaucacacgggccccggugugugauguuccccucccuguguccauguguucucauuguucaacucccacuuaugagugagaacaugggguguuugguuuucuguuccuguguuaguuugcugagaauaaugguuuccagcuucauccaugucccuguaaaggacaugaacucauucuuuggagaaauaggaaugcuuuuacacuguuggugggaguguaaauuaguucaaccacuguggaagacaguauggugauucgucaaggaucuggagccagaaauaucauuugacccagcgaucccauuacugaguauauacccaaaggacuauaaaucaaucuacuauaaagacacaugcacguguauguuuauuguagcacuguucacaauaacaaagacuugguaccaacccaaaugcccaucaaugauagacuagauaaagaaaauguggcacauagacaccauggaauuuuguuuuuuaugaguugcuucaguggggaaagagagaugggagaaaggagagcaguagaggucagagagaccuugguucugagaccuuccagucuucuuuaguucagaguacucagcaugccaaagcuccauacuuugggguauugauuguuuucuaagcccuaacacuacccucugucuaguugcugggaggaucagacagaaaaggacagaugucacucugcaaggcuggaagaacauacaguuggugaagaugugcaguaauaguggggcagaucccccucugugcagaagcuccccugugagccuucuuaaagcacucagccaccucauaacucaagaugacauccauuucuccuugcggagaaaggauuuagaacaaguugaguccuggucaccuuuguguucucagagaacuuuccuggaggacuagaccuguggucaggagggaaaaugguucucuuauuuuccaucagggcaucugcucaggcaauucucugugacuuccugccuuugcaaauguaggucaauccuuccagaaucuuacccuaacuuuccccccuccgauuucugucaacacaaucguucaccuagaaucuuuucuaugcccucaaaacuucaaaucuaaaaacucccugaacuuaaagcaaaguuauuauuuccuuucuagugccauagcucuuuguccaauucgguuaugaugcuuacagcaaaaggaauucucaugcaguguggcuucuguguguuucaugagacuggacuacagauguguuuccucaguuucauuuauccagcuaccccaugucuggcaaaugauaaucccaggucaggcacuacucuaauugcuuuauagauauuuuaucuucauaauaaucccaugagaaagguaccucugucauuccaguuucacagaugaggauacugagggucacauguuguguaauuuguccagagucacagcguuuucaaugugggugaaccaggauuaacacccaggccaacaacugaccccagagcccucauaaaagucugugcuccucugggaauaaggacgucaggccgggagaaagagccuaaugguauuccgugagaggcggcuaugcggcauugcauuaugcaucagaaugacuaauucuguguacgaggguugucaggugaaacccaguggaggcacagcccagaguucugcaggggccuucgcugguaaucugaugcaaucaaauguucuaggggugguaguuagagcucugcuguugcuggagagaggcccaagaaagaaguuucacauauuguuuuuugaucagcagguuuggaaacuuugaauguuuggcucacaggaugguggaaaugcuccagcacuuccuguggcuucgagucugguuucugcgauagggaacugggcucgagccuugccuccuccacuggggacugucugcacacaucaccgagugacaggcuugcugggaggaagggagcagccacuggcauuacaacagcugaaaaggaauuugaaaagcaaauauccagaaaaccagaacaagggaggaagugugugcauuaguuugcaaaaugaugaacuuuccaguugaaaugcugauucccaaagcgcaagagagcuuggagugaagggaagagagugaguggcucagcucaggucucaucuuguuuuugaaagaauuuuuccaggaggaaaaggaaucuggaauaggcccuccucucaccucucagcagcucccuuucuauuucuguccagugggaacaaaugaauagcugcugcuugaagaaaugccggaagguuuucugugcaaggaauucuggauuuuaaaaaugcaucacuggcuugaguaauccuucacauuuguaauuuuaaucuuugaauuugguuuuaaggaaagagugguucauuuauucauucacuugucuggaaaauauugaguugcucuuuaccaugcugucugaucaggucuggaacaacagagaugaguaagauaugaguccuacccucagagaacucauauaaacaaauaggauaagguguggaaaagugcucugguaggucacuguaagcgccuaagaagacagauucagggcaguuacuucuagcacgggaggccgugaggucagggagaucuuuaagagaaacuggugcaugagauuggcacugaaaucuagaugggaauuuuugaagcagacccaagggaaggaaaggacauuggagguagagagaacauucugaacaaagacagggugaaagcgagagguggagccgacugggcuucuggguuggguggggacuuggagaacuuuugugucucgcuaaaggauuguaaauacaccaaucagcacucugugucuagcuaaagguuuguaaacacgccagucagcacaaugucaaaacagacaaaugaacgcucuguaaaacggcccaaucagcucucuguaaaaugaaccaaucagcaggauguguggguggggccagauaagggaauaaacgcaggucaccugagccaguagcagcaaccuggguccccuuccacgcuguggaaucuuuguuuuuuuuucacugcucgcaauaaaucuugcugcugcuuauuauuuggguccguguuaccuuuaugagcuguagcacucaccgcgaagguuugcagcuucgcuauucacucuugaagccagcgagaccacgaacccaccgggaggaagaaacaacuccggacgcgccaccuuuaagagcuguaacacuaacggugaaagucugcgguaucacuccugaagucagggagaccacgaaccccccagaagaaacuccggacgcaucugaacaucugaaggaacaaacucuggacacaccaucuuuaagaacugaaacaccgcgacaguucgcugcuucauucuuaaaggcagugagaccgagaacgcaccaauucuggacacaaaaggaccuuagcaggcucaggaaauggcaagccauuuaugaagagggaagagauagcaaacguuggucucaaguucucuaguucuuuacccagaccauagcuggcugggggaugauccugauuuagucugggggguuccuuuacgcauugccaccagcaggugccgcaaauggaccauuggcagucuuaagguagaaccaguuuuccaugucagacuuacagagccauuggaugugccugggguuuggggagcagggacucguugggugggggaggaugcaccggugguaccuggaugcaggcugugaaaaguuuauauccuagaggucccaagucaccacagauuuaaagcaggaagugagauguucaaaugaucacaaauacaaguauucuguuucuuuuacuguuuuaucuuccguugcuuugcacaguagaaguugcaguuaauagaaguuuuacuguucucugaauuggaaagaguuacucaaaagaauugggcuacuuuccuggagacaagcccauagaugcagguggugauaauucaauaugggacuaacggaaaguuuucucugccacuuuccauugcauuucuggccaagacuauuuagcgauucuuucugagaaaccgaggaggcaaauagucucaaaguauguccuaugagaaacgugugccgcaagauguuucguuaaaaaaaaaguuuucuggacagauacauuugggaaauauuauagauugcauauggacauuucacagaacacguguuacguuaaagucccugagaaguccugcaguaaaggaaacuuugaaaagaacggcguagagcccagcacaguggcucaugccugcaaucccaguacuuugggaggcugcagcaagaaguauccuuugagcucaggaguucgagaccagguaacauaaugagaccucaucucuauuaaacaaaaaaauggcauagugguuacgaacaugagcuaucaaaucagacauguagauuucauucuggcuggguuccguauguggaugugagacuuugggcaagauauuuaaugucuuuacaucuugguuuccuuguuuauaaaauaggcuaguaaugguaccuuauucauaaaauugucucuaaaaguauauaguaagugaacuaguaaguuauuaguggauauuauucuauucaguuuuuuccaagaauccugacucuuuauuuuugcauugcauuuauaaauaacucagagaagcggugcugugugggaaaugcuggagugagacuaacucuugcaauccaugcgugacuucugauagcagucccacagaggaaaggcaggcccuaggugcugagcgcuacgucacagauguggacuugcagcuauaugaagcucuagaauuggggagcaaaagaccauuuccucuugacugcaagguuagaguguguaacuucagucuguuuugccuuccagucauuuaaugacaaguuuggaacucagggcaguaaacagauaugguuagguugauauauuaggaguuuuucaauuguaagggacagaaacaacucaagcugauuuagcguaaugaggaauuuauuaguuugucuaucuaggaaggauguuaggguaguacagagaacugaaggaaaaguguuaggaaacucaacagaaacugaacauagcuaggccuucuguccuuguucccuuuugaauguuuuccucuugacuugucuuugcuucuccuugccucauucuuuccuauuguggaugaccuuuccccauggagggagcauggcugcagacagcuucagcuucagcuucauccccagcagaaggcaagaacuccuggugaucuaccugccuggucccugcaaagugcuaggauuacaggcgcaagccacugcgcccagcugacaaauuuaugagauccuuauuaaggauauuuauacuagguuggaucacauuuauugcaaauuuuuuuucagauuguuauucguguuuaaauuuuuuaaauacuuuaauauauaaaaauuacacaugggucaugcuaaucuucucuguauuguuccaguuuuaguauauaugcugcugaagcgagcacugucucuaaauuuuuauaaagguuuuuggaauucagaaguuuuuaagcuugcuuguaucaaaucaucaggcucuucuuugacgcuuucugccuuuuguguuuuauuaguuugcuagggcugccauaaaaaaguaccacagacuggggugcuuaacuaacagaaauggguuuucucacuguuacggaggcuagaagucagagaucaagguguuaucaguguugguuccuucugagggcuuucuccuuggcuuacagauggcugucuucucccuguguucuuagguggucuccccucuguaccuucuguguucagauuuccuccucuuaaaaggauaauagacaaacaugcuguauuagggcccggccugaagaccuaauuuuaacuuacuucuuucgagguccugucuccaaauacagcuacauucugagcuacuggggguuaggauuugaacauacaaauuuugagggggacacaauucaccuguaacaguucucauacuaaagaggccucuaucaaccugagaggauuuaaggauuugaaggaagucauuuaaacuaguuaagauuuaguaucuucauuaauuuacugcaaauaauaacaccugucacucagggcugugaagaagagugaguaaagugcguguccacggugcccagccccaugccugcucuaggcgccugucugccacuccuucuggcagcuguccccuagccuucaugaugucaaugccagacacugggaaagcaaagacuuuucucugcaaguuuccauuauauugcaagccaaccguagcuaauagcacauuuccccaccugucaaguaaaugggcugaauuguugcugagauuagcauacauggcuagcguguacagaaaaugaaauacugagccuccacacuggauuccauucucuguuuauucucuuucugcugagugcuugcauguucuguucugaacacaccguguucccucauuucugaagccacaaacuuccucuuaggccccgggcugucuucagaauggccaucaggucccugauacgggaaccugaaaugacacccccaccauauacccauccauccagacccuccaguguagggcagguggggggacaugugcccaccacugcugcucccaugggaaacaaagacuggcuucagcaaaccuggacacucauacauccugaauaaugucagcugaccacaccaccgacuucauguauuccuugaccuagacacuaaagguauugagacaauuucagucuguuuggcauaagaaggaugguagcacaaagaagagaagagcaaaacuuuuacccaaagccuauuucgguggccccuucugagguucaguguaccaugcagggcgguguucucaaaagugaagacuaggccaggugugguggcucacgccuauaaucccagcacuuggggaggccgaggugggcagaucaccugaggucaggaguucgagaccagccuggccaacauggugaaaccccaucucuacuaaaaauacaaaaauuagccacgcaagguggugccugcuuguaaucccaacuacucgggaggcugaggcaggagaaucacuugaacccggggggcggagguuacagugagcugagauugugccacugcacuccagccugggugacagagugagacuucaucucaaaaaaagaaaaagaaaaaaaaagugaagacuagagggcuccaggaagacagcagugccaagagggaagggcugcuuucagugggugauccuccugaagcccuuucccuuucugccuaaccuaaugcaaggggaaaauguggucuaugucuuuuucuaucagagacaacucaacauuaaaaauaugagaugaacagcucccuuuccacuauccccaucaucauuauaaacccauuauccaucaucaguagauaaugacuuagcgggacagaggacagcuuuucuggugaggaaggaaggggcugaggaguggaagcagaucguuucuccagcuguuugguguuucucucccauugaucugcccuggccuccacuggcccaucuguugggcuugugagugcaguaggggaggggacacacgguucaccagggcaaguguguucguuuccccaacacacagcuucuacaggaauggccauacaggcuuaauuuuuuucucaguaggguuuacugugcaacagaaagacuacaaagagcauuaaaagguucaaagccauugcagucacccaaaacuaaaaaacuauaugggaaauucagaaaaaacaacaaaaagugaucagguauuugggaccuuuguggaaccgaaagaauuaauuaagcuguauggaaaaaccuguagagauguaacagaucuuuaagagacuacagcaagaggcauguugaacuuggggcauagaacaauguguagagagaugaguuucuaggugggagucaaagcgauuucugucugucgucuucaaaaugccacccaaccuacggagacauuuaguggaagagugggcuuguucacggguuauagagucagauguuacugcuauacagacuucaguaccuaacucuagaagaagugauuccucuuuauuuaauccacucaacuauaaacacaccacuuaacaugcauaucgaggugauagaaucuuaauauuaaacauggaacaauucccauauuuuuggaauggaauaaagucaagccagcaggcaagcaggaacgguauagcauucucugcccauucuuuacccaccaccugggauuugauagugacuuuggaaggcaugaugauuagaaugucuagccaccugccuagacuucccuuuuguuucucccuuuaaugguucuuaaauuuuaguuuguauaagaauuauuguacccggcugucuacacaacuucuuguagcugguauuuuacugggcaauuuaaguaauacuagguuaucuacuuugguaauuuugauaacacuaggcucaguacugcugguagcucuaaugagauguucauugaggaggggaugcauucauacaacagcuauguauuaaaaugccugccugccgcggcccugagucuguaacugugaaugcgauguggaccuugcccuuagaguacuccagauguaguggggagaaguugacaaagggagucuaguaaccccagaguuaugcugggggaagcauaggacaccaggaugcugacuuuguuggcugaagauuuuagaauguauuuccuucucaguuaugccucaccaagaggaguugggcuugugugcugaucuuuccuggagagccugaugagaccaugugccuuguguccaguucaaggaugggauagguugcccugaucaucgguaaucugccuagaggauuugcuagcuuaccgccuguauuaguccguuugcaugcugcuaauaaagacauacgggagauuggguaauuuauaaaggaaaaaaaggguuuacauggacucaguuucauguggaugggaggccucaccaucauggcagaaggcucuuacauggcggcagacaggagagaaugagaaccaagugagaggguguuccccuuauaaagccaucagaucucuugaggcuuauucauuauaagaauaagaauaagaauaagaauaccauaagaauaguaccguaagaauaguaugggggaaaacuuccccuguaauucaguuaucucccaccgggucccuucuacaacaugugaaaauuugucgagacugaggggaagggacuguugaccucuagaggguggaggccagguaugcugccagucauccugcaaugcucggggcagcuccuacagcaaagaaguauggccccagcugcuaauugugccaggaaugagaaagcccaggcuagaaccuuucuucccuaaauuucaucagaaguaacagugauuauauauagaagccuuaagugcuguuuucuugugaaaacauaaauuuaagaggauaaagucuggacuucugaggauaaaacaugaacuagauuauccauucugcaauugugcaccuggcuguaucccagaggagccuugcuaugccccccucccuuucucucgugguuuguuaauguuggggaaaacugaugaggucuaauugggcuugguuaagugaauucccaaggggaagccuccuugcuccuuugcucucucaauggcugcuuuguguacagcuccccucugacucuccacuggagccacguuauuguauucucaccuguucaacagguuuucccugaacggucugagaaauaaauaccaguuaaagggguagaaaaacaagcuuggccuuugauuccuagaagguuagaugaccuuuuuugcuguaauucuagacaauuuuauguagaggugggggcaagguacuuaaaaugcauuuuaauuuuuauuauuuacugucuuaacccccacgauuguguaugcuuucuuuugaauaguguuaccuaaaauucacacaaucuguuugcacauuagagccugcuuucuuaauucuuaugcuaggauauguaauugaacuuggaugucgaacugaaguaauguagcacagauaaaacgcauuguucuuagagcucucaaguauucaaagagcauacagacuauggagaggaaguccgaaguacagauuguuugcuugcauuugcacaaagaagacacuauaauuacuuaacaagucccuauuguuggauauucaauuguuuucaaguuuugagaauuauaaacaaauuggcauugcuaugguuaauaauuauuucuugaggauaacauccuagaaaauuaaaauuacucaaagaggaugcgaaauuuuaaggcuuuucguauaguuugccaaaggcccucuggaaagcugugcugauuuacacucugaauaggugugcagggacacacagcuuccuucuuuagaagucacaaaccaagaggugugguggaaguguccagggggucaggaguucucugaacacauucacuuacuguucuugcacuuacuuggcuucagcaagucaccuguuucaggaacauaacaggcaugcuccugccuuggggccuucgcacuugcugauuuuuuggccuagaaccugauuucuccagacguccacaggggccccauccucaccucucagaugucuuuuuuuuuuuuuuuuuuuagauggagucuugcucuguugcccaggcuggagugcaguggcaugaucucggcucacugcaagcucugccuccuggguucacgccauuuuccugucucagccucccgaguagcugggacuacaggcacccaccaccacgcccggcuaauuuuuuguauuuuuaguagagaugggguuucacggcguuagccaggauggucucgaucuccugaccuugugaucugccugccucggccucccaaagugcugggauuacaggugugagccaccacacccggcuugagacagagucucgcucuguugcccacgcuggugugcaguggugcgaucuugguccccugcaaccuccaccucccggguucaaaugauucucuugucacagccucccgaguagcugcgauuacaagcaccaccacgccaggcuaauuuuuguauuuuuuaguagagaugagguuucaccauguuggccaggcuggucuugaacuccuggccucaagugauccacccgccucagucucaaaguguugggauuacaggcgugagccaccgcaccuggccucagaugucuuuacucaggugcugccuucucggugaaccuuucucugaguuuccuguuuaaaauuguauuccugccccucccacacugguagaggcacaggcuucaguuuccuucgcugcuugauuuuucuucauauccuuuguugcuauaucccagauuugcugcuguauauccucagcauggggaauagaccuggcacugagcagaggcucaauaauuauuuguugaaugagugacuaaaccacugcuuuguagauuugcucuugcuaguuaccacugauuagcuucucagcaggcuucccuaaucaucuuuggccaaaggaguagcgguuuuguuuugguucauuuccuuuacuugucagcugcgcugaaguuaguuauuuauauaacugcugguguuguugaggcuuccauuauuaacucugcuaucucuauugucucaguaauguccagcuacugcugagaucugggauaguaacucacaaggccuacucuggucugguaaaggaccaaaugcacauguuuaagaucuucguuacagauaucaauuucucaaaaaagacaagagaacccaauagaaaagggacaaauguuuggacuguucacaaaaagggagcgugugucuuuuccucuuuauguucagccucacucacaauaagagaaauauaauuuuaaaauacauuaagauuuuauuuuucaaccugucagguuugcaaaaauucauucuguuggugaggcuggguguaaauagacaaccucauacaaguccaauggagagaaauuuggaaauggcuaucaauauuaacugcaccuauguuuugacccagcaguuucaguucugugaaucuauuguaaggauguacuugcauaugugcaaaaucaguuauauauaaguuuauggaucacaguuugguuuaugauagcuaaacuuaagaaaucacccaaauggcccacagcaggggacugguucaucaaauaggacacauccacacaaugaacuacuauguagcugugaaaagaaucaagaugcucucuuuguacuaacauagaaggauuuagaaaauauacuaaaagaaacaaaaagaaugcucccuuuuggccagucacgguggcucacgccugcaaucccagcacuucaggaggccggggagggcagaucaccugaggucaggaguucaagaccagccuggccaacauggcgaaacccugucucuacuaaaaauacaaaaguuagccggaugugguggugugcgucuguaaucccagcuacucgggaagcugagacgggagaaucgcuugaacccgggagguggagguugccuugagcugagaucaugccccugcacuccagccugggcaacagagggagacucugucucaaaaaaaaaaaaaaaaugcugccuuuuauauaaagaaaguggcaaauguaauaauguauuuuuguauuugccuucuauacuugaagaaaguuuggagggauaccuaaugacuuuggauaacuggaaguauaagaagugaacgcagauauugggcaggugggugacacugggagaagagacucuacacuguccgucuuuguacacacaaacacacauacacacacaaguuuguaucacaugauuguuaacaaaaaauuaauuuuaaaaagaaauggggcugggccagguggcucacgccuguaaucgcagcacuuugggaggcugaggugggcagauuacccagaguucaagaccagccuggccaacauggcgaaaccuugucucuacuaaacauauaaaaauuagccaggcgugguggugggccccuguuauccuggcuacuugggaggcugaggcaggagaauugcuuggacucaagagguggagguugcagugagccaaaauugcgccacugggcaacagaaccaggcucugccucaaaaaaaaaaaaaaaaaaaaaaaagaaaugggcuagccugggaagaggcagcagaggauaaugguuaccuccuuuguguaagaagcacgauucauucaagugagaauucaaagucuguucugaaugccauucaguccacaucuguacauuuucugccccacccccaccccccaccgaaggugcauugugugaaccgaccuuggggagggaguaugggugugcaugugugugagcucucaggguguuucuccuucuucaugauauccugguugcuauaguguggagaucuguuugugacacacagaaaacacuuuaaagaaacacugcuuccugaccaugacuuccugggcaaucuguccuuccucagacuguugagugccagacguuuauaugcaugucuggacagagagugagccuggcucauucagacccugggcaccauucagagcagaacucagugguaaggaacagcuuucuuuccacugaagauucgcgcaagccgugccccacagggcagcgucuccuggcggcuuugacucaagggcguuggcacgggcacccccaucuuucuucuuuccucaggagcccauuguaccguuggcugugccccugcaccuucagcacccaggcaccaaggggagccguuuuucauaccaaaccaccagugaaaacaggaagugaugaagcaaaauucacccugcaucugcacugagugacuucucuuucuuuuucugucauuccucauuagguauagacacguguggccguuuacgcuguaggauccucauucccacuggcuuugaacauuuuggggacuuacaaugccgccacccgcggacaucgucaagguggccauagaauggccgggcgccuaccccaaacucauggaaauugaucagguuaguaacgugacagcauugggugucuauuuucaguuuccuuucuauacuggaauuuucauagacuuuggauagcucacucuucucccuuucucucucuagcuguguugaaaaaucugugcaauaauaguugcaaugugcuugauuucuguagcacauacagugauggaugggguuuuuauacucuuccagcauccacuuggauugugucaauacaggauuugugucugaagcuaggaaggaggugggagggacaaguggaucgggcccugggcaguugacacaguggaggcugccccaucccugccuugccaugacacauggauaugugcagauuguuggaacacaggcaagacaaaacuuaauuuuuaaaaucccuuuuuuuucauuuuuugcagaagcagccaaaugcauugguacuuuguuauauuaauagcuuuguaaugaaauuaguauagagggguucagucuuggauuucagccaauuguaauuuuuauuuuuaguguaaaauucacaaugugucuagcauauugucugccauguaguaaauacucaacaaauguuuauugaauuaaaaaauaucaagaagacuuauaaaaguggcuugacccauaaaggcauccuuuaacuugaaucuugagaauuguauggugugauucucaugcacuauuugauuauagguuaucucagaaugguuacuuuuguccucacuuuacuguagucacucuagagcaaaugauuuaaggaauaaaagguugagaccuauuauauacuuacagguuucauaauguauauaguauaggguucuagauggcuuucuacauuuucaaaauuacaauaaccauggcaacuccaaucuuuauguucuccauacuauuuuacaauuaugauuuacaauuuuuuuuccuggucagauuuuauuaucugguggcagaucaaugcgagaguuauauggaauugugcgaauccaaaggaaucauuaaaaugaauuauacgggucagcucagaauuaauugaacuuaaacucaaauguaagaaaggguaaauuuuugggauuuuugucaaaaaagcuguuaucagaccacacaucauugucauuuuaacugcucucugagguaguuuucuacugacucaagaaggaaccuauacaaacagagaaaaguagagaugccuaauaguuucggauauauuugagucaggcaacagaugcuuaucugcuuucauaugugguuugagaugcuaguuaaaauuuaccuuaagaaaauguuuggagauacucggugcagacuaaauguaguuuggauuagguuuggccacagccuaagagaccaguggcuucagugagauggaaguuggucucacacacguguagagagguccugaaugccccgcaguggcaugcacuggggcccucugucuuguugcauugcccuucucaaucuguggagcuuuggaccacaugcuugggcaucacccgaaagcacauuagaaaugcagaaucucuggucuuauuccagaccuccugacccaagucugcauuuuaacaagaucuccaggguaucccuguguguaguucaaucugagacgugcugagcuggauaccuggugcccaagcccgaguacuaaucagaauuacccaggcacuuauucgaaauaacuauuuucaguggucccaucccaagagacucuaauuuagugguucugguaaacuauuuaauuuugauucugccauggucagugcaguuugggaaccucugcuuuaagacagcagcucuugauagacaguccuccuccuuaccugugagguuaguguaguguucucugccuuuggagauggccuuugcuauguguguguuuuaauauauauauuuuuaaauuaucugcuuauuuuggaauaauuuuagauuuacagaaaauuacaaagauuguauaugcuuacauuuauacccuauuuccaguuuccccuuauguuaauaucuuaaucuugguacauuagucaaaacuaagaaauugacauugguacaucacauuaacauaacuaccaacuuuauuuggauuucaccggauuuuccacuaauguccuuauucuguucgaggauccaauccagggauacgaauugucacguuuccucagucuccuuccguuuuggacaauuucucagucuuuccuuguuuuucauggccugauagcuuugacaaguaauuuuauguugauacaauuuuaaacacacaaaaauugccaggauaguacaaagaacucuguaccuacuuuuucugaaccauuugauggagcccuggaagcaccaucccccuucaccccugaacacucaguguguaugucccuaagauuguagccauucucuuacauaauaaucacaguacauuuauaaaaccagaaauaaauugaauacugguauaaugcuaucgucaaauucacaguucguaauccauauucaaauuccaucaguugucccaauaagauccucuauagcuauuuucucucugguguaauauccuguccaggaucauguacuauguuuauugucaggucucuuugaucuccauugaucuuuagaaauuucucagucuuuaucuuuugugaccuugacauuuuuguagaguacaggacagcuauuuuaggaaaagucuucaguuugggguucucucacauauccugcugaucagauucgaguuuuguauuuuuggcagaaauguagagaaaugauguguccuuuuuggcucaucauaucaagagguacaugguguugcauugccuaauucuugauaauuauucugguuuuacagaugacaaguguaaacaguugguuaaauuauaggccuccuauuaaucacauauggaaaccuagacgggcaauuaggaacccaguuccuaauugcccugcaguugcuggaauuacaaugagacuuauggaaguguugcugucagauguuguuucuugauugaaucagaaguuggcacaagaauuagaaguauguuuucacaugcaaugaagaguagaagaaaugauuauuacuuggguuuucuccuaaucuucuaccuuguucaguaaagaucacauaaccugccucucucccauagcauguuagcuucauuuagaaagcucuuugcuucuuuuuagccuggauagcugcuauuucacuaaaagccguuuccaaaaguuggguuaagcacugcugcucuauugucucccaaaauuuugggugccccuccacuuaucacauuguauuguccuugucuaucaacugaacccagugguccucaaccuugacuguguacaagaagcauccagggagcuuguacaaaaugcauauaccagcuugugcaaaaugcagccccagcugcagagauugugauucugcuggccaggggcagggcuuuucaucugcaucugugauaagcaccagaugaaucuaauccaagggcuuccacaguuugagaagcagucauuagacugggaacugccugucuuugaguguuguuucuccuugccuggugaacaguccuuaaaaugaaaagauauuucaugaaugaauaacugggaggcggugcuuccugaguagugauuaucuuaucaggugcucaauucugcucagccacccuccaucagugccuggaguuuucagagggacgucugcccaugauggacuuguuuaucuucuuucuaaauauuuaggagaaaauucuguguuuccacucagcaggaaaaauccccaggagcuucuuagacauggacuuugcuguaucacaggaaggucucaaaagaauuaucaacucacugguuccugacuccugcucucgccuucacaauguauuguugaguuucaagcccggggagccgcuugaggaugaggaugcuuguugucuggauauaucaaggcuccugcaugcacuguucuuguuaaccuauuauguccugaauaauguauuuguuucucggucaagagucuggaaucccaaacacuucaauaagcagcaucuaguaagaggcagugggcuccaaggacauuuaaaccuggaugugagcacuuguuuuaguuccuucagcugcuauaacaaaguaccuuaaacugggaaauuuaugaacaacagaaauuuauuguucacaguucuggaggcugggaaguccaagaucaaggcaccaguggauguggugugugaugagggcuuguuccucauaaauggugccuuguauguuuccccacaggcaaaaggggcaaacaggcucugucaagcauguuuuuauaccaccaccaugggggccagguuucaaacagaugaauuuuggggagacacaaacauucagaccauagcaguccuggagcccugcuuucugugaaaggcucaguuagccuugagccucaguuucuuugggauaauaauuugcuacuuugaugguccuugugaagauuaaagaaaucaugugaaaagaguguagcauguugcauagcuuagagugauuccucaauaaaagcagccauuauuagcuagauuagaaaauuagguacucugguuuuccuuuucaccugcacuuccauugugaacauuugcccucuguucucauucuuucucugccuaacuuuuucaauguuuaggaaggagaaaaaauuaaaagacaagugggaggcauccucugguaauaaagagguguccuaauuggacacauagccaauuugugcuauggaauauucacuggcucccuaguacucugugauuuuuuuuuuccaucuuggccacucaccauuucugagcagcagcuuuucuguucccugcauaaacucuucaagccuccaguauuucuugucucugcccugcccccucaggccuugcuuuucaaggaagacacagaccagaaagcuaccacuucugucuuugccuagaacuucucggccuacauauuugcauggcaucacagacuaccugaugccuuuaucuccugccuuccuguuuuguuuugcuuuuucuacugcuagcagagaagggaagagguggucccaauuuguuuccagugcuuucagcuuaucccaacccccaaugcuccacauagguguuuuuuuuuuuuuuuuuuuauacuuuaaguuuuaggguacaugugcacaacgugcggguuaguuacauauguauacaugugccuuguuagugugcugcacccauuaacucgucauuuaacauuagguauaucgccuaaugcuaucccuccccccuucccuuaccccacaagaggccccggugugugauguuccccuuccuguguccauguguucucauuguucaauucccaccuaugagugagaacaugcaguguuugguuuucugucccugcgauaguuugcugagaauggauccaaaggacaugaacucaucauuuuuuauggcugcauaguauuccaugguguauaugugccacauuuucuuaauccagucuaucauuguuggacauuuggcuugguuccaagucuuugcuauugugaauagugccgcaauaaacauacgugugcaugugucuuuaaagcagcaugauuuauaauccucuggguauauacccaguaaugagauugcggggucaaaugauauuagcccauccuuucuacccuaccuggggcuuugucccagccauguucucuucucuuauucuuuucuucuucucugucuucaacagugaacucuucuguuuucaccuuggaaaauccuccccuugaccuaguaacucucuuuugguaguauuuuauucuguuuuuccauuccaggcuuauuuaaauguuaccaguauaugccaucuauguuguuccaugcuuauuuuaauauuugcaugaacaacaauuuaccucucuacagggcuccccuuuuugguggcaccucugccuugguuguccucacccucucgguuacgcucggcaaagcugcccauucucaucuucuugaaacucucccuuccuuccucuagcuucagugccugagauucuuccucccuguuugauucaucugggauuguuuccuuccugguuccucuucuuucuagaucaguuccaaccucagugcuaagcccucuggucuguguguucacugucgacacucuuugucuuagaguccauguucgcucaugacguuaaaguuucaccucugccuacauacauaacaacaguucccaucaccggcauagccugccagcuaaccacuaguuucauuucucuguuggguggauauaugguuccccucucuaacuucaguugucuacagacgagacaaaugguuagugaaacugcccauauguuaaccugaagaaaggagucucacagguauuaccaacuuuuugagguuauaucauguagaggggggaccauuagauauguucuuuuuuuuuuuccuugacgcagggucucacugugucacccaggcuggaguacaaaggcucaaucaaagcucacugcaaccucuaauucugggcucaagauauccuccugccucagccucucgaguagcugagauuacaggugugcaccaccaugaccagcuagucuuuguauuuuuaguagugaugggguuuugccauguugcccaggcuggucucaaacuccuggacuuaagcgauccucccaccucagccucccaaagugcugggauuacaguccaugaaccaccacagugcccugccuagaugcguucuuuauggcccaaguguaggaacuccauccuauuugugcuaggagacacauuucaccuucacccaagaaaagccagcacgggccaucucaucaggcgaggggauccaucaucucuaccaagugugcaucagacaaaugcuuggagaagauguucugagcauauucaggcccaaaaagggcaaugggaagagauacauaguuuucaaccuuaguucugcuucucaaauggcuuggggcagagggguggcugccgagggcuuccgggcaccccucgcucacuccugcugcagcaccuuuguauugucccauuuucauuugcguaugauuuggggaaagauuuuguuugaaaaaaguuuaucaguuuaaaaaaauagacauggaugauucuugagcuuucugguauuccugagacuucagucagauucuuuaggguggcuuugcauccuuccauauuuuucauaagcauugucccugggccaagguagugucugcaggcacuguaugugauucccagguaccccucuguuuuauagaagcugcuccuuuagacgcuuguucccgcacauucauggucuuuuuucaucucuugccguuuccuucuaaaaguaugccaccuugaaugcccccugccuucucccagcucucuacugcuuuaaauccuggcuuugcuaagcacugcagagagccuccuuuguacucaaaccuuuucugaucgcauuauaaugcagucuuuucuccaguuuucuaauuucuuauaucauuuucuuugccuguagcuuuuauuugcaguuaauauauuucacacguaacguaauuuacauuuuucuuuuuucaugcucacuucucuugaaauagauuauaagcucuuggaggucagccaguggcuuacauacauuuguauccuuugguucaucacauugaucuccguuacuguguguguacaauagguuucaauucugaacagugaagauaagaauaaaacacugguggucuucauucuccaaacagaaaaauuauaauagcacgccuaccccaguauauugggaaggguuuaauucccuaaaagaaacacagaugcauguguuuuagguaagugugauugccugcaguuuuucaacuaccauauuucuauagcauauuuaagauauaauuccauaugcauaaauuugauuuacacaagaccuuugaaaagcucauugaguaaaacccauuugaguuuuuguacuugacauggaauuuugcucguuaguagcaguaauaauaacagcaagcaccacacacuauguggcaggcaauagaaggccuugcacgugggauuucaucaccuuacuacagccuucaagaucggcuuaggcucccuacuucauaguuauucaaagguucauuaacuugcccaagauuacucagcuaggaagguacugauuugaauccagcacuguauaacaccaaaacccaggcaguuuuuugguuuuuuucuuguuguugagauggaguuuugcucuuguugccccggcuggagugcgauggugcaauccuggcucacugcaaccuccgucucccagguucaagcgauucuccugccucagcuucccgaguagcugggauuacaggugcccgccaccaugccuggcuaauuuuuguauuuuuaguagagacaggguuucaucauguuggccaggcuuagacauugccaaaugucucuugggcgguggacagagucuccuccuguugagaauggacuaggucaggggcuccugagcuugcuucuguaucagaaucacucaugaaacauguugaaaauacacagaggaucauuguguagugauucaagguucagggauccuuguuuuuaugaagcuccccuggugaugcucaugcuguuggaccuacauuugaaaacauuguugugaagcccuugaaauuuaucacucucccugcaggagcuaccuuuggcucccacgguaacuuuuagugaguccuuuaaagauagugccucaauuuauccaugagggaaaugguccuaaaaauucuuagccucuccuuuacagagaguacaaacauaguuuuaagagcucauuuugcuccaauuaagaaagcuguaauaaagacugugauacugcaccauugcuuucauaccgucauaauaggugaaaugacauugguagaggaauagacauccuucaucugauuuuugcaacuuuuagauuugguaauguaacagauauuucuuaaacuuccuuuaaaaugaagugacugggguacuuacuuuucugguuuuagcucucuuuucuugugugagagagucuauauaaccucauaaaaucuuaaaaauuugccaaguuuuugaagaaaaacacagcaaacauaucucucccuuuaacugagcugaguuuaauugagcgagaaugaacucuggcauucuccuuuuccuucagcaaaugaaaugcagauuuuuaguuugcucuguaggugggugcuggugggauucucuucuguucuacuuccuuccacaacacugccacucugagaaguucgggcaacucaggacacucuuguauuaacuauguuuucuuaagacuugaugacuaagaccucugacauuucuagaaccuuuugugaauguuacacuuugugcuuauuuuccuguuaggucaacagguuaauuguggcaggauaucuaaauauguggauuucaguguugagaaggaacucuggguacccaggaacaaacagcuuguacuuuaggaguauauagaccaaugugcaguguguccagaacuccaaggaaaugagagcagccucuagcaaauaaaauaugugcuuuucuaguuucuuguuccuagcuuuccaucaaaugcauucaugggucaauggcaucaccaucaugcuuaacccccauccccacaaucuccauagccccucaaauagcaaguccuguaaaaucagccuccuaagugggcuugaguccauccacccuuuuuccguccuagccgccacugcuguagcuuauuuccccuagguggcuucaguagcauaacagcuggcugccaggccacgcuucuuccuuccccuccaauccauuccccuaggccuaacauucugcacuggcuuccauugcacuagaauagaauccagacguccuugcuguguuggcagggcccccugcccccagcucuugccagugcacugccuugcuuagugccacucuggaguuccccaacgccaccaucugaguucucaucauaugcaaacauuuucuccuuucacaaacacaaauuucuuccuacuuccaagucuuuaaaaaugugauuuucucuuaacuagaaauuauccuccucaguucucugcaugucuaacaccuguuuauucuuccaucccagaugaaguguaaguuccuuagaccuuucucuaaggccuuuucugacucuucagaccggaugagggugcuugcuguguagaacuuguaacaucccacagggcuccacuugucagcauuguaaucacuacgugaugcucugcaugggccaaguauguccccagcgccagcauagggccugcacgugguaaacucauaaggaguguugaguaaaggaaauaagugauauuuauacuuuuucugucuauugauacagacaauaauacaugaacaggaaugacuauggugaaggcauucuuugccuuguuugcaccauguauucuaaauacauuauuacauuuuauaaauuggcuuuaggaaaaucuuugugugucuuuccaucaaagccaucuguaguuaaaagacaaucagugacuuugagacaaaccagcucaaaaugaugauggaugaauccuuacucugggacaaacucguggcgaucuguuuggauugaucagccucaucaucaugagaugcucauaauuuccggcugucauuucuucguugaccacccugaccuguauaaacaaccauccaucugccugucugccuugcuuaucuacauggcucuuguaccucaaacucagcauauucaaacgguccuuguuguuccucccaccucaaacccauacaguuuugcuuuucuucacguuuuccuuuucuuggugacagaugugaacuacacccaguuugcucaagcugacaccauguugugucuuuuagacucuuuuuuucucccucaucuuuuuauccaaucagucaucacagaaaacugucugcaucuggucucggucacaucugcugcugccacccucucuggaccucuuccuucuggucaguguggaggaguacacagagcaggagagagcuuaaacaucgguguguguugaguauccucaaagcacuucaaaagagagagcauaauaucuacacaaacaggagauuaugaggacaaagcaaauggguauaaauugugaacagguguaugugagaaagagccaauuagacaucuuauaagugaaaaaugcaguagucacugggcgugguggcucacaccuguaauuucagcccuuugggaggcugaggcgggcggaucaugaggucaggagaucgagaccauccuggcuaacacagugaaacccugucucuacuaaaauuccaaaaaaaaaaaaaaaaaaaaaagccaggcguggcggcuggcgccuguagucccagcuacucgggaggcugaggcaggagaauggugugaacccgggaggcagagcuugcagugagccgagauugcaccacugcacuccaacuugggcgacagagcgagacugugucuccaaaaaaaaaaagaaaaaugcaguaguuuuucccuuaucuguggguuugcuuuccccaaccaacuacagucugaaaauguuaaauggaaaauuccagaaguaaacacucauaaguuuuaaauugugcacuguucaguguacugugauaaaaucuugcauuauccugcuuugucccuccaggacuugcagcaccccuuuguccagcauaugcacgcuauagacacuucccauuuguuagucacuuaguagccauuuccguuaucagaucaacuaucaugguauggcagcacuuguguccauauggcccuuauuuuacuuaauaauggcuucaaaauguaagacuagugaugcuggcauuucagauauacccaagagaagcuuccuuuaagugaaaaggugaagggucuagauuuacuagggaaggaaaaaaaauaguugcuaagaucuaugguaagaaugaaucuucuuucugugaaauugugaggaagaaaaauaauucaugcucguuuugcucucaaaccucaaagugcaaaaguuagggccacaguguaugagaaaugcuuaguuaagaccaaagaggcauaaaauuuggggguggaagauaugaagagaaacauauucugauugauggcagucagguucaguacuaucugagguuucagacauccacuggaggucuuggaacauaugccccucaaauaaaggagggacuacuguauauguuaauaaaaugaaaaaaaagaaacaaaacaaaaaccaacagcagaaagauaaaacaauaaaacacagaguaacucuagaguggauuuggcuaaagagagaauugguuaauugaagguugaaaacaaggaauucauucagaacauggcucaaaagagaagggaaugaaaaauauuaauacaaaugcuaagcuguguugaaaaggauaaauuaagaagcuauaaucuaugucuaauuggcaguuccacuaauaaggaaaugaauguuggagacaaaauauguaaagagcuucuggcuaaugucaugcuucucuggaauuaaagggaaaucugacagugagaaagaacaggggcucuggauuuggccacuuggaucugugaggcucucccaucagaagccauguggacuuuaauaccguguccaagggaguagaaaauggaagauuucuaagcaggggagugacgugguuaguuguacuuuuagaaggugccaauuggagaauuguuuuuugagggcaaaauggaaaaugagaggcuagauugcucuugcaguagcccaaucaagaaacaacuaugccaugaacugggacagugauagggagacacaaagaaguuagguauguguccccguugugacauaugggaagacuaauuugacagaaaauugaugauugauuaugugugugggguaaggcagaguaaagugcuaaggguaguucugagauuucugguaugaacaacuggaaggaucuuggugacaccugccaagauagaaaacaucuguagaggacuguuuagguggacuugcauuccucauggacaccuuacagagggguacaggcaauuguucaggugucagcauaucuccuuucauauuuccuucggguuuugauacacuggccaguuuucccauuuaacuucucucaaccccagugcaauccccugucauuugagauugcacaccugauuaugcugcuccccugucuaaaaacccacauggguccaaaccuuuaagaguugucauaguucagacucacuaaaagagagaauuguaaauauucucaccacaaagaaaugauaaauauuugagaugauggguaugcuaauuacucugauuugaucauuccacaauguacacauguaucaaaauaucacuuuauaccccauaaauaugcaguuauuguuugucaauuauaacuaaaauaaaacuaaaagaguugucuauaggaauuaggcauuuuuuccucuaucuugccuuuugagccacugucucaucuuucauuugugugacauuaucagcuccuccauaugcaaagagggucauccauuuugcucugccuuugcauuugcuguaucuucaacccaaaaugccuucggaaauccagauagcacugacuugugcuugcuccccuguacccacaggcagaauaaagaggacagcuuugagagucacuccggacugcauuggcaggacaggaaacaaacaacaauaugaaggagagagggaagauguaguguugauuccaaguuuauauucugacaaacuagaagaagaugaauaaaaguugaaaacugggaaagagaguuuugggguaagauuugaguuugagguuaugaaaggauaugcauucagguugaaauggucugagacagaaaggacuacagagaaguugggguuggagauggugauuugggcauccagagugagcuugagcagagaggcucuccugguugguaucaaacguuccaguguuaauuuaggauuuuauaauuuaugcaugaggaaggaucaucuacuauucauauggugaugcuaaaacauugcacuucaaauaagauuucuccugaacuuccuaugugccaggaaccaaggcacccagcuccagaacccacuccacagguguuagcgcugagcaccugggcuugucguucaugguuuugaggacuugguagauuugagauggaguuaaaggguaaggauuguggaauuguacaggucuguguucaaauucugacucucuuccaugugcugugaggcuuugagcaaguuacacagcaucuuuuuuuuuuuuuuuuuuuuuuuuuguggcagggucucccuauguugcccagagcuggagugcaguggcaugauccuggcucacuacagccuugaccuucuggguucaagugauccucucacuucagccucccaaguagcugggaccacaggcaugcaccacuauacucggcuaacuuuuuguauuuuuuguagugaugagguuuugccauguggccaggcuggucucgaacucuugagcucaagugaucugcgcaccuaggccucccaaaguguugggauuacaggcaugagccacugugccuggccaaauuacguaacguuuuaagaaucccucauaugguuugcucauuagugaaauacacuuaguaauaucaucugguagggaguauaugguagucacucaaaaaacaguagcuguugcuacacuguaucauaauuagaaaggcuggccaagugaugacaguaaaagaagacaguaaagucuggguugaugauauauugaagguaggggugaagaaugugagauugucauuauuguuugcauaguuuagacccuuccugaaaauccuguguuacuauucuucagggcuguagguucugccugagguugccaccauuaacuuaaugggacauuuuuugagacucagaagccacgucccuccacuaccugcuggcagaugucucaucauguccauugccacucaagaaaggaggaugaauugccauuaguacauccacucaaaagcacgcagaccaacuaguagcaaagagagacaagaaguacaagaaaaaaauaaaaaaacuaaaugagaaacaugaacuaauuucauacuuuuuuggucacuuguuccuuucaguguucuuuugacugcugucuuacuuucaaucucagguuccuugccauugauaaaccuucauaguccuguguggaaauugagccugaacccuacuuugccuucagggcuuauuggcuuucucauaucuacucuccuagccugauaacauccuauccauuggagcugacagucauuucuguuuauccuauugaaucugucugaauuuuuauuuuuaagcuaugcacauaaauacaguuaauuuuacaaaggugaacuugacacacauaaaugaauuauuucacaugggugaagguaagcagaccauaaggccugaauugauucucccugugaaucauucauuuccacaugaaaggaaacacuugauuacaaaggcaugguggagugcaguggccuucugugcgucuagagucaucuggaaguacuuggaaaagacugauaucaaggaaguuugaagacaauaugggaauuaggaaagugguuguuguugcugucagauauaaggaaauuggggaaaaacguuguucuugauauccauagcaacauugauauguaacaauauucacuaaaauaaucaggaacuaggagaaucacaaaagauuauaauugaucuaaguaguccuuuauuuuugcauuguucaucucuauaguucugucauuaucuaaaguugcaguuucccuuccaauugaagggaaauacaaugucugcugagcagaagcauguuagaauaucuaaaggagaagguaggucugcuugucuuuaacccguuaauacauucaacauaauuauuucuaucuuugcuuaucuucauaguuuagugauuuuuaugacagaaagacuguacuuuauccugguaaaaucuaauaccuaauuuguuucaugaagcuugaaacaagacacuuuugguaaaccauuuaacuguuuuuuugaaaugaaucaucauuugucaagaaaaagguggcagaguaucaucuuucauuuuuuuuuuuuuuuuuuugagauggagucuugcucuguugcccaggcuggaaugcaguggugcgaucucggcucacugcagccucugccucccagguuccagugauucuccugccucagcccucuggguagcugggauuacaggcgcaccccaccacgcccggcuaauuuuuguauuuuuaguaaagacggaguuucaccgugugggccaggcuggucucgaacuccugaccucaggugaucugccugccuuggccuuccaaagugcugggauuacaggugugagccaccgugccuggcccaucuuucaguuuuuaaaauuaaugugauccaugguuuuacuacuguggagagguugcuguaagcccccuuugucauuuuugauaauugcuugaaucuugggucuguuauucacacagcaacuguugucagaauacuugcuuuccaagaaccagcugaauuugccucaggaaaguggggcuuugucguuaccuuucagauucaucaggcuguuauuaggaagauaggguauagacacagccuuuucagaacacaucugauuccuccauacaaaaguagauggcucagaagcauggagaguggugguaggaucauuggaagaagaguagaacuguuauaaagugauuggugucauugacacaaugucacgaggcgccucugggagcuagauggcuuauuguacauuaaaguuccuucaagucacauuguacacguuguagucaacaugcuauccucucucagugguguccugacauuugaaagcuagauuucuuuucuuccugggccaacguuacuaauaacugcagagcagaauauguucaaugaauuucuaucuauaaaagcaaaguaaaauuccaaaguaaaaucccaagugcugugcuguaccaccucaaaguguuagaauaaagcaucugucagguagguuuuuuuuuaagcacuggagaaaugcuuuuuaauagucuaggaccaaaaacuuuaagucuuuguggaaaagcauuuugcaguuagagggccaugaggcuaucgcuggacagaaggguggaggagcagugaggaccggggaccgcuucuguccucugcuugcugugauccgucuuuagcugcuccccugagccuccauggcagucaggaagagaccagaaaaaaaagagaaucuaaaagucuggaaacagaagauagguuuuuaaucaauguucauuaacugcaugccuuuccaggcccagcagccacgcgccugggaggggacagugucccacaggcagucucugccaccaaaguaagugccauacagguggcaaaacacaagaagaugaauuuaagaauaaacagcaggaugcggcaagugccaaaggcagcaucgggggcuggagucacuuuaaggaagaaggaggaauuggauuuucauucauuuauucacucaauuucuuuaaccagcauuuuuuuuuaaagugugugaaguguccaagggauguaaguuaauaaaagaagcuaucuguagauaacguuauguaaugcccuacuauguaccaggugcuguuucaaggauuuuacaccauuaucucaauuaaucuucauaacgggaagagaaaacagaagcacugagagaaguaagaagcccagguuccaaagccagggacugcagaagccgucccuggaaguccucuaaagucauugauggccaggugcggugcuuacgccuguaaucccagcacuuuggaaggccaaugugggagaauugcuugaggcuaggaguucaagaacagccuggguacuauagcaagacccugucucuacaaaaaguaaaccagccagguguggugguacacaccucuagucucagcuacucaggaggcuaagacaggagaaucccuuaaacccaggagguugaggcugcagugagucaagaucauaacacugcacuccagccuuugugacggagugagacccugucucaaauaaauaaauaauagagucauccaagagcucauaguuggggggaagauagagaaaaacacguagucaauaaaaauucaucauucuaaaaccuuuucucgugucuguucacuugauaccaccucaugaacauuuuccccaugucauuagaaacauuugaaaugaauaaacuugauggaagcagccuuuuuuuucugggugaugcccauuuugaggcaggcagaggccggagaaguggaugucagagcugagaacggcagcccaugcuccauaguggcuaaaacaggugugugggcacauuggcugggggcgcugccagucucagcaggccagugucaaggcagaaaugugggcagcaacagacuugagcucuccaaggugagcauuugggcuuaguaaaguccccaagccaggugccuuggccaacagacaggaacagguggcugcgcagccagggccugccagugcucaucagaggcggggcagggaggggcucugaugagggcugacagcuggggggucuccugggaaggugcuuccaggaaggcuggacuggccaucuccuaaauaaacagccaaggacuccccugguggcugggucuccagugccuuaaaggaacauauacucugagugagagagugaucauauuuuuuuuaagagaucaagaagaggcaaaagagaauuguuuaguaagaaagaaagaaguguuaaauuuaaaaggguggcagggcauccuugugauccauggauccgcauaauggguuaugcaggacuaaaccuagaagacggcucagaggggagacauggauuuagaaauuagugguaccagcauuguauuaugggcaaaggaaaaagaauauagaaaggaaagcaaaagaccaauacucacuuuaaggaauagagagagagauagauugaaaaucagcugguagagaauuuggccauuuucaauaaucuagcuuuuguuuuuuuccucugccuccuggcuccaagcaauucuccugccucagccucccuaguagcugggauuacaggcgccugccacacccagcuaauuuuuguaauuuaguagagacagaguuucaccauguugcucagccuggucucaaaacucuugaccucaagugauccaccuggcuuggccuccuaaagugcuaggauuacaggcaugagccaucgcguccauccuuaaaucuaacuuacguuacaaaaauuggcaauaaaucuucuuguguaggaaauuuacuuuguggacuuacugucuuuaguaaaguaacaaaggaacucuuuuagagaaaaagaguuaagauaaaaagaggaauacauccuuaauaagaaaagcuacuccuugaauguagcuauugacaccugguacuuugccagucagauucauauggaaaggcauacuucauuuaacaaauaacgauauuuuugcaaauguuaaaauuuccccggaauauacuauaaagugaagaaagacuuugauaugcugcaagaugaccucauuguugggaaggggaauggggaaaagaauguggggucauggccuccgugcuuaugggccuugauccccgcacauagaaaugugguaacugccuaauccucuaaguuauucugaaaaaauuccugcuuuuguuuuucagcucacuguugagucugagaaggcaguuuugaucauccaaacaaaaagcuuaagauauuuagugaugauuuguauaaauuauggaaacauacugaagcaguuaaaauaauuuggucucaauaccaauuuuuuuucgagacagagccuggcucugucacccaggcuggaguguagugguacuaucuuggcacggugguacuaucucggcucacugcgaccucugcuuccugggcucaagcaguccucccaccucagccucccaaguagcuguuacuauaggcacacgccaccgugccuggcuaauuuuuguauuuuuguauuuuuuuuuuuuuuuggagagagaguuuuacuguugucgcccaggcuggagugcaguagcgcggucucagcucacugcaaccucugccucccagauucaagcgauuuuucugccugccucagcuucccaagucaauaggaguauagguccccaccaccaugccuggcuaauuuuuuguauuuuuaauagagaugggguuucaccauguuggccaggcuggucucgaacuccugaccucaggugauccaucugccuuggccucccaaugugcugggauuacaggcgugagccaccacauccagccuuuaauuuuuauauuuuuuguagagaugagguuuugccauguugccuaggcuggucucaaacuucugagcucaaacuauccaccugccuuggccucccaaagugcugggauaacaggcaugggccaccacguccagcccaaauauuuuccaauagaguacagaaguuaauucuuagggccaggugugguggcucaugccuguaaucucagcacuuuggaaggccaaggcgggcggaucaugaggucaggaguucgagaccagucuggccaacauagugaaaccccgucucuacuaaaaauacaaaaauuagccgacugugguggugcgugccuguagucccagcuacuggggaggcugaggcaggagaaucacuugaacucgggagguggggagguugcagugagcugagaucaugccacuguacaccaaccugggcgacaacgggagacuccguuuacaaaaaaaaaaaaaaaaagggaguuacuuuuuaguuccuuuuggguuuauggaguuauagggagaagaaucaagcaguuucaucauuuugaacuaaauuaauuuuucuccuggggcuuuucuuuuuucuuuucuguguuuuuuuuuuuuuuuuuuuuuugagacggagucucgcucuguugcccaggcuagagugcaguggcgcgaucucggcucacugcaagcuccgccucccgaguucacgccauucuccugccucagccucccgaguagcugggacuacaggcgcccgccaccacgcccggcuaauuuuuuguauuuuuaguagagacgggguuucaacguguuagccaggaugcucucgaucuccugaccucaugaucugccugccuuggccucccaaagugcugggauuacaagcgugaaccaccgcgcccggccuccuagggcuuuucuuucaaugaaaugaaaagcaaauuauucagcgggucuacagaaagguauuaauauauuauucauaucacucuacucucaggucuuggagaauuggacagauagacguaccuuacguaaccuuuugggcaaauguuaacuaaaaaguccauaaggcagagcuggcguuuggcuuggaauuuacuggucaggcaaugagcucaugucagacagagggcuuucuauaggaaaugagaacaaacaaggauaccaggcuaguguuuucaagauaauugggguaucuuggucagucuugucugcuuaugagaguagaaggcucaccucuuuggucaugcuuacugauggugauacuuguuugauugguaucugauuuaucaucuguugaauuacauucuuuaccagcugguguucagugcucuuccaagccaugaauugccuaauuccuacaugaaucauucugcauagggaguagugacagcuuucagugucuaacagcuuauggccagcggcugcucacagucacccagcagugguaggaaaugggaaacgugcugguuaauccaggcuaucauuaaaaauaguuggcuuuuuuuguuguuguuguuuuuuaaaggaaaguucgugaauguauagauuuuuuucauuuagcagagguguauugagucuccuauuagauccuauucacaccuacauacugugguaacuaguacugagggguggggaaggcuacagaaaugaacuaagaugccuuguucucaagggacagagagauaagauagauauguagaguccucagaaguuauuaauuuaaugugcuaaguacacagagggaguaauuacaucuauuuagggagauaagggggcaucugauuagaggagguggcuuugacauggauauuaaaugguaaguaagagucccuuguuagaguuggaacagaaagaaggagagggccauuucaacaaagcaaauggcaugagcgaaaguguggagaugggauuuuuuuuuguuuguuuguuuuuggugacucaccauaaagauccagaagcauggggaacguguacagaauaguagaauuacagagaccagauuguggauggcuuuggcugacaagcuaagugacugacacuuuuuuuuuuuuuucuuuugagacagagucuugcucugucgccaggcuggacugcaguggcgcuugaucucagcucacugcaaccuccaccuccuggauucaaguaauucuccugccucaggcucccgaguagcuggaacuacaggcaugggccaccacgcccagcuaauuguuuuauuuauuuauuuauuuuuuuuguauuuuaguagagacaggguuucaccauuucuggccagaauggucucaaucuccugaccucaugauccgcccaccuccgccucccaaagugcugggauuacaggcgugagccaccaugcucagcugggacuuacacuuuuauuggagcaaacgaguaauaugagcaaaguuuguggggaaagucuaauuuuguguauuuauaguugacauggggauuggagaaaaaaaaauuggagauguggagacuuaucugcagggaccuggugaugggaucuuuagaacaaaggugguaggaaaggucuggaaagauaaaaagggagagagguuguggaagaaguagugaugagacuuagugucuuguaaauguguaugucacagaauguauuaaggaagaaagagaagacaaggacaaguucgcuagaaaugugccucaaagaucugcugaaaguaggcaaguugaguguaggaacugauggaagguacgauuuuggguugauucgcuagggaagcaguugauuggaaauucauggcaaauaguuauuaaugaugggcugguacucaggaaagggugcugggucagaggaagcagaauuaagggugaugagauugggguguacgcucaaagaucuauuugauggcaggaguuggaaugaggagagucaggaguucagaagaagaguuaggcggugagaagcaaugcuguggacaucacagaggaaacagcuacauaaccuguuagcaccuuauaucugaagagugaagacauaaagguuaacgagacuccugggcaguaguggugccauaaugagggcagagaagucguggcagaaucaggugugggaucugagggaugugugcuaccguuggguagauugagggguagggaaugugaaagugaugauuuuuguuuccacuuuuaauaagauaccugcaggagaguuaaaauguucugucuaacagacuguuagagauuugcaagagaguggggcuacagcuguagacuuaggacaguugaagagaaugagauccaugaggaacugacugauuaaauaaaagcagaaaagaggagaaaagaaaucuggaauuagagagcuacagguaaaagagcaacuaugaaggauuuguuggacuucauugaaggauuaguuauauguguaggagaaugaagaaaauauugcgcuauaucauagaagcucuggaaaggggguuucaaaaagaaggaaguaguaacagugucaaauaaggcagacaggaaaaggaaaguaagaccggugaaaagguuauuggaauuaguuuuuggguggugagggcuaauguuugauugggguagauggaagaauggaggggcccaccauuauguaacacucauuuugauuggcuaggcuaaccuauggguguucacucaacuauaauucuuuuuccucugugguuuaguuuuucuuucaucuuugucuguuaagucucuaagcuuugugcaucuguggucuuuauuccuuucauauauccaacuucauuauguucuagguauaauaguacccuagagaccucugucuuuuaaaacuugauucucuaucuaugaaucagaccugaauuaaaauccaaguaauuccucugagacuucagucucuaagucuaaaucugggagcaguugcuuuugaugccuucuccuaccucaacaauaccuucuuggccugacuuuuuguuucaauguaauuuaagacuaaaaccuggcuccguuauuuauguuucauuuuugagggugcaugaagugaaauuuggggagauucucugauaaguaaucacagaucgauggccuacagggaucucuggcagcuggaagggcaaaauucuugucuuauggaaauaaguuuuguuucugaaguuccuuugucauuugguugagcgaacacauuuguuccucagcucacagcaagagccauaaacaguggacagcuucuugcaaaggccuaggacuuauguaacauguaacuacaguagaacccaauugccauugucaucuuauucuagaggacagauucaggauauaaggaauacccccaccaucuuucugcuccucaguaauucuagguuuccuuuucucuccaaccgcauucauuuauuuuuuuaacuuuugugcguacuuaguagguauauguauuuguggguuacaugaaauguuuugacacaggcauggaauauauaauaauuuuauuguggaaaaugauguaucuaucccgucaagcauuuauccuuuguguuacaaacaauccaguuauaccguuuuaguuauuuuaaaaugugcaauuaaauuauugacuauagucacccuguugugcuaccaaauacuaggucuuaucauucuuuauuuuuuuuuggaacucauuaaccauccccaccucucccacaaacccugccacuacccuucacagcuucugguaaccauucuucuacucucuaucuccaugaguucaauuguuuugauuuuucgaucccacaaauaaaugagaacaugugauguuugucuuucugugccuggcuuauuucacuuaacauaauggcuuccaguuccauccauguuauugcaaaugacaggaucucauucuuuuuauggcugaauacuucauuguguauauguuccacauuuucuuuauccauucaucuguugauggacucuuagauugcuuucaaaucuuggauauugugaauagugcugcaacaaacaccuccaaguguguuuauaguuguaggcgaagacagacauucuucugcacacgugguagugaaugugcucauagaggauugagcuccagugggagagaguucacuggagggacaccguacacugaacugggccuuuagcagggguuagggaggcccuuggagaggacuauacaaacgguguucagaauucaccaauggagcaggcguagauagcaucacguccaagggugaggaugcaaggaggaaauggagcccuuucaggaguccuaauccuuuuuugaagucuuuugcccuuuguauuaauuuaauauaauuaauauaauuuaauuuuuauaacagccugagggguagguagaaccuauugccauuuuacagauaaacuaacugggguucagcaaaugaagaaaauugcgguuacuuacgcugcaaacaagcugauagagcuggauuugaacugaucuauuggauucagaaucucuucgcagauaccacauugcccuucauauagacaggaguaaaaccugcuuauauguagacagcuuuuuuaugguuuuguaucugaaaauccaggaccauguauuguccaucucugauuucucaucuucucuuccucauucauuucuugucugugauuuguucuuuggguugacaugauacuccccauccuagagacagacagggucuuguuugcauccaaaacaggaagaguuuccacaucucugggagagcuggugugucucucugcugcauuccuucuaucuugggggcaggcggagcacaaguguggcuguuaggcacaacagaacagcuguagucacccgccaguugacaccagggcacauggugucauggucgcauuacuggagugugucuggcucaagcugcugcaugauuggcauuuauuggggccaucaucaggggaagaauucuauguacuuuguaagaaccauuucguaacaccucauuuuccauuugccacauguucuuauaaaaauaucaugaauccaggcuuuuugcaugaagccaaacugcagcuugccugauucauguacuacuccugagggauucugguuuugacuuggccucaugggcuuccauuuucugugagaucuuugaacaaaguuauauuuucacccuaauuucaguguggcuaaauuaaauaugaugcauauuuuguucaacuaauaugcuaaguauagaaaaaaggaccacagggguaauaaaucauuaauaaauuugguggugacagcugguagauuguuaccuugagaaaaauaagagacucauugacaacaacuaagaauagcaaauguaaauucucuuugcuuagauaaucuuuuuaugaagcuucuucuuuuuuuuaauuuaaaaugaugaaacgaaacuaacaaguauuuccuuuuuuguuauuuugcagaaaaaaccacugucugcaauaauaaaggaagucugugauggguaaguguuacucaggauuuaucuaaggcauucuaguugauaaauugacaagcaaauaauauauuuccaguaggauaguaaaauauuauucauaagucacccacugacuugcucaaagucaauaagaauuacuguguaggaauaucacacccuuuuccaacagaauucaccauuaguccucaaagagcagaaagugugaaauggcuguuaugugcacagugggguuggcuuuauuuauuuuaggaaguuguguuccuuuuguccuaccuagcagggaguacucuaaagguuuuugaggacacaguauacacuugaucugguauaaacugagaggaccacucagguccccauagaggaugaaagaauugaacagacaaggcaguggguaauugugcugcuccgugggaucucacacugauaugacuuuccuacuucuuuguggcugcucuaaagaauacaaaggaaauguauauaugguagcugcaugacuuuguuuuuuuuuaaaccagaacugugaaaauaguuguguuaacugaaauuuauauaaggucuagaguacuuaauuggaguguuucaaucugcaucaacuauacugauaggggauuguagaauacagagacaauuaaaaugugccaacuuucaaaaacuuaaauugcauuuauuuucuuuguuuuucuuucuuugcuucaaucccuuaaaauaaguagaauuguaaagauuuguauuuaaaucucccacaccaagccuugaggaugaacugcuuaaaggugagcaguaggccuagcaucaggucuagacagucuacacaugaaaugauuggucucaggguaauggaagguaggcuaaagucauuuugcuuuaggaacugcauugugguauauguugggauugguccaauuccaaucacagggugcuuaguucauccaacacuaaaaaauuguaaaaaugaaaauggccacuuucauuuuucuaaucaguauacgcuuguauuuuuaagguggucucuugccaaccaugaauauuuugcacuccagcaugccgauaguucaaacuucuauaucacagaaaagguaggucaacuacauuauuuaauaugggauacauauugaaggaaaguaaaucaugaugauguuuucuuuguucgggccuagacaugcaggucuaaauuuuaggucucuacuauccacgaaaauagagucuguaaagcaaacaacugcuacuuuagaauccacaagaugauauuugccagcucaagaguaaagaccaaauauguuucgugucuuguuuagcaacugcaguugccuucuaacagugaauaugucucucuuacugcuugguuaaagaauuuauuugauacuuaaugacuuaguuggguuuuccuuucucagauuuuguuuuuuucaaaguagccucuaacccuugcuuaaaguacgugaaauaaugacaagaaaccuuuucaaauguggaauuauguauguaggcacuaagaguguucuaugaaucuugggaacccagcucucuccuugggugauuuuaaaucuuuuuuagcaagauuaaaggagaaggagggauuugugaagacagcaauggcccugggagcaaguaaaauuaauauguacaagaucccugauagaggaagggcacacuggaauuuauugagugcauacugcaugccaggaacugagccaugcacauuacaucuguuuaggauuucuuccuuaagacuaaccugggcuauaaaaauacuggcuuugguuaacagguacgacacugagucauugaggacaaaugguuagacuaaugcuucauacuugauucuacaagaagcaaguuuagacuuuugugcuucuuugauuuuugucuuuuggaauuuccacaauaguuucgcauccgacacaacuuuagguugagcucacugaaaugcauaugagccaguuuugucuucuaaacugauaaucuugggggccagcagggagggaaggaacagcccugguaacagcugucauuauaacaagguggccagugcugaaacagaagugaguacaaaguacucuugaaggagggagaaucggguggccucaggcuucagugucuugcaggcuuugucccagucaguagucccuagagugacuguaauuuuauccaugaaucagguggugguagaagguggaggcaguaacaaggguucuacuuccccuuaggacucccuugcucuaccccaaagaaggagggagggcauucaguucagcaggagagaggccucaaaggccugaaugcuucucagaaauugcuucguucuucccagaugaacacugggaauuuuguaacugaugcuguuuucuucuucacgucaaauguuucuuuguaacauugauuguuacaaagcugggaacugggccaggugcgguggcucacgucuguaauuccagcacuuugggaggccaagggcggcagaucacuugaggucaggaguucgagaucagccuggccaacauggugaaaccccgucucuacuaaaaauacauaaauuagcuggguauggugaugggcgccuguaauccaagcuguucgggaagcugaggugggaggaucacuuggaccugggaggcggagguugcagugagcagagaucgugccacugcacuccagccugagcgacagagcgagacuccaucucgagagaaaaagaaaaaacaaagcugggaguuaacaagugaacuugauuuccuggcaugccuuguauauuaaguuuaccuuugauuccuuugacuuaaacguuuaguuuccugucucuauuuucccuuugcuucaguuucuuaauguuuuucauuuauuuuauacugcaucuauauaauuugcaugcuauucuuugugagauuaaagagguuauauagaaauccaaguuaaaugauagcaguuaaagguauugccaucauuucauucauaccaguuagugaguagugaaaucaauucaguuaguugucagagcauuaaacacuggaacauaguagaguagauuaggucagaguauaucuccuguguugcuugugaaauauuuguuccaccuacccacauguauaauacauguagauuacacuggugauuuacccuggguugugguaaaaaagcuguugagucgugaauaguucuggcugugaauaaucugugcuaguagauggccccuggugguguccugucuucugucaccauugucuggagaccucaguguagugaagauuacuaaagaugggguucucagacuucauagagaacauaagcaugguacagugaacccuuaaaaaaauauguagggcuuuagaucccaaccccagagacucagagugagugggacuuggauauagccuaggaguuuucauuuuuaaggcacccucugggcagucucaugcuggauaccuggaaccacugggagaaacagcccuggggccuauuuucuaaagaguuggaacccauguguacaggacauuaugccuucuguccagaaguugugcacaaaguucaauuuaggaaugugggcugggcacgugguucacaucuguaaucccagcacuuugggaggccaaggcgggugggucaccugaggucaggaguucgagaccagccuggccaacauggcaaaaccacgucucuacuaaaaauacaaaaauuaguugggugugguggcacaugccuguagucccacucaggaggcugaggcaggaguaucacuugaaccugggauguggagguugcagugagccaagacuguaccacugcacuccagccuaagugacagagcaagccuccaucucaaaaacaaaaacaacaacaaaaaacaaaguauguaggaauguguuugugugcugccauuucuuggcauaauuugaaaauuauuaacaucauauaaugguuaugcuuuuuuccugauuaaaauucauauauacucagaacauucaaacuauugagaauggaggaaauuauuauuuuaugguguaucuuaguuauuuucugggaaucuuguuuugccugaggacauucuugaaguugaguuuauaaaggacuggccacaaagucugucauggaguuuuucaucuucagugggcuguagcagagauuauucuuuuaugaagaguuuaaggagugagaagacucaucuucccuaucguaguucuuuguuuguaaauacggugucauugcucuuccucaugcagcugucacugggcacagcugugggugugcaugugucacggagcucagcacgcacagagcaggagaugacggugacuccuggcuccacagggucgauccugggcugccuucaguuugcugcuuuguccaucuaguuccuugcaaguauuccuaaaaauacagacauuuuuucccauuuuaaaaauaauguacuuagcaucaucuugguuacuuacagcccagugauuuguuagguuauauuuucaucaccaugguaaccagugacucauuuuugaaacuugugcaugcuguuaguuacugauuuucccuuauauaugagacugucucugucuuuucgcugaagaugaauaucaccuucagaaaauuuuuuucagaaaaaaaaaaaauucucuagcuggccaaacaauccaauagaaauagugguugauggaugcuugugauucucuucuaagauccuccggaaggcacuuucccugcuuuucuaauguucuccaagcccauuuuuugaaauagucuuccuuugcuuauuaggccauuaacugagguuuuuuuuuggugcagugggggaaaaugucauguuaaguagcauucagcagaagcauugcuuggaaaugccucagagaaaguuaagauucaaugauucacaaguucaaauucugcucuagaaacuuaacuauuucagggugauguccaggagagagagagagggagagaauaaaaaaugauaagugaaggguauguuuagguggaauuugucuuuugaauaagaauucuacugagacagcacuaagcauuguuaguuuaugacccucaucacaguccaaugaugcagguauuggugucuucauuuuacgagaaaagugagacugagagagguuacucaacaacuuguggggguuguacaggucagaaguggacaagcugagacuuggacccaggugggucugaacccagagcucucuaugccaucucugagaaacccucuguaccauugccucagccccaauuuguuuaugaugcccuuucuuugggcaucacugucaucaagccagugauccuaaugguaacugccucaaaaacaauaaauacaggaaguuacagacuaugaacacugguuaccagcuucagucuguggcuuccuuauuccuucugaggguaacuuggaggaaguuguaacagguaaccuuccacuuacuagagcuucacaaagugcauuuauauuugccuuugguauggaucguauaacugccuaaggcaguaugauugcacgaauaccauucuuuuuagacaaacaggaaaauugccuugucaucccuaauccuaagcauguauggagaugaguccccagaaaacacagggcacaguagaggaaagccaugaggagguuagguugugugcuuguggauaauugagauuuuauuaugauugcaggaugauacucacuuccuccauacugagaccuacucuagcauguaugaaguauagugauguaucgcuaaugucuuauuuagauaaauuccauaucuuguaaucacagaaauacgcuaagccucauucaggcccucucugcaaagcuggccccaggcaccuuugguaaggaaguaggguuguuuggggggcacccccuuuuuugucuuucccacuuccuaagugcccuggguucucagacagccccugaaccucccagaaucccuggcagccagaauugugcacucccuuggauuuguacauuucauucuggucaggagaugauuccacuauuuugcagaauucaguucaacuaucaugcuuugguagauccagcuguaaguaagcaggguaaucccagucuccagaaaggauugaagcuuagagguaagcaaggaugaaggccugggagggaaucaaaggagauggacagagagaagccugcaguccuauuuuccagcucugguuucugugcuuccugucuuugcauccuugugagagaccugcugugacuuuucaguccccgccccuuugcuuaaaucacuuuaugcuugucuuuguuacccucaaucaaagagcuuucucuagggcaggcauuuuaaugugagcaaacucacgcccaggaaagcuguaaauuuccuaaaccagccaaauacccuauacaacauucccuuucgugcugccuuuggugaaggacucuggauuugaucaacugaagucacuguggcugccucagcaagacacaccagcagcccugggcuagcuccuguugggccaguccacaggcaauaauggguggagaaaaauguuccugccugauaugguuuggcuguguccccacccaaaucucaucuugaauuguagcucucauaauucccacguguugugguugggaccuggugggagauaauugaaucaagggggagguuuccuccguacuguucucgugguagugaauaagucucuugagagcugaugguucuauaaggggaaaccccuuucucuugauuuucauucccucucuugucugcugccauguaagaugugccuuucgccuuccaccaugauugugaggccuccccagccacauggaacugugaguccauuaaaccucuuuuucuuuauaaauuacccagucucagguaugucuuuauuagcagcaugagaacggacuaauacacugcuuuucccuuuggccugucccuuuaucucuucaggguuuccugacuccaagcauuucuccugugcugccucuucuuccuguucugagacccugcugccuaacaugccuaacaugccuaacaugggucuccucuguuaaacccaugucuugcuacccaauuauuuccuuuuugccugaugaccaaaccugauuucugcuauggauguugcguggaugcccaaaggcugcuuguauuccuguccccagccuuuggcaagcacuggacucuccuagacaggcugcuuaucugggcucugccacucaucaucugggcagccagagagaaauggacaugcugggaggaaaaaagccacaugugaacacauccaauagaggagacuagaagugacuccccagugugugccagguacugugcuaaacccuggggauaucucuaaccuuccugauaaucacagacaaaauaaaucuuuaccugaaauuaaccaguuacagugacaaugagugccacaaaggagaaaugugagugucugggccuaauuaagccuugaggaagugacauuuaggcagagaucuagaaagaaaggagggaggauagaugggaaccucuuaaagugggcuagauugauggugugcagagaaauagugauaaagccagcguaggaccauccagauguggcuggaaaguuuugcauaugcccugauugucaaggcuuuuuaaggucaucuuaaagaucuugaacuucauccuaagaucauagggaagccuugagaugguuuuaagcuggacuugaugacaaacgauuggauugcagacuuccuugugauuacucugaauacacucuguuggaagaauugucagccuauggcagaaacagugagaaaacuguugaauggagaggaaaagaaugcauggguguuuuauuuuuuaauuaauuaauuauuuauuuauuugagacagagucuugcucugucgggcaggcuggagugcaguggcgcaaucuuggcucacugcaaccuccaucucccaggcucaagcaauucuccugccucauccugccaaguagcugggauuacaggcaugugccaccaugcgcggcuaauuuuuguauuuuuaguagagaugggguuucaccauguuggccaggcuggucuuuuaauuccugaccucagguaaucugcccgccucggccucccacagugcugggauuacagacgugagccaccacacccagcugcaugguuguuuuaaaauucgcauagagauugacaacaaaugcuggguagcacuuugaguccaaggaaaacauagaacgagaugauagucuuaaaugucugccuucgaagagcuuacuaucuauuaucuccuugacagcuuggcugaggguaguaaugauacacugcaguugaauaaaacagcucauuuuauuuauuuccaaagugauaucuucuugauaaauuugccuguuuacacagccugauaaaauguuaauauucgguuaccugauguauucauuccuguccuuucucaugcugcuauaaggacauaccugagacuggguaauuuauaaaggaaagagguuuaauugacucacaguuccgcagggcuggguaggccucaggaaacugacaaucacgguggaagggaaagcaaacauguccuucuucacauggaggcagcaaggagaagugcagagugaaguggggagagccccuuauaaagccccuuauaaagccaucaggucugugagaacagaauggagguaaccacccccaugauucaguuaccucccaucggcacgugggaauuaugggaacuacaguucaagaugagauuuggguggagacacagccaaaacaugucaccugacuaauuuauaucaaauuuuaacuuccccuuuggacauaccuaauuuuaggauucagacacuccuagcauaggacuuuaagaaggagaaauggauuugcccagauuugacaguuaaugugcugcaaugagaaagauaauuaagguacaguccuugucuccauagaguuuucaaucuagaggaagauuggguugauaacaauuccagucauugggguaauuagaagggguccugugugaagagauuauuaggaauaugauuuuugagucacuagguuuauaauuugaccauaugauucuguguaccuuaaaaaaccuuuugacuaggauaugaacucuucuuuuuuuuuaacaucauaauugagguaagauuuauacacccuagaauuugcccauguaaaguguacaaugcaaugguuuuuauuauauucauagaguucugcagugcuuuauuuuuuugauagcaaagcugugauauuuccaccuccaguauuuucaucuuccaaagcucuuagccuuaaauguagauuuuggcuccaaauuuagagauuuggauucuguaguucaaggcuaagguucaggcaucuuuaacaaguacagcugguccuaguaccaagcucaaacacuuuccaguggaacagugagcagccuuuggaucuuuccacuauuccugcaugagaugaaaaaccauauuuugaauucauacuggcuuguaggcauggacuccccaugcacucccugagcugagggugucauucugauugguuuccacuguugccaacagagaaugaaguccaaccuccuuucuuaagccaguguucaaggugcaucacaagucaacauuuucaauuuuauucuuucucuuauuccuucaauuuuagccaaacugcuguaguguucucuaaauauauguugauuugucuccuugguguagcuuuacuaaccuggaauucaguucucuuuaucucccuccuauuauuucagguacuagauuaggugcuaaggauaaagagaugaaaugacauacuccuugcuucgaaagcugaaucuuagaaacaaacacacaccuaggagcaauaucauuuaaaugacugccauuucaggacaacaguucauccucuucuuaccaauccuaaauuguuugagcuggaagaaacccuggcuucuugccuaacauaacuguagccccacuuuuggagauucgucucuuaauucaguccucuuauaaaucucuaccccuccucucugcugcuacagguauuauugucuacuaguucuuuuucucucagguaucuguuagcugaucaggaccuacaucgcuuuaucguugucuugaacuguuguuuaacuauuucugugcugauuuauguuuuccucucagcaagguuccaaguacuuuacaaucaaaaacuguauauuccagcucugugucucacgugguucugugaauauaauauguagguguuggaagauuguggguuuuauguuacauaguuuucuuuguaagauaagaauacaauuaguugcuuaauaaauuauguaugauguugguuaauucaauuaccagaagacgcacauacacauuaagauuauucacaguggagaaauuguagagugaauaaaugaaucuuaauguuccucuuagagucuuaaaaugguguuaaaaaguuuaguuuggcuuucagucugcaacaacugauuaauuaccuuuugaaaagaaauaugcacauacacacacacacacacacacacacuaucuguacugugcuggauauugaccaaaaauucuuaaaagauacaagggaaauaaggaacagagaccgucuggucccuuauaauauacaaauaaccaucacgaugcagaucaucaaacaguaauacaguuucaaaguauuaucacuuuuguucucauuauagcaaauaacguccucuaagaaccaaaugguguuugugagagauaauguacucaaaauuauguuacugcucaauuuugagaaagugaguuuuacuuuauuucacccuaggcuaagauccauuaauaaucacaugacucaccaucuucaguucuuuauuucaggcaguuggcucugugggagcagcaucacagaagaguagagagaauuguuggcuuacauacauacaaaacuuuagagcuucugugaaggaaaacaugggcacugacuuagaaaccuugccgauauuuucuccccuaccccccacacgcuuuuucauuaaauaaaggaaaaacuuugcacagucacacuccacuguggugacacauuuuccaauaaccgaggaacaacugaaugcaacuauuugcaguuagaauucucuguacguaugugaaaacaagccacuuaaaacaaaacuuggagcagcaauuuuggaaaacaggaaaaacucugaaauaugccaucuaguuugcuugcaacacagaaaucgugaaccaagaguguuuuacuuucuuuucuuucuauuuuuuuggagacagagucucgcucugucgcccaggcugaagcgcaguggcgcaaucucggcucacugcaaccuccaccucccggguucaagcgauucuccugccucagcuuccugaguagcugggauuacaggcgcacgccaccacacccagcuaauuuuuguauuuuuaguagagacagaguuucaccauguuggucaggcuggucuugaacuccugaccucagguuauccaccugccucagccucccaaagugcugggauuacaggcgugagccgccgugcccagacgccucugcccuuucucaauccaucaagcacaacuugugaaaauugaagugcauauguacacacacacacgcacacacacacacccucacacacccuccucagauuguccugacuuccccuaggagcuauccagcccuggcauugggcuucagccagccauuccucuuuccaucaucgucaccccucuuuugcccuggugucuuugcucauagugacucaaacuaaauuggcaguagacuuucugaagcugucucuaaaaacauuuuugggugguuuuagacuuuucuaauuagaguuugggaacuggaugggagcuaucauuuuaaaucauuugcuauguuuccucuagagaggacuuggaagcauauauacuuauuucaggaugaagaaaaaaaaacagccuaaguugagucaccuaaaugagagggagcucggaagagcagggcagcgaccgccaccagcauuacucagaugucgguggguuuuaugacauguuauuuaauguuuacacugacgguuggauagaggcuauaacaagaugauuacacaggcagcuaacuuuguagcuuaggcucccuagcuuaugcuugguaagaugcaacugccucuagaauugcaggcaaggacaaaugccagaggucaugaucauuccauguucuccaguucagcuaugaaacuaaugaauagauugacugaaguacugaaacauuuaacuguguaaugcucagauacagaaugagugacacguggguuuccuccaaacaggcacuucuuuaccaaaaaugacccuaaaaacaccagaacacuuuuuccaaacaaaacuaacuacagugaaaagcaaaaaccauuauuaguaaagaagauuacuucuaagaauggcucugugauucuuauaauuuguuucaaggccagaaacuuaauugcagaucuucuaagcauacuccuguucauguuuuuauacuucuaaaaugagauuuauuguugaacagcaaucagauuauguugggcaaaguuuugaaauauacacuguguauauuuuuguguguuugugugucauggguaaaugaaauaucgaugaaaaaauagugacuuuacuacuuggaaugccuuuuuguuguuuuuagucuguuuucuauuuuuaaaauauuuguuagaacccaucaggaugauuuuaugacuacugaugguugugcuccacagauggaaaaacauuucauuacacucuuugcucuacaaggucagaaacaaagcuagauuccuuuacuucgguuaucccagugucuagcacagugcucuauaaacauuuguuuaauggaauaacgaacaucuacuaugagcauaaacuggugacccaagggcaggcauagggggcaggcaugaaaaagaccaaaaagaaaaggagaaauagaagaaagguagaaaguuaggcggaaagucuggggagagauaagaggaagaugaacuuaucucuacccaggaaagguagugugccugcaacucuuuucuggaggugacacucaguaacauuagggcccuagguugcccauucuuuccacugugaucagaaucaaguuacaauaauuuauugucugauuguuucuuucugauccccauuguucugguuaucuauuggggcauuaaaaaacaccccaaauuuaguaaccuaaagcaaaaauucauuaucaguagagaugauuacuuauacucacuguuucuccaggccaggauuuggacaugacaucuucccauccaugauggcuugucucuucuugaugucuggagucacaacugggaagacaugaauagcugggggcuagaaucauuuggaagccucuucuucacucaugucuggcuucugggcuuggaugccucaaagacugggcucaguugggaugguaaacuugagugcccuacauauguccuuuccauguggcuugggcuuccccacagcaugguggcaauguucugagaaggaguuccaacaagagggcacuuccagagagggaguguuugaagagaaccaagcagaagcugcauggcucguuaugaccuagccuuagagguuuacaggaucauuucugcuguacuuuaucucuccaaguagucacaagccugcccugauuagaggggaugagacauagccuggugcauggcacacaccuguugucccagcuauggggacugaggugucugcaggcuguguugaacugugauuguaccugugaauagccacugcacuucagccugggcaauauugcuagacucuugucuuuaaaaaaaggggaauggaggugggacauagacuccuccuccccauggaaggaguggcaaagaaucugggggcuuuuuaauuaaaccacccaucauuucuuuacauuucucuuucagggaaaaguugucagauagguauacuauuuuccagaaguuauccgaagguuaaacugugucuuuuacuuuugcaauuauuuaacuuuuuaaaccaagaggaaggacaaagagauaaaguaagaaaaauagaagaaagugugcaucauacaaacauagagcagcaacagugagguaauuuucuccauugauaaaugauagagaucuauugcuucuuuuaaacguggggugggggaacaauaaucguguaaaccaagaaauuuagagggaguuuauuuggcacuuugauauuuacaccuucuuuugagcacaauuuugggagaaauugggauucaccgccuuuaccaugucugaagauuaaagucaaaaaauaaaagugacugcuuuguugccaucaacugcacuuguaaagcaguaacgauucuuuauuuuuccaaggcagccuuguucuuggugcuuugacugagagaaagggcuggagaggggugggugggugggugaacugcagcucuuuacugucucugggaauggcguaagucaaggcaaccuuggucaucaagcacaagcuucauuugcuuuugaacuccuaugggggagaaauacuacaaaacacaaacuuuaaaagugauucauugugaucuuaucugagauuuuucauuucauuaggagauaaagaggagagaauaacuuccucuuccaauaguuuuuuuuuuuucugauauauucucauuucucauuuuuucucugcucccuaaugcuuauuuuucuuucuccucuggcccuuuuccuucugauuguuuuuccuuccuuuccuucucuccaugacuucauucuuauuuugcuccaucucuuccucacuaccaucuccuuuauugaguuauuagccaucuuuuuaaaaacuuccuagucuuacaacaaaaaaugauaaaggggauaucaccaccgaucccacagaaauacaaacuaccaucagagaauacuacaaacaccucuacgcaaauaaacuagaaaaucuagaagaaauggauaaauuccucgacacauacacucucccaagacuaaaccaggaagaaguugaaucucuuaauagaccaauaacaggagcugaaauuguggcaauaaucaauagcuuaccaaccaaaaagaguccaggaccagauggcuucacagcugaauucuaccagagguacaaggaggaacugguaccauuccuucugaaacuauuccaaucaauagaaaaagagggaauccucccuaacucauuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacacaaaucaauaaacauaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaauugucccuguuugcagaugacaugauuguauaucuagaaaaccccauugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauauugugaaaauggccauacugcccaagguaauuuacagauucaaugccauccccaucaagcuaccagugacuuucuucacagaauuggaaaaaacuacuuuaaaguucauauggaaccaaaaaagaggccgcaucgccaagucaauccuaagccaaaagaacaaagcuggaggcaucacacuaccugacuucaaacuuuacuacaaggcuacaguaaccaaaacagcaugguacugguaccaaaacagagauauagaucaauggaacagaacagagcccucagaaauaacgccgcauaccuacaacugucugaucuuugacaaaccugagaaaagaaaugggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuaggcauuaccauucaggacauaggcaugggcaaggacuucauguccaaaacaccaaaagcaauggcaacuaaagagcuucugcacagcaaaagaaacuaccaucagagugaacaggcaaccuacaaaaaugggagaaaauuuucacaaccuacucaucugacaaagggcuaauacccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaauguucaucaucacuggccaucagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagugaguguggcgauuccucagggaucuagaacuagaaauaccauuugacccagccaucccauuacuggguauauacccaaaugacuauaaaucaugcugcuauaaagacacauguacacguauguuuauugcggcauuauucacaauagcaaagacuuggaagcaacccaaauguccaacaaugauagacuggauuaagaaaauguggcacauauacaccauggaauacuaugcagccauaaaaaaugaugaguucauguccuuuguagggacauggaugaaauuggaaaucaucauucucuguaaacuaucgcaagaacaaaaaaccaaacaccgcauauucucacucauaggugggaauugaacaaugagaacacauggacacaggaaggggaauaucacacucuggggacugugguggggucgggggagggaggagggauagcauugggagauauaccuaaugcuagaugacgaguuagugggugcagcacaccagcauggcacauguauacauauguaacuaaccugcacaaugugcacauguacccuaaaacuuaaaguauaauaaaaaaaaaaacucuuaaaaaaaaaaaacaaaaaaaacuuccuagucuuguccaccuacuuuuauucuaccuuuuugauguucagguccccccucucuuguagcucuagacuugucagcacuguaguuagguuuagauuuuuagaugcuaaaaaaugagguaccacuuuacugauuuaauacaacuaguauaaagcauucuuuuuucagugucugcugcucugaagcaagcagauacaaaaucucaaguaucuucaaaaaacauuuacacagauuaggcauauugagacauauuagaaaaaaguaaauuaaaaaaagaucaaaauccuauuacuuagagaaaaccaauggcauucuacuguaucuacuucaaacauauuuaagucuagaaguauauuuguguuuuacaaguguguaaaauauacacauuguuucacagcucuagacuuaauauauagcagccaucauaacacaguaguuaguauacucagccuacuuuauuauauaaugaggauuaaacaagguaaugccaacaacacaguuugcaaggcacuuggcccauagucauuccucagugagucauauuuccuauuuauuugucaaacuuuccuaauggcugaaaagaauucaacucaauucuugaagucaguucuuuguauuuggacuuuuaaauuguuuaucuuccucucucugucuuuuuuuuuuuucaagcagugcuaaaggggccauucuucaaaguaagucuuuauguaguuccuuaacuauuucauuauaaacuauugauaaaaguugaaugaugagucaaagaaauugugucaucuagguauauguggccaucauuuauggaggacccccuaggugccaggcacuuucaugaguuauuucauuuaagcuuuuaggauucacaguagucuuagacauuugggaguuuuaggucacauagcuucugaaugccggaauuggaacugaaauaagaucuuuuauauuauugugaagaaaguuccauuucagcaacuuuucacaggugcuucaggaauugcagaaggaguugacuuauacaaccuuuaaaaauauuguuuugaaugauuuaaacaugaauaaaacaaucagcguaaacucugauaauggauaggagcacagugaaggcaagcuuuauuauuauuauuaagaugccaggcuaaguugauuuugagagagccucaauauaaagcauuucauuuccuccucccccaugcauauauuuacacuucuuauaaaauaugucauugacugggaagauugcuuuuaucuuaaaucaggcaugaauccacccacucaagaaaaaucaucucagcaaguucgcugcugcugcaccuguguccuuggcucauggaaggucagggauaguucaggcguauuggcuugagagcaugucaggugucuaaugaaagagaaaaccuaauuuuccucuuuucuguaaguuuugaguacuuuuccccgauuuccaguauuuauuauaagaaaggaguugagauuagauguuauuuauacaaauuuacaugaugaaauaaauauccaaguaucuggaaagauuccugagauuucaagguaaacuuuuaaaagcaauuuccagcuaaugcucuguguugacagauaaugccuuguguaugauaugguaaguggaauucugagauggccccaagauucccacaccccuaguguuacacacccaucuaaucccugucucuugaaugugaucugggucugugaauaagaggggcuaucacuucugugauugugucacagcguauggcaacgaggauuuuguaggugucauuaaggucuucaaucagucgauuugggaguaaucaaaagggagaauaucuugguaggccugaccuaaucagauagacuuuuaaaagaaggugaagcauuaacgagaugucuuccuguuggccccgagaaauagcgaacugccauguuguggagagggcuacagagaaaggcccuaagaucaaccucucagagcugagaggggucccuggccaacagccagugggaaauagagggaagagggaucuugguuguguaaucacaagaaaugaauucuacaacaaccugagugaauguggaagagggcucugaauuucaaaugaggacccagcugacugacaccuugauuucaccccucacagacacccagcuaaaaggugcuagacuccugauccauagaaacuguggagacagcuaaaaggugcuagacuccugauccauagaaacuguggagauaaauauaucugugcuguuuuaaacucuuagauuucugguaauuuguuauacagcaauggaaaacugguaaauacacggugggaauguauucacguuuccuccacauuaaguaaggcaacaacacacaaaagcguauugaauguggaagcuugcuauauuauuauaaugaucaccuauaauaucagagauugaguuuuuauguuaauaaaagucuuauuauuccugccuauuaccuuaauaaaauauacauugacaaaccuaagcucaaaaaacauauuaauguugauacaauacuucuuucucuauuugggcucugaggcauuaucugagcuuuuuuuccuccuucuagaacaaaaaguuuccauuauuugaaaacaacugucuugacuaauaggugcuuuuuaaaaagacugcauuuugguuguuguaagaauguaacuguuggcagggaaaggaaaagcaagauugugcaaggcuaauuuauagucaguacauuguuucaaaguguauguuuaucuuuaauuguucucucauuacaaaguaaagcauagauguaagaaauccagccaucguuucagacagaugaguuuugugcuagugauacuguuuuuuaaagucagaauucauuuaaguaguaauuuaaaaacuuuuaaaucauacaauauuucaaacauaucaaaaaacuacaaaaaaugauauaacugacacuuguacagcccacugucuggauguugauagauguuaacauuuugccuacuguuuugcaucaccuuuaaaaaaccuuccaagcauagcuaaaaccuuacucuaucaaauuuucuaucucuccuucuauuccucucuccccagagguaaguaguagccugaaauugaaguauaucauucucaugaauguuuuauagguuuucuacauagguaugugcuuaugaauaauaucaagaauuguuuuauguguuaaaauuuaaagcauugauauccuacucuagguaacuuuugcauuuaauuuuuucacucaguaauauuuuugagaugaauuuuuuuuuuuuuuugaggcggaguuuuguuguuguugcccaggcuggagugcgauggcggauuguggcucauugcaaccuccgccucuuggguucaagugauucuccugccucagccucccaaguagcugggguuacaggcgccugccaccacacccagcuaauuuuuguauuuguaguagagaagggguuucacuguguuggccaggcuggucucgaacuucugaccucaggcgauccaccugccucugccucccaaaguguugggauuacaggcgugagcccccgcgccuggccugagaugaauuuaugauaucccaugacauaaauaaaacacaguugauuuauccauuuuuuuaaccaauaaucacuuguuuccucaauuuugguaucacaaagaauacuguacuaugcauguauuuguguggggcuguuuaaaaguuucucuagaauagaauguagaaagcuuuuggauuagagggaaggucauucucaacuuuacugcuuuucaaagugguucuacuagcuugcagucccacccgcaauuaucagcuuuucuauucccgucacccugaccagugcuuguuugcauagccuggcuaauguuagccauggcuaggacaccaugggacuucuccuguccuuuuuuuuuuuuuuuuaaauggcuucucgcucagucaccuaggcuggagugcaguggcaggaucucggcucacugcaaccuccgccucccggguucaagggauucuccugucucagccucccaaguagcugggauuauaggugcaaaggagagaauacccaagccuaugaguagaaaaguggguuaugugcaaagaauuaaacaggcagaucaagaucuucuugcagugugaagucaacguaaacauaguuccagauuuguauugauucugaaaauauauuaaucuuuuaccuguauuuuaaaaaguauaugccaucugaaugagagaaaacaucagauaacaaauucaagaguguaaguuuuauggugucaaaagggcaguaacaacugauaacucuuaguucaaauaacuguauaaaauuuacucaaugacaccaaaagcaaaucucaauuuuauauauaugaaagaagauauagacuacagaaguuauuuaauuaaaaucuuaguggaaaacuuaaaauuauauugugaaacccaggaaugaaauugauuaugauagaaaaaaguuuuuaaauuuaacaguuccuuuuuuuuuuuuuuuuuuggauauagaguuucacucuuuuuuuuuauuauuauuauuauuuuuuuuuuuauugaucauucuuggguguuucuuacagagggggauuuggcagggucacaggacaauaguggagggaaggucagcagauaaacaagugaacaaaggucucugguuuuccuaggcagaggacccugcggccuuccgcaguguuugugucccuggguacuugagauuagggaguggugaugacucuuaaggagcaugcugccuucaagcaucuguuuaacaaagcacaacuugcaccgcccuuaauccauucaacccugaguggauacagcacaugugucagagagcacaggguuggggguaaggucaccgaucaacaggaucccaaggcagaagaauuuuucuuaguacagaacaaaaugaaaagucucccaugucuaccucuuucuacacagacacggcaaccacccgauuucucaaucuuuuccccaccuuuccccccuuucuauucuacaaaaccgccauugucaucauggcccauucucaaugagcuguuggguacaccucccagacggggugguggccgggcagaggggcuccucacuucccaguaggcgcggccaggcagaggcgccccucaccucccagacgggguggcuggccggacggggggcugacccccccccaccucccucccggacggggcggcuggccgggcagggggcugacccccccaccucccucccggacggggcggcuggcugggcagaguggcuccucacuucccaguaggggcggccgggcagaggcgccccucacuucccggacggggcggcuggccaggcgggggacugaccccgccaccucccucccggacggggcggcuggccgggcagaggggcuccucacuucccaguagggguggccgggcagaggcgccccucaccucccggacagggcggcuggccgggcggggggcugacccccccaccucccucccucccagacgggguggcuggccgggcggggggcugacccccccaccucccucccggacggggcggcugccgggcggagacgcuccucacuucccagacgggguggcugcugggcggaggggcuccucacuucucagacggggcguccaggcagagacgcuccucacaucccggacggggcagcagggcagaggugcuccccacaucucagacgaugggcggccgggcagagacgcuccucacuucccagaugugauggcggccgggaagaggcgcuccucacuuccuagaugggauggcggccaggcagagacgcuccucacuuuccagacugggcagccaggcagaggggcuccucacaucgcagaugaugggcggccaggcggagacgcuccucacuucccagacgggguggcggccgggcagaggcugcaaucucggcacuuugggaggccaaggcaggaggcugggagguggagguuguagcgagccgagaucacgccacugcacuccagccugggcaccauugagcacugagugaacgagacuccgucugcaaucccggcaccucgggaggccgaggcuggcggaucacucgcgguuaggagcuggagaccagcccggccaacacagcgaauccccaucuccaccaaaaaaauacgaaaaccagucaggcguggcggugcgcgccugcaaucgcagguacugggcaagcugaggcaggagaaucaggcagggagguugcagugagccgagauggcagcaguaccguccagcuucggcucggcaucagagggagaccguggaaagagagggagagggagaccgugggcagagggagagggagggggagggggagggagagggagcagaguuucacucuuguagcccaggcugcggugcaguggugugaucucggcucacugcaaccuccacuucccggguucaagcuauucuucugccucagccuccugaguagcugggacuacaggcacccacccccacaccuggcuaauuuuuguauuuuuaguagagacggaguuucaccauguuggccaggcuggucucaaacuccugaccucaggugauccacccaccucggccuuccacagugcugggauuauaagcaugggccaccacgccuggccuacgugucuuuaauuugcauuucuccaacugcugaggcugagcauauuuuucuguguuuauuaucuagucaguuuucccuucuauaaacugccuauacauucuuuguccaauaguggguuuggaguguuucauugucauggauuuacaggaguuguuuauauguuguggacacaaauucuuuuuccuaaauuucuacccaguccauaguuguuuuuucuauugugucuuuugucaaacagagguuuauaagaccauuuuaaucaaucagauuuguccuuuuuucccuuuuguuacuugggcuuuuugcauuuuauuuaaaagcacuuucucuagcuauauauuuuaaagagauucucuuguguuuuauuucaaaaguuagaaaguuuugauuuucauauaggucaucaaucuauuuugaaaguguguguaggggguauuauauggcgaucuaauuuuaucuuuugauggagacagccaguugucuuaccacuguuuauugcauuauucauuaccuaucugccacuuccaugacuugcauugucacuucuuucauaugucaagguuuugugaauauagggguuucuguggcucucuauuuuguaccauuaucauacagcuuugauagcuuccaacuaacaagacuagauuucuaguagagugaaugucugugccuuuuucuuccucuuucucuucucuucuucagugucaucaucuucuuguucuucuuuuucucuuccucuguucuuccucuucuucucugucaucaucaucaucaucaucaaaaucacccugcuucugccuuuuacuccuccauaugaauuuuagcauaugcuugucaaaucccauuagaauuuugauuaaaauugaauugaauuuauggacuaauuuugggaaaaauuugcauucucuaagauauugccuaucccaucuaugaaaacaauauauuguucuauuuauuagaauauucuuuaacauuuucaauaaagcuuaaccauuuuugcccuuaaaguuuuuauacguauauuuaguaagauauaugccuagguaccucagaauuuuguauccaucauaaauuguacguguuuuaagcacuuccauuguuuauagcuguuuauauagcucuuauugaauaguuucuguguauagcaaauucuguugagcuuaauuaauuucugcaaauacacugagauguauuuaucaucuuuuaaagauuaacaaaauaaguaucagagauuacauaauuuuaauaugauuauauaugacuaguguacacccuggauuugaacuuaguuuuagcuaaaucuuuaccuuuuucugagagccuuuccuuuuacaucagcuaauguuucucugacguauguuaucuuguuuagcaggauuuuuuuuaauacuaaaaaacuaaaaucucauuauagagccuguaugugaaagaggcacuuaauucacccaguauaugucucuuaauaucaguuaauuaauucaucuggauagccacauucauggcagagaguaagucuauaaaauaaaugcuuuuucuggucauuaucuuuggaucagcucuuaaggaaaacacccauccuaauugaauuagcguggcuuucccaauugcucacugucuuacuuaugcuuaggccuauguugcauuagucccucccaacagaucuggaggcaaggccuagagcauagugugggugguccagggcccaaggagaaaagcuaaugugguaagguaagaugaagacaaguuuuuaaugcuuguaauguugaacuguuuaacucucuccucugacaccuaguaucccuacuaacuccuccagaaaagccucagauuuuaauuucacuccuggcaaaaaaaagagaaaauagagaagauagagggaaaaaaaucucgaaugcaaugcaagugaaagcccauucuuucucuggugugugcugcuggguuguuugcuuccagcugucaguccagaucccauuugucugggguuucuuucuggcauccucucuucgucucauacuaggcccuuccucuuagggcuggagcaggugcauuucugggaaugguucuggacagcuuuuugagccucagagcacaguaguuauagaugccuggggcuguuuguaacuuugcuucaguguugaggcugccuggugcuguggcguuagugaacagcugaugacagaugguucauuucugugcaggauguguugcagacauguggauugguaguggaaccugagcaaauauaucucaacucucucuuuuaaaaaaugcuuaauaauaagugugcccauaguagguaugaaauaaauauccacucguugacugaagguuauagcauagggaaagaaaggaaagaugguuugaaauuuauuuggauugugagagaggggaagggguuguuaccagugagcuuuaguuuauagauauuuucacuauuguuccagacucuguuaugauuauaauauucauucuauucacucaaaaagcauuugaugaacacauuugauauaccaggcaccauucaaggcacuggugaugaacuaaacauggagaugcccauucuucuugggcaucuguucuuuuggguguggaaacugacaggaaagacuuagaaaacgaacaaggcaauuaauuuuagaucgagguaagagcuaugaggaaaauggaguaggacagcccccaaaaaagacaugggggcagagugugguagguguugcugcuuugguuuacccugcuaagugcuuggccauagaauauagguucaaguaugacccagaaauaugacuugccuagguucauguuuauaaacaaccagauuucaaaaaauaagacuacauguggguguacaugguuuccagaauugagggcuuaaggccuuucauccuccaaccauaugagugucaaaacuuauacacuaaggcagucauuccgccaucaagauuugugcuaaccaagguuaaugucuggguucuccaucuucgcaaugugguugugccagcuuggggcaaucagccucacucugcaaggcccugguuguccaucuguaggccuuggccaagauugcuuuaagguaucagggaaggucucuuuaaagaggugacacaagguggggcauguaauccucaugccuguaaucccagcacuuugggaggaugaggugggcggaucaccugagguggagaguucaagaccagccugaccaacauggagaaaccccaucucuacuaauaauacaaaaaugagccgggcaugguggcgcaugccuguaauuccagcuacuugggaggcugaggcaggagaaucgcuugaacccaggaggcagagauugcagugagccgagaucgugccauugcacuccagccuggggaacaagagugaaacuccaucucaaaaaaaaaaaagugacacuuugggaggccaaggcuggcagaucaccugaggucaggaguuugagacccaccuggccaacauggugaaacccugucucuaccaaaaauacaaaaauuagcugggugugguggugcacaccuguaauccaaacuacuugggagacugaggcagaagaauugcuugaccugggaggcagagguuucagugagcugagaucgcaccacugcacuccagccugggcaacagagugagacucugucucaaacaaacaaacaaauaaacaaaaaaaaggugacauuugagccaagacuggaggauaacagggagccagacccuagcauuguaggaaaagaaacagccagcagaaaaguccugcagcaugaaagagcuugguguguuagagaacaaaagggaacaggauagugagcuggaagugagaggagguaccagagaaauugucgauguugacuagggcugcaucacagugucuucuaaacuauagugggaauuuggaucuccuuccaaguacaaugaaaagcuacuauuuuauccugggguucaugaacuuauguaggaggaacacuacagccauauaaaaacguaaacuuuucauugcuugaaucacaaaugucagcaacaagccaugauaggauaagcaguaucugugccuuuauuaugaacagaaauuaaaguacauccauuuauuacuguuuaucacaguuaucucuaaauaucauuuaucaucuuaugccuaauuagaaauuaugguaguuauuagaccuuacaacagaucuuguuauuuaaugcuuuaauacaggggucagcaacuauagccuguggacuauguccaagcugccaccuguuuuuguacauaaaacuuacuggaacacagccaaacccauuuauuuacauaucacaguugcaacagagguauucuagccugcagugcuuaaaaugcuuacugucuggcuggaaaaagauugcugacacgugcauugauaaagcagcauauauauuacuaugauacaauuuuuuuuuuuuuuuuugagaaggagucucuugcucuguugcccagacuggagugcaguggcgugaucucggcucauugcaaccuccaccucccggguucaagcgauccuucugucucagccucucaaauagcuggaacuauaggcauaugccaccacgccuggcuaauuuuuguauuuuuaguagagacaggguuucaccguauuggccaggcugcugucaaacuccugaccucgugaucugcccgccuccaccucccaaagugcugggauuagaggcaugagccacugugcccagccuaugauacaauuuuuaaaauauuuggauaacuguuugguuucuuugcaagcuuauuuauuuuauuuuaugcauuuaaaaacauucugaaaagaagauccauagacuucaccagaguucucuaagacauccaugacuaggaaaaaaagagaaagaaaaagaaucccuauauuucauuaucuaaggcuggggauccaaaugggcggacuuguauuuauuuccucugccugagauucucucccuucucucccuccuucuuuggcagauuuuccauuucuuuuggagugugguacugaagcugccuccuuuuuaugaauaauauauuggauccuacacauuuacugaaugagccaagcagaggcuuuauuagcaguguccaguguaaugcccauaauaacacuguguggugugggucugacugucuucauguggcacugcagaaagggaggccccaagacguugucuugcccaucauucauuuacccuguauucacugagcaccuauugcuugccaggggcugugccaaauucccaggugacaaagcuguuacuggugaagccaaguuuuggaucaggcccaucugacacuagugucuggguggcuaaugccacagcagguuauguucaggaugucaugugacacccugcugccucaagcuuggccacuccuccaucccuaguguuuccagccgcauuguuccuuggcugugagcuguaaauguuuuuaucucauccucucuccacagaccacuauuugcauuguuuugccuagaaugggccauggaguuaguauuuucccagcuguaguagcaucuucagugaucccugcucaugccacuggaauggcccuuuaaaaauguuuuuuuuuuucuuuuuacaagcaugaguuucuuuccuauaagugcagcucuuuuuucuugucucuguagcacuuuguggcuuucugagaccacaggcucuaacuugcccauugcaccccauguuuaagcauuugcacaugucguuugauugagggguaaguuaaaacugcuggcagugggaagggcuggcaaucaggucucuuaucucaaguggauggaaaaauaaggcuguucaacgugguucgcucaacucguacaggucccuucugugcaaaaccagggagauugcuucuccccuggaaacacaggcacuccucauuggcuggguugggcaaauacccauaauauuaggcauuuuuccugcuuuuuuccccuucuuuugcagguugcaagugauggcaauguacaugggauucucaaacuggucaccaguacuuagugcaugaacacacauuauauucuauauguuuggugcaauuuugcuauuuugcauucugcuuuugucaccacaauacagugucccagggucccauauuacugaacauucuuucauagcagcacuucgauggcuacaugguguaucuuuggccugccuuaccauaauuugcuucaguuuuccuuuguguuaggggacauuugcaagacuuuguauaucagccagcaucuagucaggauacagaaaccauacuguuauuuaaacaggguauauuccaauguaaaugauugacaacuaguagaagcugguuaguugugaguaaaagagaacucuuauggguccagaagaagcuguugcagaaaagaagcuauggccuccaguuugaggaagagugggcaguugaggaacuaaagaccaagagcgggcauugcucgucccccagaguucuucagagagggcauggccaccacagggacaucaccacccacgggugaugcagaaacuugucagaggaaagcagcuggccagcuggcugugcagcacuauagacgugucucuguugccagaagcuuggguaggcagaacugcuuugaagcagucccugguagggagagcagagcccgggugcaggaggccugaggccuuccccauggaauaguaaugguggaucccaaagggaauguccuuuccccaggcagaaucacuccagugcccucuauuggugaagugucacauugccgcagcuggcaaccugucagaaagcagggccaagaaugguuuugaguugagagacaauaaaugaauaacuggaauauuugggcuugcuuuuagcuuuuuuuuuucuuuaaaccguuuugcaguaaacaucuuucauaaaauguugauugcaucucugauauguugguaggauaaauucauagaauuugaacauuucaaaggccuuagucauauguuacaaaaccauccuauugacucuccuaguuguuguauaugggagcaaaggcauauagccuuguuauagaacuuguuacuccuuaaccuuuugaaucuuggccuuguuugcuggguuguuaacucugaggcugggagaugcucagagccagcgaugucaagguuggagccugcagucugauguaauaagggccaagcucugccguggagggagggaguaguguguugcugaaguccucccucaccucgcucagucuucugaacgcauucccuucccaucucauucacugcuucaacaaauucauucccuaaaacauccccuucaucacaucaguaaucuugcucaaaagcuguaaauguuuccucuuuguuuauggcaaugcaaaugaaagaggaggggagagaacugaccuauggcccuggguccguugccuccauucaguuguugagggucugaagcaaauugacaugcccagggucacgugggaaguaaguuggucagggccaaccagggcuuccuuccucccaguccucugcuucucccagauaccagaccauuguugcuccaucucccuaacuccucauuguccucccagcacagcaccugucccacgagagguuuuauuaauguguaucauacuccccuagugcucacacuaucucugaacucuuauggguccagaagaagcaguugcagaaaagaagcuguggccuccaguuugaggaagagugggcaguugaggaacuaaagaccaagagcaggcauugcuugucccccaggguucuucaaagagggcauggccaccacagggacaucacaaccuacggauggugcauaaacuugucagaggaaagcagcuggccgcuggcugugcagcacuauagacgugucucuguugccagaagcuuggauaggcagagcugcuuugaagcagucccugguagggagagcagaggccggacgcaggaggcuugaggccuuccccauggaaucauaaugguggaucccaaagggaaugcccuugcuggggcugccccacugucugaaaugcaaagauggccccccucagcugcugugcuuaaggggacugccuacaccuaacuucaaggccaaguccaagauucacaucuacauaauuacauuccauuacuguuuaacagauuagagucaguaauucuuauccugggguauuagagauguggacaugaacuggguucuacccugagcuuuuaguccccagccuagacaccaggcaaaaaguagguaugugcuggcuccuaucaugugaaauuggcuaaggaagcaagcaacuuggugucuuuggacagggggcugcuuuuuuuaaauuaaauuuaaucuuuuuuuugagcagucguggacaucugguugugcaugucccuuuaaggcgaguuugucgucuccagaaaagcauguuguucuuucucucuaucuuccacaaguccuugauuaaaacacugaaggagacagacaggcuccuucuguccuuucccucaggcuugccauguccuggcagauucccugggcuccugggaacugucuacccaucucugucugcuccuuuugacccagaucuuauuacagauacagagagagcaaaccauuuauugcagaacaggcccuucaccuucauguucuguguuuauagaccacaaauagguaguuaauagauaucucuuaauacuuguucuuucuuuuuuuggcuuugggaauuugguacaggauaucuggguccuguggaaagugaaaugaugcgagaaaaagacaacagcugaaaauggaauccucacuuaggagcaugaaaaaaguagaaaagaagucaaaccacaaauucuucaaauuaaugggugggaaugaagugcugccacucuaaugggguggcggggcugcuguuucugauggugagcagccccugcaaggcuagagccucaguuauggggaaugggcauuuacagcagcugaccacuuuuucuuccuuauccuucuuccucauucccaccugccuuuuuuccccuguuucuuuuuuugggggguggugucuggauuuuauuuuaggguauuucuaauaugcuuccuuaacggucgauccguaguccugucuggagacauugcuguguaacuuagcaaccagcguaucauauauugcccucaguuguuucauuagccugaagaugugaacaucaaaaaaauggacacacaguuggaccaaagcgaucaggcuugcaugcaaaaacaguuucugugaugauuaagaaauggaccugaagaacagcauuauuuuacaguaacauaucccaaguaaggguguccucauaucuggagaaagagacagacacagacaaggauggagagggagugagaagagacagagccagggaagaugcuggagcugccugcccuccacagggccugaacgcagaggaucggaagccuuccucccuguggaccuccuguuguccuugcuaaaaaacaggaaggagaauagaauugggauuuuugaguaggcauaauucuucauuuaucugacuaaguagaaaaguuggcauaacgagaaaaacagauuucagagggaaacauaugacaaugacauuuuucugugccaucuuauuacccauccacauggaggcugaaucgaugagcuaguaaagacacaaagacauccuaucgagaugccugugaauggcaggggcugguacagucuggaacugcuggcuaugaguaaauaugacagcagggcuuuggcuggcuuucacugggccacuugucauucuccucguacauugugugcagucaggacauuucccugcagaaauguucuuucugcugcuuuucucaucauuuuugagaagcuggcaugaguuuuguuugcuucagacuuuauuuauuaccuugaaauucagaauauuuauuccaaaugucauguguagucuuagaaaaguuuagacugugacgauucugaacuucauuuugcaucagaauuacuugggaucauaguaaaaaugcagcaaaccaggccccugauucacgagcuauggagggaaauccccagaaaucugcauucuaacacucacccauggugauucuaaagcagaugggcugaagaucauaggauaaaugaaagauuaaagacucauuuuccagagagggcauguggcaauuucuuggcacugugaguugauagauacauucuuugcuuucauggaaucccuuucccuguuugugggggguauugccucauuguuuuuuucuuccucacacacuuuauuucccauaaguuauugggguaacaggugguauuugguuacaugaguaaguucuuuaguggugauuugugagauuuugguguacacaucacccaagcaguauacacugcaccauauuuguaguuuuuuuaucccucaccccccucccgcucuuccccccaaguccccacaguccauuguaucauucuuaugccuuuguguccucauagcuuagcugccacauaucagugaggacauacgauguuuguuuuugcauuccuaauuuacuuagaauaauagucuccaaucucaucuggucgcugaaaaugcuguuaacucacuccuuuuuauggcuguguaguauuccaucauauguguguguauauauauauauuuauauauauauuuuuauauauaccacaguuucuuuauccauucguugaugaugggcauuuggguugguuccaugauuuugcuauugugaauugugcugcuauaaacgugcaugugcaaguaucuuuuuuugaauaaugacuucuuuuccucuggcuagauacccaguagugggacugcuggaucaaaugguaguucuacuucugguucuuuaaggaaucuccacacuguuuccacaguggcuauaguaguuuacguucccaccggaaguguagaaguguucucuguuuaccacauccaugccaauaucuacuguuuuuuuuauuuuuuugauuauggccauucuugcaagaguaaagugauaucgcauugugguuuugauuugcauuucccugaucauuagggauguugagcauuuuuucauauguuucuuggccauuuuuauauccuuuuuugagaauugucuauucauguucuuagcccacuuuuugaugggauuuuuuuuuucuuacugauuuguuugaauucguuguagauucuggauaucaauccuuuuucauauguauagauugugaagauuuucucccacucuguggguugucuguuuacucugcugacuguucccuuugcugugcaaaagcucuuuaguuuaauuaggucccagcuauuuaucuuuguuuucauugcauuugcuuuuggcuucuuggucaugaaauccuugucuaagccaaugucuagaaggguucuuccgauguuaucugcuagaauuuuuauaguuucaggucuuacguuuaaguccucaauccaucuugaguugauuuuuguaaaaggugagaaaugaggauccaguuucauucuccgacauauggcuugccaauuauccuagcaucauuuguugaaaaggguguucucuccccacuuuauguuuuuguuugcuuugucgaagaucaguugguuauaaguauuuggguuuauuucuguguucucuauucuguuccauuggucuaugugccuguuuuuauaccacuaccaugcuguuuuggugacuauggccuuauaguauaguuugaaaucagguagugugaugccuccaggauuauggcugccucuguugagucaugcagguugucagggaagugggggaaggccggccgugacaggcuucacccagcucccaugcaaacugaagggccagucucacucccaccauacaaaguucggcuacagauuuccuucucccuguggaguuauacccccugcuccacuggccacccucccguuggaucccuguggugccaggugguaauggccugcuaggggacgcagcgagcucccaggaccuuucugcugcuuccucuacccuguauuucucucccgucucuaaauuggcucagcuccagguaaggucggaaacuucucccgcaaagagaccuucagcuucuuuaguggggguguguuuucggagaagagggucucccuuuccuacuuccacaguuggggcacucacaguauuuggggugucucccggguauugcaggagccagucugcuuccuucagagggucuguggguccucucgggauuacugguuuguccuugcagucuaucuggagcuaaaauccacaaagcgagcuuccgcacgcuacucuguccggagcugcaaucuaguccugccucccguccgccaugaugauccccuucccauuugccauuuuaaagccuuagagccacgucuccccauugaguugaaaugccuggugagguaguagcccucacacacuuuuuguuuguuuguuuguuuguuuguuuuugaaacggaguuucgcuguuguugcccaggcuggagugcaguggcgugaucucggcucacugcaaccuccaccuuccaguuucaagcgauucuccugccucagccuccugaguagcugggauuacaggcgcccgccaccacgccuggcuaauuuuuuuguguuuuuauuagagaccggguuucaccauguugcccaggcugcucucgaacuccugaccucgugacccaccggccugggccucccaaagugcucggauuacaggcgugagccaccgcgccuggccccucacacacucucauacgucauuugaugcaguuucuucucuggccugagaaaagugaccuugccucaguuaaaugcugguuggauugacccugauaagacagagaugaccuuguugcucaccuuguugagggagaauaucagcaugaaacacuuugucagugucucaggcagaggugaauucaucaggacuccacuagagaugcaguaccaguaggagauguauaggaacugacugcaaggaauuaccucaugggauuaugggagcugguuaggaaaacccuaaauccacagggugggcuggaacucugagacacagacugaaucugcuaucuacuguccacagguagaauuuguuccuucaagguacccucggcucuguuuuauuguuaguguuuuguuuuguuuugaagagacagggucuugcucuguugccuaggcuggagugcaguagugggaucauagaucacugcagccuuaacuuucugggcucaagcaaucaucccaccucagccucccaaguagcugggaccacaggcauaagccacuaugcccagcuaaacaacucuguuuuuaaggccuuucaauuuauugaaacaagcccauugagauuaucuaggauaaucucucuuacuuaaagucaagugauuauagacuuucaucacauauacaaaauaccuuacagcaacaucuagauuaguauucgcauaacuggaaacuguagccuagugaaguuaacacaucaaaaagggccacccaguaccacaccacccccagccccgccaaaaaaaaaaaaaaaaaaaaaaaggaaaagcuaucacagaaaguaaagucagaauuuauugagaauuggaaguuugguuuaguugggucuuucaaagcaugcaugggucaugauacaacaguuuggauugguggaaacugcaggcuuugaggcaagggauucaaagaaccuuaggguacaaacaguugauguuuuucauuugaguuucugggucuuucagaaaguuccuguaaugagcagucaugccaucugccuaggcaggagacuucuggaagaauaaaguuaugccaguaaagacagaggaagcauacaaagugcuguuauugcagacauuggaaggugugcguucucaguaaccagcugagugugggggugagggagaugguuucuauucucagcccagaggcucuggauuccuuucucaugaagcgggccacaugacccuuguucccaaagccugagccuugcauuucuccuuaggagaauaucuguggacagauaugccggccauauugcccagcuggcucaagagagagaugacauguuugcuaacagcaaaucagagcuggagugccaccccuuacuccugcucuucccucuucuuaaaugguggaagaucagucuaccuuucaagagucccgucuuccuuuucuuccugcaucuccagcucuaagcgaccacauaggacuuuucucuguuccaugaagaugucuuguccuuucaugccucagagcuuugagaugugcuguuuccucuucuccccugggaaauccugccuaugcccagagggccaucuugaaugucaucuccucuaaaagccugugcugcacacccuguucuuccccucucucugcaucacaccuaugugcugaugcagugcuggucacccccaggucucugccaugguacagaugcaguuauuauaugucaguuucugucacugaccaauucccagcggacaggaauuaguccuguuuaacuuuguaucugccuuggugccucaucuguggcuggcauacaguaguuuagcuauuuauucaacagauaguuuuugagugccggcaugugccaggucauagguguccacucuucuggaugggagugauauagacauaauaaacuaucugcucucauggaggugacauccuaggggugaggaagacagccaaugaacaaaaaagaugcauaaguaaaagcacauagacagcacuuauugaugcuccgagggcugcucccucugaaacagacugaggacugaauaggauaaaaaaagugggugagagauucccugccuccaauacaaagcaugcuugugagacagaauuccuccuuagacaugccggucaacuuacagaagagguaugcauuugcuaauauuuguuauccugcuggguagacguuucuguccuugguguaacauagauuguacuauuauuuuuauuuauuauuuauguauagggucuagcuaaaaacaaauaagggucuagcagugugcuuuuuauguguuuuauuuuauuuuauuuuuugagacggagucucgcuccgucacccaggcuggagugcaguggcguaaucucggcucacugcaagcuccgccucccggguucacgccauucuccugccucagccucccgaguagcugggacuacaggcgccugccaccacgcccggcuaauuuuuuuuuguauuuuugguagagaugggguuucaccguguuagccaggauggucucgaucuccugaccucgugaucugccugccugggccucccaaagugcugggauuacaggcuugagccaccgugcccggccuacguguuauuuuugugcuuaauaauaaacagcgaacucucucucucuuucucucucuuccuaucucauuucuuuuuagcauuugcaauuugccaggcuguuuuaaggacuuuaaauggauuaucucacuugguccucagaacaaccuaggaaauaggcaguauccucauuuuccaugggaggaagccggggacaugagaaagcugggaacaugaggacagccaugccacuugcaccagguuuucccgcucggaagugaaauguguguccagucuggguggccccaucacuuuuaagcuaugcacuaugccuccugugugggauuuaugaaaucagaacaaugacaagccucuuucuuucuuaaugaaguuuacaucccaaguuaggccuuucagagccaaaggugucaucagcauauggugaaaaagcuguaauccaguugacuuucuggauagaauauagucucagaaacaguggucuaccauugccuuuguuucugaguuugcucugccuuucugucaggaccuuaacauuuuuaaugcauauuuuaguaguucuacauaucuccuuuucauuuaaaguacaagacacugauuuaaaagcaugggggaaggaagggagagaagauaaauguaauuguugauugagaaggcacaggcagaaggugcuguugucucugggacagcaguaauugcucucauucuugagccaguuggagucuagaugcagugccugcguccguuuccucuuguucuuauucaccucuaacagugcauuguucuucccacuuuugggaagagaguuuaggucugaggaauuaaguagcuuuuacugaguccacucagcuggugagaagcagagcaggaauugagcccagcuuuaucagagaauuuaaucaugcuuugcuuugaaacaaacaaucaucaagacccuuucuugaaagcaaucuugcuuggguuccaaaaaagaaggagugaaccuugaaggagugccugagggagccuagaggccaaugcggaacuuuuccagcccuccucccacccagcacccaguacaucaccuuggguguggcagggaagcccugggacuccgaggagcauuccuuagcaguuaggaauccagucuugauuauuugcugucauguauguugagcgacugaugaacucuuccucugaggguaaaugcaaggccuggcucuuaccuuugucaggcagacagagcacagcauuuguugucagacuaccuggguuugaguccucucauccuccuccaugauguugggcaaauaacuuauccucucagcagcuuugcuuucuuaucuuuaacgugggcauagaguuauaauguugguuacauaagcaugagaaacaaaaacuccgagcccaguuccuuucaauaaauguuaguuuauugcuuuuguuaggaaugucucauugcagcuccaaauuuccaugauuauuagaaagauuauuucugggccaggugugguggcuuaugccuauaaucccaacacuuugggaggcugagaugggcagaucacaaggucaggaguuugagaccagccuggccaauauggugaaaccucgccucuacuaaaaauacaaaaauuagccgggcuuggugacaggcuccuguaaucccagcuacucggaaggcugaggcaggagaaucgcuugaaccugggagguggagguuacagugagcccagaucgugccacugcacuccagccuaggugacagaacgagacuccuucugggaaaaaaaaaauuguuucuaaacccuccuggccgcuucauacccuuggggccuucuucccuuccuguuuggaaaauuugggaagaauaaacuagaccucuuuccucuugggaagggaccugccuuaagucuuacaugaacaggugugccuggcccaaggguucagucagcacgucugcuggcucacucugagcguuguucuccauaaucacuaauauaaaggauuuuuaguucuccaucuuauuuucucaaguuguuuagagcuugagcaaagaaaggguauguuauguauuuggcuuccuuagaacucuguuguuaguauuugccaucuuccuuucauuucucacagagucauagaauuuuagaguugaaaagagauuuuaaaaaugacuugaauucauuuccccagcuccuaucucagccugccugccaagaggcauucaguaccauguuugcaugcuucuaguaacaaugagcuagcucucuccggaggugacccagugcaucaggggaugcucuacacugggcugaauugcacacauagggccuggaucuggugguguuggguuuucgggccugccugcacuuggugugaaauguucagaucugcuuuucuuugggaagaaauacuggccugaaggcugccccuuuuugggugguucuuuuagaaaauucauuguccaaaaaaucgucagaauuggcugaggaagcaagcaaucuuauaugucuuuggcauuucaucaagaaauuucccaccaccucagugugucugcugaguccugagcaaacuccagcuuguggcucgucuuaaauuaugcaggguagugauccugaaggcagauuuauuaacccccaacuucagcauaccagguagggcaugcgaccacggugaguccuggaaggccuccuccuggaaauugggugugguguguacucugcuggaagaaaauaaaaccaccaaugaaauucuaucuucaaugucaaagaugcuguauuagucuguucuuacacugcuauaaacaacuaccugagacuagguaauuuauaaagaaaagaggguuuaauugacucacaguuccgcauggcuggagaggccucaaaaaacuuaacaaucauggcagaaagguaagcaggcaugucuuacauggcagcaggugagagagggugugaaagaagcaaaggggaaagagccccuuauaaaaccaucagaucucgugagaacucacucacucucacgagaauggcaugggggaaacugccccuauuauccaguugccuuccccaaggucccucuguuaacacauggggauuacaauugaagaugagaguuugguggggacacaaagccaaaccacaccagaugcuaagugauagcuucauaacacuuacuucaaauauacuugccaaauggaggcagacugauuggagagcugcuuauuuaugcuguuugugcuuaacuucaaggcaacaugcaaaaggaaucagcaaauguuaagaaaccaaacuccuuaauaacccuuuuaaagaaacagcuuuacugagacagacgucacaaugauucaccuuuuaaagguguccaauuuggggguauuuagugcauucacaauguugugcagccaucaccaaucuaguuccaaaacauuuacaucaccccaaaagaaaacacuggacccauggagcagucauucccauucccucccucccccagccuuaggcaaccauuuauccuaauggcugauucuauuuauuugccuauccuggacauuucaugcaaaugcagucauauaacaugaagccuuugugucuggcaucuuucacuuaguguaauguuuucaagguucauccauguuauagcauguauugguacuuaauuccuuuuuuuuuuuuuuuccuuuaagacggaguuucacucuuguugccuaggcuggaauguaguggugcuaucucagcucacugcaaccucugccuccuggauucaagcaauucuccugucucagccuucugaguagcugggauuacaggcgccugccacuaugccuggcuaauuuuuucuuuuuguauuuuuauuagagacgggguuucgccauacuggccaagcuggucucaaacuccugaccucaggugauccaccugcuucggccuuccaaagugcugggauuacaggugugagccaccacgccuggcccuucauuccuuuuuuaugacuuacuaauuuucuguggaacggauagaccacauuuugcuuauccauuuaucaaguaauggacauauguauuguuucuacguuuuggcuauuauagauaauguuucugugaacauuagugcacaaauuuuuguguggacauaugcuuucacuucccuugaguaaauauguaggagugcaaucguaggagucaggaauuguagaaauguaggagucaggucauaugcccuuaauaaccuuuuaaaauuacuuuuuuuguuugcuauacuugggacccauauuccuuuucuuuggguuuguauucacuuccuuuguacugaauauugucagauagaaaguuaacagccuuuauagaaauaauuaaaaauuauucaagugagaauaaacugaaugccuguuauaucugcuagauuauauuugccuuuguucucuucuuuaccaagcuucuacuugaaaauuuacaaagauuuuuucuucuuuuccagaaccgcaaugagauaaaaaauggcacuauccuucgauuaaccacaucuccaguaaguugaucuuagcuucugacuuccagcaaacucuuugcucugcguuucugcuauaugugauugugggauauuaauuuuugagguugacuuuagugcaaagcaaaaggcuuccagaauguccugacaugcagauucuggauuagcaggaaugccccuccguagauuucccacugcagaggaggaagaccuuauuccaggcgaagggcaagcuugucuaaccugcggcccaggauagcuuugaauucacaaauucguaaacuuucucaaaacauuaugaguuguucuguauuuuauuuaguucaucagcuaucguuagcguauuuuauguguggcccaagacauucuucuucuuccuguggcccagggaagccaaaagauuggacacuucugcuuuaagauuugaguuuggaggucaucuuaacaacuucuguguuacagcugggaucacucaccuguaccaauugguuuuacccaccuacucacacauccaccuaaugccaucugagcaaauucagacaacaaacaaagcaaacaaaaccaaagucaguuacuuuccuuuaaagucgguuacuuuccuuuaaagucaguguggcugggcgcgguggcucaugccuguaaucccagcacuuugggaggccgaggcagguggaucaggaggucaggagaucaagaccaucuuggcuaacacagugaaacccugucucuacuaaaaauacaaaaaauuagccgggcguggugguggacgccuguagucccagcuacucgggaggcuaaggcaggagaauggcgugaaaccuaauagguggagcuugcagugagcagagguagugccacugcacuccagccugggugagagagugagacuccaucucaaaaaaaaaaagaaaaaaaagaaaaagucagugugugugugugugugugugucugugugugugugugugugugugagagagagagagaguuuaaguauuuuguagcuuuaauggguuauuaugacaauucauaaaaauaauuuagaaauauugaccacuucacugauccauugacagcugauucuacauaagaacuuuagagucuucugaauuaaagcugcuaaacaagacgcuacaguauauuuagacuauuguagcugaugaugucucucuucuuggucuuuccuacuugcuuggagauacuuuagguaguaacauuagcauauuuaacuauauuauuuuacagugcauuucauugcuuuccuaaaaaauuaucugccccaaauacaccaaguguuacuauuuucacucugcauaugugaugaaaacugugucuaacuaucauuuucaguuuccacugaagccaugugguagacuaaaaauaaauuuaaaaauugggaaaagcaucuggcuaaaauuaagcuguggguacuguaacuaccauaaauccuuauuguugaaaauuacauuaguguggcuuagaaacuccuaaacauuuugcccaauaacauccugaaccuaaaaacagugaugagcucaauggagugaguugcuacaguuggcugaacugucuuugaugccugcuuugcuacuuaauggagauuauaaucuacucauuuuucaguggcuacaugaugagcugaggcguuuucgucugacuuugcauuggucuucuuacucaagucagcaugaaugaauguuaauuugaccuuuacaccauuguuuuauguguuuuuuguaguuucugauuauccugcuaaaagucaucaucugcuugcuggacagaaaaaguagaccuugccuuuuauuucauuuuagagucuaaaagacagcuuuuuaaucaaagccuucucuaagccaaagaaggaguuaguuucauuuuuuuacugcuguggauuuaugaacaaaaauuccgcaaucuaagucacuccuugagagaaggcuuagauguuaggcagagugaaguuuuucagcaucccaaaagaaacuuagcgugacuugucaucaggaagaauggaauuuguguucuugagauaaugauccucacauucccagcucagugaauggaaagaugugaaagccaguguaagaggcacuauuaaaagaugggagcagccgggugcaguggcucacgccuguaaucccagcacuuugggaggccgaggcaggcggaucaccaggucaggagaucaagaccauccuggcuaacacgguguaaaccccgucucuacuaaaaauacaaaaaaaauuagccaggcgugguggcaggcgccuguagucccagcuacucgggaggcugacgcaggagaauggcgugaacccaggagguggagcuuacagugagcagagaugacgccacugcacuccagccugggcaacagagugagacuaugucucugucucaaaaaaaaaaaaaaaaaaaaaaagauaggagcccagcuacaaaagacuggcuuacauuuuccaaaaagcagugauccccaaaccuggaucagcuguggaaguuugaaaaugcugaugucuggggccuuaauagagaggcuggauuacaauauuugggaauaggccccaggaaucugcauuuuaagcaaucaccuugugguuuggcuguagccacagggucuagaauugagaaguuacucuauaagccagaaauuugggaucugugaacuuuaaauagguuauuuuuuauaguuuugcauguagcugaaaaauauacuugcauaugcuuguucauuuuuacauacacaauaaaaauauguuaaaaacaacaacaccuauuagaguaccauaaagaagccagcagaugguguuauacuagcuuucgaaguuccuucgucugccucagcugaacucucccugaagccaaauaaggacaucucaacauccacaugggcacacacacgccugcgcgugcacacacacacacugcuguuuuuauguaacguguagcuaugcugaguuuuaccuccacucugucaaagguggucuuuuuguugauugaugaauuuguuuucugucucccuuuaucacagaacagucccuucuggauugauccuagagaaauggucacuaauacuagaagaucuaaacaaacaaccugcacuguuuaauucauuuguaauaggccuuguacauggcugcugcuucuccacugcaugguacaucuuuagacagucucucuaguggccguguuaaacaagcguaucuuucuagugugguaucuuuaucuaucuccugcuaccauaaaaaauauaggcugggugugguggcucacaccuguaaacccagcacuuugggaggccaaggcggguagaucacgaggucaggaguucaagaccagccuggccaagaugacaaaaaccccaucacuacuaaaaauacaaaaauuagccgagaaugguggugggcaccuguaaucccagcuucucggcaggcugaggcagagaauugcuugaacccaggaggcggagguuacagugagcugagaucaugccacugcacuccagccugggcgacagagcgagagccugucucacaaaaaaauauagccaggaacacacccagagaaugugugcaaaugugugugaccuuuggagcagucaggauuuggggagcuucuauaugcagagcugaguagugucuuguagugucuccuaccugccaugaucauaauagcugugggcauagagucugagguccucuguugcaugcagcauauuuuaaaaucagcuuuggcuauuguucguaucagaaacagcuuggcuugccagaccauuguuacuuuucugaaauuuuuguuuuaagaagugcuuauggugacuauauuuguagucuugaaguagagagaaacuucuaaguagaacacaaaaugcagaaaccauaaagaaaaagaucaauaaauuugacuaccaaaaaauuaaaacaaccccacaaaaacuuuguguuuggaaagaauuccagaaacaaagucaaaaacaacauuggaaaaaauaauugacagcugcauaauggagguccgguucauucauuugcaagauuuuuuaugaguggaucaagaaaccgucccaaaagacaggcugccaaaagcuaugaacaagggaaaaauaaacaaaauaaugucugugcauguauguguguauguaucuaucugagaagaaguucaaucucucuuagagaugaaaaucuacaguccuagauaaucuaagugugaggaaaagaugcuguggggucaggauuuugaaaauuugaaguagaaucuauuuguaugcccucuucgggggcaaucuagugguauucaccuaaguuuaaaauacauauaccuuugucuuaacaguacugcugcugggaauuuauauaauaaauagacucacaaaagcacugcaggaugaacacacacacacacgcgugcgcgcgcccaagcauggcuauaugcaucauuguuuuuagugaucaaaaacuaggaaccuguuauguaucuaucaguuggacuagguaagugcaguagguaauuuuuauguuguagaauacugugcaguuguuaguaagaaugugauacgugcugccgaggagguaucccuaaaguaugccauuaacacaaaagcagguugcagaacauccuguauagagggaugccuguuauguauguggaagggaaguguauguauauucagauaaaaggauaaaauguuucucaagggauacccacaagaaacuguuaccuuugggcuaacuuuauuuuuuuauuugguaacuuccaguaguacucguguguguguguguguguguguguguguguguguguguguguguguguguauauauacauauuuuuuuuuuuuuuuuagauggagucuugcucugucgcccaggcuggaguauaguggcacaauuucagcucacuaaaaucuccgccuccuggguucaagugauucuccugccucagccucccgaguagcugggacuacaggcguacgccaucaugcccggcuaauuuuuguauuuuuaguagagaugggguuuccccauguuggcaaggcuggucucgaauucuugaccucaaguuaucugcucgccucaaccucccaaagugcugggauuacaggugugagccaccaugccuggcuguacucauguauuucuaccuaucucaugugcugguauuauuuuuaauuaaagaaauacacaaauauauauuacaaagccauuauaguacaaaagaggugaaucauaaugcccuaugcuaaaaacaugucaagauugcaaacuaugagauuuuuuugugaacccuauuauaagcgaacugaauuauugaccauuaugccuucuuuuggccuguguggauguauuauagaaagcagaacugcucaucaagucccuacuguugcuuugucagcuguaagcauaauccuugcuuucuacucuuucugguuuagggagccgguaucagcauuauuuaggucagagggccugucaucaugauuuuugggucuuauucccucuggcaauaagaaaaauaguauuaucucagucauuguguggauucagguuaucggagauucuuaacaauaagcccauuaauuuuuuuuuuuaauuccauuuuucaauucagguuuucaauuuuucucuccugguuugagaaacuaauaaaggguuguaacaugccuuaaauucuauuuauuggcaucacucucagcggccuagcuuaugggagaagaagccaguggaggcuggcaggcagaggcgacacaggauccccaggcugcugcccaaggacagauugcaggggcggccagggcaccgggucagaguuucuugcagguucaggagaugcagggggcuugggcuaccugccuuguagggaauuggagaguuggaaggagugucguggagggcaagccccagaacuucagcauguggugcucuuugaggaaggauguccuguuccucccggugcucuggcaaaauuaacugcgugcuguuaacuaggaagccuggacagaugcaggugugccagccacccccauggaaauggcauuuaaagcugugggcuggaagaggucaccauggggaaaguagaggagagggcucagcacagaccccuggggacacucuuaagguuuagaggaggagccuagcaagaagccaggugagcaaaguguuucaaggaggagggaguaguacuuagguguguuggaggcuguccagguaauaaagaugaugcgaugaggguggucccugggcugccaccuggagguauuaauagcaugguggagacacucuccaugcagggcuggacagggacgccucaugagagcggggagaauaggagguagaacggaggcaacacuuucgagcuacucucucuuccaaaacuuuugcugaaaaugcaagcagagaaaugaggaaguagcuguagggaaacugggucaauggauguuuuuaccuuucuguuuauuuuuuuuaaagaugggagauauuagagauuuuugcagcuggaaauguucuacuacagagagagaauugaugauacagaagaaagggagauaaauuugaaguaaaauacuugagaaggccaggggagaggagauccagagcugaggggaagagcugacuucugauaggaaacaggguccccgccacacagcaucuaucaggaggaagcagagcuugaggguagagaugccagcagcuggugcuguuagaaguaggaagaugaaggaacuccuggcugauugcuuugauuuccucaauuaaaugaucaccaguggaggggaggcagcagaaaggcauagaggggguuuaaggagaguagaaaagguauggaggagucauucugaagggacacagcaaacauuccaggaaaauauuggauugcugggcaacauugagcguacauuugaagauaucuauuaaacuguugaaacuaaggauguuuuuagacuacuuuuuaauuggcaucauggauccagaguuaugcuagaaguuucuuggggaugauuuuaacuuguaucuucaagagagagaaauguuaaaugcuugacacacacacacuaccaguacccuuuccugugcccacggcuaauccuuuaugagcuguuuccucccuuggagucuggagucuggguccagaacccuuuccuaucugggacaugagguagccacaucaagcuguuucaauggcccaaaguaaaacuuuuuucuauccuuagagcaauaccagaaaauauaacuugcugucugauacagagaccuacaugacuauuagauucuuuucaugugugcugguugcuugaaaaaucagaaccaaggcuaucuuauuuuuuuaauaauguugacucuuuccucccaaauauaaaaauggugcaaauucauuauggaaaaugcaaaaaauaaggcuuccugcaaagaaaauuguuuagaauauuacaauucauaaauaaccacaggucacaucuacuugccuucuuugaccauuuguaugcaaaugugugaauacauaugugugcauacaugaauguauauauauucauuuauagguucauauauauauucauuuaugcauucauauauauauguguauucauuuguacauucauuuagugaaauguguuuugaacucaugguaaaugccagacacacuucugugugcugggugacauuacauucuggcagauacacacacuccacugcgcauauucccaccucccauaaacaauaaaauauguuugcgucuuggcuguuucucuuaauauugccucgugaggauguucucacacuauuuuacauucucuaaaaguuccauauguaguucuauaugauauuucauccuaugacuaugucaugacuauuucaccauuguccuauugguaaacacgaugguugcucaauguuuggcuaugaaugcuguuuuaagggcuccaaauguaccacacauccaucuccgauauuuacaugcauccauucagggaagcacaucaccaccagggacuccuucagcucugcaugcucaugaacacccuaggcuaccuugucuacugcuuccacauccucacuucccuccacacccccuggccugcagaccccagacacaucaguccucuccuuucucucccuccagacaggccaggcuuguuccaccugaaucagggcuuuggcacuaaccauugaugcugcccagaauauuccacuccccaauguggugggguccuucuugucagucagaucucuccuugaaugucacuuccuuagguugcuugucccugaaaaccacuccaucuaaagaagccaucagucacucucuaacacaaacccuccacuuuagguuuugcuaugaaacaucaauauuugauuuuuuauugcuaauuuuaaaaguuguccaccugccacaccaaggugggugagccccaggagguugagaaccguagcugucuuauuuguugcuguaucccaaaugugcggaacaaaugucaagcuuuucagaaguauuuguugaaucagugaaugaggaugcugaggauuuugaaggaacauuccuuuccacuggauaacuggaaagacuugucugagaauacauauauuuauauauauaaaauauauaaaauuauauaaagagugaucugcaauaacugauaucugagaacaaaauuuccuuacaaaacuccaaucuuuucagaauaaaaacuuugauucccacuuuuuuuauauaauaaauguuguauuuccagauuauuuagaaauuagagaagauaaaaagaagguauaucccugccuguucuggauccaauuggaaaaauauugcauuaaaagggucccaccaguuugacauaauauuuugauuggaggucacuucugggacucaccucuguggagcaccuuuuccuggcggacuccaugaugaggguuacugcccagcugagaugcacucugucacacuguggguggaagggaaccuuaaacaugaucucaucacaguuccuugguguaccuacugauggggaaaaugaggccaagagaggugaagagagaaguucacugcagcccuggagguagccaauggcagagauguaaguagcccugccuuggacuccugggucauggagguuuccaucaugguccccucgccaccuggcuugccacaguccuccccuccucuuuagugaugugucuccuccaguuguucaccuauguccuaggaugaagagggaaauuuacccuaaagcaaacacugugggaacugcacuuuuuaaagaaaaguugucuccuuagauacggguaccaagggaaggagcaaggccuguggggauaguuaagaacagccucaugccaacagaacacaucauucucaggcgcuggggugagugaaggagaggggugaauaguucuguaggaacuuuccaggccauugagucuaugagcuuuuuuguaguuugacaauuuggagaaggcuuuacugcuauuacugggagugacuccuuggcuaagaucccagcaaguuaggauauugcuuugcuauucuuacaugugaccaucuugguaaaauauuuucaauuucuauagcagcaacccaugagcaguugugggauuugggaggacuccacagucuugauuccucugcuugggacauuuguccuuuucagguuucuguuguuucucuccucacuucuuuuauuuuaaaauuuauuuauuuacuuuuaaguagguaaguaugaaggcauguaaaugaauuaggaagaauagauauaauaaaguauauauuaauaagaguagguauaauaaauuccaucuacuuagcuuccacauuauugacuuuuucuuuguuuucuuagcaaagguucuuccuuaaaggugcacagcuuuuaaaagggcaagcacauuuucuuuagguacuguaaaccaggagggccuccuuguguuacagcuggggaagaucaggugguaguugaaaaacacaaucagcugggcgugguggcucacgccuguaaucccagcacuuugggaggccgaggcaggcugaucaccugaggucaggaauucaagaccagccuggccaacauggugaaacccugugucuacuaaaaauugaaaaauuagccaggcauggugcaagaacuuguaauuccagcuacuugggacgcugagacaggagaaucgcuugaaucugggaggcggagguugcagugagucgagauugugccacugcacuccagccugggugacagagcaagacucccuaaaaaaaaaagaaagaaagaaaaacacaaucagagcugcucauucuaucaucacggagagaugcagcauccugagugauuuagaguggugguccucagcgugugauucccaggccagcagcagcaacacuuaggggcuuguuaaacacaaaacuuuugggaccccaccccagaccuuuagaaccagaaacucuagggguggcccuuggucuguguauuaagaagucauccaggugauucuuacacaggcaacaauuugagauccacuguuuacaauguguuuucuggaguccagcugcccaguuucuauuuuagccucagcacugauaagcugugugaccuugggcaaguuaccuaacuucccugaacuucaauuuccuuugucaaauaaagccuaugauaggaccuaccuguugggacuauuguggagauuaaaugaauuacuuuaugagguauuuagaauaguggcuuauaaaaagugcuaggaaacuuggcuauuuuuuauauugguaucaacugcaucaaacacuauuagcauuaauaaugacaaugaaauaauuuuuggguacucauuauugucauaaccuauauaguaaaugcaaacauccuucuuggagaaaaaauacacuuuucaaggaauuugaaaugauuugcuuggguuaacuauuaaauguucaugugaaugcuguauauccauuugaaaauuuuggaaaguacuauaucccugaacaauuuuaagagauaaauaauucucacccagcucuccacucucccuuuuaauauuugagugauguguggguuaucuguagaucagugaauagauaaguagggagggcucucguuuuccucccugcucuuuuccuucuuuucuaauuucugaugcaacgugucuguuuuugguuuuaauuaaaugggagaccugccacaucugugaccaagugaucggggcauggguucuaucccugucucggguccuaaagaauugcaucaguuccccuguugaauccuuuucucuucuugagggcugcuuccaggugacaguggagggagaacugggcagggagggagggcucuguggcuguggaccugcugggguggagucuuucugcucuuaggaccugcauggauucccuccccuauuccaggcagagucuguggccagcacugguuuugccuucgauaccuaggugguucuccugccuccacucugcaaccuuaacccugugauaguucacaggggguuccugagagaguuguaaccaguugucuguugaggagagauaccucauuaauggggucgacacccuaucuucucccucucuaaaauauaacacgguuucaaaagagaaagcaaguacccgagaaggagaauaugaugauagcagagugcuucaaccacagugauuuugaguuaacuugguuaucuguauuaagcaaaaacacaggcagaacauuuuauuccuuuguuuuucuuacugccugccucaagugaaagguagauaugaaaaccuugacuugaugaauaaaacaucuggacuacaaauuauuacccagaaguucagcuucucuaauauauuucgauuccucucuguccugcauguagaagccaagugcaaaugccuuaaaaguaauucuaggcauagcuguuaauuugguuuccuaauuauuuaguuuuacauucacacaaguagccaaugcaugugaaacaacauguuguugaaaauugaaauuuacaagcaucguuguggagugcuggaagauuugcaguaaccuagaaagaucauuuggguggcuaaugaagcucccgaacauguguaggcaguuauuacucagaguauugacugaacgggugagcgugcuguauaaauuuguguaauugcuuaacuaagcaaauagcuuucaguugcuuuuacauaauaauuuuacuuaaaggguaaauacuuccccuuuccucccuccuuucugccgcauccuguucaguuucuagggcuuuaauauucuuguacucuugcucuugcuuuuccucgaaauggaaauccaacuccuuugagaagaaugcaacugcuuccuguugugacaugagcagaccucgcucugaagguggaguguuuggguuggaagccuugaagccugucguugagaugcccacucuguaauaugcagauagucuugcgcuuuuggcuuuuguaucucuguuccucauugaaacauaaaucuguuuugcuguugugguuucguuugucaacacucuucccuuugcuuuugccccauaaggcucagaacgcccagcagcuccaugaacgaauccaguccucgaguauggaugccaagcuggaagcccugaaggacuuggccagccucucccgggaugucacguuugcccaggaguuuauaaaccuggacgguaucucucuccucacgcagaugguggagagcggcacugaguaagcgucuuuuuuccuaacuuccacagcuguccugcgugucuccgcguuuugaauauuguuacaugccuuacacuugcaaacucuguuuuaaagaccagagccuugguuagacucaggaaaaaaauaguuuuuaagauaguggcgaggcaguggguuuguaauuucaagaguucuccauccuuugcccaccaccaucuaguaucugagacaaaauagaaauccaucaagugcuagaaauuucagguuuaugugggaaaauaucaugccauuaucucagagggccuuggcaacaaugaaaguauaacucgacaaaacaauagucccucauauucguugccuaucccuaagaaaaauuuucccucccuuaauccauuaaaaaauuagauuaccuaauuauguuucuuuuuucauugacagcucaagcuaguucaaguuauguuucaaaguauaaaaccaggucaagauauaaucccugaaguaauuuuaaaacuuaacacuugaaugauuaaauacuugucauuaauuacuugaaauuaaaugcagucaacauguauuaacuaccuacucagugcaugcaaaagaguugaacaaaggaaaauuuuuucuuacgagcuugccuuccagaaauugauggagacuaucauaugggcagaauucuauugcguguaauuccuccugagagccaggaaucuagagggcggacccauuaucucucucucucucucuuauuuuuuuuuauuugagauggagucuuuguugcuuaggcuggagugcaguggugcaaucgcuguucacugcaaccuccaccuccuggguucaagugauccucccaccucagccuccugaguagcugggauuucaggcaugugccaccacacccagcuaguuuuuuuuuuguuuuuuguuuuugguagauggagucucacucugucgccaggcuggaguguagugggacgaucucgguucacugcaagcucugccuccuggguucaagcaauucuccuuccucaggcucccgaguagcuaggacuacaagcguaugccaccacaccuagcuaauuuuuguauuuuuaguagagaugggguuucaccaugucagccaggauggucucgaucucuugaccucgugaucugccugccuuggccucccaagguguugggauuacaggcgugagucaccacgcccggccuaauuuuuguauuuuuaguagagaugggguuuuaccacguuggccaggcuggucucgaacuccuaaccucaaaugaucugccugccucugccucccaaagugcugggacuacaggcgugugacaccacaugcagcuaauuuuuguguuuuuaguagagacaggguuucaccaugucagccagauggucucgaucucuugaccucgugauccgcccaccucggucucccaagauauugggauuacaggugugagccaccguguccagccugauuuuuguauuuuuaguagagaugggguuucaccacguuggccaggcuggucuugaacuccugaccugaagugguccaccugccucugccucccagaagugcugggacuugggacuacaggcgugugacaccacacccagcuaauuuuuguauuuuuaguagagacaggguuucaccaugucagccaggauggucucgaucucuugaccucgugaucugcccauuucggcuucccaaaguguugggauuacaggcgugagccaccgugccuggccuaauuuuuguauuuuuaguagagacgggguuucaccacguuggccaggccagucucaaacuccugaccucaagugauccaccugccucugccucccaaagugcugggauuacaggcaugagccaccaugccuggcuggaacccauuaaaucucagccucacagaggagaugagugugaacuguccuugagggaguuggaguuccaucaugagggaggaaggaaugucccuuccugccggggagcuugcucucuggugugacuguggagcgucaggagccaggcggggccagcucuuauguugguggagagacaacuccuuuaaccacugaaugcugaaugccugcuaggaugagcaggaggcugccccugccauguggucaggugcuauuggcagagacuaguagagcauacaauuuaaagcaugugaaauugcugaaucaauuaauugcauaugaauaugcuaagcuaauaaaguacagugucaggauaggcauuuauuaugaaagaguaaguaucauugagaauggagguuuaaaacuggguuguuuaaaggguaccuaguaauacaaagaaugaauugauaacucugcaaguuagagaucuuucugggccccuccccuucuguccccuuccucuccuuucccucccucccuucucccuucccuuccuccucccuucucccuucccuucccuucccuucccuucccuucccuucccccugccccucucccuuucuuccuuccuuucuuccuucccuccuucucccuucucucccucccuucccuuuguccuccucuccccuccccucccuuccccucugcccuccccuccccuuuucccuccccuuuucccucccucccuccuuuccuuccuuccuuccuuccuuccuuucuuccuucuuuccuuccuuccuuccuuccuccuucuccucccuccauccucccucccuccuacacuuggcaucaucuggccucugcaguugguacuagugaaaacauuuuuuuucucauucaaagacaagauauucuuuagaguuuggaguuggggaucuuaacucgcagucaaguagagaaaaucccuagaacugaaugugaagaacaucaugucagagaagaccgacaaacaggccugggugaucgggaaagggucaacuguagacagguaucauuuauuuuuuucaaggaugacgaaaccucugcuuaugaaaguuugggcauaccucaacguggagugguacagggaaauguaaacccuggauguugucagaauccagugugguuacuguaagcuggagcuggagcuugaaucagcgagagggaaguugaaaaaguuuagggauccaaggagcuugacaaaggaauggauacagaggguccugucugugaggggagcuccaggcuggaagcuggucuggaaugugucaggauccuauugccuguuucuggggagcagaggaggaggacgaguuguuauaaacaccuucacucaucacuggauuacuucauguaccugccagacaugguagccuauacuacauaccccccacggcuucuggugagagaguggggccugggggaggcugccucggcaacacuaacauguuaaauaaaaauguaaaaauguuuaccccuguuuauugauuaagcuaagucaaggacaaugcaucagagccaguuguaaugucaccugcugauaugaguugguucugccacaaguaccuagguauccagggcuugagcucuggcacauucagaaugauauuugcaaauacuucugaaauuauuagaauugcaauuguaauuacgguuacuuuaccgugguaaagacagcaaagcaggggcgcaugugaucugcauucugaacaggggccugugguggagccccucaccuccagaggccggcaguuacagacuucgacaaugaaacugccugcuaggagcuuuuguuuucaguuucucauugcuuuacuuugcuagggcugccauaacaaaauaccacagacugaguggcauaaacaacagaaacuuuauuuuuccucagaguucuggaagcugcaaguccaugaucaagguguuggcaggguugguuucugcugagguugcucuggauaguggauggcugccuucucucucuguccucaugugcacaucccuguuuuuucuuuuugucuucaaaucuccuuuucuuauaaggacaagagucagauuggauuagggacaccuaauggcuucauuuuaaauuaaucaucucuugagagggcuuaucuccaaauacugucccauucugagguacugggguuuagggcuuaaacaugugaauuaugaggggccacacuucaguccguaaugcuuauaaaagggacacaaucauuuuugcuuuaaaagaaaaagaguaagaacugaugcuauguaugugccuugucaacauucuuacuuuuucucagugcuguggccuuacuuuaugacacaucuccaccugcagaacaguccaaaagauucacuauuccucagacccaggaugggggacagcaggucugaauucugucuccauguugcacacguauuauacaaugugagagaaugucaauauugaauguacuuuaugugagcuaaagcaacugaaugccuuucuuaaaaaaaggaguaucacacucauuaauaucuuaacuacagucacgcacugcauaagaacauuucgaucagugauggaccacaaauauaaugguggucucaugagauuaugauggagcugcccuauacaguugugccauuuuuuauauuuuauaccaugguuuuacuauaccucuucucuguuuagauacacaaauauuugcuauuguguuaccauugcguacacuacucagccuaguaacaugcuguacagguuuguagccuagaagcaauaagcugugccacauagccuagguguguuguaggcuauaccauguauguuuguguaaguacacucuacgauguucacacaacagaaucaccuaaugaugcauuucuuagcauguaucgcauuguuaagcaacacaugacuguauuuauaauaaucaguaagccgucccaguuugauacauacagccagguuucagacagauaaacagagcuuaaggccagguguugggugaauucucuuuugcauuugucucuuauacuuucccaucacacuauguucgugggaaggaaugaugucucucagggucaucuuuggugucccccuuccuguuuuauguaaauucaaaguuacgcuauuuucggggauggaggaaggagggacuggaguugcaaggccuccugccuuccuucugcugguccugcaucucaugcucagagguggcuuauuuaauaaacagcaaauuuuucagaucuuucgcuaagauuaaaaaggaaagagaaagccauuuuucuauaagaaauccuggcuucucuguuaaacuuagagcaagacuucaauuaauuaacaggaaaccuuugggauagaaaccacauaaauuaaauagauccuguaauuuggaaggcauuuagucaugacuccugggcaauguuccagcuggagaagguggucguuuccuaagcaggaccuguggaaauuuucguaaacauugaagaaauguugcuggaauuuuucuccuuacuuuuaggaauaaugagauucagagaugacuugcccgccccucauuacccaaggcugggcuuuuuguuuuuuuuuuuuuuuuacuuuaaguucuuggauacaugugcagaacgugcagguuugcuacauagguauacacaugccauggugguuugcugaacccaaaacccgucaucugcauuagguauuucuccuaauguuaucccuacccuagccucucacccucugacaggcccuggugugugauguuccccgcccugugucuauguguucucauuguucaacucccgcuuacaagugagaacaugcgguguuugguuuuccgcucuuguguuaguuugcugagaaugaugguuuccagcuucauccaugucccugcaaaggacaugaacucauccuuuuuuauggcugcauaguauuccaugguguauaugugccacauuuucuuuauccagucuaucauugauggacauuuggguugguugcaagucuuugcuauugugcacagugcugcaauaaacauacgugugcaugugucuuuacaguagaaugacuuauaauccuuuguguauauacccaguaaugggauugcugggucaaauguuauuucugauucuagauccuugaggaaucaccagacugucuuccacaaugguugaauuaauuuacacucucaccaacaguguaaaagcguucccauuucuccacauccucuucagcaucuguuguuucuugacuuuuuaaugaucaccauucuaacuggcaugagaugguaucucauugugguuuugauuugcauuucucuaaugaccagugaugaugagcuuuuuuucauguguuuguuggccgcauaaaugucuucuuuugagaagugucuguucauaugcuucacccacuuuuugguaggguuguuuuuuucuuguaaauuuguuuaaguuccuuguagauuuuggauauuaacccuuugucagauggcuauauugcaaaauuuuucucccauucuguagguugccuguucacucugaugauaguuuccuuugcugugcagaagcucuuuaguuuaauuagaccccauuugucuauuuuggcuuuuguugcaguugcuuuugggguuuuagucaugaagccuuugcccacaccugcguccugaaugguauuccuagguauucuucuaggguuuuuaugguuuuaggucuuacguuuaagucuuuaauccaucuugaguuaauuuguguauaagguguaaggaaguggcacaguuuuaguuuucugcauauggcuagccaguuuucccagcaccauuuauuaaauagggaauccuuuccccauugcuuguuuuuaucagguuugucaaagaucagaugguuguagauguguggcauuauuucugaggucuuguucuguuccauuggucuauauaucuguuuugguaccaguacuaugguguucugguuacuguagccuuguaguauaguuugaagucagguagcgugaugccuccagcuuuguucuuuuugcuuaggaaugucuagauuauaugggcucuuuuuuaguuccauaugaaauucgaaguaguuuuuucuaauucugugaagaaagucaaugguagcuugauggggauagaauagaaucuauaaauuacuuugggcaguauggccauuuucaugauauugauucuuucuauccaugagcauggaauguuuuuucauuuguuuguguccucucuuauuuccuugagcaguaguuuguaguucuccuugaagagguccuucacaucccuuuuaaguucuauuccuagguauuauauucucuuuguagcaauugugaauaggaguucacuuaugauuuggcucucuguuugccuauuauugguguauaggaaugccugugauuuuugcacauugauuuuguauccugagacuuugcugaaguugcuuaucagcuuagggagauuuugggcugagaugaugggguuuucuaauuauacaaucaugucaucugcaaacagagacaauuugacuuacugucuuccuauuugaauacccuuuauuucuuuuucuugccugauugcccuggccugaacuuccaauacuauguugaauaggagugcugagagagggcauccuugucuugugcccguuuucaaagggaaugcuuccagcuuuugcucauucaguaugauauuggcuguggguuugucauaaauagcucuuauuauuuugagaucuucauaagugaaggagaaauaaaauccuuugcaggcaagcaaauggugagagauuuugucacaacaaggcugggcuuuuaaaaggucucucuccagcugguacuggguggggccauggagcaaagucaguaacagaggaacagugaggaagugucaucuugacagagcaugagcacaguguuuaaaaccugaguuuaauuguucuauccuuaauggaguuuugaaauuucauuccuaauuucugcuugaaacauaggagugaaagcaaauacagcuguggggaaacauguugccccagccugagcaacaaaaggaauauugaggaauggacaguguuuccagaaacaaauaucaaaaagauggauaucaaaacauuucucagaaaugauauauuuuauuuuauuugaaagaaggaaaauuguguccacaacucuuaaguccaaugucauaaaaaauacugcucuucuuuggguuuuaauaaaacaccacagucuuuguccaugccucuaagcacacagacaaugagaaagccuacuucuguguccuuccacuguuagucagucaucacuaggggcagaaaaacaggggaaacauuuccaagaaugaaagggcaggguacuuauaguuuccuucccgcuuggcaaugugaugggaaaauuacgcugcuggaauaugaguaagcuguaacaccacccugggcaggaaagucaacugcgaacaaaaguuaaauucauguauuuaugaugaacuuggaaaguuucugguuuuuuuuuuuuuuuuuuuugagacggagucuugcuuugucacccaggcuggagugcaauggcgcaaucuuggcucauugcaagcuccgccuccccgguucaugccauucuccugccucagccuccagaguagcugggacuacaggcaccugccaccacacccggcuaauuuuuuguguuuuuaguagagacaggguuucaccauguuagccaggauggucuugaucuccugaccucgugauccacccgccucggccucccaaagugcuuggauggaaaguuuuuuuaaauuaacuuucuuuucuuaugaaaaauuaucugucguuugaaaaguauauaaaaaagcagaaggaaaaaauaagaauaauuuguagugugccuuuccacagacgacuauuuuuaauaucuugaugaauaucguuuuuuauauauucuuuuagauacacacauaugcacaggcuuuauaaaaguagaauuauaauacucauguuuuuauaaccugcuuuuuguaccuaacaauauuuccaugugauuaaauauuauucuccccugucauuuuuguugcaugcguacuguuucauuuuugcagcuuuauagcuuauuauguacaauuaauauacaauaauuugaagaaugugcauaguacagugaacuauuucccuauuguaggacauuuauauuguuuuuaggguuuuucucugaacuuuuauuuuauuuuaucuuacuuuuuuuugagucagagucuugcucuguugccuaggcuggagugcaguggcacaaucauagcucacugcagccuugaccuccagggcuuaagcaguccuccugccucagccuccugaguagguagggacuacaggugccaccacaccuggcuaauuuuuaaauauuuuuuauagagacgaaggucucucuguguuucccaggcugguguugaacuccuggucucaaguaauccuccugccuuggccucccaaagugcugggauuauaggugugagcuaccgggccuggcuuucugaauauuuuuaaaucagcuuuucuuuuagcaaaauuuuuguggauauuuaauuuauuuuguuggaauaaaauuccugacucagaguauguauacauuuuaaagcuguuuuaaaauaagaauagcccaauagcuugcagaaauguucuaauuuauacuuuaccauucuuguaggaguaugucuauuuccaauaccuuggucaauacucggcugguuuucugguuuuccucagaaagauagcagugguauuuguggaguucucacuaaucuggggaauuuauaagugcuguuuuauuuguuucauugaggucauuucuccaaaaucuggcuguauuaggaacauuggaaggagucccauaguuauuuuagugauauguaaaguucuuagguaauugucuuaaaaagaaacauuaaguguauaaauuauuaguuccuccccacucugucauacauaugacacagauggaaaagucuagugcuguguguauguauauuacauguauauaaaaauugucaucauuuuugcauuaauacaagaacagucuugaaacagguucccuccaucucauauuaaccuuucguuauucaaauucuuuucaucuugccugaaccagagguguuuucauuuucugaauguugugaaaacugagguauagcuugaauuauacacuuuguuuugauguucccuagcacccacacuugagauggauuuguauguuuuauugauucagcgaaauguacguuacugagggcugaaccauacuccucacacuggguuaggcaugugagacguaagaggaggugcauggaggauaacacaaagauguauaugacaguuuuccauuaugugugaccuuuuccggaauuuugccuucacacaaaagaugaauuucuguuuugaaacuuuguuaaccuccaaggacacagaugaucagcucuaacuuaugcuauugccucugagaacuuggugucucuuagaagucuuggcuguucugggagguccagugcaggccaaagcgauucaucuacuugcugccuugcagccaaggccagcugacaccaugcacguuuugcacuuuaccuccucagaggccacagacccagacagaaagaagcugcuccuguggucucugcagucaaccccagcugugauggcugccacaucuucccaaggcuuucugcuguuuucuuggagccugcagugcacucugcauugcucagggagcuccagcuggaacagcucuugagggcucucccagaaauuugcaucacaaaggccaaagaggccaaccuucuugggcuuugucagagauuguguggcagaaaauucccuaaacaggaucugcccccuccucacuccuuuugcuuucucugugcgucuuuguccuucacucugguaauggaaaugagaaagggucacacagcccauuugaagaagagauuaucuucuguuggcgaaaaaaaaaaugccguuccuugggcugaggugagagguuucuggccacugugaaacaucaaccuuuccagaguaauuucucuucuagucacguuucucuaaaaaaauagguauauugagacacacacacacacacacacacauauaaaaucccacuuagggcaauagacagauguugcaacaaaaauuucucuucuccuuaugcauaaucugaagccaaagugaggaugcaaauuugaggaguaagaagcacugugacucagcacugaguuaugucugugcucuggucagggagagcucuccaaggucagggaugcuggaggaggcggaacucauauaaaaaccauaagcaugcucaggccccaggccagaaaguuauuuuaaaaguuuacagcaacuacuuuauguauuacacacacacacacacacacacacacacacauuuuauuucaaaaccauuuuaaacuuaaaacuugcaagaacagagcagaaaauccccucuugcucuuuucccagagaccccauuuaaguuucaccuguugucccagcucuguccuuuaauggaaagaaucuagcuccagguggcaccuugcacccagguggcccgucuccuccuaguccccucugaucuggaauuguucuucacucgcuccuuuucuuucaugacuuugguguuuuuaaauuauaggucagccauuuuauagaauacccuguaauuuggguuuguuaaaggguaauuuguuaaagguaauuuucauggaaaaguaaaaucauaacucucauacagaugugaaaauugauuauacaaauuggguaauucuugucacacucaacuaagucacaguugaggagcugaggcagaaagcacaugggcacauggcaccugcuccaagaaucgaauugucugcaaguccagcugcuaagauggccugguguaacccuaagaccaguuuaaucuaguagcugcugaaaugaccugcugugacuuuaggacugguuuuaccuaccacugucacucaccaaucagagcuuagcagcucucaaaaauucuagugccuauaagcuuucuuucaaaaccguagguaacauuccuauuucuaauaaaacucccaaccuuuccuuuguuccucagacauaccaaagucuaccagucuauguguaugcuucaaauugcaauucuaugauucuccaauaaaauguuuaauuuagagguuucccucuauauuacauuuugacuucagauauacaaauauguguuaaaauaauuuauuuuacucauaugauaugaugaaacuaggcagauguuauaacuuuaaagaaaaagucaaaagagcacaaauuuauaugaagcaaaggaauguugagaugaauugcaaaugaagacacaacuaguuuuccaccaguggaaaggaagucaauuaaaucacugccagacaggagauauagauagauagauagauagauagauagagauauauauagauagauauagacagauauauacagauauauauauagauagauaucuaucuaucuaucugucuguuuaucuaucuaucuaucugucucuccaucaguuaccuacaucuuaacaaagcguuguaaaauaacucaaagccaacaggacuagaaucugauagcccaaaaggauauguuguaggcgcugcuuaguuuucuacugaaacacaagauuuuguuuuuuacagauuuauccaguguucucucaucacaacaaacauuacaacaaaaauuucucuuuaugaagacccauauuguaugucuuuggcuggaauauaacagaugguugugauuuuuuuucccccauuucguccuguugauggcacaugguaucucuuuguuuuauuacugguuauaacuuugaccacuucauuaagauagcaucuuccagaugucuccacuauaauacuuucucccuaccuuagcagcuaauucaugaaaaguuuguagggagacacagugaaacuauguaaagccucauuaccccaauuucacccaucaguuuuggcauugacauuucuuaucugaauuaauuauugcucugaugauuuccaaaggaaaauuuucuaauacuaugauuucuucuacauguauuaguugguuuucuuugguaguaagagcucuguuuuuucccuacguauuuauucaccuacauguuuaucuccaguggggagcucauaccagcuccugagagccacuuuuguacaacucuguucugcucugcguucauugaccucauguugguucuuuaaguuggccauagugagagucguuacacuguggaaaucggaaaauaauaucaagcagauucguguguuuuuccccagagaucugguguuucaacaucagcacaucacucuauaacaauguggacuaauucauuccuguuuuauucaguggguuuaaucuaucacuauuauuauugauuuugaugcucagcgugucccugauguggccugugggagcucuuucaagcugacuucuguguccuuuugaccuguauugcguuauguuuugagcauuucuuuacuuucuggcucaacaagauguuccagaacuaucuagaucuccuugccccaccccuaauacgagccacuuccccaaggagcccugguuccuuuuaguggagaguagccucuggcccuugcgugcugccaauuuaugcucaggccugccuccccgucucacccuuucacccugcccaaugccuuuuugaugaaggaaggaugggaaauaguaaauauuuuuuaaaagaaaggcagguaaaggagggggagcagaagaggaauaaaaauaucucuuuauaugcauuuuuaaucccccucccacaaauuuuaccagagacuaaauuuagucuuugccuggugauuuggauuucugaaaugguuacauuuuaugugguugagaaugugaaaauuucugaagagcaaaaucguuugucaaccguguauucagucccuacucuggaugugccucacauuacgcuauugucacagugcagaguccuagcccucaagcagcuagaaggacagugagauguccugaggcuuauagcugauguguccucagggccuguggccugcgaugcaggcaccaucuaugcugucugaggaagagaaaucagaagucagagagacuuccuagaggaccccagaaugagccuagaaugagaugaguuuggggguaggacuuagcgaguugggcaaagaggggauggauguuucauaaagagggaagaucauacuuaaagccagagagauuuggcagacuugaggaaugagagaugguuuggccaguuuugaaacacuuguuucuucauauucuugagccuaguuuuuuuaaaaaagcauaaguauccuuuauuauagccagauuugccuauucuaagccaccagcccagaguucaguuuugggauuuaacacuagugcaaugucuuauugcaaagagauugauugcagcaucuucccacagaagaagccaccugagagagaaaagagaaaguaaaauuaguggacauucuaccaaagaaagauaauaaaauauuucuuuauagucuagugguuuuugucucaauguuuuuucauuuaaaauguaucaauuccuaucccuauggguaccccaccccgcuccauugaacacagacccauucugaucuaaauggacgguuuuggaugccuuuacucauaagcaaaugcaacugguuaaugacaguaguuuaaugcugaucuuuugauuguuuguuucugaucauuaaagaacaccaguuuauuacuuugaaugaugucuugaaauggauaaaauucuuuuacuucauggcaguuaaaucuguccuaaaucuaauccugaguuuucuucaagauauguucuuuguguaaaaauuguugcuuuuaaguaugcuccucacaugguuguuuuuaaauuuugcaggcgauaccagaaauugcagaagaucaugaagccuugguaagaauauuugaucgauugauauugaugauuuaacccuuccuacuuuccugcauaauugagcccugucaucugacugauuguauaacuaugcaucuaguauuuugaauaagugauuuuuuguuauuuuuguuuucuauuugauguucuuuuauaaacaacuucuucaaaaauguauuuuccccccuuuuuuugcuuuggaguagaaagaauauuuuauguauguaaccacuaagugaugcuguaaccacagaaagauugcuacccuacuucuggagcagugcuaagcauaauuuuauguauuauuuuaaacaaaacuaacuuuuauguggccugugugauguucaaagucaaaagucuuugauuuucuucaguggcuuagaaagaaaacggauucacauuuuuaaaaguauccaggauugaaggaugcaaugaaaauuauuuacuuugagucugagaaagugcucgaucaccuaucuaugaagugaauuguaugauugugucugaagauagaaaccuucuuucuuagaguuuucccuucuaaguuucuuucuuaaccauuaaacagggugaguccaaauaugguucuaacaaacuguuugaaguaggccgaacagauuuucauggugccaagccauuaagcagauaauuucaguuugagaaggaacacugaccagcgucucaaagugugaaccuuauuuuguaagcucucagagaaaauccucaucaccuucaauguacuauaguauuaugcuggucucaaaucauucacacacagaaaaguaugaguugcaggaauucuucuguuuauuaaauucuaauaaaguagaaagcaauauugagcuucuaggguaaagcuucuuaaauuucauuuugauguauuuaauacaguagaagcacuuaaugguaaugacaguagaagccacuuuuuaugagacuuuauccugggcauugucucaauguuuacacucauuacuccaaauccacacuuacauucaacauacaagcucgguauuuccuuggugcagaaguuaaaaucagauggaggagcugggauucaaacuuacuuucuccccaucuacuuaacagaauuugcaaauauagaggaauuuggggcccugaagccaaaauaauuuauuuaaaauuuauuagacaguaguuuuaaucuuuugguauguagauaugcuggacaguuuguaguguaguucaugauuuuuauugauaaaucauagacagaaaugaauagucaaggcccugguucugguaauggcacaguagcacaaucagacuaacacagauaacaauuaugaaauccggacaaaauauuauaaacaaaacaucuuaaaccaacuauaugaaggcacuggauagcaacccaaaacaggcagaagguagagggaaguuaacccuugagagaccagaugggucuuugaugggauuuguauguuugaagcuuuuucucugagaacaccuacucauccaggcagcaugggguggcagagagccucagucuuaguaaguuacuaagaagauguaguuugggacugcagagcagcuagcuaauuagagggaaucuaugaaagacgagaagcucagagaguaggagacuccacauccacauguaaacccugucgcaguccacugcugaucacugaagugcaaaugcacacuuuaaugguaaaaacagcaacuuaaagaucugagcaaagaugucagcugucacucacuucagaauuuagauuuuuacuuccugcuagaacaaaaauuaucacucuucagaggaacaaaacugauaucugaauauugacaguguuuuguucacaauauccaguauauaauaaaaaugugcuagguauguaaggaaauaggaaaagacgaccuauaguuaagaaaaaauguagguaguaaaaacuggcccugagaugacccagauguuggaauuagcagaugaagguuuuuuaaaaacuuuuauaaauauguuaaaaacuaaagaaaaguaugaguguaaugaaugcacagauggggagucuuaauagagaaauugaaaccauaaaaauaaccagaugucaguuauaaaauugaaaagcacaauaaagugaaaauuuuacuguaugagguugaagaugucagaagaagagauaguagccuugaagauguaucaguguaaguuaccuaaucugaaaaguugauaaaaugaauaaugaguacuugaccugugagauaauaaguuaucugaaauacauuuaauuggagucccaaaaggagaggaaaaagaauggggaaggcaaauauuugaggaaauaauuacagaagaaaauaaugauggagauauaugaagcaaguucuucacacuggagagacaugauaguagauagauacucagaucuguaggaaaauaugaagaacaacagaaacuaaauauguggguaauauaaaaagacaaaauguaguuuuacuuuccuuuaaauuucuuuaaaaggcuguaacuauauaaagcaaaaauuauaauacuguuugguaggguuuaugacauauguugaugcaauauguaugacaaugagagcacaaaggauggagguauaagagcaacuacacuacagcaagcuuccuaguguauaaucuuccguuuaaguagacauuaauauacuaauggugcacauuguaauacacagagucacaacuaaaaacagugcaaggaagcauaggccaaaacacaaaggagggauuaaaucagacuacuaaaaaaauuugauuaauucaaaagaagguaaggaaagagaaguagaauaaaauauaguuaagacaaacagaaaacaaguugguugacuucaaucuaaucauaucaauacauuaaauguaaauagacuaagcagcucaaugaaaagguuuagauugucagaugaaauuuuuuaaaaagcauggcccagcucuaugcuguuuauaagagauguacuauaaagacaagggcacauguacguugaaaauaaaaggauggaaaaacauauaccaugcaaaugcuaauaauaauaaaacugaaugguuuuauuaucaggaaagauaagacuugaaagcaauauguuaucagaguuaaagagggauaauuaguaauaaaaauggucgccucauuaagaagauuuaauccuccuuuuuauuuuaaauguguaugcaccuaaaaauuuuaaauguguaugcacauuuaaaauuauuauacauguguauaauaaaguuuuaaaauacgugaagcaaacacugacuacuaaggagaaaaagaggcaaacccaucagcauaguugaugauuuuaagaccagucuuuccuaacugguaugaaaacuaggcaaaauguuaaggauauagaugauuugaucaacacuaucaaaggucuugccuuaauugucauuuauaaagcaucagacucaauaacagcaaaauauacauuauuuucaaaugcacauggaauguucaucaaaauaguccauaguaaggcucaagaauuuucaaaugauuaaaauuacacagauuauguucuuugaucacaaggaaauuaaauuagaagucgguaacaauaaaauagccgaauagccucggauguuuggaaauuagaaaacacucuuucauacuaucaaagagucaaggaauaacucaguugaaauuaugaaauauuuuaacugaaugguaaugaaaauacaacauacccaaauuugugaaugcagcugaagcugugcuuagggggaaauuuguagcauuaaauaucuauguugaaaaggaaggaugguuuaaaaaaaaauggucuaaguuuuuacuuaagaagcuuuaaaaaaugugaauuaaguagaaaaaaagaauaauaagaauacuaaccaaugaaauaggaaacaggcaaauaauacagaaaauuaaagccaaauauuuauuaggaaaaaaaagaaaagagaaauccaaauaucaacaccagggauaaaagagggaauaucacuacaaaucauacugacauuagaaauaaaauaaaagaauauugcaaauaauuuuacauuaauaaauuuaauguuuuagcacuuggggaggccaaggcagguggaucacuugagcccagcaguucaagaccagccuggguaacauggcaaaaaccuaucucuacaacaaaauucaaaaauuagcugggugugacgccuuguggcuguagucccagcuacuugguaggcugaguuaggggauugcuugagcuagggagguggagguugcagugagccaagaucaugccacugcacuucagccugggcaacagagugagacucugucucaaaaaaaaaaaagaaaaaaaaaaagaaagaaaauuaaggaugaaauagacaaaugccauggaaaacagauuuaccaaauguguuagucauggaaaugcauggcuuugaucuccuuucaggaagaacuugcuagucagccaagaagagugcaguuaccugauaguuuucaguuaucacauguuccagauucauagcagcuuucaguacucuccaaaggcagcauuuaguuauugaacaugguggggauaccagagccuggucauuucuacccauuaugggauuccucuaagaggcacuguuuauucugcagcguuccacugaguuggcugagacauuuucagaucugcauuugcuucuuccccuucccuucgcaggcaucagaucuguuucauggucccaaggcuuuccauacucaauccugcuuucugccugcuuuaucuuccacaggcauugcccaaacucguacucaaucucuguucucauaacuuagucucagcaucugcuucacagaggacuaaaacugacacaucaaaacugacucaugaugaaauagaaaauuuggacgcccauaguuauuaaaaaaauugaaauuggcugggcgcgguggcucacgccuguaaucccagcacuuugggaggccaaggcagguggaucacgaggucaggaauucaagaccagccuggccaagauggugaaacccugucucuacuaaaaauacaaaaaaauuauccaugcauggugacaggcacccguaaucccagcuacuugagagacugaggcagagaauugcuugaacccaggagguggagguuucagugagccgacgucgugccacugcauuccagccugggcgacagagcgagacuccaucucagaaaaaaaaaaauugaaaucauuucucgaaaaccuucauacaacaauaacagguuacacuggugaauucuauauuauauauuauagaagaaauaccaaaucuaaacacaugcuuuuggaaaauagaggagagggaccaguucucauuauuuuaugauaccaguaucacucugauaccaaaaccuggcaaagacaauacaggaaauaaaaauuauagaccagaugcaaaaauccacagaggcauguuaauaaauacaaucaagcaauauguuaaagggauaauaccuugugaucaauaagagcuuaucucagaaauaguuuaacauuugaaaaucaaucaagcagcucaguguuuuaugaaauaaaggagaaaaccuaaagagaaaaaucaucuuaauggagagaaagcauuucauaaaaucuaauguauauuaauaauaaaaauucucagcaagcuaggaauagagggaacuuccucaucuugauaaaguaaucuacaaaaacuccaucauacuuaauguugaaagacugaauguuuucuacccuacagacugagaauaaggcaaauauguuugcuuucugcaguucuguucaacauuguauaggauuucuuagcuauugcaguaagucaauaaagaaacuaaaagcauaauauaagaaaggaagauguaaaacuaccucuauucauagaaaacaugauuaucuauuuagaaaauucuuaggaaucuacaaagaaacugcuagauauaauugaauuuagcaagguuucaggauacaaugucaauaaaauaaaaaugaauuuuuauauuuuaacagcaaccauuggaaaaugacauuuuaaaauuuccacuuauaaaguaucaaaaucauaauuuguagaaauaaaucuuuauuuuuagggauaaauucaucgauagacaugcaauaucuauuuauuugcuaaaaauaaauaaaugaggggaaauaaagaccuaaacaaguggagggauagaccauuucaugugguggaggacacaauuuuaauuagauagcaguucucuucugacauccuuuggcagggacacagagccaaagcauaucaucuuuauacuauagguucagugcaauaucaguuauuuuuuaaaagaauuacaaaucaauccuaaaaccacugguaaugugugggaccuagaauagccaaaaugaucaacaauaaaguugaagaguuucguugacugauuucaauacuuccuauaagguuagcuaucaagauggucugauauugguauaaggggguagauaaacagaucaauguaguagaauagaguccagaaucaaccugcacugaaauuuuuaacaaaggagcuagaagaauguuugcugacauaagucaugcuuuuugaagguaaggggugugucuauaggaugacuuauaaauccauaccuuucaauguauauacauuuuacuuccucaaggaggaaaacagauggaaaaacucaaagggcagggcagaacuguggccauuaaccuugacaauuaaggaucuauugaguacaauuuaucauagcuuuaaaaguggccuuuauuuucaucuuuuuucaaauucuguauuggggccgggcauggugguucacgccuguaaucccagcacuuugggaggcugaggcgggcggaucaccugaggucaggaguuugaggccagccuggcuaacauggcgaaaccccuucucuacuaaaaauacaaaaauuagcugggcaugguggugugcaccuguaaucccagcuacuugggaggcugaggcaggagaaucgcuucaaccugggagguggagguugcaaugagcugagaucgcgcuacugcacuccagccugggcaaaagagugagacucugucuaaaaaaauaaauaaauaaauaaaauucuguauuaacgggcuugccacuccauggaaacauuuggaagcacuauucuuuuauaaaauuaguagcauaaauuuacaugcuuguuuugagauuggcugaauuuuguuggaaugaagauggugucuacuaaguugaugagaaacauuuauuugaaucauuccagcacacaugguguguuggcugugacaguggcuuuccaccagcauguaaaguuugcaguuggcuuaauuuguggcugucaguacugcacaaucuuuagccuaacaguuuacaaaauacaaauaauccaaacaaauaaaaauguuccuggaugugccaugugguugcuuuauauuuguaauucuuuuagccuugacucucuauacccagcauugauuucagagguagaacuugccuucugcuuucccgguuuggagccugaauuacuccucuaggaguggaaauaaacaccuaugucaagguucaguaagagcuuuuauagccaucucacuugaaagaggugauugaaucccuugauuuggaauguaauaaaauuuuagcauggccauccuuucuuugcaacugagaguuugaaguugaauuuggaaaaaguucuuccauaugggaacuuacuaugucacccagcaaccgguccuaaugaauauguuauauacagaauauguguguaauacagaauauuauguaauauguauauauuauauaccuauguguauuuuacauaaauauuauaugcuaguaauauauaaaauagguccuauuauauauuccuaucugucucugccuaucugucaugucauuagauagaucaagagagcuauccuuccucugaguaccuugacugguguaugcugugaaaaagcuuuacucucacuuaccaaucauucccacuaauggauacuugagaagcacauauagcucuauuugcagucucagaaauggugcugcaccuccuuaacagccauagagauugaaaucuugacucccaaacaagcauggggauuuggaaaccaaaugauacuuuuucuccuucucuccagcuuuuuuuucccaaaguccuugcagccuguucugucugaggagucuguagacagagcucuggaguguaguuuugggacgauugacuguaccagauguuacuaagaucauuuggauuagggcucuauugagcagguagcuagggagcagagucauauugcuuucauauauuagagaacauaaauauacuuuaucuuuugcuuuuaaaggagcuacugaagacuaaugucaucugguuuccugaucuuaucugagugcugucuagcuaaugggaaugcagagaagaguauuuuuuguuguuuauugguuuauuuguuuuaucuuucuucgagacagagucacucugucgcccaggcuggagugcaauggcacgaucuuggcucacugcagccuccaccuccuggguucagccuucugaguagaguagcuggaacuacaggcgcccgccaccaugacuggcuaauuuuuguauuuuuaggagagacgggguuucaccacguuggccaggcugcucucgaacuccugaccucaggugaugcgccugccucagccucccagagugcugggauugcaggcaugaaccacggcacuaggcuaauaguuugauucaguaguguguguguuucucugccacugccuguuccauugccugugcugcuguugauguuacugaggcagguuuuuugccuuguacagaugcugugaaugcuguccucccauggcguguauaugggaauuuuuuugacauuugaggucuuuuaauaugcuggguaugaccaaauauccacuauuaguuaucauuugguucuuguuuuuccucuuuuuaaguaaauaaaauaaaugagcuaauuuugcuuacugcucaugcuguauguuauuauguaaugauguuuucacaguaauacuaaugccuacccagucuauuaauaaaucuuacuaauugcuuuuauuuccuggcucuuauuuuccugaggcagucuuuuuacuuucuuuucuucuucuuuuuuuuauuuugcaaucugauauuuggauuuucuugugauccauugucuguagaaagagucauucuggaauuuuucuuuaaccuuacucaauacucucuucaacccauuauuccaccugucuuucuaauguucuguucuuuucuucaaauaaguuuguguugucugguuuggaauuucuuuuugaggcaugauccuuugaugccaccuagggggcaccuguaagaucgagguugcccuuugcagcucugaaaagccagagauauuagcugcuuuucuaucuggucugaaugguuuggcuuuccuugcauugcuguuuuuguuuucauuuucuaguucuaagaacagagaauccuuaacacaaggugaaacauuugaaaaucuuguccuucauucacguuuuaaaaaucucacuuuugcauagugagaauguaguaacacucacacgcuacuuacaauucacugcacagcauuuggagggcuuuaagcauguuugcuuguuuucauuucuccaaaaaucucugagcuaguugugacuaccacuaccaucaucaucaucaucaucauccccauuuuuaauaaaugaggaaagagaagcauaggauggugcauaacuugcccacuuagggcugaagggagaaccccugcugucugacuccacaaacuaccuacuuagccguuuucguuuagcugguugcauccccucuguugccccuggucuccggcagcuuuggaucauugucuuucccugagaaccacuuccccuucuauagguuccauuuagcauuacaucuucuguggugaugcagaauuucaaaggucauuuuugaggcugggcugaguagaacaguaggaagaagggaaauugagaagcuguuuuaaaagaaauguuaccuguuuucuauucuacuaguuggaaauaaaacuaguuggaagguucaaucuaaauauguuaggagacuuuguaggauaucaauaaugguaugcaugagccuacaaaugaaaaaucuauauaaccaacuuuauuuuuuuaaaaauugaaccuaggaaucagugcuguuacauaauacaguguacagauccugacuggcauaauucaauguacucaaagaaagaguauuuaucauaaagguguuaauacuuauaaugaugauaauuuacaauaaaggugaauaucuaugaaagauucuguguaucuaagucucugcuaaaguguuguuuugaaagcuguagacaccaggauauugucuaauaaggguccuagguggaacugcauuugcccaagccuaaucucuguuuggauuuucaaaccacauauuagacccaccuuauagccuacugaaucucagcaagucuuuuggucagcaaacccauuauguggagugauuaucuccaucgauaugccagaaaaguuacuaacuaaagacgaaaugcuggccaaaaucaaaaugaguauguuuacuugcauacauguuuguaucuguguguccacacagagggauguauagaccacuuaaaaaaaguacuaauucucuuaauagaaguauuuuuaauuuucucuuuggauguguauggguaauaaaggaagcacauugcccugccuaagcagcuccaaauuucauuagccaagaagcuuuucuuuaagccaccauuuacugagugucuauaugcuacauacuuuauuaaguaaguagcucuguggcuagauagauaucaccaucuaguuuuucagcugaaaaaauagaggcucaggcagggucagugaauugcccagaacaacacagcucaccagaacgagaguuggugugagcccgggucuguuggaugcugaagcccugguugaccucaucaaggccguccugcccaaccucaucaaggccguccugccccuucaugucacucauguuagugaagaagucaccugugguccugcuauuugucucuugaucuuuuaaaauucugcuuguauucacuuucccagaacuuucuugcuucugugucuuugcucagcuuuggggcucuugacucuugugccucucugucuuuuucagcuuuggagacaugcuguccuucacccugacggccuucguugagcugauggaccauggcauaguguccugggauacauuuucgguggcguucauuaagaagguaagguggacucugccucuuuaggcuuuccuuacugucuucugucauagcuauuuuucucugcuuugaggauguuucauaauugucuuuccuuuaguucuuuauauuaaaagauggguaugauuuuuuauaauauuauguaugugggggucaggaaacccaaauucuguauaaaaaugauuguaagagauuauaagggauugcaugugcgcacccauagcucagaccagauaagugugucacacuguuaauaacugcacaaguguguuaauuccccaugugugacucuguugguuucaagaccuaaacagaguuccuacugucauccuucuugagccuuuaauccccaaccugguguccagggaaaaggaaagaggcaaaguauacugaugaccugcacaccuagguuugaagcaggguuauaugaaaaggagggaugccugaguccaugugucuuaagcagagugagccugcuuacuuguaaucagggugcaaggaauaucucagacaucacccaguucuaccaguucuucauuugggaggaagcaaaugaagauggaccuggugcaggaagauggggcagaagagcccuaccauuccuugcaauugaaguguaacaaauuugcaacucuguuuccauucuucugacuaaaaauaaacagucuugaucuugucacucuuaaauguagauuaaaucauggacaauuaucauuuauugauuuauuuuuuccuuucuuuguauuugcgaaaugguuuauaaauucauuggcauuucuccucccuacuacuguauuaggaauaaagagauguuuggaauucauaacuuuauuuuauaaguaucgguuacuggaaagagaauuucagugaaucugugcaagccagaaaaucagagcaaaauccauuaagagucacuugaaguuuuuaagccuuuuauuuuaaacuaaugguagacuuaaagaaaaguugcagcaaauuggacuuugggaggccagcgcagguggauuauuugaggucaggaguucaagaccagcuugaccaacauggugaaaccucgucucuaugaaaacuacaaaaauuagccgggcgcaguggugggagccuguaaucccgccuacuugggagguugagguaggagaaucacuugagccugggaggcagagguugcagugagccgacauugcaccacuacacuccagucugggugacggagugagacccugucucaaaaaaguaaaaaaaaauuaguacagacuguuccuauaagcccuucauccagccuccccuaaaguuaacauuuugcaaaaugacaguacgguuaucaaaauugauaaauaagcuguggugcaaugccggcauuugauuucaccuguuuuucuaugaaugccuuucucugguuaaggaucugauccaggaucccacacugaauuugguugucaugccuccuuaguguccccaagucugugacagucccucagguuuuuuguuugucauuuaugauuuugacacuuuugaaaguuaacagucaguuauuuuguauaauguuccucaauuuggauuugucugauauuucccucaugguucaauuaaagaagguuaugcauuuuuggcaagaaugcuacagaaguuauggcacauccucagugcauccuuucaugggcauaugaugucacuguccucugacuggugauguuacccuggauuacaugauuagguggcaucuguaggaucuccccacuguaaacgugcugcuuuuuuuuuuuuugaaauuaaucauuaucuuaggggagauguugccuugaaucgaaggacaugagauggcccuaaucgguugaaugagggggguaggaucagaggccccacaggugucauguccgcacuauguuuuauguucauuuaagacaagagcugauuggaaacccagggccuucucaacacaucucagaaucaacucucuuuccuuauguaaauccauaaagccaaaggggaugagcaaaaggaacccuguagaaaacacacagaaaaggaagaggccccuuuuugccuguauuuaucagugguaugaauugccauaaaggaaagaaacuguuggaauugccauuaagaguaaugcaaaaaccgcaauuacguuugcaccaaccuaauugcuaaagaagccaaagacaucccgauguguuauaaaguacuuuccugccaccuuuggugguggcagggaauguaagcauuagauuaugagaggaaaaaauaaauggcacuauuuugccucucuaagaucaguuccagagaagcaauuccaaaucugaagauagugaguaucauugauuuuuuaauacuuaacaaacauuuuaacuuuuugaauuuacagcaggcuuucuuuucuaccuccagagugcccggcuugucuguuaugagagccucuuuugcuauagaauguaacaacaauguuguacugaaugugaauuccuugaaauuauguucuacuuucaccaacauuagcucuuuugauuccccacagcaauccuuuccagaacagaacagauagucuuguuauuucugguuaggaggcagggaugcaguggcuugccgagguugaaugaggucacauagugagugggcguccuuggucacauggucagggugcuucuccuccucaucaugcaccugugcuuuccaagugguggaaggcauaguucccggagccuugcuuaaccagccugucucuuacauauuccucccugaccuuacugcuuagaguuaagcaauuucuucugcucucuguuccccugggaucuccugaaugccccuguuccagcacuugucacauuucggugaauuuuuuauucauuuaacaguauuucccaauagaguauuaccucaggaaggcagaaacguggcuuucuucaugucuuuauccucggggccuggcacagaguaaggucuuaauacauuucugugaaaugaaugaauaaaauuugcuuggaagcauuaaaaauacccacagaauuugaagaagagaaggaaaaaaaaguacuguauuuaaauauauuuuaaguaaaauuucggugaugaguggaaaggaauuagaaagcuguguuucuuuaaaugaugugagcaauggccaaagagaaugacagucauuuaauuuucuaacaacuuaagaaaauguuuuucauucauugaaauuaauucaaaaaucauauuaaauguaagaaaguaaagacugacagucuuggugguuuaaauaaaaaauuaaguauuuuuuaaaaagcagcacauuuaaucuauuucauguccucauucccagucucauuuucuuugcauugcuacuuagagaucuguuacaugaauuugaaaaaauagucaucagaaaauuacuuacuuuucuguaagguuaacuuuuuuauucauuagcuggaccaaauucagcacuuugacaacccaggaauuguaugcaggcaacugucuuuuaaauggagcuuuaucucaacaaaaaucgacuaggaaaugggcugacaaaagaugccuaucucuguggucuagaguuggcuuccuauuaaugccaaauucauaccacuuuggagaaauauuuuuuuucccugccagccucugucuccuucucuauuacuuuaucuguuuuguuaugugugaaucuagauucugguuuacaaauuuuggcugcaauaaauagcaucauuucauaaacagcucugaaacuuggaauuccuugauaccaauauauaauguugcauuuuaaagacucggcuacuuagggagagaguaagaaaauauggaguagaaagaaaagaaaaaaaaacuuuagguguuaugaguugguuuuucccuagccaaguauaacaucagugccuucuuuuggaaggaaaguuucauauaaaugcucuugaaacccuagcugugcaggagaaccuggcuuaccccgcaaauguuuucagugccuggacaaacaucccaccauuuugcuuuagagaccugguaauuuuugccucuuaaaaauuugagagauuuacaggcaucuaccuagauaauuuuaaauacaggaguggagcuucauguucuccauggcugguuuuuuguuuuguuuuguuuuugagacagagucucgcuccgucacccaggcuggagugcaguggugugaucuuggcucacugcaaccucugccuccuggguucacgcgauucuccugcuucagccucccaaguagcugggacuacaggagcccaccaccacgccuggcuaauuuuuuguauuuuuaguagagauggggguuucaccauguuagccgaucuccugaccucgugauccacccgccucggccucccaaaguucugggauuacaggugugagccacugugcccggcccuccaugauucuuuuagguuuugauaacauaggagaauuuuaagaucucauucuaagugauucuaagaaguauuuauuggaucguugauucaugcacuguaaugccccuuagcuucuuaaaaguuacauaaguauuucucuuauuuagccaagauuuuuaaaugaaugagcaguacaaggagcuaguguguauaauuaauuacugcuaacuccucuugcuucuuccuuauguuacaggccuacuuucgagaagcuguacuguggcuggcuuggguuggcucacuugugucacccaaaaguacaguaauggagcugggauaaauugaaaggcagagggaaucauuauuacucuuuugggggauaaaggaaaugaaaauuuaaauaggcaugaauaaccuucucuagcuauaugaagaucuauaguuuucaaacuggacguagagacauguguccauuaacuaauuuauacauucaguuauaaggaguuggucucaagcucccuggaggacgacaguuauuacauucacuuggaucagcccugaugcguugguuauuaauacucauuaaguggaaguauuaggucauuugaauaucuggcuaaaaccagugacaaauaaaacaaaagaaagaaguuaaguuucagaaaaccauuagcaucuacuucagacuuguacauaggacuguaaugcauugagugccccagguguguuacacaaaaugcucauuauguaacaugcuuuaggauugcugaaaugauuaguuuauuuaugucaaggaagaggugaauuacuaggaacaugaauuuuaaagaauacuuucaugaaaguaagggauucauuucuuaggagaaaaauaaugaauggaaauggaauauguaugugggauauaaauaugccugaauuaaagcaaagacagcaaauuauuuuuaccaccauugagcaagcccacuggcagcagagaagaguuaaugauuuauagagaacuuuaaaacccauuaugagaagguauacuucauaucagaaaacacugaguguaggcuggguaccguggcucaugccuguaaucccagcacuuugggaggccgaggcggguggauuacuugaggucaggaguucgauaucagccuggccaaucuggugaaaugccaucucuacuaaaaauagaaaaauuagcuuggcgugguggugcaugccuguaaucccagcuacuuaagaggcugaggcaggagaauugcuugaacuggagagguggagguugcagugaacugagaucauaccauugcacuccagccugggcaacagagcaagauuccgucucaaaaaauaaaaaauaaaaaagaagaaaacacugagaguucugauugaauauuucaagaaaggaaauauuguaaaaaggauauuuauggaaguaggcaacuaauucaggggguaaauuuccauuugauggaaaacuugaacauaaaauaaacugcagaagauuauguuucaguaacccagcaaugaguuagaccacugggccaguguuauuuguauauacucuguaucaaaacggagacaugucagauguaucacagggauauaaaauaggcagcuggaaauaugaaucaccagugauuauggauucuuagaaaagagugauaauugggaagagaggaguaggaagacaaugagauugauaaucccccuuuuuaauuuuuggcuuuuuuggaauauccaaaugguggcauccuuuuggaugccaagaauaggcccgcaguguacuucauaguaaaugccuuuuuaucuguccauacuagacuguaagguccuugaaguuuguuauuuucaucuuuguauuuccagcucugugggacagggcaagccuguuacauaguacacacgcaaugcauguuacugaaauggaucacuuaaugaugaguaaauauuggcugaaugaaaagaguggauaaagauggaggcggagggugcuugacaauaucagcaacagcuucucaggcagaagccuccaugcauccuuaaggcacauccaaauuuaauaaauagagacaagcaggggagccgggaaugaggagaaaauuaguugcaagaaaaucugaaguauugucaaugaauuucuuuaugaguucuucaguuuccuaauaccagugccaagaauuaugccgagagcgugaaaaaugguuugguggggugggggaggagucagauaauuuauccucuguuuagaagaugucuaaguuaaguauuaaacccugaacacagugugacaauaauuggauuuuugucagagaaagauggaccuagggaaagaaggguggccuuagcaugguagauuugguggauuggagcagacugcgaggaauaagucaagggcuugccaaggauaguaaacaugucggagaagguuauuagccaugagaagagcugaagcagucuuuugagaaccugaaaauuuccauacucuuccugaaguuuguauuuuaaaauaauagcuuuucggaauguaaaaucauaaugucacugcacuucuucacauuauuucccaccccugagauccagauguagcugggguaggcagaguguugguaucugcgucucccaccccuccuuucaccuggaaaucagcggacuagggacaauuccgaugguaccugggaacugccauggugugcugugcauuuaucaugugcaaagauggagaggagaugaggcaaguggucucuggggcagcaaaaaagggagaaauuaguguugacaggggggaagcagcaagaguuuacuugucguggaaccaaguuauuuagcuuuuaagaacagucauuaugcugauauaauaauggcuuuuuauugugagcugucaacagacaguaauaacuuuuaaugaggccucuaaaauaaaaccuuuaugguacccauguguuuggauuacugcgauccauuauucuaaccucuauuuuauuuuccgcucacauugugauuuauuauguuuggggauuuagugauuaauuccuuagagaaucuauuuuggagcuuaaaguaguauuuuaacuuuuaguacugcucacuuaaaugauuuccuguuugcuaaauuugggagagaugaaaagaacuuguuuuaaccaucagaaauuggaagaaagggguaacgaguuuuucguuuaagagaguggccggugacugagaaguugccaguugaauuguguugacaagugagauuugugcgagucccuuaagaaugcaacaagaacauaauaagcauauaaaagccauggauuguguggaugaaggaguagccugggaaugcaagaggaauggcaauuaacauauguugacauuaccaucccagagaaacacagguauccuuacaauauauguguugaaauugucugccccuaaaagaugaaacucaggagaauaauccuaggaaauacagaaagaauaauccuuggaggugugucuuuuuuaaaacauuugcuuaucagugaauuauagagaugagauaaaucaugcuuuguaaugauaucaugaacaaucccuaguucaauggguuucuugcuauuuugcuguaauuccaggucauccucagugccugguguuucuuaaaugaguucccgauuugauucauuuguucccuucuccacgucucugcucuacuuaccacgagcagucaauugugucccacuuggauuuucagauagcaaguuuugugaacaagucagccauagacaucucgauccugcagcgguccuuggccauuuuggagucgauggugcucaauagccaugaccucuaccagaaaguggcgcaggagaucaccaucggccagcucauuccacaccugcaaggguaagcaugccaagaugcucuggggaggagaaaugcuucaggaagauggccacgguaaugcacugggaaacguuuuauguuguuauaguuugguuaaauguacagaaaaagaaucucaauuuggcauauaaccaaaccacgugucacacuggaauggcaugguuacuuucccuuggccucugucccucacugaacuccaagcugguucuuggcauugccuguccccacgccuggcccuugguaagcucucaguuuuaauggauauugguagauauuggcagaguuuuacuuuuaagaagauaaaacaggaugauuuguucucuuaaguucucuuucuuaaaccauguaaguuaauguuuucugugauauaaugaguauuuucauaguuaauuagaaauguaauguuaugcauuuuuacuaggaauuuuuaaaggcaggcuucuuucuuaguuaugcucaaggugauucuagugagcuucuucuuuuguauuuuauaauaaaauguaggauuuuuucuaguggcuugagcuauaaaauggacauaagauagcugccccugcagccugcagucuuugaggcauuuuuccccuucuuuccucccugagguaacuaggaagguugucucugacaauaccaaccugagaaggacucuauuguacagugcuaccuuagaaauucaaguauuuuggauugcagugauaauaaacauuaugagcuugcuuacacaggaaaggagguuauuggaacaauacugggguacuuuguagaauccagaaaugacauaaguagcuaagccuugagaaggagagaaaccauagcuuccccggaguccucagcagauggccuuuucucuagcauuuugguuggcacuacagugacccaacucccccuaacuguugccccugguccauuaggucacaauuacaaauucucaagaggaaacccaauuggcccauuuggguugguggugcagggugggaaugguucucugaaauguuaacuguuguguugauaauauaaacuaccaaagcagauuauauuagauauuauuuucauuuggaggugggaggauuaccaacauuuaaaauuuaagucacagaagcugaggauugugguggccuccgugauuguggccucagaaucauaauucuucaaaaugaugauaauguaagguagcuucucuagaaauaagaccaguuucacauuuccuuugaaugugaacuguauuaauuuauauacugugucuuuugugggaaucucaaaggcacacaucuucaucccaaagcacguuaccaaaguggagaguuuauuauucuccaaguacugugcuaaggauuuuacaugcauaaucucauuuuaucuucacagcaaucccaugaaauaagugugucuaaccccauguuguagaugagguaacugugccuugggggauacucaugaacuuguccaaggucucagccagccugugaugaacugggcuuugcacccuauccuggccuaguucuaagcuccaccucucucucacuggccugauaaguuauuccuaaauguagcucauaagucacucuuuguuuaugccuugaguccuccuuauuuacuguuuaccacuugccuuacauuagagcuuuguuucauuuuauuauuucugguuccuuuccagugaaaaucagauuuauaaacaaacaccuguucuuuuuguuauugaaauguuuauauuuggaaauagauuuuuagaauauauaauagagccauccaauuagcccaagaauguggagacaucugaaacuacucccugauauauuucauguaucagacagaaaauuacacauacauacacauacacauacauacauacagacauacauacaucuauuacuaguaguacaucaauuacaacauccccuagguuuaugccuuuaaucugaauaagagagaaggcugccuauauuucugggcauucugcacugaccaguguacugucagcuaguaauaguaguuguauauuuaccaccuugugauguuugaaaugcauucucagugcaaaaugcauuuucuaggcccugccuuucucucucacuuuuuuuggggggagggggcugauuuugagccuuuucaugguuugacccagggcuagccucuucugacuucguguucugauuuucugaauuguucucuaucuuuacaggucagaucaagaaauccaaaccuauacuauugcagugauuaaugcgcuuuuccugaaggcuccugaugagaggaggcagguaaguugcauuucuuuagucuuauggcuaugucaaggcuaggaacuuugugugcagagaacgcccucuccuucuauucggggacucauugggccucucugcuauccuggccacagauggacucuccagagcagcuauguuccgcugcacggcuggcccgcugggguccuucccaaauccaggggcaaguggguagagauggauaagcccuugacugaugagggaugcuaggaguguuccagcaguagagccuuuucaugaaaugaaaugcaaccuggaagcccagauguaaaaagaugaaaacgcugcugugguggaagcagaguuaggagccccugcgaccuucugucauuucaugggaugcucacuagguugagggaagugcuguucucauuuucuguaucaggaaacagacccugaggggugccauguuuuucccaaggaaggaggugauggaagguaagaggacaggagggauaauaugcagauggcugcuccuuguggagauaacugcauucguaugucagaggggcuccuugcuuggugagauuacuuacuucuguguguggauguggcugggaaauuggagccaucuguuuccucuccuguauaaaaagagccgggugcgguggcucacaccuguagucccagcccuuugggaagccaagguaggcagaucacuugaggucaggaagcugagacuagccuugucaauauggcaaagccccaucucuacuaaauauacaaaaauuagcugggcaugauagugcacgccuguaaucccagcuacucaggaggcugaggcaggagaaucacuugaaccaagccgggaggcagagguugcagugagcugacaucacacugcuguacuccagcuugggcgacagagcaagacuaucuuaaaaaaaagaaaaaaaaaggaaggaaccccuuaauauacauacauggaaccuuuccucugaugguguccuuugucuguagauccuuuauuucuuucuucacgaaggaaaggagcauuacagaggggaugugaagaaguggaauuuugccuugucuuggaauuuaggucacaccucaaaauccauucauguuuuuuucaaucaacaugucauguaauauguuacccuggucacaauuuccuuccuuaaaaaagugggugggaauaugagcucuuucacucaccuagaaacuaugcuggggagcuugauggcaguugccagugaguucguuuagaagaaauuagaaagcgaaccugcuacugaaugcuaugacaagaauuuuuggauuuuauuuugcuuuuucauugccaaggauuuuaaaccucagugacuaaacaugagggguucugguuuguuuuccauuuagaauuucuuauucaucccuggggggcuguguuugcacaaguaguggugucacuuuauaguuuccuggacguuugauuugguguucgcuggagccagguggaggugccugcccuccacaagccugugcuaggggcagucuuaccguggcuggauuuuuaggaguggcuuugcagaucugaggugaaaucaucgauagggcugcuucugugauauuuuagucuaaauaccgaacucauaacucccaagcagcccggaaguugucuggaagcucucaccguguacauacccaagcuugacuugggcauuggagcaacgggguccuucugcuggccagacuggggacuucuggcccagccacaugguagcugaguguagcguguggggucaggaagguugcauucugaucucaacucuuggaaguuuccuuuccccaucugugaaagaagaggauggauuagaggaggugaaaguucaugcccacucuaaaggccauuucacuuggaucucugaaucuagacaugaguaaaaugcuuacugcaucuuauuuuauaccaaacacuacuguucauuuguuaaauuggacucucaugaccauggacaaauagggaaucaggugucaaucuguacuaacuucaggacauugauaauaaugguaauauaauggaaugucgauauaagauuagguuuggauuuugugaaucaagucuuucuuugaaaacuaugcaacauaagacugacaggagacaguuuggcuauauauuauucuaauaaaccaccacaaagaguaauaaaccaugacaaagaguagucuaauaaccuuaaaccauuuaagaaaagauuccaacuaagaaagacuguauauaauucagcagaaauuuaugaaguauuauaugacucauucauucaagcucuaaaaaauaccuacaagguauuuaauuuacuugcccauggaaaagugauguggacuucauaaacuauaaacucuugaaauuaagaauguuguucaucaaaauaaagggaguaucaugauuuuuaaauuuaaaaaaauuucagugaguagcgagauagcucuaaaaagggauuucagauucauaaugaagaaaaguuuguuggauauuauuuucugaaggucaguagaggccuguaaagcagaagacugagcuaacuggugacaucauguggguugcuguggauuuauauuaacagcugagcuuguaugccuuagucugggcucuauguucuaaguaaaauaaaguuucagcuggucugaauuugacguuggcauuguuauuggcguauguucugaaaaauuaaaaguucugaauuuuuggcaaauaggaaaauugaccaaagucagccaucaaugauaauauuauugagagucuggcaugugccaagcaguguucaguguuuuauauuacauuauuucauuuuauucucauauucagagaaagccacauuauuucuguuuuauaaguaaggaaauugagccucaaagggaguaaagaacuugaccagguuacugagcggguaagaaucagaguucgagucucaaccuuaucccugcuuuuaccugcaaagcaucccauccaacgccugucagagaugucacucauagaauucuccuguauuugccaaguaaacaacuccccgaagccuggauagcaccaagcccauuuucucacuccaauuagauugaaauauaaucuaaacauguauuuacuggauuugcaggaacacuauuuuuuguuuguuuuuuguuguaucuguuuaaagccuuagaaccauugcuuuguuuggaguagccugauuccacuucagucaaauacuuuuuuaaaauuucaucuuuuuuugacuuggggccagacacauucacaggacuccauuaucugggguuucuuugaauuuggaaugcuuuuaaacacuuauaccuuauuucugcuguuacugaaaaaaaugccaccauggucagaaggaccugugcuguuuuuuccuuugcaucugugagguaggccuuacugagagaggccugugcuggggccuaggguaaagcuuccuccucugggaacucccuucccuucuaggguucccccagggguggaggccuugcuuucccaugccucugggauguaggagauucucaguuuccuggcacaaacggagggaagggcugggcuaguuuugucggggaggagguugcuguuaggcgggcaaauggauccuuuugcuuacaacuuuuaccauuauucaguucacuauuucaauggcaaauauguuggugagaucccuuccaaauuucucuacaaauacuuauacuuuugauaagcacuauuuaaaaaacuuguuaguuaaaagauuugguagaaaaaucagaaaauacugacucaaaaggaagaaguuugaaagauuccuguaauuauauucccagaggcagaaccacggcaauuauuuacaacucuugugacuuucauggugcuacuucccuguuuguucugugcaaauauucuccuaauacaucauuuuuuuucaccaaaugugagcauacuacaugcauuguaguuuuucuaaacuucuuuuaaaacuaaacaauauuuuguggacaucuuuccaugucaguauaucuggauucauauuuguagcuaucuauacuuuuacauaauuuuaaugcuauaaaauauuccccauggauucucacauuuacuccaauaauuccuuacuauuagaccaaaaaauggaggcauggauauuucuauuuucucuuugaccaagcugcuguuccuuaggaggguaguauaaaauauuuauuuguuauuuuaucaaacauuuauugucuucucggugucagacauuguacuuugggcuuggaauacaaaaaagaaaaagacaguuucugcucaugagggacucacagucuuaugcagacaauaaauauuguaaacagacaauuacaaugauuucuuuaguagaaguuggacauacauugucccuucuaacuuuaaauuuuauagacugauagacaaacauaggaacagaaauauuuuuuuccgucuuuauuuaugagcaauaauuucaucuuuuuaaaggaaagaaauuaaaacagcuauaggauccuuugaggcuuuuauuugucaucuggucuaggagaaacaaaaaaaccaccaccagugggccuuucuaugaagaucagcaagaaagcccugcuuucuaugccucguggaagggaagguuccuucuggguuaccauuugaguuguuucucaaugcgucauugcuccugcuuucuuguuuucaagaguauaagaccuaguauuggauguugacuugagugccaucuagcuuuuuugagucaccuuacaguauuuaagcacuuuucaaugcagugggucagcaggggcguucaaauacaguggucaaccucuaacagaguccucugaauuuccaucccuucuucucuccugcuugcuuuccuuucugugguggcgaugacgccguuagguugauguagagagcaauguugacauccuugauuguccucugacuguaagucacccacguucccuuuguuagcguaaagugggcccugcucuccugugcugcuccuguccaccccugcuuguaugcccuccucagaaaucucccccaccccccauguucuugguuuucuuugcuuucugcaaauuuguuuuaaccuuaguagaaaucaugguugaguuuuuaaaccguggcuuaguuucuucucuacucaguaagaguagcaacaccaaaaacacccccuaccacaaaacaacggucaagugucuuccugaauaugagcaguauuuuuacuuuaaaaggcuccaagugcuccaagacuaugcuugauauacuauuuucccuuagucuccacuugucaauauuuauaaagggacucugugcaucauuuccuuuaauaaaaucacccuugaauccuccauaccagucaggagaugccaaggcacaaaacaaccugcagaaaucaggccuugcagagcucagugaguguagacucuagagcuuugcaucacccagauauuugcccuucacuuaaacuccacucagaucacuuauguagccugguauauguauuacucacucuuugguuuugcacagauuaagaugaaaugacuuuuagaagauacuggaaucuccuugcuacaggcauguguugccuaauaaaagcuuucugcacguacguagucuaauaaaagaugaugaggcuuucuaauagccauugcuuuguuuggagugccugauuuuuauuuagcacccaccuuuuucuggaaggaagaaauuccuaaagaaaagaaguuugcaggugccagauaucuuuccuuugcuuuuggacauugcuuuuacauucuaaauaaaacagucaaaaaaauaauuugaauacuacugccuguuugaguucauuauuucauaagaaauacugcugauauacaguuacgaagcacaccccaggauaaggucauuuuuggccaugucgaaauguagcuuucuaaccuaagccuuuguguggguguguuuuucuuccacaggagauggcgaauauuuuggcucagaagcaacugcguuccaucauuuuaacagugaguaccuaugcgcugugaccucuuugugggggaggaguggccuggugcauuuguuaaucucuucuuuuggcuucagucugugguuuguucugugacuuccuucuguggugaagcaguaggaacucuaaugaaggaaaaagugaguuuuuggaauuggaauaaauaaaggcuuucccacaggaauugccucauuggauuggagggagggguuucuggaacugcucuggagagagaaagggggaacgcauucuggccggaaggguuggauagcucucucaguggggcagguuagggagaucagggcuuaaaagauucacccugaugagguuuugcucuuucaaugaggaagcuagcuguaaacauaucagguaccaagagaaguccugagauguugaacaucaguuuugggggcccgcaugcaagagagaggaaggaaagauauagauaggagccacucauucgcugcgaugcaagaugaccuuaaaccuugguggaaaaaaaaaaaagcccuaagugucaccuugcaaauguuuagaaauaaaccaaauaacaagauuuccugaggccuuacccgcuauuugacuuaccagcuacuugaaagaagcagguugauugauugcccugcuuacaaaaaagaaaaaaaaaaaaaggaaaagaggaaaagaaagaaaaagaaaaaucucuguuugcgugauuccaaagagcaguucagcaagcuuacaguuaaaaacacuugguccucaaaugcagguuuuauuauuauucaaguauggugaggccaacagaucaggagguggcuggcauugaaaaguuuguuaauuauaguuccccaaaggagggggcaugccgugccacugggggauugucggggcaggggaagcuccugagucaggaggcaggggaagcccaaggagaccugggcgagagcccuuacugugguuuuugagggaagggauaugugaggccagguaagcuggcugagcagguuuaggauuggcuaguuugaauaauuucagugggcuuuggaguuuaugggcugucuccaguugucugguaccuggcccugggugguuagggcaggagaacagugguccuaagaguaggagccagagcuuguagaggaguggggggugggugccaaggcucuggacugauucauuugcauaugaaaggagucauuuauuaucucuaggaauuggcuagaccugggaggagcagucucuucagggucaacaaggucccagaugucccaacagcagaaacaaaugucuaauacacacacacacuauccccccucccucucccaccaauacaaguaagccaucaaaaauuaauguugaaaauaaauguucuagaucccaaagccagugguaaugccagcaauuugugaccaaguuaguucaauuuuaaacuuccuggcugucaaagaugacaagaaauguaugaguguaacuuucauuguuugauaaaaagaggucccccaguucuucgggaaagauaaaccuuuucccucuggaacugaaaucugaaaugaaucuugggagagcaucuuaauacauucuagguccaauugugguuuuggaagugcagaaguauucauaauuacuguccuucuuuauauuggcucucaguaaauguagaagcagcagcaucaauggguagcucagugucuucauauuaccuugaugugggagucaggguuagaaugcccugagauaugaguggcauuaaugacuguguucacccugucucaaaaaucaguuugcuucagugggacuucuuguaugagauguuguugauggcugaaguucgagguugguacucuccugcaagaacuuggagugcaguacuuucgaguugcuaagaaaagagauucccauacgcuuuggauacuaagugugugccaugaguuaacaugcuuuucugaggauuggaggauaagggguuugauuugcuccuaaccauccguuaucuagcuucccugcuucccauaauuuugguuuggugacuguauucucucauuccucccuguccucuuucuucuauuccucaaucuucucccaccccuccuccuugaauuagcuauuucagcauggcacugacagcuaugguguggauugcagguggaugucagguugagagucacccaggcagcacucuaaggaccuagacuuccuccaauccuggaggaagaucauuuuucucuacaauggggagcuuugucauuuacugaacggccacuuagaaguugguuugcagcagucugucuacccaggagcaacuacagauugccaagagaauuggucuuucagauaacauggcaugaguggggcuagcacaguugaaauaacugauuugauggguuguuccaccacauugauccauuguuuggcauuuuuaauguacagucagaaucucuguugaaaaggcuguauguuagucccaaaugcugaauguugaguugguggcagcugucccauuucugggcaggggugaggggauuggggguggaccuauccagucuuccuguccugccacuccuuguauguucucuuuucaguucuguuucuauggggaaaagucauuuuaucuuucauuuaauuguuaacagugaguaaaguaauucacgagcauuugcucucugcuuuugaugguagacauccuuguguagcucccacaguggauuaagauuugauggguauuuugcuuuuguguguuccuucuaaaacuuuuccccauuuugaagugggcucaccugucagagacagucccaggguaagauaauggcaaaauugcuuccuauggguaugcaucauugguuuuucugcugcgugugacagaugcuuccauuguagaaauccacaguugucuuggagacacccccauuucaagcacaucuucucuugacuuauauggcugccaucaucagucccuuuccagcgcuuuuccccuuccacucccuccugcccacaguagguuuuuucauggccugugaccugaagaucaggaaccuuacugggcucugaaauucaaaggaaagcucugaaauucccugugcccucaccuuccuucuccauuccuuauaccucccagugaagacugugagagccuucuugaguguuaauucuaguuguuuccuuuucuuucuuuuuuaaaaaauuucauuugugaaccaucucccuagcaugucauccgagcccagcgggccaucaacaaugagauggcgcaccagcuguauguucuacaagugcucaccuuuaaccuccuggaagacaggaugaugaccaaaauggacccccaggaccaggugagugcucauuggacagcagucaaagcacaggaaggacagaaagugucauuaaaagucuuuucuugagguacccugaaacuagggaguuucagaguuugauaugaugucauuuuauuaucaucucagaacuuaggggcauggcuucaaaauuaggugaaucuaggaucagaaaauauaccaaaugcauucuuccauuaggcuccaaacaugcauguucuuucugcauuuauugaauaagaaaguuugaugucacaugaccacagacuuuagcuccuggccccaaguaacauuuaauaguaguagcuuuggagucaaguucccagacaacuagggccucuuggugacucuauguggcauugauucugugggguugaguuagcaauuuucguucuccagggaucagugccaagagcagggucccagauuaaaccugauuucugggccagcauuucugucgguuggcuguuggcuguaacucucugcugggucucuuguugugcaugaaagguuauagcuccauucagaaggcuuuggggaccuuugcugugugaggguagagugagaggaaacagcugggagcccugccguagcacauuuucaacuuaaacagcgcugcagcuuuggaaaggaaaacacucauuauuggcacgugagggccugaucuguugcagaugugaacugcauaugugaaguguguagcugccguggcacuucauucauggagcaaggccauacgguuaagaaugauggagaggcuuugagaggcggugaaugugccccacguuuuuggcaagguguggucaucccagggagaggagacugucaucuuaccacuucuaguggcagagagcaaugccucuuaauauugaaugacaugacgcucuuugcuuggaaacccuuuuaaaaauuuauuuauguauuuuauuguggugggauauguauaacagaaaguuuacuauuuuaaccauucuuaaguguacagucuaguggcauuaaguacauucacauuguuaggaaacugucaccaccaucuaucuccagaacucuuuuuaucuugcagaacugaaacucuguacccauuaaacacuaacuccccauuccccuguccucuuagucccugguaaccaccauucuaguuucugucuaugaauuugacuacuccagggaccucauauaauugaaauuggacaauaugcauauuucugugucugguuuauuucacucagcauaauaucuucaaagcucauccagauuguagcaucuacugggauugcccucuuucaaagccuggauaguaucccauuguauguccacaccacauuuuguucauccauuuacccuuggauggacacuuggguuguuugcaccuuugacccuuucuuucuuuuuuguccuguguugguuuccaugaaguaacuuaguggggugaggcacuuugggugcuucuuacuuuguucccaacuguacaguauccccaguuucucuagcuuagcuuucuccaaucacgacccuuccaucauaucugggccucucaguuaagacugcacuggacuaucaauauucgugcuccagauaacuacuuggcuaagaggaccacuguggaauacagccaggccugaccagcagggagacugacgggggaagaguggucugcaaagcccuaacuuagaacauugguucucuuuuaucuguuuuucuuuugccugaaugcagugauucauuuagaccccagggaaagagggaguauauguaaugucacacaaugaaagcagcuuuuuccccucccuuuucuuuuuacucccugauuccuucaggcucagagggacaucauauuugaacuucgaagaauugcuuuugaugcugagucugaaccuaacaacagcaguggcagcauggagaaacgcaaguccauguacacgcgagauuauaagaagcuuggguucauuguaaguaagcuaucuccaguaugcgcucucccuccagccuccccgggccugaccucagccacauaacugaugucucuuccgagcgugugguccucuugcgcuuuacggaauaguuuccacauuuccagauguuuagcugguuuaaacaggaucacaugaaaaucucuucuggcuucagugaaauggaauaacuugcacaagugugacuaauacugcauuuguuuauucaguucugauuaaguguaaccgagaguaguuagcccggaauguaucucgacuucauuaaaucuauuucacaagaugcuuaagauuuguguuugccuuaaaugagugauggaucuuauuauuggguuauugaguugauuacuuacauacaucaauuuuauaucaaagucaaauugaaagucuccugaaauuuaauccugaugacauuaacacaauuuauguuuucuuaaaaggucucucuugcuaugaaugcuaauagguugucuccuagauuuuuuuuuuaguuugcaaaucagaacacagcuuguccugaauauaauccauuguuuucauuucuguuugcacuauauucucgauuuucuccccaugaagucucugagugaccuucggcuaauaucaaauucugcaguuguaaaauuggauuucaauuuuaauccccaucauaaauggcauuacugagauuuuggcuucggugauuagaaaucaccaggcauuauuuuauaguuccaaauacucuuuccuuggaaaaaaauauauaagcuauauaucuguaugugugugucuguguguguauauauauaagguguauauauuuuauauauauacauauucaugcauauacauauauacagacacacccaaauauauauauauacacacaauguauauaucuguauauauacuaauaauaauauuuauacauaguuugacaaaugguaucaugcuuuauguguuauuugagaaggcuugucuuucaugggaauauucuuugaaaauguuuucauauuacuguguuucauuacugauuuguuuuucauuauuuagauguaauacaauuuauuuaaccaagcccuuuuacuaaaugauucaaugcuuugaaauuaccauaagucuauaauuaauaucuuacagcccagaauguaugcacacccaugaucacauuauuaggauaaauuuguggaacuguacuuuguaugagauauguuuucaaggcuuuugauacugucuaauugcuuuccacacacagaaagucauguccauuuuaaccagcaguguucauuuuuuuuuuaacucucuccaguaguguuucuuaaacuaaaaaaaccuaaaaaccuaaaaaacuaacacucuguccaguuauuguuuuuauaguguuaguuuuaauaugacguuuuaaauaagaauacuuacugcauauucagcuuugcagcuugcuuuacagagguauucugaaauuauuuuuguaucauuauauuuuauguuucgaccuuggcauuccauuuuaucuuuuaguugaaucaauuuuuuaaaauuuuagcaaaaaaugucaugacugguggagcgggugaguuuccuguacuugugugucgaugaccaaagcuccaggguggcagugaccuugcuggcagagccccucugccagagcgaugguccagggaaggcggaugggacucacuuucuaccucacccucaauuccaaguuuuacuuuuaugugguaagcaagacauaucgaggucacuugggaggcuuugcgaaaucacccaaucucucuuacccucaagucauaucaaaauuaccaaggaagaaucagggcauguacauuuggaaaauacucuuaauugauuccucuucugagggagagccugguucuagggugcuccugugacugcaauuuuaucguccuccuccugccagugccuggauuucuucugagcuauguagaaaauccaaaaccugaauucuuuccaugugcugccuccgggaugcaugugucucugucccaguagugauuuuccucgggggcaguuggaucccagaaugcacaguauggagggacuguggagagagagagguugggggccaaccacauggaggagauaggauuacuauagaaucugggucccugugagagcuaucuguaaugggggugugugcuaugaagcaucuccuuuuuauuuucagacccuguucuuaugugagaugaccaggguauuccaaaaucagaguacauuuucucaauguagcuccaucugucuuaacauucuuguuaauuccuuguacaguuuagucuugguguaucucugucuuaguuuucccugucuggggaguguucugcuucaugaguacagaauaauaguuuuuuuuuuuuaacugaaaguuaauuggaggugguuuuaaggccuuuagcgcuuaugaggacuugaaaagucauccuagaaaaagcaaagacucugaacagagaauaaucauaagagaguguugguuuucuuuauuuuuccaugguucuuuuuuaguuuuugauuuuaguuauuccccugcaacuucucccaggccagucuugcaucagagaguugagaaguuggaacgacuauuuaguaaugauuuugagugcuggaaaugauccaguaacuuuugacaagcagauauuuucacuuuugaauacccagccagccagaaauagacaggccucaguaaacagaaccgcauggucauugcaccaccuagagacggucuugcaaaaacgcugaaagcuggcugaugauaucagggucuggcugcaaaaucucuagaugcuguaagcagucucgugcagaauucucucuguacuucccaaagaggaaucaucuugccuguuaaacuccuuacugaacuuuaaggauuaauuugagguuuggaucaucuuuuggaucacuuugaagaaaaguucaguucauaagauuaagacugcuauuucucauguuucugcucccaaguaggcaaugcccagcaagcauuacaugacaaggcuuuggaguucacugggccuagauuuaauuuuagcuuuccuccuuuugagccaugggccagugguucagucauuuaaccuguuugggcauggguuuucucagcugugaaacugggcagcaucuuuucuguuuugagauuaugggagggccccacaggaccgucuaccagcgacuagcacagcagcuggaaccaaggugcacucagccagugcuacuucccuuucuuccuuuuggagagaacacaucauagaaaucaucugcagccuuuuaaguuuuccaagguaaaaguggccauugcgccaacaaggcaagaagaacaguuuauuaaaagguaauaaaccacaacaccuuugaggaggcagaugggcaucacauuccuucucagcacaacaucccaauggagcaaauuuuucugauaaaauaauucuaaagucacaaucuagguggcugaguggcuuguaaguuuagucauaacacagaaaagcugcuucaucuucugagaucucguuuuuuguuuguuuguuuguuuguuuuugguagaguuuugcucuugucgggugcccaccaccacacccagcuaauguuuguauuuuuaguagagacggguuucaccauguuggccaggcuggucucaaacuccugaccucaggugauccacccaccucggccucucaaagugcugggauuacaagcaugaggcacuacaccagccaucuucuaagaucucuuguuauugauucugugguuucaaaauggacaggccuuuguagguccccuggugggaagagacagaguugucugggauaaugcuauucuuuuuuuugagacagagucucgcucugucacccaggcuggagugcaguggugcaaucuuugcucacuguaaccuccaucucccagguucaaggauucuccugccucagcauccugaauagcugggacuacaggagugcgccaccacacccagcuaauuuuuuguauuuuuaguagagacaggguuucgccauguuggccaggcugcucucgaacuucugaucucaggugaaccacccacuuuggccucccaaagugcugggauuacaggcgugagccaccgugcccugccgggauaaugcuauuuuuaguggagcuucuaaggaagggcauauggauuccugagaguaauggaaggcagacucucaccucuaggaugacuuuauuuugagaacaggggaaaugcuguauacaaaguugucccucuugauuguagccgccaagaccugugcaccauggcuuucacacucugcaaaguguuguguuccuggcuagagcccuuucagaauuugucucugguuuauuuccaauuuguagucucucuauuugugaauuuuuccuuguucagucuaccggacaagcaugaaaaaggagaugucuguaguucaucuuucugaucccuucugaaucaaagcagauauuaaaaucagacaaggcuuuuuuuuuucuagcugcuuuguuuuccuuuccuuuaucuugacugcagagaaaauaagcuuuuuuuuuuuaaaaaaagaaauuguuucucaacaauauaauguguuuuaacaugaaauauuuuacaaaaaaauuucaucauauuucaggaucauccuggagggaaaaaugacuaaaaugugaagguggaagagguuauggguaauggugaaaacauuucagaauuaagauucauguucaaauuuuuaagaggauuuucuaccuucuugggugauggaagauaauuaucuguaguuacacaaguauaauuacacaaaauuacauaugcagggguuggugucaucuuaauaauauuuuuucagcaaauagagauggcagggaaugaaaugaacugcauauuuauauuuuuccuucucuaucucuguccccauccuaauacuacggaaggaagcgucuuugucuaaaugcuacuaggcuucaacagucauugugagaguaacauugugauuaagcuugggcuguagauuuggguugcugacaucgauuucugacucuaccaaucacaggcugagugacuugggcaagguacuugacauuuucauguuucuguuuuuuauucuuuaaaaugagggauaauaauuuucucuaucaauauguguguuguguagauuaaauuaguagauacuuggaaguuguucagagcagugcuugcuacauagucugugaaucuagaugcuauuauuacgaucuuaugauugauauuaauauuauuggaauggcguccagugcucugugacaccgugagagauggugauagcagaacgugagaguuguagguugucccuaggaggguagugugaaaauccguggugaaaguaacaguuaaaggugaaagaacacugggugcuugggaaacugcaggucauuuaucauggccaauguuuauguugcagagagggaaguagaguugccuuuuggagugagggaaagguuauagaagaauuuuaaauucaaagggcuuugcaauauacagucaguccucauuauucauggauuccguauuugcaaauuugccuuuuugcuaaaauuuauuuguaaugcccaaaucaauauucaacaugcuuuuuuagaucauucuuggaaaaugcacaguggcaaaaaaucugaguugcccaacucagauguuccagcugaagucgaacaagacaccaagccaccacccugccuuccuguuucagcucucaugcuucaaacaggugucccuuucccagucugucuaggccacguuuuucucauuuuugugcuuccugcuuucugaugguaauuucaguuucaaauggcccuuaaauguagugcugaagugcuguuuuuauguuccgaaguguaagaaggcugugacaugccacgcagaaaaaauacgaaaauauauggguuuguuaagcuuuguuguggcaguaguuacagcacuguuggcugagcauucauuguuaacaaaucaacaacauauacuaaauagggugucuuuaaacagaaacacacauaaaagaagguuauauauucacugguuggcaaaagcguuauggucagaggcucgcagaaacaauuuaauauuguuccuaggagcaaugguucaguaguuguuaacuuauuugcagcaacuuucuaggacauaacuacugcaaauaagaagagucuacuauacuuggaaguccccagggagcuuuugggcagcaguaaacuauggagaggagaaucccagagggucccgucugugauaaguggggaagagaaagucugcucuuaaaugguaaugagaggugaagccggcugggcuucuggguuggguggggacuuggagaauugugugucuagcuaaaggauuguaaacgcaccaaucaguacucugugucuagcuaaagguuuguaaaugcaccaaucagcugucugugucuagcuaaucagguaggggacuuggagaacuuuucugccuagcuauaggauuguaaacgcaccaaucagcacucugugucuagcuaaagguuuguaaacacaccagucagcacucugugucuagcuaaucgggugggggacuuggagaacuuuucuuucuagcuaaaggauuguaaaugcaccaaucagugcucugugucuagcuaaagguuuguaaaugcaccagucagcaugcugucagaacagaccaaucagcacucuguaaaauggaccaaugcgcucucuuuaaaauggaccaaucggcaggauaugggcggggccaaagaagggaaaaaaaagcaggccaccugcgccagcagcggcaaccccuuugggucgccuuccaugcuguggaagcuuuguucuuuugcucuuugcaauaaaucuugcugcugcucacucuuugggucugugccgccuuuaugagguguaacacucaccgcgaaggucugcagcuucauuccugaagucaccgagaccaggaacccaccaggaggaaugaacaacuccagacaugccgccuuuaugaacuguaacacucaccgcgaaggucugcagcuucacucuugaagucagcgagaccacgaacccaccagaaggaagaaacucuggacauguccgaacaucagaaggaacaaacucuggacacaccaucuuuaagaacuguaacacucacugugaggguccauggcuucauucuugaagucagcaagaccaagaacccaccaauuccagacacauuuuggccacccagaugggaccaucgcccaucgccaggcggugagacuaaugccuauugccaaauggugaguaccgucggaccccuuuugcuugcuauucuguccuauuuuuccuuagaauucgggggcuaaauacugggcaccuguuggccaguuaaaagcgacuagcguggcugccagacuaaagacacacgugucaggcuuucugggaaagggcucucuaacaaucccugacucuucggaguugggagcguugguuugccuggaaccagcuucugcuuuuccuguacuucugggcugagccgagggucgacagagaggaaagccauucagcucugggaucccaacaacaaguugguugacccugcagccaugagcagaacucucaaaggcaugucguccaagcagacucgcccaucuauccuaucuauucugacccuugccgccuggguccuaaugccugccagacaaacuuccucucgccucucuucucugaggcuagucccacuucuaaaaaaccacucccugucucuggugcuuuucuaguuucuccuauaagaauuauuucuaguauaaacuccaggacucuguuaccuucuuuaggugcccgggcucaccaaucagaaagauguaauuuuugcccaaagccccauuguagggggacuaucuggaauuuuaggaucccuccucagacaaucaggccuaacaaaagcuauuccugaagcuaggauauggugagccucagaaauuguauccuuccuauucauauaagugaggacaaaagacaucacucuuccaacucuggagaucccuucccucccucaggguacgacccuccacuucauuuuucgggcauaacaucuuuauaggacauggguaaggucccaauacuaacgggagaaugcuuaagacucuaacagguuuucgagaaugugucaguaagggccauuaaauacaauuuugcucaguccucuuuguggucuaggaggacaggcaaggguccagguuuucgagaaugugucaauaaaggccacuaaaucugaccuucuugguccuccuuguggucugggaggaaaacuaguguuucugcugcugcaucagugagugcaacuauucugaucagcaggguccagggaccguuguggguucuuggggagggguuguuucugcuacugcauuagugagcacaacuauuccgaucagcaggguccagggacaguuguggguucuuggggagggggagaaacaaaccaaaaccaugggcgguuuugucuuucagauggaaaacacugagacaucaacaggcucacccuugaaauacauccuaagccauugggaccaauuugacccacaaacccugaaaaagagguggcucauuuuuuuccugcacuauggccuggccccauauucucucucugauggggaaaaauggccaccugagggaaguauaaauuacaguaagaaggaaaagcuaaauaauuucuacagaucauucaguacugcucaguaguaccauguuggaauucacaggggaaguauuauaacuuacuguguuucaauucauuuauuuuaaagccagaaacugccuugaaauggcugcuauaccaaaauaccgcauccccaaaaccuggugaauucucagaaaaaucauucuaggugaagagaagccagucuaugguggacuugccuuauauuucagcaccgaucccagugugauuuuaucauaggcuuucaucacuaagaauguggugcagucucuuggaguacaaggacagcauuaguaagaaucuagaauacauuuaugggaauuggagaaauuaaauuuugacauucacuuaauuuuugugguauucucuuuuugccacagagcaucucuggaaagcacaagauaaugcagguuuuugucaaucgaaucacuuuucccuauaucccuuauuaauaacugggauaguauucugaaacaaguacuuugcuuucaaauacauuuuagauuuaacccauaaaccuaaaaguaaaauaacaguauauuuaaaaacacacauuuacugaaaucuuauacaguuauagcuauauagaaugcaggaggucccggggugcucugcagggaagcucugccaguccuagccaguccaccagacccagucagccccuuucaccugaaggauccuugggggacauggguaaagggauuaccugggaugguucaggcugcaugaacucacagagaugugccuguuccucagggaccagaucuuacacugucagccuccuugacacuuugaucagaccggacucucucuuuuccuaucugaaaugcugcagaccucaguucuaauaacuucugaggcaucccuggccccaacaagccaggaaauuccuuagugaaccagagcagaaauagccaccagauggcgcaaacacacagccauuggcucucagccaguccccugaacucuggcugaccagcugcugggacauucuguuacguugcaacccugcuuauaagccugaaacguuugaaguuguuuaaaguuuaaaggccaagacagggguucuuggggucuccuuagagggcucuaaagcuuucaucaggacccgguaggaacuagaagcauuguuggaugugcaacuggccccccuauuaaaugggauuugccugauguucauggcagaugggcuuuuucccaggaccugagucucccaacucucauucccaguuauuuuuccuuacucugucaugaaaguauuuuaaguagggcaagcaauuuuugcuuucugcuuuaacauggaaauauaggaaagaaugcacuggaaauggaaagucuaugaauguuggcuguaaaaacaauaauaauguauuuggggguugaaaguacugucccauuauuaaaauaugugacaguaauaacgugaggagggcaggguaguaaagggaguuaaagugaaccagcauugguggggaguuaugcaaagcuguauggggaaguuugaucugacucuugacaugugguucucagguaaauagaaucuuuuagaaucauuuuucaauuuuuuaaacaguagccauuucuggagcuguauguucagagguacuguugagauuucuguuuuaaugguagggagcauucgagccucuugagcauucuuuucuuuuuaucucuaacuuuucuuuccucacuccuaaaaauauuaaggggaauuuauuuuuauuuguauuuuuuuuuuuuuuauugagacagagucucacuuugucacccaggcuggagugcaguggugcgaucucggcucaacugccuccugggcuccagcuauccuaccaccucaggaccacaggcgcucaccaccaggcccagcuauuuuuuuguauuugugguagagacagcauuucaccauguugcccaggcuggucucaaacucuugagcucaagcgacccacccgccuuggccucccaaggugcuuggauuacaggugugagccauggcgccuggccauaaaggggaauuuuaaaagggaagagaagcgaaaguggguggccuaugaagcugcugaugggucaagcaaaaacugucagggaguuugguugcacacuucacugauuggcaggugggcauccuuuucagguggcccauucgucacaggugaagagaggauugccagcacccugccuguacauguucaggguugccucugugcugucuuucuuggaugcuuuuggucaaaugacagagagaauggcaugcacugucuucauguuuaauuuuauaugcagaguugucuuaaaguuguagcugcuaguugggcacaguggcucucuccuauaauuucagcaguuugggaggcagaggagagaggaucacuugaggccaggaguucaagacuagccugggcaauaaagucacacucuugucucuacaaaaaaaaaaaaaaaauuaauuagcuuggccugguggcaugcgucuguagucccagcugcuugggaggcugaggcaggaggaucucuugagcccagaaggucaaggcugcagcaagcuaugauuacaucacugaauuccagccugggcaacagagcgaaacccuaucugucuguggggggauaaaaaacaaguuguagcugcacauguaggaaagaaaagguuagcuuuggaaagcucucuugaaaaacugaagaagaucagguuuauuuccugucauugaaccaagugaaccaagcacauuaagucauggggcagggccucugcacagugggcucuucucagauaacucaaggucucguggggccauuuccacuucaguguagcaucaucauacuuccuaggggugcagagagaucaagaacucccacuuagaauacuugcagaucuuucuucugugauccaccuuugcugucagcugcauugagaaaggacauccaaacuggugcaguggggccccuaaggacaguccuaacacaagcucucugucacugucucaggugaagaguuggcccauguuuugcucuugcugcaaggcaugugcuguugccaccauuuccaucuguuuggugacuuucguaugggauauguuacucccuucuuccuacuccggcauggggagggagcaaggaggaguacuuauugcugggaguaaucuaauuucagaagcacccaugaccuguggacuccuucugaaaaggggaugcaugaauaauuguacuuuuaaaacuuuguuuuguuuugagacagggucuuguucuuuugcccaggcuggagugcaguggcaucaucauggcucacugcaaccuccaccucccaccucagccucccaaaaugcugggauuacagaugugggccaccauguucagcccguuuucauauuuuuagaggaacuauuuuaagggaaaaauuuuaaaaacaaaugaccuaugauucauuaccaugauaauacuugaccuucguucuucuuacuuuuuacgguaauuaacuuuaacuccagacacaauuucucaggaaugguuauugaacaccaggugaagagacagguuucuuccaguccuguuuuuccaaacuccuuuccuauuuagcacgcauuguggugccuuaggagggacauuugugggcaguuaggguugaaucuguucucugguccacuagggggcgcgccuaucaaaggcaugugugugagaaacucugcaggcugauggcacuucaauaaagagcagcucugauguguucaugaaguggaggacuuaguggggacucuucuaaguggguaaguuuagcagguucagaaaaaugcuuuuccagccagaaucuuccuccuucccccuuuuagcucaaaaucuccaauaacucuguccccuggcuguggcggaaggagaggcaacauauuaaacagugucaauccuucgucccugaguguauugugcaaacuuccuuggcauccuuucuuugcacauggcgcuuuggagcaaaagggcaccauccagcaggugcaagggugacacauagggaaccaagggcaaagaaacgucagggucucguaauguauaagcaagucaauuguguuugaggcuaauaaaacauagcuuuuacgagugcagccuuuggugccagacugccugguuuugcaucccagcuucauugcucauuagcugugugaucuugaacaauuuaccuaaguguuucuugccucauuagugaguuggauauagucguaucucccacccaggcuuguuauggacauuaaugaguuaauugauguuaaguucugagaagccuuggcauggagccaguuuuaguaaguuuuuacaauugaugauugucauuuggaucugaugguggaaaugagucugcagaaugcauuuacaguaacccagaugacuggggacauucuucauuugacuauaaccagcugggucugagaguagaaauacauggcuucaaaaacaguuaauugucaggaguggcauaucccaaaguccaugaauucuagagaauuucguaagagugcuuagcagugcaggacuuuuauaccccucaaagagccucuuuagugaaggaagcgguggauuuuuugcucuguauuuuugcuacucaggaauuagcauguaggcacauggccgaggauguccuuaugcugccugcucuugugcagauuuucaaaagcagauaagacucaaaaccacaacauauauuaaaucaauauuacuguccaugacaggaagcauuuuucaauuggaugacuccauccacgauacccuuuggagagugccuuggaccuaggcuggacagugcuaggacagaggaccaccagagucuggcagggcugaguggugaugggguccugguaccugggaaagguaguuauaggcauccagcaccucuuccucugaugauuuucuguaggugcuuguacucgugauuuugccucuaguaggaucauaucaaagcaccccugagaaucaugcugguuauucuggggugcaggcaagagagggaaggaaugaccaguuaagaguccugugauccaguuaccugcuucccauugaccugcuuuugauggccaucaaucagcuccacgcaaagcuagcaugccuucuaucuuuauccuuucuccugagacagugugcuguugugguacuuuuuauuuuguuuuccauuuuuucaaguggugacuauuugucacagugcccuuccuaccucugaauucagugugaugugaccucgggagaggaggugugagcacgacguccagacucggacaugucuguuucacgucugccgggaaguaauuuuuaugcugggagcuggcuucauggcgugggauucuaauucuggggauggcauuuuguauguguaggaagacugucaaaaccuuuccaaugggaagggacaagaaccaauuugagaaucacaugguuacauaagaacuggcccugugcgggcaucucugcauacuuccugcacuuguucauucugaagacgagagaaagaggagcaggaagaaucuuccaugaacucugcaaaccuacaaacuuuccaaugagaaguggugcacacucccgagauggugcuugggacaacaugguuaaaaggguaagggguauuuauuaacccuuugcuuucuuguuauuccugucccuccucuuuaaauguuuacauuaccaaacuggcuagacugcugagaaucuaucauuuuuagguugccugcuaggguuucuacuggucuuaucccaguaaauagcugcagaaaauagcugcaguggccacacccagcagcaguagugucuaggggacucuuugggaccugagccagaaaguucccauaugcaguaucucauucugucuccacaagacacaagacacaaggauuauuaugucuauuuuagagacgaauaaaaagaggcuuacagcuucagaagauuugaaaccugcccacaauagcugcaguguuucagcagcacaaggagacauaugcagacuuaauuuuuguuuucaaguuguuuagucgcagguucagacacucaugggagcaaggcagugaaauagaugaaaguagcagaucuuagugaagcuuuauuucuagccucccaugccaaggacaccccccacucccuuggaguccuugagaaagccaccaaaugcuugucucacuguggccuuuccacacucaggaugguauucccacuaaugaagaccacacaccaacuauccacuugcugcuucuuaagggaacaugcacagagcaucguccuuccugaaucucaagcuaaacccagcaggagcaaggccacguuucuaucuggggguagaaagcaaaauugugcuuccaguuuuccagggaugcuauaaauccuucgcaaaugcucacagcaagcaaguggcagggccaguguuuggccccuuucacccugacgccaguccucccccaccucagccucgaggcugugcugucuugcuauuuaaggaaaagggaacaugcugucuacaaggucucagucgcucuuuacauucaauucagguaaauccaagaggccuugucuccauucucagcuuauugagccucugccugccuucuugauguuguucauuuguugaugaccuugcuucauaaccagggcaaagcagugagggaaagcaaguauuuucaugacagguccugagugcucaucuuccugcuucaugauaacccagaaaucggccuucacuuuuugccuucuauuguucauagauggagccugaaguuagcagauuugaauuugguucucuccauccccccagcccuuuaauauauuuaucugugaugucauauacuaaagcuuuuccuuguuucuugaaggguucucccucauucccacugcagccuucccugugacuuaugagcauuagggcaaagggaaagggcuggaaaauggagaccaggaagagggaggccucugcaguacagcuuuuaaaguucaggggcaucuacuggaggugguccgucugggaccaggucuguuaggagaagagccacgccagcuuuuucggagaggaaagcucugggaggagguacaguucuuccucacuuugggaaagcaucacagauuccugcaacugcugcucagugcagggagccccgccuccagccagcugggcauggcugggcauccaaacaggcauccaaggugugagacaggggccuguggauuucuuccaucuaucugaguggcucacuguagaauggcgucccaucggucaccuguagagcacuuugauaguaacggaucaugccaggcaauagggucauguuggaguuuaaucuagacuaaaaauaagagacuaauguguugauucauuuguucgugcaaccaacauuuaugagcauuuaugauauuuaaggcagugugcggacaggccucucucuagucacaaagaugaaucggagaagccaaggccuucauggaauugauuguugagugaacuccuuaucacucuggaccucaugugugcuguucucucuccuggcacucucauccccuguccucuacaauucucaguucagaacugaguguguuguauucuuagacuagacacagggagccugcugggagcucucccaguccagguccuacccccguuucagcacguaguuuguacuugcuuauuagccugaugucccaccagagggauagguccuugucuacuuagcacaccuuugcaucucuugcacccagcacaguuccugccacuggauaggcauaugguaaguguguguugaaugaaugaaugaauagaucaauuaaggauucuaccguucaagaaaggagacaccuuuacuuauagguagaaguugauauaugcuaugagaaucauacaaauagacuauaaaguguuucugaaauuccaaaaauggauaaggagaauuuauuugaggacuccaugagauuuuacaguggagaggacgcugaagaugaaccuuaaagaauagggagcauuuggacaugagugagcuggggaggaggaggagcgugggugaccaacaaggaguggaaaguggaagaaugugaaguuuccuucaauuucugcuccuuugaggcugggccauaaaauauuaugugcugcgguguuuggaugauauuugauaauuuguaaguuaagaaauaaugcaguuaaagcugaggauuucacuucggugguaguaaaaagauggcaggaaguuggaagaggcuggaggugauauuggccgaaacuagaaauagaaggggaauagaaagggagaaaacaaaugugaaagaaaagguguggagcacagggcuugguaacagauuggauauggggaguguugcacagcuuguguggccgggaagcuggguugcucuuucugcagauaggagaugcagcuuugggaaggggcugguuuguuccauuuaggauaaaggacauuugaauuacugucaggacuuuucagcuggagauagccagaaggccaauggaaauacaaauaccuagcacaaguuaacauuugcuugagauuuacaguaaccuggcaaguguuuuguuagccuauuuuaaugaaaggggagcugggaaacuauagagcagagaauaaacuggccaggacauacaucgagugugugacacaugggacuccagucuucaugugucaaguucugugcuuguucuggagaauuucuccaggagagccagggcuuuccagagcauucuggaugagaagugccagugagauguauuuagagggacaaguugcugaggcagcaccgggugagaucauuugcugaagccuagaguggguucuucucuaaguguguacuagagucacauguuuauguguauguacauguauuacaugugugugcacaagugugugugcaugugugugcucaucugccagcaggagagaaaauggugauaagagaaaacuggaaagaggauggcccgccacgcagggacucugauuuguuuguaagagcugggaaacacaauugauacucuucccguagcaggccauuggugcaguccuauuuucgccguuuccuagugacucacacuguauagauagugcugccuuauuuuuagugcugaguaugagugugcugcggaaggcugccgguuaccaaggaggcugugccucuaagcuccugcagggagccccccgaguggugacuccagccuccgugucacucucugauaaccccuggcagagcaccuccuuaacccgaggggugaccgcucugggcugccuucccuccaucccugcuuauauaacggcuuuuuguucuuauucaguuuacguguuagaaaaaauuaccuccaucuuaaaggagaguucugggaaaauguuaggcagaucauagagagccagggggccuugguuggauacaaucacugugcggguugggcugcguagccccaccugguacagggguuuugagucagcuuggccucuuugagccuccccccucaccaagaauccaggggggaaguggucaaaguacucaggaaguccucagaauuuuuuacuuuacaagguaauacaaacccagcgaagggguaauuaucagguugaauucuucagaucccucacaaaaauuccauuuuugggucugagcacacaucugcaauguuuuguuuuguauuuugauuucaugaacuuuuucuuuccacucuuuaaauguguguguguguauauauauauauauauauauauauauauauauauauaucuccuauauauauaaaaaauauauauguaucuauauauaaauuauauauaauauauaaaauauauguaucuauagauaaauauauaucauauauaaacauguauguaucuauauauaaauauauaugucauauauacauauauacacacacacacauuuuuuuuuuuuuuuuugagacagagucucguuuugucacccaggcuggagugcgguggugcaauccuggcucacugcaaccucugccucccaggcucaagcuauccucccaccuuagccuucugaguagcugggauuacaggaaugcaccaccaugccuggcuaauuuuuguaguuuuuguggagauggggcuucuccauguugcccaggcuggcucgaacuccugaccuuaagugagcugccugccuuggccucccaaauugcuggauuauaggugugaaccacugcgcccggcccaguuuuuuuuuuuuuuuuugagauggagucuugcucuguugccaggcuggauggaguucaguggcacggucuuggcucacugcaaccuccuccucccggguucaagcgauucuacugccucagccucccgaguagcugggacuacaggcaugcaccaccacauccagcgaauuuuuguauuuuuagcagagacgggauuucaccauguugaccaagauggucucgaucucuugacuucaugauccaccugccuuggccucccaaagugcugggauuacagccaugagcaaccacaccuggcccuggcucuggcccacuuuuuaccaguauuuauuucugcuaaucaaugugacacaucccuauggugaaaacuugggagaggaaauuguggaaaacacacacacgagaaaucacucauagucccaccuuccacaggcaaacacugcuacuguuagcaucuuucuucuucuucugugaacucuguccuuuacacaguggagacugaccucuauguuugauuuccuaacauuuccauguguccucaguacaccuggauaaacaucacgugcagaagccagauaacauuuugugugugugugugugauggagucuuccucuuucgcccaggcgguagucacuggugcgaucuuggcucacugcaaccuccuucucccggguucauggaauucuccuggcucagccuccugaguagcugggauuacagguucgugccaccaugcccagcuaauuuuuguauuuuuagcagagacggguuuugaccauguuggccaggauggucuugaucuccugaccucaugauccacuugcccuggccucccaaagugcugggauuacaggcuugagccaccgugcccggccgaugccagauaacauuuuauuaagugguugaaccaaaauuuaucuaaacauucuccuauauauuuaugauuuuuuuuacaagaagggguuccaugaacauaugugaguaacuguuuguccacauugaggauuauuuccuuagaacagauuguuagauucuugggucggucaaaauauaagaacauuuuugacacaauuauuuuugauauuuauuuguaccuucuauuuuuaaguacuuccuuguuuccaugagguagauuuuuguuuguuuuuucuaacuacuuugauuuaguugggcuuaccacagagaauucagaaauguagguaaucagaaucauuuacauaaaaaucagccauauuucuauauauguaaauaaaacauuguuauaguuuuguaguuuugauguauaucuuuccagauauuuucuuucuuuuuuuuuuuuuuuuuugagacagagucuugcucuguuacccaggcuggagugcaguggcgcggucucggcucacugcaagcuccaccucccgaguucaugccauucuccugccucagccuccugaguagcugggaccacaggcgcccaccaccacacccggcuaauuuuuuguauuuuuaguagagaugggguuucaccguguuagccgggauggucucuaucuccuugaccucaugauccacccgccucugccucccaaagugcugggauuacaggcuugagccaccgugccuggccuuuccagauauuuucuaugcuuguauaaguaaguaugcuuucaugaaaaugugaucauauagguuuuugaaauuuuuuucaaaaugaauuuuuaaaagaaaauuucugguugggugcaguggcucacgccuguaaacccagcacuuugggaggcugaugugggcagaucaccugaggucaggaguuugacaccagccuggccaacauggugaaacuucaucucuacuaaaaauacaaaaguuagccgggcgugauuggcagggugcccguaaucccagcuacucgagaggcuaaggcaggagaaucacuugaacccuggaggcagagguugcagugagccaagaucacgcuauggcacucuagccugggugacagagugagacuuugucucuaaauaaauaaauaaaaaagauaacauuuccaugugaaaaccuagaauaggauaguuuaugaugucaucuuaguauaugcuuagcuucaucugauagaccguaaugaaagauuuucuuucuucauguuuuagguacaaaacuuagauuaaaaaacauaucccuguagaaagcauguugagacuucucuccacauuagucugggauuauuaaauaauuauuacuauuaauaccauggagaugaacauacaugcaaccugcagaacaaaugaaacguguugcucugaagcaaaguaauuuuuuaauaauuaguagccuaucagcauaauguucauuuuaugucuuccuaaacuuuuuaucacuugcauugugguuuauaaauauugaccuacugauaaagagccuuugcugcuguucuuucguucaguauaagaauuucugcuaaauaucauuucuucuuccuuuuuuuuuuuuuuugguagggacaaaacgauaaaaugucucuagaaaucugauuuggcaugguuuguagagagauucauaguccaggauuguuuaaccacacagagucuucaggguuuucuagagguuuacauucugaugcauccauaaaaaccaacugauaaugucauuuuuuagauaaaaauguaguaugauaguauuuuauucagcauuguggcuugggacugacauaggcuuuauaaauuaucguaugauguggugaauagguacuugauuuguuccacaaaaaucugcugccauuuauuuuguuuuuuuguuuuucaaguuuuggcaacaacuuauuaugcaagauucccugaauucuucccuggaaaugugucucucauucuuuugggagaucauugcuuaagcuagguaacaaucugauuucacggagagaguuagaacucaugucuuugaauaaccacgguuacauacccauguagccgcaagagagugggcuucucuccuucccagaggucuugauguucauuaucucugcccuuggguugccauaaacuucccugugucuuucuucaguuauauagcauauguuauauacacucauuuuucauuagcuucagaguucaagcaaaugucuucuuugcauaauucacugggauauccuucggaaugccuuacagaaaccaguguuucucaaaaggauucauuucuucccugcucauguucacauuagaaucuccaucuguugauggaggcugaaagucugauucuucuaaggauguauguuaugccugcacugucuguccaucauauacaguuuuuuaauuccuuuugucccauggcaaugcaguuugaaucuuucauguacauaaacauucaaacaucaugauuaaaaguaugguguuccauacacaauuaccgaauucuuuuaaacaauuucuuauuuuugaauguauauguuguuaccaguuuaaaaauuauuauauacagugccacagcaaauacaccuacagcuuaaucacuagaagcacaguuccuugguucaggauugggcauauuuuauaacauaaauauaauucagcaggaggacuaaaacaguuauugucaaaaaguuaaugaaaaucucagaaacacaugaacugagcugcagcaaugaugaaacuugucuuuacugcauauucucauagaagcuccucauggaaggcucagucaugggguugacugugggggacacauccaggcauuucauacccuaaaccccagcaagauuuaguggucguuggguuguguuuuuaaagauuuccaugcauauuacaaaauauuccagaaccagugacaauuuauaccauuaccauuagucuuagaaaguggcuguuucuaacgccuaggccguuucauaacucuaaagauuuucuuuuaucuuuacuaauuuuaugguuuuaaaaaaaacucuuaagaugccuuuucucuaaauacccacagccacauuuccuaucucccuauuauagucuucucuugcucuuaguuauuauuauuauuauuauuauuauuuuuuuuuuuuuuuuaccuuucuccaguggccuguguguguguguguuugcguguguguguguguguguguguguguguguguguguguguguaacaagaagcacagucuguauguuaagcacuagcccccacuuugaauaaacacuguaagguacaacuucauguaaugaaggauaguggaguaauccaguucugcaaaaacaucucaucaguaagugucauuuggaaccuaaggacuggggcucuguuuucugcagcucuucuugauugguuuuggucaaaucauuauuuuuugaaccucagcuaauuuauuugcagaguggugauggugcuuuuaaacuccucucuuuaaaaaguuauuagagaucaagaagauguagugugugaaguuuguaauuucugaaccgcgguaaaagugauuaugauugccauugaagacaagauuuuaaugcacccccaccccccugcuuuuuuuuaaacucugugaaugaagauucuugucacaagguaauagaaaugauuagacaaaggaaaccuacuggcauugacuaacuggaguccuuuagaugccccaguuugggcugggauagaaauuucuagaaaugggauauucagggaguucccuugaagaauggccuugugucguuauuuuuuuaaaaacugugcugucucagucacugugaauucaagugcuuaacaguuuuuagucuacacaaaaauuagcuaaggcaauucuuuaauugaaauagucaaauuaucacauuucagugcaccugcggccuuguauauacaguaauacaguuuacuacaguuuaccugcauggucauuuuucuuuacuaucagaauucauuuggaguagaugacugauaauaaaaaacugguuauaguaauaucuauaguaaacaaaguuauuaaaugcuguacacuaaaagcauaauauguuauuagaagaauggggugaauugggaaguuuuauuuaaucacuuuuacaaaauuuguaaaacugagaacauaacucauauuuuaacaguuuuauugauguauaauuuauagaccauauaauucacucaucuaaaauguacaguuugggugcuuuuaguauguuuacaggguuguaaagccaucaccaaagucaauuuuagagcauuuucauuaucccaacaagacccauuagcugucaccccaaucuguucguccuccccagccccaggcaaccaauuagucuacguugucuauagauuugucuauccuggauguuucauauaaaugaaaucauacaauacauagucuuuuguuacuggcuucuuucacuuagcaugguguuuucaaguuucaucuauguagucucauguauccguucuuuguuucuucuuauugucugauuuuauucucucauacacacacaucccacauuuuauuuaucuguuuaucaguugaugagcauuuggguuguuucuaguuuuaguuaugaugacuaaagcugcuaugaacacuucuguauaaguuuuuguguggguguauguuugcauuucucuuuguucuguacuuaaaagcacacugauuguaucacauacugacucuauguuuaaccauuugaggaaaugccagacuuuuccaaagugcuugcaccaauguauaugcucaccaguagcuuaugaagauuucaguguuuucagguccucaucaacacuuguuauuaucugacuuuuugcugaugggagggaaugggagggaagugguaucucauugugguauugaguugcauuuaccagauggcuaauaauauuugagcaucuuuucuugugcuuauuggucauuuuuauaacuucuuuggggaaaugucuguucagauccuuugcuuguuuguuaauugggcuguucaucuuuuaaucauugaguuguaauaguucuguauguucuagauacaaguccuuaucagacaugauuugcaacuucucacauucuguggauugccuucccacuuucuugagagugucuuuugaagcgugaaaguuuuuaaauuugauuuuuauuuugauauauaucuaguuuguuuuuuauuuuuauugcuuaugccuuuggugucauaacuaagaaaucauuguucaauuccaggucaugaagauguauaccuacauuuucuucuaauaguuuuauaauuuucacccuuauauuuaguucuuugauccauuuugaguuaauuguguauggcauaaggaagggguccaacuucauuuuugcauguggauaucuaguuuuccuagcauuauuugcugaaaacuguucucucuucauugaauuuucuugacacuuuugucaaaaaucaauugacuauaaaugugaaggcuuauuucuggauucuuaauccuguuccauugcuauauguuuauucuuaugucaaguccacgcugucuugauuauggaaacuuuguaguaaguuuugaaaucagaaaguguguguccuccaaauuuguuaguuuucaagauuauuuuggcuauggagggugucuugaauuuccacaugaauuucaggauugucuuguugauuucuacgcagaagucagcggaguuacugauagggauuguauugaaucuguagaucaauuuaggaggagcauugccaucccagcuuaacaagauaaagccuucuaauucaugaacaugggauacccauugauuuauuuaggucaucuuuaauuucuuucuacaguguuguguagcaguuuucagaauauaaauuuuguacuuuaucuuuuaaauuuauuccuauuucauucuuuuguaugcuauuauaaguagaccuauauaaaugaucccuaagaagaguacuucaaauuuucuggaucaaaaaucuugucuggcuugagccauguaaccauguuggcacaaucagucacaucuaggguuaugugguccuuccacguuauauauaugguauguauauauauacagugcuguuucuccaacaaaagcuugaaucuagggugaucugaguggguuuaccaugcccacuacaagccccugcccagaaaguggaccuuuguuuggaacucaguuaucacauaaauacucauuuauuauuuuuucaggacuauucauuuacuuuaugaaaauuaaaauacaauguuauuuuuaacaaguaguaaauggaaagaaugaguaauauuaaagcuuucauuucuauaaaugauacuacuuagaccucccuauuaaauauucugggcucaguaucaaauucuauuguaauaucuuugaaaagcauagaagcaguuucuaauuuaaaacucuagcuagcugcugcucugcuaagaauaaagauugaccacaaauucaacuuaaucugucgauccuuugcauuuaggcuaucauauuugauucagaauaacuccgcucuuuaagacaguuuuuaaugacgugaugagagaggaaaugcaaaauauuuuacauuagccuauacucuauuuguccgucuaguuauaauagacagacucauuauaaauuaugacuuccuauuucauagauaugaagauuagucaaauauguagaacaagagaaaaaaggauagcaaugaaguaauucgugauggacuuuuuuuuuucuuuugagacggggucucacuuuuugucccagcuggcgugcaguggcaugaucauggcuuacugcagacucaccuuccuggggucaagugauccucccaccucagccuccugaguaacaugccaccacaccagggcuaauuuuugucuuuuuugggggguagagaugggguuuugcuauauuacccaggccaaucucaaacucccaggcucaagugaucugcccaccucugccuuccaaagugcuaggauuauaggugugagccaucaugccaugacggacuucauaaacauaguaaaagguuucagccaaagcaguuugauuuaaauggauguuuuaauccuuggcuugcaauaauuuuauccucuggaaaguauggcuuuucagucaacguauucacuuuuggccuugaccguguagagcaauuacaggagcccauaucaacaagugucuucaguuguugcauuagugccuggagccagaacacaaagguagccagagagggugccccuaaaccgugucuccccacaucucugacucugaaccacacaugcauggagccuacucaaagcaaccuagcuauggacagaagaucucacuaagaccagacuuguagcccuggaaacaguuugcaguuugugcacagacaagagaacuaucugcuaaaacaaaggaagcaacacucauuggagaaaaaacagaauccagaaucuucaccaccuaacauucauaauaucuggaaaagaauccaaaauucccagaucauggagaaugaggacaaaagaaaaucaacuccagcucucagaugaaccagauguugaaacuaacagacaaaagguucaaaacgacugugauaacuauccccaaugagaaaaacaaaccauguuuucaaugaaugagaaucuuagcagagaaauuagagguguugguagagaaauggaaaacaguaggaagcaaccaaauggaaauucuagaaacaaaaaauaaaauuucugaaguuguauguaacaauauauaauagaucuuuuauaaauguaagcuauuauuauuauauaaggguaaagauaagguauuuugccuuuauuuuauuauacguuuaccagugaaaucgaagcagauaggacaauucuauccaccuuuucaucuucuaaaccuuauucucuuuggccuugagaaaaaaaaagucuggaauauacuuagugaagugagaaaguugagggaggugggggacauagacuauggcccuucccucuuuccugcuacuucuguccugcugugagcacaucugugcuguugugcuuuauagagaaaauuccaguuuaccucccuauuucucucucucucuucuggguccugaguaacaggaggucagcuuuucuaggccuuucuuaucucuuccccugauaaaaguuggauucauguguagugcacgaacaaauaaagcuuuggggcucugguucccuccucuucucccccugccucuuccuccucauugucacauccuuauuguaaauacuuuaggggcaguguauaaaaaauggcacuaauuacugaaacaauguuauuuaccacauacacuggcagaauguuuacuauguuucuuuacagccgggguuuauuuuuguuugauguauuuaguugcugugaaaaugaacguguugcucacucucgauagaccuguucuuccuccuccuuccuccuucuccuucugugccagaucguccuccucuucagcagcuucucuuccuucauuaggccuucugggcaguuuuuaggaugucugcuccuaaacuauuuccauuuaaaauuguucuaguguaucaacacaccaaucacuuugacuccaugcaagcuggucucugcauuucaaaccuagcuuccguguguuaguccuuuuugacauuuuuauaggguuucuccaggaaaaaaaagaagagcauagcaaagguaugagccauccuuauggagugccagccuagagggaaagaggaacuaaacauuguuuguauacuuaccaccuaugagggccccuccaccauguuugacacacucuucuugcagcuaacuggugaaauagauguuuugucccugguuuuauaucuaaaaauacuauacugagguuaaguaaccugcccagagucucacacgggguaagaagggacaccagaauucagugauaauuguaucauucccaagccucuuggcuuuuuaaauuuauuuacucuaaaccauacugcaccucucuaaguaaaagguuaagagaacucaggaaugcaaaugaaaaagcgcuugucaagggagagagaagagagagaggagggggagggagagagagagagaaagagagaaagaaggagagcgagaccgaucgugccauugcacuccagcgugggcaaccaagcgagacuccgucucaaaaaaaaaaaaaaaaaaaaaaaaaaguagagcacaagagcacucaugaucuuccuauguugucauuuuuagccuuuuuccaccuuauaugugcugagagcuguucugcugccauuuucucucccugccucaagagcacauuuaagugcaagugaauggggugggauugugauuguuacacugagugauugcuuagaaucugcccuaccguaucugccgguguauaaaacucuaccgauguuaccaaacucugagaggaugugaagcucuaguuuucacugugcugagcugauuaccucaugucgucaccagggggcagcaccuucccaugccuuuggacuuaggagccucggggcggugggaagcccacaccaaaccccaugccuuagcuggucaccucuuaccuuccaagccugauccaaguuugggcaaaacggauguaaauguguuuuuaauuuuuuuuuucuuauuugagaggggggcaauuggagggaggaaauacagcuuauauguuggcauacacauuugaaauauuugguacuuucuaagcaggaguuuuauguguauucuguguucuuuucucuacugagaaaauaacuauuuccuuugcuagggaugcaguaaucagcaaugccuguugcaaccauaaguuacaccauauuuucucaaagaaacaugguaguaaucagaggccauuguucaaaguacugacuuuagucagcugaccugcaaucaaaccucaguuuaggcacuuacuagcugugugacccugggcaaaauacuuaaccucucugagcaucacauacucaucugugauaugaggacugcaauacauuccugcuuucuuuuuuugacaaauauuuauugagaauuucuuuacuuguggaaugugguauuauguccuguguuuaauggucuuuauauguaucucccaguucaguuucauauaaauuggccucuuguuucuguaacuaggauugcauuucugucaaaagucuuggcuuauacaaggacgcucaaaggccauccaaucugcaaauacaagacagagcugccucaggaaaugcccgaugauuuaauuaaaaugugaagaguagcccacagagagggcaggugugguguaaccccacccugcagggaugaggcgggcauccuccuucucggugacuuagccuggaguacuaccuuggaguaguuucagagacgguucucaggacaaaaaguugaccccuguuuuagggaggcugccuuguggccacugggcaugcugaugguuugccaucuaacacuuuaugccucucacuuguccccauuuugaguccaggcaacugugaccccuggaauuauggagagucucuugggacugucguuauuauuuuuauucuuacugagguaaaauucacauaacauaaaauuaagcauguuaaaguagacauuucauuuaguacauuuauaauauugcacaaucacccacuaucuaguuccaaaaaucauuuuuuugaguuucuauuuugauaugauuuuaaccuaggaaaaaaauuacaagaauuguacaaggaacucugcauaaccuuccaccagauauauucacuguugauguuuugccucauuuccucccugguguuugcuuucucucuuucucuguuugcgugugcaugugugugugugugugugugcgcauaugugugugcauaugugcauauguguguguguauauauacauauuuuuccccaaaaaaacacuuuagagcaugcuggagacauugugucccuuuagcacuaaauacuuaguagguacguauuugcuaauauggcccuauuguacaauuauaaaaaccugaaaauguaacauucauacaauucuauugucuaauccacagucaugacucaaaauucaucaaauuuccuuuacacuuauucuuuccuagacgaggaugcaguccuccauccugugcggauuuagcugucuuucuuuuugcucuccuuugaucuggaauagugcuuugccuuucuguguguucuuugaccuugacauuucuaggagaauacagaccaugguuuugugcaucaucucucucaauuuggauuuggcuaaugcuuuucaugauuagauucaaguucuuauauaucaucucccucccaagggaaaauggguccugauuuccacaugcuaaacuuaggagcauugauuauccuauuaccccuacaaaaaccagugauggcacggagacggcauuuuucagccuuacauuguaaagcugucccaauucugugggcuauagugauaugagggucaguuuccugaagaccauggaaaaucugcugcuauuccuuuaguuucgggcaucauagaaugggagguuuauggcuucaagacuggaagauggugaugcagaagcacauugugcagcccuuuggguuaaaaaucauucuuucauauuguguggcaaaauggaauuugcuuuauguucauucacuugucagaugcugagugagaaaaugacaauuuacaauguaaauucuuaagauaauuaagucagucuucuauggcauggugaaaaauuccccaggcugccuacugggcuccugcacacuuugccuagaaggaugaauucuucucuuuaccucgcuguguaacuucccucugccaagcaaaagcaccucgcuaccuugagaauaaauugacaaucucaauuuugauauguugcugauuucuuuuguguacaugauuauuaauguacagcuuaucuuagcagcagauccaaggaagugauucuuucuuucuacuguuuccauguagccagccuugcccaagucuuuguuccucuuuccccauucacauguauuugauaauucagcuuuuccuaaaauauuuugccuuuuguuuuuaaaguugaaagagcuauaugcaaggccgggcucgguggcucacgccuguaaucccagcacuuugggaggccgaggcaggcggaucacaaggucaggaggucgagaccagccugggcaacauagugaaauccugucucuacuaaaaauacaaaaaauuagccggucgugguggcgggccccuguaaucacagauacucgggaggcugaggugggagaaucacuugaacccuggaggcggagguugcagugagccaagaucgcgccagugcacuccagccugggugacagugugagacuccgucucaaaaaaaaaaaaaaaagagcuauaugcaaacauucagauuaaauuuggauuacuuuuaagccacaugaacaaaauuccccucgccagucuguucccucuaagaaaaaaauuaucuguugccuuuuuuucuuaagcuaucuauuuggaaauaauuugggguugacugaacugucgcagccauaguacagaguguuacccuguucccuuuaccuagcuuccggcaaugcuaauaucauacacauuaugucuuacacaaaguauauuuaucaaaaccaaauauuaacagugugugauccuguuaaccaaacagcagaguguuuuaggauuucaccagguuuuucccugauguccuuuucuuuccucagaucccagguagcauuuaguuauagucucauucaaccugcgacagcuucucagucuuuccuuauuuuuaauggccuugauauuuccuagcaagucuggucauguguuuuguagacuguucuucaguuuggguuugucucauauuucucaugauuagacugggguuauagguuuuuggagagaaacuuacagaggcaaggugccuugccaccucguaugaggagguacgucucuccugacuuuuacaauuuuuauucucuacuauugugugguuuuaaauaucuuucuauggugcuaauacuguuuuuuuucuaauuaaaaaaauuuuuuugagacagggucuggcuuuguugcccaggcuggagugcaguggugugaucucagcuuacugcaaccucugccuccugggcucaggcgauccucccaccucagccuccugaguagcugggacuacaggcgccaccaugccuggcuaauuuuuucuuuuuuuuuuuuuuugaagagauggggaauuguagcucccaugacucccguguguugugggaacaacucagugggagauaauugaaucaugggggcaguuucucccaugcuauucucgugguagugaauaagucuuacaagaucugaugguuuuguaagacguuuccccuuugcuugguucuuauucucuccuugccuguuguaguguaagacaugccuuugaccuuccgccaugauugugaggccuccccagccacguggcacugugaguccauuaaaccucuuuuucuuuaugaauuacccagucucggguaugucuuuaucagcagcaugaaaacggacuaacauacugcuaaucccucccagaaacacacucacagacacaccgagauaaugcuucaccagcuaucuggguguuccuuggcccaggcaaguugacauguacaauuaaccaucacaggaaguuccccagugccuaacucccuccugaaucaugcauuggcugucuugaguuugggggaggggcauuuauuugguuugauggaucuguggauauuuuagaaagcugauuucaaucuauaaaguaaaccuccccuucaaauacaaagaguaacauagauacagauuuuaucuaauuucccuucacugaugaccucucuaggucccaguauauaccacauaguaagcagugagucaaggaaaagaagggccagaguaauccacaaaccuuaaucaauccaugaccacccagcagcuggagcaaucacucucuagcuuucucucauuagguacacacuaaauuagaaaucuuuaaguaguguccucuugaacacagagugacaggaaugaaaugcgacacauaacagaggaaaacaaauacaaauaguuuucaaaauaaagucagucuuuagaaggaaggucacuuuuguuuauuuccuaagauuuaauucaaauuauucucagaauacauuuuaaauuauugugcuguaacuugaauauuacuaauuacuaugcuuccaauuggggaaaacaaagaaauuuaauuagcucugaaguuugagaacuauugaaagaagcacuauucccaugccacuucuuuguacuuucuugugcucaugauguuuuuaauugcuaguauauuuugcuuuaugugugaauguguuuggcaaccauugacacagaguggaguaucaugaguuuuacaagccacucauagcagaaaguuuucuugacagggcacagaaaaugaaaucucagauuugcuuuaucugacaaucuucugcuagaacaugcuauguuuagaguucucauucugagagugucuaauuggaaagguggucuucuuuaauuccuugaagcucuuaauuucaguuccacuggaaacucuucuucccaccuuuuaucuaguuuguaacauacaauguccauuucugcugggucacuuuucccacuggaagauacaucuacaguccuuccuaagcauuuuuaauggcuacaccauauccguacuuaggcauugagcugugucuuccauauuggucuaugccaguauugucugacguugauuauauagucgucuaaaagcuauaacuguguuuuccuuuucccuucuuuacuuugucuucuaacuuuuguuuacugcaaccaauaucagcauaaaaguaauagagaaauaaaagaaaauguguuccauguuuccaugacagugcauccguuaguuauuuuuguuuccuguuugcuuccaguuuuuggucauuuuguaaauggucaaauaauuguaauaggagggaaaagauuauucuauguuuuacuugaagcauuaucucacaagcacuuuuucauauuguuauaccacaauuacuuuuauggcuguucauuccauuggguugaugcauuguauauauuuugauauuuuuaaguacuggacauucaauguucuaguauuuuuguaagcaauauuauauuguacauuuuuauucuuacagcuuucuguuuccuuuucaguuaucucacugcgauagaccaaaauauuuggagacuuucauggucguuaggcuauauguugcuuuuuguuuuguuuuauuugugacuauuuuuagcacauugucauuuauaagaaaguacuuugucaaugcauagggaggaggugacaauaaggaagcaguccuuuucuuugaaaguauuguuaggauucugaggaagcuuuucuaggaaaugacagugaaaguauaacagucgaugagucuuuggggagcuugggaaauuguugagauguuaaaggucauucugaaauuaauuugccuagcccauuguaggcuauacugaaauuauuaucucuaguaaaugacagcauauucucagcuauauccaaagacuguuguagaaccagccacgaucuccuguauaucauuccaaacaucacuugaaaguucuuucuugugucuaaucugaauccuaugcugcugugaaaaucauuuucagguauugcaguucaacuuggaacuaaaaguaacuauguucuuauacacugagaacagagacacuguccauucuaaagugaucaugagucguuuguugguuuuguuuuguuuuguuuuuucuuugagacagaaucucacucugucgcccaggcuggagugcagugguacaaucucggcucacugcaaccuccgccuccuggguucaagugauucuggugccucagccucccgaguagcugggauuacaggcgugcaccaccacgcccagcuaauuuuuuguauguuuaguagagacaagguuucaccauguuucccaggcuggucucgaacuccugagcucaggcaaucugccugccuuggccucccaaagugcuaggauuacaggcaugagccacagugcccagccuguuggguuuugaguugggcauggggaagagugaaagccaaguguccccagaggguuaagaaaccuguuggaaggugacccuggguguaacuccauggugggccgcccgucucaacugcuguuugguuucagcuguccuaaggggaggacugacucugcagccugacaauacuuucugugauguguuacuauuggcaugccguuccaacuggacauugaaaauuugcagacaaauguagagauuugguagugacuaauuugcauugcacaagguguugguaguagugaacagcuugcuaugaagcccguauucaaaauuuggaaggaacaaacacuauggauaugcucaucucaccaaacuacccaaccuauuuuucuuucacuccuuuucuuugucuccuuauuauucugcugaucauuuucucuuugcaguguuucaaaugcuguuucucuuuucuuuucccgccuuccuuuuuucccuuccacuccuuuuuucuauaucaccuuucucucugcccccuccacuuuaucucgggucccacuucgccauugauuuuuuaccauucuuaaccccuuuccucuuuuauugagaaaauaggcuuuaaauuuggagugugcuaagaaaaugucgcuuuaugcugaaaaacugcaggauucagggacugcauuugugguguggcuuauugauagaagagaggcuaugaaagcuagugcuuacaagugauuuaaaggugacggcucagugucucagguggacgugauuauauugugggacagcuggguuccauuuuagcuugauauugaccucuccuugccauguaauuaacagugugccagccacagaucauaaagugagugccguucaaugaauaacaucauguacuggugccuggaguuuguuguacccaugggaccuagugggcauggggcaugccuggauaucuagccaggagugacacuuaagcucaauugcuggaugcuggauuacaagagcucugacaugcauccucagauagcccgcucgauacagauggcugaugaguucugaagcuucaugcugauguguccaggagcccaggggcaaacugacccuuuccucuuuaggcacaaugccugcgucggcuguuuagaaaucaucagaaaacauuuuaaucuuagggggcucgauuuuuggugauuaaacuagaccccuaaauagaguucucuaaaccccaaacacaaugaacagagauucauagugaaguagguuugccuccgugaaugaguguugcagugaaucucguccuuuucuuggcuuugguguuguguagugauuaacaaaaacgugagaugaccgcugggcaucuuuauaggaaaaaggaagugggaggguauuaagcauagaauggaugcucucauuugcuugagauguguaaaauaaguugggguagaauggggaagggcagaagacuaaagauuuaagccccccagucaugguuucauuuaauacguuaaggaauuugaugagguaauugggcagauucaaggcaaagagagagcagggcugaguaucagugaucuucagauaaucacuaagguauuauucaggacacaagccagaugacguuagcuucaccagaagaugggcugauguggccauggauucaguuaguaauucuuggaauugcuggggcuuggggcagccaccaccaugugguuuaucuuugucuaaccucacuaaagccagccgagcagacacugucuguuuggggcuuucagguuugggguggugguucucaguagaggcugaagaggaaagagagaccuuuuaaaaagaaaauauuucuuuucucuucucuauauaaguuuugagcuuaacaggcuuugaucaagaagaauuucaccuuggguuucuguuuugaguuacaucuccucaagacgcugccauggggcuggaggagaaggucagagagagggaaaacuuggacugugcugaaaccccuuuaggcucacuuauuuaguuauucacucagaaacagcagcauggacuaggagcuaucugugcuuuugcaauguagcuucacuacuuaauuugaaauaaauucccuuauaauagguccaauguauaauccgaggcagauuugaaauaacauucaaagaguuuuuggccaucuacuccauugcuuccuuccaucaguggggaucucugugacguggcuuguacucccucaaugguccuuuuucuuggaaccucacauggucacuuugggccagaagaugguauagcaugaauaagaagagguggccugcaguccuaggugcugguccauacuggccaggacagagaauacaggauaucacauagucucuaaauacaauuucaaagagugcaucucuagaguuaagugaguuugccuuaaauucugugcaguugcagaugauguaauccauuuauaaacauuuuauuaggcagauuaaauuaagauacaggaaaugcuauuucacauuucguugaagaggaaagucaagucuugugaacguuguuuacuauaacagaagguucuuacauauccaucucaacucaauuuucuuauuguuucaggauccgaguucccugcugacuucuacuccuugcacaguaaaaagucaaucugcuaggagcuugcugagaugaguaagagccgucugcuaguuaagggaaauuuggacucaaugaaaauagucaauggaaaccucuguuugcuguaucaagcaugcaguacuuauacccguacauggaacaaauuuuuuuuuagcuucaauguuguaaggaagauagcaauuuuccuucucagcguaacauauaaauguacuacuuggaaaucgaguaguuggcuugaguucuaguucugguauugucggcaauguacucgccuaagacaagcccuuugaccacuaucuauagacucuaauauccuaaucaagguuauuaguaccuucugauaguagcuuagcuccuccauuuacagcaaaucuuacuuuuucugcauucagcugaugaagucuaugaaagaauagcaggaauaauaagcuaguuuugguguuuuggccuuuuggauaggaaugcagggaggaaaugaaaugaaggaugucuugaaaugucucacuuagacuuucuuauguucagagaaauacagagagaacauuuccuagauauugaggguaaauuucucuucuugaacuaucuuaagugccucagaagaggacuucaguuugagaugacuuuuuuuuuuuuuuaauguaagcacagacaauucucucuccacccucaacccuuuacacaauuucugagaacagcgauuuucaacgaaggggaggaacagaaaugaaguugacaagagaagccaucuaaaauuaaaacucuccauauggaauugcuuuuucuuuuccuccagagaguguacucacucuaagucagcucugucuuugaacauuuucuuacaggauagucauuggaggcucugauaacuccuagcuucuauuauuguccagcuuguaucuuuuaaaugucaaaacuauguucuuccaaaugacaaauuuuuauuuuuaaaauauuuuuacuaacuuuacuuguauguugaacagauaauaguacaaaauucaaaaacaaaagacccaacuuggugaauuuuguugauuuuuagucuuuggauugaaucugaugguguuuagaaguugaugggguauaaguagcucucuaagcuagauccuuuauugcuucccaucagucuaaaauguauuagaagagaaaggcggccaggcgugguggcucacgccuguaaucccagcacuuugggaggccgaggugggcagaucacgaggucaggagaucgagaccauccuggcuaacauggugaaaccccgucuccacuaaaaauacaaaaaauuagcugggcaugguggugggcgccuguagacccagcuacucgggaugcugaggcaggagaauggcaugaaucugggaggcucagcuugcagugagccgagauugugccacugcacuccagccugggugacagagcgagacucugucucaaaaaaaaaaaaaaaaaaaaaaaaaaauagaaaggccugguuacaagaauaaacuaauggauaauuuuuagcuaauagcaaguuuaccuagaaaucagauauuuaaauacugcugcuguaucuauauuuuuauguccauauuuuauugcccaugacgccacugauugguagauacacauuuuauguacaacugagaaaaagaaaccuagccaguuaaacuauuucccagcaccuccuguuauuuaaaugaucucuuaggaaggaauugaguguaucuaauauauuuuuaaaauauauuuauugaaagaacucuucuggacuuaacgauauauaggcauuuaucauuuaacagucuuauaaacauauaaaaaauacaagaaaaauacaucagguaaguuuuacuccugaaacuucuguacaagaaaguuuaagucuucugaaucacuuucaacucaagacuucagugucucuauuuugccacgcaauuugcccuuugugcuauaaagaauauuggugaaauaguuuuaaaagaauuuuuuuguuuauuuugcauuaacaucuucuacaaaguuucugggaaaaauaaauuuauaaaaugaaaguucagccaggcauggugcccacaccuguaaucccagcacuuuggcaggccaagguggguagaucacuugaggccaugaguuugagacuagucuguccaacauguugaaaccccgucucuacuaaaaauauaaaaauuagcccagcaagguggcacaugccuguaaucccagcuacuugcgaggcugaggcacaagaaucgcuugaaccugggaggcagagacagugagcugagacagcgcugcuguacuccugccugggugacagagugagacucugacaaaaaaaaaaaaaagcaagcaaggaaggagaaagagagagagaaagaaaaagaaaaacaaagaaggaaauaaaagaguaaguuaguucacuaaugcugaguucuuaagcuguuuaccacugcaauuuugucauguuaacacaauucugacuguugcugggcuggaaauguagaggaacagaucccagcacuuccaaccaccauuuggugccuaggguuaguaacugcucugguauaucucaggguuuucauuacaguugcugagacccauucugcuaauucaauucaaugcugaauuuuuaaauauucacacaugaaaauugcuuugcgacugcuguccaucugacugcaauugaaagaugccauucauugugaaauucuacccaaauuuagaauuggaaauagacgaaaagaaaugugcaucugcgccaggcgcgguggcucacgccuguaaucccagcacuuugggaggccgaggugaguggaucaccugaggucaggaguuugagaccagccuggccaacauggugaaacccugucuuuacuaaaaauacaaaaaaaauuagcugggcaugguggcgugugcuuauaaucgcagcuacucgggaggcugaggcgggagaaucgcuugaacccaggagguggagguugcagugagcagagauccugccauugcacuccagccugggugacaagagugagacugucucaaaaaaaaaagaaaugugcauuuuagaguuaaugaaagauaaugauuaaauauaauuucuagaauuuuuaguguuucagaugagaauuguggacguucacugugcucguaagccaaaaugccaagucaaaagcaaaagcucuuccuguugguuccuaagugugaugauuggguuuucacauucaugugugacaugugccucccucaaaucuugugaugaugucggcacgugacccaucugacgugggaaaaaaagugaaaauguaaaaagaaaaagcaaaagcuugaaauuuugaaaugucuuaauuucuuagcgugauuauccccuucguuagaaugcucgcaaaucuuaacaauacauuuuuuucaggacaucuaaagugacucaauuugaacauuugaaguggcagguuaaaaaaauuuuuucccagggaggagccaagauggccgaauaggaacagcucuggucuacagcucccagcgugagcgacgcagaagacgggugauuucugcauuuccaucugagguaccggguucaucucacuagggagugccagacagugggcgcaggucauugggugcagugcacgaugcacgagccgaagcagggcgaggcauugccucacucgggaagugcaaggggucagggaguucccuuuccuagucaaagaaaggggugacagacggcaccuggaaaaucgggucauucccacccgaauacugcgcuuuuccaacaggcuuaaaaaacggcgcaccaggagauuauaucccgcaccuggcucggaggguccuacacccacggagucucgcugauugcuagcacagcagucugagaucaaacugcaagucggcagcgaggcugggggaggggugcccgccauugcccaggcuugcuuagguaaacaaagcagccgggaagcucgaacugguuggagcccaccacagcuccaggaggccugccugccucuguaggcuccaccucuggggacagggcacagacaaacaaaaagacagcgguaaccucugcagacuuaaaugucccugcgugacagcuuucaagagagcagugguucucccagcacgcagcuggagaucugagaaugggcagacugccuccucaagugggucccugaccccugaacccugagcagccuaacugggaggcaccccccaguaggggcagacugacacuucacacggcaggguacuccucugagacaaaacuuccagaggaacgauuagacagcagcauucacgguucacgaaaaaccgcuguucugcaaacaccgcugcugauacccaggcaaacagggucugaaguggaccucuagcaaacuccaacagaccugcaacugaggguccugucuguuagaaggaaaacuaacaaacagaaaggacauccacaccaaaaacccaucuguacaucaccaucaucaaagaccaaaaguagauaaaaccacaaagauggggaaaaaacagagcagaaaaacuggaaacucuaaaaagcagagcaccucugucuccuccaaaggaacacaguuccucaccagcaauggaacaaagcuggacggagaaugacuuugacaaguucagagaagaaggcuucagacgaucaaacuaugagcuacaggaggaaauucaaaccaaaggcaaagaaguuaaaaacuuugaaaaaaauuuagacgaauguauaacuagaauaaccaauacagagaaguacuuaaaggagcugauggagcugaaagccaagguuugagaacuacgugaagaaugcagaagccucaggagccaaugcgaucaacuggaagaaaggauaucagugauggaagaugaaaugaaugaaaugaagcgagaagggaaguuuagagaaaaaagaauaaaaagaaaugaacaaagccuccaagaaauaugggacuaugugaaaagaccaaaucuacgucugauugguguaccugaaagugacggggagaauggaaccaaguuggaaaacacucuacaggauauuauccaggagaacuuccccaaucuagcaaggcaggccaacauucagauucaggaaauacagagaacgccacaaagauacuccucgagaagagcaacuccaagacacauaauugucagauucaccaaaguugaaaugaaggaaaaaauguuaagggcagccagagagaaacgucggguuacccacaaagggaagcccaucagacuaacagcugaucucucggcagaaacucuacaagccagaagagagugggagccaauauucaacauucuuaaagaaaagaauuuucaacccagaauuucauauccagccaaacuaagcuucauaagugaaggagaaauaaaauacuuuacagacaagcaaaugcugagagauuuugucaccaccaggccugcccuaaaagagcuccugaaggaagcacuaaacauggaaaggaacaaccgguaccagccgcugcaaaaucaugccaaaauguaaagaccauugagacuaggaagaaacugcaucaacuaacgagcaaaauaaccagcuaacaucauaaugacaggaucaaauucacacauaacacuauuaacuuuaaauguaaauggacgaaaugcuucaauuaaaugacacagauuggcaaauuggauaaagagucaagacccaucagugugcuguauucaggaaacccaucucacaugcagagacacacauaggcucaaaauaaagggauggaggaagaucuaccaagcaaauggaaaacaaaaaaaggcagggguuggaauccuagucucugauaaaacagacuuuaaagcaacaaagaucaaaagagaaaaagaaggccauuacauaaugauaaagggaucaauucaacaagaagagcuaacuauccuaaauauauaugcacccaauacaggagcacccagauucauaaagcaacuccugagugaccuacaaagagacuuagacucccacacauuaauaaugggagacuuuaacaccccacugucaacauuagacagaucgacgagauagaaaguuaacaaggauauccaggaauugaacucagcucuccaccaagcagaccuaauagacaucuacagaacucuccuccccaaaucaauagaauauacauuuuuuucagcaccacaccacaccuauuccaaaauugaccacauaguuggaaguaaagcucuccucaucaaauguaaaagagcagaaauuauaagaaacuaucucucagaccacagugcaaucaaacuagaacucaggauuaagaaacucacucaaaaacgcucaacuacauggaaacugaacaaccugcuccugaaugacuacuggguacauaacgaaaugaaggcaaaaauaaagauguucuuugaaaccaaccagaacaaagacacaacauaccagaaucucugggacacauucaaagcaguguuuagagggaaauuuauagcacuaaauguccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacgcuucaaaaauuaaugaauccaggagcugcuuuuuugaaaggaucaacaaaguugauugaccgcuagcaagacuaauaaagaaaaaaagagagaagaaucaaauagacgcaauaaaaaaugauaaaggggauaucaccaccaaucccacagaaauacaaacuaccaucagagauuacuacaaacaccucuaugcagauaaucuagaaaaucuagaagaaauggauaaauuccucgacacauacacucucccaagacuaaaccaggaagaaguugaaucucugaauagaccaauaacaggagcugaaauuguggcaauaauuaauagcuuggccaaccaaaaagaguccaggaccagauggauucacagccgaauucucccagagguacaaggaggaacugguaccauuccuucugaaacuauuccaaucaauauaaaaagagggaauccucccuaacucauuuuaugaggccagcaucauccugauaccaaagccgggcagagacagaaccaaaaaagagaauuuuaaaccaauauccuugaugaacauugaugcaaaaauccucaauaaaauacugguaaaccgaauccagcagcacaucaaaaagcuuauccaccaagaucaagugggcuucaucccugggaugugaggcugguucaauauacgcaaaucaauaaauguaauccagcauauaaacagaaccaaagacaaaaaccacaugauuaucucaauagaugcagaaaaggccuuugacaaaauucaacagcccuucaugcuaagaacucucaauaaauuagguauugaugggacauaucucaaaauaauaagagcuauuuaugacaaacccacagccaauaucauacugaaugggcaaaaacuggaagcauucccuuugaaaacuggcacaagacagggaugcccucucucaccacugcuauucaacauaguguuggaaguucuggccagggcaaucaggcaggagaaggaaauaaagguuauucaauuaggaaaagaggaagucaaauugucccuguuugcagaugacaugauugaauaucuagaaaaccccauuguuucagcccaaaaucuccuuaagcugauaagcaacuucagcagagucucacgauacaaaaucaaugugcaaaaaucacaagcauucuuguauaccaauaacagacgaacagagagccaaaucaugagugaacuccuauucacaauugcuucaaagagaauaaaauaccuaagaauccaccuuacaagggaugugaaggaccucuucaaggagaacuacaaagcacugcucaaugaaauaaaaggauacaaacaaauggaagaacauuccaugcucauggguaggaagaaucaauauugugaaaauggccauacugcccaagguaauuuauagauucaaugccauccccaucaagcuaccaaugacuuucuucacagaauuggaaaaaacuacuuuaaaguucauauggaaccaaaaaagagcccgcauugccaagucaauccugagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccacauaucuacaacuaucugaucuuugacaaaccugagaaaaacaagaaauagggaaaggauucccuauuuaacaaauggugcugggaaaacuggcuagccauauguagaaagcugaaacuggaucccuuccuuacaccuuguacaaaaaucaauucaagauggauuaaagauuuaaauguuagaccuaaaaccauaaaaacccuagaagaaaaccuaggcauuacuauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaacccacaaaaugggagaaaauuuucacaaccuacuuaucugacaaagggcuaauauccagaaucuacaaugaacucaaacaaauuuacaagaaauaacaaacaaccccaugaaaaagugggcaaaggauaugaacagacacuucucaaaagaagacauuuaugcagccaaaagacugaugaaaaaaugcucaucaucacuggccaucagagaaaugcaaaucaaaaccgcaaugggauauuaucucacaccaguuagaauggcaaucauuaaaaagucaggaaacaacaagugcuggagaguauguggagaaauaggaacacuauuacacuguuggugggacuguaaacuaguucaaccaauguggaagucaguguggcgauucuucagggaucuagaacuagaaauaccauuuaacccagccaucccauuacuggguauauacccaaaggacuauaagucaugcugcuauaaagacacaugcacacguauguuuauugcggcacuauucacaauagcaaagacuuggaaccaacccaaauguccaacaaugauagacuggauuaagaaaacguggcacauauacaccauggaauacuaugcagccauaaaaugaguucauguccuuuguagggacauggaugaaauuggaaaucaucauucucaguaaacuaucgcaagaacaaaaaaccaaacaccgcauauucucacucauaggugggaauugaacaaugagaucaauggacacaggaaggggaacaucacgcucuggggacuguugugggguugggggaugggggagggauagcauugggagauauaccuaaugcuagaugacgaguuagugggugcagcacaccagcauggcacauguauacauauguaacuaaccugcacauugugcacauguacccuaaaacuuaaaguauaauaauaaaaaaaaaaaaaaagaacacuggcuuauacccuauaauaccugauauuuaauaauaaaaagaauuacaggagagaaaagucucuacacacaaacacacacaaaaauuuucccauaauaacucaaacauuuguuuuacuguaagaaauucagaggucugauuuaaggaugaccuucuaauugaaaagaggaaaagcaauggaaagauaucuguauuuguaacugaaacuggcucaaaucauagcuguauucuccuuucuuugaaauguguagaauuauagccaauggguuaagaaaaauuauuuaaaacuugaaaauaaggcaaccaaguagagcagcauauccuuucaaugucauauuggaacauuuuuaaaauaaauaaaccugaacaaggauuauuuauucaggagaacuucuuuaacuuuuguuuuuuacucuuaauuagagucuagacacugggaaguuguguguuaguguuuagauuuuuggcaguagaugucuaguggaaaaaagaacccuauguguuacacauuuuaggacauuaaccagcuuugcauguaaccuagcaauuuuauacuaaaauuuucaaaggcuagaaacaccuucuccaucagcucucuuuggaucagccuuauuuuuuugccgguuucuucauuauugaguugaguaaaucuugacauauauuuauucuguauuuuuacaaguccuguuuucaacuuuaaaaaauuuuuucacuuugucaagauucaaacgucucaagugaaauaguuacuacuugucauuaugguauauauuuguagguugacaagugcuccuggugguaguucauagugaucugcagagaugaaaaugcauguuuacgacguuuaaaaguagauugcugagccugugcaugacuuagacuucaucaagugacucggaugugauuagcaaaugauucuacuuguguggauggaagaguuucaggggccagagcuggccuugugcaaggaaucuagccagaacauuucagaagagccuagggaugcaguggugccccacgaggcagcuguucaucuuugccccuccagcaccuggugugggguuuuuuaagcucucaaccaugugugugguaguuuccuggaguuaccauccuuguccuucaggggauuugaggauuugagccucuuuuugcagaggcuccagaaacgcaagguugggucuucagaaugaucucuaggaaggaauugaguguaucagacauuaaauuuacuuaguuccaguuuacccccaccgugcacuuuuucuuaucucucucccucuuccauuaaucccauuuuucucccuccuuuccuucccuccuccccuuuuuuuuuguguugaccuauuuacaaacucaccucacuugagaugauguggaagauuacaucacgcuuaacauauauauauauauauauauauauauauauuugauuaccugaaggcuuucuauaaugccuuaguggaagccuuuaugguaaaugccaaucaaugaaacacagggaguagaaguuuccuguguauuugaauguugcauugaucaccuuaucuaguguaccuagccauuuucuuaagguaguaauuaaaguguuucauacuugaagugguuuagggucaugaguuuugaauugacagaauacucaaaguacagugcuguauuuucuuauguagcucauguaggucagcacucaaaagucagguaagauguugcugaaaguauaaaugaguggaaaacaagaaaggcuguuaaauucuuugccagagaaaucuucauaaauagaacaagugaccauccgggugggagacugaaaaugucuguuccugaauucacugagauagagagguagaauauccccacaauauuuugggggacuuuugcuucuuuaauucauugucugauuauguugauaaaaccccggggauggagauauguacaguucaacagucucaggaaggaggccccuuaaguacaauguuuaggggauucaagauaagugugggcucagaauggugucaggaaucagaacccuggagccagugagaaagccagacuucacaugaaugacaucugaagucuaguaagagcucaaggucaguugaugucuugaggggagccaggcaugguguaagaaccaggauuucuucaagagggaacuuuagaagaauguaguggagaaugcugacgccacuccagacugaaagcucauagucgacagcugccuccucacaagagcccaccugguucuggguccuguucacagcauuuucugggcaucaugucauuuaacccucacagcaggccagugagagaguaauacuauuacuuuccaguguuguaggggaagaaguggccuuagagaggugaacuuuccuucuaagaguaucaacugauauugaagcuugcauuggaacccagguuggucucucuccaccucugugcugccagucgugacccugugcugcccccuaugucugcuccucccaccuguugcaaguagccagccucuuaccugaugaagaccaucaggccugaagguccaggcucuuuggcuccugcagaaagcccaauuggggugggacaucuggucaugcagaagccacgugacuggugggcacaggacucccaggcaccuguucucucaagggugggcucuucuggggacauuugggggcuacuuaugauucuuuugagcuguccuuugacuuauuccuuccaaccuccaacauaaagggccacucagagaagcaguaccuauggcagcuuuaaaccgcccugcuccucugcuguucugucugacagcaugagaagccagcaaaagcuucuucacaucagggugccaguggggaaacaggaaggaaaagggggaauaagaaggaaaagcaugcuauuuucuacacaggggaggauuucauaccaauguguucagaaugguuuuacaaagacugugcauauaugcuccaggucuguucaggaaagauucauuuguggaggauugaaauguuccuauuaauauuucuuagagaaacagaggcaucuacugaauuucacaaaauguaauaugaaaacugaucuccaagggucagcuuuaauauuuuacuuccuucuucauuguugaaaauauauuucagcucucuuuuacauaccagcauacagcacagggagaagauagcauaaucacugugaaaguauuaucaaaugcaagcacgcauuugcauuuuuggcaaacaaccacuuuugauuuuacauuguauuguuccauaauauuuaaagcacaaaguccugaaauuaucaaaccuacuugaguuugcgauagucagauacuaguuucauugugcuuuuaauuaauaaaauguggauugucuaaauuaaaauuuucauuaugaaauauuuuggccauaagggaaaaaacagaauuaaaugguauucauguaugugccuaccacucagauuuuacagauacuaacuuugugcuguauuuucuucaaacgugacuuuauguugugacuauuaauaaaauagcacauuacagguguaguuguuguacagccccguucacguccucucuuccucccuuucuccuuucaugaggcugauguauauuaguccccugaauuauuauuauuauuauuauuuuuugagacagagucucgcugugucacccuggccggagugcagugccaugaucuuggcucacagcaaccucugccuccugguucaagugauucucuugccucagccuccccaguagcugggacuauaggugcacaccaccacgccuggcuaauuuuuguauuuuaguagagacggaguuuugccauguuggccaggcuggucuugaacuccugaccucaggugauccacccaccucggccucccaaagugcuggaauuacaggcaugagccaccgugcccagcccccugaaaguuuuuaugcuuugacaacaugguugugaaaauacuaagugaaauuuucuuuagagcuguauuuugaaguaacauuaucaauuuagagccauaagccuauucuuuuauuauuauacuuuaaguuguaggguacaugugcacaaugugcagguuugcuacauagguauacauguaccauguuuguuugcugcacccaucaacuugucauuuacauuagguauuucuccuaaugcuauccuccgccagccccccuacccacgacagccccagugugugauguuccccucccugugugcauguguucucauuguucaacucccacuuaugcgugggaacaugugguguuagguuuucuguccuugugauaauuuugcugagaaugaugguuuccagcuucauccaugucccugcaaagcacaugaacucauccuuuuuuauggcugcauaauauuccuugguguauacgugccacauuuucauuauccagucuauuauugauggauauuuggguugguuccaagucuugcuauugcgaauagugccacaauaaacauacaugugcaugggucuuuauagcagcaugauuuauaauccuuuggguauauacccaguaaugggauggcugggucaaaugguauuucuaguucuagauucuugaggaaucgccacacugucuuccacaaugguugaaccaguuuacagucucaccaacaguguaaaaguguuccuauuucuccacauccucuccagcaccuguuguuuccugacuuuuuaaugaucgccauucuaacuggugugagaugguaucucauugugguuuugauuugcauuucucugauggucagugaugaugagcauauuuucauauggcuguuggcugcauaaaugucuucuuuugagaaguguccauuuauauccuuugcccauuuuuugaugggguuguuuuuuucuuauaaauuuguuuaaguacuuugucaauucuggauauuaguccuuugucagauggauagauugcaaaauuuuucucccauucuguagauugccuguucacucugaugauaguuacuuuggcugugcagaagcucuuuaguuuaauuagaucccauuugucuauuucggcuuuuguugccauugcuuuugguguuuuuagucaugaagucuuugccaaugccuauguccugaaugguauugccuaaguuuucuuguaggguuuguaugguguuaggucuuacauuuaagucuuuaauccaucuugaguuaauuuuuguauaagguguaaggaagggaauccaguuucagcuuucuacauauggcuagccaguuuucccagcaccauuuauuaaauagggaauccuuucccuauuucuuguuuuugucagguuugucaaagaucagaugguuguagaugugugguguuauuucugagggcucuguucuguuccauuggucuauaucucuguuuugguaccaguaccaugcuguuuugguuacuguagccuuauaguauaguuugaagucugguagugugaugccuccagcuuuguucuuuuggcuuaggauugacuuggccaugcaggcucuuuuuugguuccauaugaacuuuaaaguaguuuuuuccaauucugugaagaaagucauugguagcuuaauggggauggcauugaaucuauaaauuaccuugggcaguauggccauuuucacgauauugauucuuccuauccaugagcauggaauguucuuccauuucuguccucuuuuauuuuguugagcaguaguuuguaguucuccuugaagaguuccuucacaucccuuguaaguuggauuccuagguauuuuauucuccuuauaguaauuugaaugggaguucacucaugauuuggcucucuauucuugguacauaggaaugcuugugauuuuugcacauugauuuuguauccugagacuuugcugaaguugcuuaucagcuuaaggagauuuuugggcugauacgaugggguuuucuagauauacaaucaugucaucugcaagcagagacaauuugacuuccucuuuuccuaauugaauagccuuuauuucuuucuccugccugauugcccuggccagaacuuccaacacuauguugaauaggaauggugagagagggcauccuuuucuugugccaguuuucaaagggaaugcuuccaguuuuuccccauucaguaugauauuggcuguggauuugucauaaauggcucuuauuauuuugagauacauuccaucaauaccuauuuuauugagaguuuuuagcaugaaaggcuguugaauuuugucaaaggccuuuucugcaucuauugagauaaucgugguuuuugucauugguucuguuuaugugauggauuauguuuauugauuugcauauguugaaccagccuugcaucccagggaugaagaagacuugcucgugguggauaagcuuuuugaugugcugcucgauuugguuugccaguauuuuaaugaggauuuucacauugauguuuaucagggauauuggccuaaaauucucuuuuuuuguuuugucuccaccaggcuuuggugucaggaugaugcuggccucauaaaaugaguuagggaggauucccuguuuuucuauugauuggaauaauuucagaaaaaaugguaccagcuccucuuuguaccugugguagaauucggcuguaaaucuuucugguccuggacuuuuuuugguugguaggcuauuacugccuaaauuucagaaccuguuauuguucuauucagagauucaacuacuuccugguuuagucuugggaggguguauguguccacgaauuuauccauuucuucuagauuuucuaguuuauuuguguagagguguuuauaauauucucugaugguaguuuguauuucugugagauugguggugauaucccuuuaucauuuuuuauugcaucuacuugauuuuucacucuuuucuucuuuauuagucuugcuagugguccaucuauuuuguugaucuuuucaaaaaaccagcuccuggauucauugauuuuuuugaaggguuuuuuuguaucucugucuccuucaguucugcucugaccuuaguuauuuguugucuucugcuagcuuuugaaguuuuuacuuuucucuaguucuuuuaauuguguuguuacggugucaauuuuggaucuuuccugcuuucucuugugggcauuuagugcuauaaauuuccuucuacacacugcuuuaaaugugucccagagauucugguacguugugucuuuguucucacugguuucaaagaacaucuuuauuucuacuuucauuuuguuauguaccuaguagucauucaggagcagguuguucaguuuccacguaguugugcaguuuugagugagguucuuaauccugaguucuaauuugauggcacuguggugugagagacagucuguuguaauuucuguucuuuuacauuugcuggggaguguuuuacuuccaauuauguggucaauuguggaauaagugcgaugucgugcugagaagaauguauauucuuuuaauuuggggcggagaguucuguaaaugucuauuaggucugcuugguccauagcugaguucaauuccuggauauccguguuaauuuucugucucguugaucugucuaauauugacagugagguguuaaagucucccauuauuauuuagugggagucugagucucuuuguaggucucuaagaacuugcuuuaugaaucuggaugcuccuguauugggugcauauauauuuaggauaguuagcucuuccuguugaauugaucccuuuaccauuauguaauggcauucuuugucucuuuugaucuuuguugguuuaaagucuguuuuaucagagaccaggauugcaacaccugcuuuuuuuuuuuuuuuuuuuuugcuuuccguuugcuucuuccuccaucccuuuauuuugagccuauaugugucuuugucuuugcacaugagaugggucuccugaauacagcauaccaauaggucuugacucuuuauccaguuugccagucugugucuuuuaauuagggcguuuagcccacuuacauuuaaguaauugguguuacuuaugugugaauuugauacugucauuaugaugcuagcugguuauuucgcccauuaauugaugcaguuucuuccuagcaucaguggucuuuacaauuuggcauguuuuagcaguggcucauaucaguuguuccuauccauguuuagugcuuccuuuaggagcucuuguaaggcaggccugguggugacaaaaucucucagcauuugcuugucuguaaaggauuuuauuucuccuucacuuaugaagcuuaguuugucuggauaugaaauucuggguugaaaauucuuuaagaauguugaauauuggccccuacucucuucuggcuuguaggguuucugcagaaagauccgcuguuagucugaugggcuucccuuuguggguaacuugaccuuucucucuggcugcccuuaacauuuuuuccuuccuuucaaccuugguaaaucugacaauuaugugucuugggguugcucuucucaaggaguaucuuugugguauucuguguauuuccugaauuugaauguuggccugccuugcuagauuggggaagcccuccuggguaauauccugcagaguguuuuccaacuugguuccauucuccccgucauuugcaggugcacuagucaaauguagauuuggucuuucacauagucccguauuucuuagaggcuuuguuaguuucuuuucacucuuuucucugaucuugucuucucgcucuuuuucauuaauuugaucuucaaucacugauauccuuucuugcgcuugaucaaaucggcuauugaagcuuguguaugcuucacgcaguucucguacugugguuuucagcuccaucaggucauuuaagcucuucucuacacugguuguucuaguuagcuauucaucuaaccuuuuuucaggguuuuuagcuuccuugugguggauuagaacaugcuccuuuagcucggagaaguuuguuauuaccgaccuucugaagccuacuucugucagcucgucaagcucauucuccaugcaguuuuguucccuugcuggagaggagcugcgauccuuuggaggagaagaggugcucugguuuuuggaauuuucagccuuucuguucugguuucuccccaucuuugugguuuuaucuaacuuuggucuuugacguuggugaccuacagaugagguuuugguguggauguccuuuuuuguugauguugaugcuauuccuuucuguuuguuaguuuuccuucuaacagacaggccccucagcuucaggucuguugcgguuugcuggagguccacuccagacccuuuuugccuggguaacaccccuggaggcuguagaacagcaaauauugcugccugauccuuccucuggaagcuuugucccagaggggcacccaccuguaugaggugucugucugcuccuacugggaggugucuucuagucaggcuacucgggggucagggaccugcuugaggaggcagucuguucauuaucggaucuugaacccugugcugggagaaccacugcucucuucagagcugucugguagagauguuuaagucugcagaagaugucugcugccuuuuguucagauacgcccugccuccagagguggaaucuagagaggcaguaggccuugcugagcuguggugggcucugcccaguuugagcuucccugcugcuuuguuuacacugugaacauagaaccgccuacucaagccucagcaguggcagacaccccucccccugccaggcuccagcaucccagguugaucuuagauugcugugcuagcaucccaaggaucugugggcgugggaccagccaagccaggcacaggagggaaucuccuggucugccgauugugaagacugugggaaaagcacgguauuuuggcaggaguguaccguuccuccagguagagucacucauagcuucccuuggcuaggaaagggaaaucccuggaccccuugugcuucccgggugaggugaugccccacccugcuuuggcucgcccuccauaggcugcauccacuauucaaccagucccagugagaugaaccagguaccucaguuggaaauguagaaaucacccgucugcugcgucaauaucacugggagcuguagaccggagcuguuucuauuuggccaucuuggaagugacccguaagucuauucuuaaagucauuuuucugugagauauaauucccgaagugccuacuuguuggaggagguugagguuaguauaauuacuaucaaaaaauacacuuucagaaauugguuccagcuuuuccugccccucacuccuucucugagcagcuugauggauccuuccccacgugugucccuuauagguguccgcuccggcagauaccccuuggagacauaugcagagauaacuaccauuuguuuggauuuugcuccaacacaaccagcuuauacacauuauacaaaaacuugcuuuuuucauuucucaguucaucaugaacaugcucacaucuaaguagauugauaaucuggugcuuucuaauauauuuacauagaaguuuauaucgcaaauucuguuccuuucauuuucuucuuuuuuaaaccagagccuuuucuccuuaacuucacuaaaugaagcuaccccucucuuuuucagccucccuucuuuccggugcugaguguuagccaucugaguguaugcuucccaccauuucuaaaugcuuuuacgaucguguguauacaugugcacaugcacguacacacucauccacacacaugcacacauagguauauuugaucauugcuguacaaaaacgggaucacacuugcuacauucuauaaacuaaguggcuguuacuguugagguuugaaaaacauaaaaaaaaaaaaaaaagccccaacauugcucaaggugccagaacauaccugggagauccagaccucucacccagguuuucucaggcagucacuuucucugcacccagcuucaaaugaagaccagucccacacagcccuggcagcucagggcagcguucgugggccaggccuucccaaccucugcuuuggguuugcaggagaacagccaccuccuaucauccagauuucaggcaccgcuuccucugauauccaaggucauguuagacuguaccuggaaccaugacugcaugagguucacaaggacaccaaagcuuuauuuuuuauuuuuuaacauaguaguuuuugacuccaucuaaucuguuugcuaagguuaggggcaauguggcauucacaugcuauuuaccuaacauuuccaauacuuucauccuucaucaagguuauuacuuuucugguuggcaauggacucaaauccucauucccaaaagcuuguucucagggcugggaaaggcacaguugcucuguuggcaggugggcagauuuccaugggcuaaaacaaaacugaagcagaagucaccguauuucuguugcuccugacccuugacagagaaagagaguggaaaauuucuccucgguauuuguuagcuuuaucguggggugucacacgaugcauuugaaaaaaguuaauuugaaauuuuaauuucaacacugauuuuuaaaccagaacuauguccaucucucuugucuuuuuauccucagcucuggcugauucccgcuggaauuauuuccaauauguucuccagaaaaccaucuccugucagaaacuuucaggaucacaggggccgaaugcgucuguuuagcuauuagguugaaucauaugauaacauuacauuuuuguacgucaaaaauggccagauagugucacuuaagugguucaacccaauauguuuacccugaauauuuacaggucggaaggcuugggagcuagaaggccccauuaggauuuuguuacccaguucucaauauuuacaggggaccaccgggagccggccuaauugcccaguuggugaugaauugauucaccugugcugaagccguccucauacagucccccugacgaacugugaaguguagugugaacggucaggcuccaggagguguaggcuucaaggauuacaauaaaggauggggguuuuuuaaagcccagagggcuauucccuggcaggaaaggaaaguugggcaaacacccuggaggggcccaaacccaagagaccucaggaccugagauugccccugacucugaggauucaaaucagacagauccucuuccuggccucuucuauccacacccuagucuccccacacuguuugaaaugaugugggcagaaugcaggccacucacacugacugcagagggcugacuugggcaggugggcaugagccuuucugcccagcgugagucccucuggcacagcuggaugcugaccugcagggaggcgcuucagcgaguacuugagcagggucgaggaugagaagccaaacuguuucucauguucuccugcaaaaugaauuuauuuccuuguuagagaacagugggcauaccccuagucaaauauaagugaaaaucgaugcaucuuuauuuacaaaaaguuagaaagauauggacagauagaaaaaaauuaccugucuucccaccacuacaaaucauuauuacuacuacuuuggcaaauuuccuuccagauuuuaaugcauucaaaaaauacauaauuaugcuaagucuuugucuugauacugcuaauccauguauacuuuauauaauaauacauagaaaauauucuauauaaaacauauauugacaaggacuauauacuacuauagagauuguauacaaaauacaacuagcaugcauuuuauauuucuacccuuuucauucaucauaaguaaauacucuaugcacauaaauguugcauaguguucccuacagucgauuuuccaucauguaguuaacaauuuuuuuuuuuuuaguguaguaguuaaguacguggacucuggacgguuggguucaaaugucaacacacugauugugugaaugugggcaagauguuuaaucucuguuugucucagucuguuaaucuuuaaaauaggucuaagaguuauauguagccuguuaaagaaaaaaaaaaaaagaauuccgcauagccuguuguaaaaaagagaccaaagucuucagauguugccauuuauaagaaguauauugaagggagguaagcuauguuuaccagccauggcucagaucccuagcaugucaaaauuagauguugucuuuuaugucugaauauaucaaaggccccaucugagguuugccuuuaaaaaaaagaggagaagaaauuuugugccuaagacacaaaauuugggcauugagucacugugauacuagcuggcaggggaauggggaccuucuagccaugagcuaagguuacugaaaacauuccuuucaacauaacauuugcaggacagauaauuuguugagugagacauuugggagucuauaaaaucauuacaguauccaggggaacaaaacauuaaacauuuacaaaggggccacuguguuguucagggagcaaaauauuagcauuucuuuguuaauuaagauuuugaacuuuugauuaaggaguuuuuaacuuuguacaaggacugauuuucugauuaauucaugggucgcugggaggaucaaacacuuagaacaagagucugcaaauguuucccauaaagggccagguaguaaauauuuuuaaguuuugugagccauaugcaaggcugugucacagcuucuggauucugcucccugaugugaaagcagccacagacaguaugcaaaucaauaaguaugacugaguuccaauaugacuuuuguuauggaugcugaaauuugaauuucaugucauuuucacaucacagauuuuuuucuuuugauuaaaaaacuauuuaaaaauguaaaagaaaaaacauuuuagacucucaacuguacaaaaagcauuuggcuccugggcuguaguuggcuaaccccuggcuuagagcaguacuuggcacuagugacugcuauguauguguuggcuccuacccccacaauugcagcuguuguuaucaccaucgucaccaucuacauccuucugcuauuauaaauaaagcacugaagaacaucuucagggagaaagguuuuugucccuccccugcuuuugcaguuacuaacugugcugcagcccuaugcuagggccagauggugcuagguucuggagaaaucucugcaugccuuugacuuccugggaguccauguguaacagcugcagcuugaucagcuccucacuucaccauggcagagagguuuccccucccaugcugauggucguuccucaccagaggcugccuggaaagcugugcugggcuccaggagaaugggcuucaugauggauuaucaagacccaccuuggagugauguuugcacaugugcuguguucuuuguuggacaucauagccugugcucucccuggggaugaaugaaaaagggagacagagaugccuacuguacaugacauguauuuaucccuuguuuuaaagugacgagaggugggagaaagggggucauaaaaggagugguacaaggaggagcugggaaguaagggaagaaagaauaggacauuguugcuagaaugagccaugauaucuggauuguuccaaaucccccaugcacucagcugaguagaaaaauugcaaauaucuuuauaaaccuugacaauacuauuucauuauucauaaagacuuuuuuaaaaaucauaaccagcuucaauuuuaaaggaaauuuauucccaaagcauuuuuuaauugaguuuuuaugguaauucuuuguauugacuguugaaucaacauaccaaauaaaauauguuccaguguuuucuuuuauucaggaagucuuaauucugcuucuucaaaauaaugaaguggcgagagucaauucagauuuucaugaauuacauaccuggcaguacacggccuuuucuaagaguaaauuuaaaagaguauuauuuuuuaacuaggaaaguuugccuuaaauucagaaucguugguguaugaucuuucauuguguuuuccuguguaauuuaugagugugugugugucuuucuguauuguuaagacuuuuaauaacucacuucugaaauagaaguuacuugaaggcagguacuauuuuuguuuuaaacacaucuuuggaugaaauguaucauuucugucuugcacagugccuugcguaguaguggacguccaaaauugugugaugagaagaaggaacucuagggguugcaaggcaucuagugguuauuugccuuucccuucccuagacagugucucugcuguauacagccagcccugacuacaguauugcucaggacaaaaucuucucugcuauuccuguuucuguaguggcacagaauacugucaauacccuuucagaugccugaagacguuguuaguccaacuaacaacggaaguuaguacaacuuccaucucaguuaaucacugcaccucacacaccuuucuuuuuauuuccugggcuaaauaacuggcuuuuuuuuuuuuuuccaacuuuucugacaugccucucuccucugauauaucugcuucuuucuggccacucuugugugcacgauuucuuguguaucaggaacuggguugcauuguggccugcagacugugcaucguguccacaugugaccugggcagggcccaguccaguggaaccucuucuguucuuguugugcuaauauuaauaaaacccaacauggcauagccuucuggcugccacaugaaguugacuccucuuggacuuguuggcagcuccaacucuuaguugauaaauugaacggucauggacucugcuugguuucagaacauuuucagggaggauauucccuuagugacacuuggagguggucuuagagcuucauugaaccugggguaucacaccagggguaaaguuguggaguuguccagcccagagaaacagagccaaggcugggaccaggagguagcaggugggugaauggaaugagagagaugagcggaaguguuaaggaggccaggcaaagagaagaggauguccaucagagagggagguacacuggggaauccagggggcuuagaaucuauuggccuagaucccuagcaucuuccuggguguuucuuucaugaggcaccuuugugccucaccuuaaagaaucaaauuuuaaugaugaggagcugggauaucaugaauuauucaugagccagauuucccuuaaucucuagacaugugcuugaauuucuaaaacucuuuuuuaugggacuucacauuucucugauuaaauuucuucuugcuaauggaccccauauuccuagucaccaaagaccuuuugaaccuaaaggggaaaaaagcugcagaauugaaguggugacucugccacuuacuagccauugucuugcccaaguugcaaguucugaccucauccauaggaugagaaccauaacagguaccucgucacuuguuuuguugggugguugggaagauaauuggaauuuugcauuuggagugccuggugugaagcccaucaguaucagugccaacaccuugucacaguuauuuuucugcucucaggauauucaccaugucucucucuuaggucagguuugauagacugucuucucuguuuucauccaaucuauugauucuuauuaauaaauuccuguuacauauggagagggaccaacagcagaaucugaagauuccuagaggcuacuuguaaggaucuuugggacacugguccauguuggggguuacaaagucagaggccuucaacagccucauuauucaaauguguaagcaaccaggugaggagagagugguggggcccaugucaacucaaagaauguauguccuaucuaaagcagucauuucacuaagagucacugcccaauccaacaccuaguacagggggagucaagggcaccagcuccaugggcugcugugaauagcucccuaacaugcgcuugcauuugguuaauguggcuuuggagcagugguucuuauaguaugguccagaagccaucggcagcaccuaagaacuuguaugaaugcacauucuuggcuccauuccagaccuacugaaucugaagcucuugagguggggcccagcaaccugggguuuaacaggcccucuaggagauucugauauucuugagaaugauuuggaaagugguucucaaccuuggaaggacacuggaaucaauguucuggggagcuuuaaaaauccaaccgccuggcucccaaccacagagcuucucauugaacugauuugggcuagaaccuggacaccaggauuuuuuuuaaagcuccccaggggauuuucaggugcaucuaagacagagaacugcuguucucaggagcuuauugaaacacccacauauucauuucuccugggugaagaggugaggagagggaggcauguaucauuugacagaguuccuagaugaccucuuuuccccuuacagaacaugaccuugaaccaccagccucaagaaauagccuugaauagggcuuuucauagauuaagugaauauucacucaaugugauuuguuuuaaagguugcuuuuaaugcuguauuuguucagcaaauguagacgcuauuauaacacaaauauuaacuccugaauccucaaaggcuuuccccacgcuaugccaucuggcaagcauuguuaucaucaucucuuuauuauccacgcuaauaaaggacuagcauggcacugguaauugaaaaacacguaucauuuaaaaaucauucaggcuagugccaguacuguuuucccaaccaggaagcauucaagaguagaaauauugccugauuacaguuugcuacuucccugcggaggugcuaauacauauuauuuuagugagaaauuugagucauuggagugagaagcuucuaaauuauaauuccuguuucugaauaaagggguuuguuuuauugacaagaguccugagcacagagacaaggaacagcaaguauauuuaaaaugcaugugcaccugggaaccaguggauuaaagcgugauauaauauagaagcugcauggggauuugaggaaugguagaucuggauucuagaucuccugacauuaccugugucauuugagaugagcuauccucucuaccagugggucucaaagaguccucaacuagcaacaucuguaucaccuggggauuuauuagagaugcagauucuuuggccucaccccaggccuacuggaugagacuugggguggggccagcaaucagugcuuuaacaaguccuccaagaaauucagaugccugcucaaguuugagcacugcuacucuccaccaggggcucaguuuuuuugucuauaaaauaagaagaccagccuagauuauauuuaagguuuacucuagcucuccaguggccaugguguaugggcacagaauaaguuuagagauuuucugucuuagagcuuauauuuucccuuggaugugugauugaaaucauuccgcugaaaaacugacaggcagguaacagaaaagaaacugauuuccaggaacuagauacucagacuagauacccaaacagcgccuugggugcucacuacaaaauaacucauaauauuuucagcugguugguacuacuuucccaaagugaaaaaacucugguguuuuggaaagggaaguagccaucuccccuuucucuaggggcugagagcugucugcugugauucacagagcagcauuucaacagaaacuaacaaauggcauuucagaaggauguacagagguacacaggcuuugcaguaaaacaagggaaaauuucaagccauuuaucaaagccccugcagcuuccauuucaagacagguggaaaaaaauaacauggaacaagaaaagaaaauaaaucuguauccaaagcaucucauaaauaagaaaggagugggggaguugcugggcuugcugggcucucagaguauuuuugucacaguacagaaagcuuuuaaauguuuuggcgugaaauucuuuuccuuuucuuguuauuaaaauuugugguuguaaaauuauuucacuggcuauuaaaaccaaaaaaggaaagcugagaaaaugauacguggagugagagagagagagagagaaugagaacauaguucauucuguaccccaaaauauuuuuuauuuuuaucugaaauguagugaugcuccauaauuuaggcacgucauugaaaaucaaaggcaauuuucuaauuggcuuuuguucaguaagagccuauuugcugcagaaaauuaggaugugguuuauugaacaugagagagacaugggucuguuauaaugucugaggggguggagaaauuauaacuuuuacuaaaaagauaggccagucgcgguggcucacacuuguaaucccagcacuuugggaggccaaggcggguggauuaccugaggucaggaguuugagaccagccuggccaacaugaggaaacccugucucuacuaaaaauacaaaacuuagccaggcauggugacgcaugccuguaaucccagcuacuugggaggcugagacaggagaauugcuagaacccagggggcagaggcugcagugagccgagaucaugccacugcacuccagccugggugacagaaugagacuccaucucaaaaaaaaaaaaaaaaaucgaccggcugcaguggcucacaccugcuguaauccuagcacauuaggaggccaaggcuggcaaaucacuugaggucaggaguucgaaaucagccuggccagcauggugaaaccucaucucuaccaaaaauacaaaaauuagacaggcaugguggcaggcaucuguagucccagcuacucaggaggcugaggcaagagaaucgcuugaaccugggaggcggagguugcagugagccgagauugcaccacugcacuccagccugggugacagagcgagacucggucgcaaaaaaauaaauaaauaaaaagauggaucucaggcccacucugccagagggaauaacguugauugaggagaaccugcauugaacaucuuugugaaauucccagcaauguuggguuguugaucaaccugguuaaaagcccaugcucugaguucacagucuggcuuugccacauaacuggcucugaaacuuugggcaagcuacccaauugucagugcuuuaguuuccuuugggggauaaugacagcaucuacccggugggaguuuugugaggauuaagagcuccauaugcaagacacuuugcgcaaugccuggugcauagcaggcauucuuuuauugagacuauuugcuaauuagucacguaguucuuuaaaggaacccuaaaacucaauuacuuuguuuuuuaacuguaaggauuuuuugaaaauagcaaaugaaugccuguggaggggugugauugauaaaaggaggcuugaaggacauauugggugcaaaauucaaagaagauugauaacucuugagccaugggaucuucuccuccaucagcuucacuaacauauagcuuuggggaauuguuagaauuagguucagagauacuaauuuuuucccacuagauuuccuuucuuacguauuuauuuuugaaacucauauagcaacacuagaaauaggucugaacuaaguaucauguguuucucuuuuacauuuggcuccccuccugugucagcuggccuaugaugcacaguggcuaauauugauuagccuacauuuuucuuaaauacaguuuucucagucuauguaaagucuaaaugcuagcaguaccaaaauaaacgcauucaacuucuaaacuggugguaaggaaaaaaguaggaacaaaacauaguugagacauauuguccaaugaaaucauugccugugaugccacagccaggugugaggucuggggcaagcuuccaaacucaucugagcggcaguuuccucaucaguagaaccgggauaagaauagcaccuaccaggugugagauuuaauacauguaaaguacaaaauagugcuaacacccagaauguacuuagcaaauguuaacuucuuaaauguuacuuguguucaugagaauccaauguaucaaagugaaaauaaucaauuuguguguaauggggaggaaguuuuacuauucuuuacuaaauaacuaaaaacauuacaaaauauuuaauggcaaguuacuuuuuagacuuaaucucuggucauuuauuuccaauuaagacuggaccccacuguauuugacaugcggaaugguuuuuauuuuuguuacgaucauauuuauuuugagauguauccuucuuaucauuaguagcaguucucuaguauuuuaaaaacuuuccaacauuggaauaaaugaaucaggauaaaaugcuaaaauaaaauacucaaaucauugcacuuauucaaccucuaguuguggacagcgaugcucuuuaaacuguggacuguggccaguaggcagcacuacucucucauaguuucagauauugccuauuagcuuauaaacaaaauuucagaucagcauggguaagacaguuuagauguauucuugaauaauguagaaaaguguggguuguuugauccucaaacaagugaacagaaaggccuuccagcaccaaaguuagaaaaaaaauugccuuuaaccaaaauugcccuggagaaacagagauucaugcuguuuauccagggacaaaaugaaaguauguuauuucauacaaauuaucuggaucaugaggcaaaagcaguuuucuuucauaccucuuuaacuuuucuuuuucaucuguuuaaccugugggaaaaacaacuugucuuaaauuauucaccauuuagaucugaauuuuuaaauuuucuuauuuucaguuuuuuuugguuuauuucaguaggguuuuggagaacaggugauguuugguuacaugaauaaguucuuuagugaugauuucuaagauuuuggugcaccugucacccgagcaguguacacuguacccaauguguagucuuuuaucccucaccaacccccauucuuuccccuaaguccccaaaguccagugcgucauucuuaugccuuagcucccacaugagugagaacauacgauguuugguuuuccauuccugaguuacuucacuuagauuaacagucuccaauucccuccagguugcugugaaugccacuauuucauucucuuuuauggcugagucauauuccaugguguauauaaauaugccacguuuucuuuauccacucauugauugaugggcauuugggcugguuccauauuuuugcaguugcaaauuguacugcuguauacauguguuugcaaguaucuuuuucauauaaugacuucuuuuccucuggguaaauaccuaguagugggauugcuggaucaaaugguagaucuacuuuuaguucuuuaaggaaccuccacacuguuuucuauagugguuguacuaguuuaccuuccaccaacaguguaaaaguguucccuuuucacugcgucuaugccagcaucuauuguuuuuugauuucuugauuauagccauucuuauaggagucaggugguauugcauugugguuucgauuugcauuucccugauuauuacugauguugagcauuuuuuccguaugcuuguuguccauuuguguaucuuuuguugagaauugucuauucauguucuuagcccacuuuuuggugggauuguuuuuuucuuacugauuuguuugaguucuuuguaaauucuggauauuagucuuuuggucagauguauagauugugaauauuuucucccauucuguguguugucuguuaacucugcugauuauuuccuuuucugugcagaagcuuuuuaguuaaauuaagucccuucuauuuauguuuguuuuuguugcauuugcuuuuggguucuuggucauuaagucuuugccuaagccaauggcuagagggguuuuccagugucaucuucuguaaucuuuaugguuucaggucuuagauguaagucuuuuuuuuuuuugagacggagucucacucugucgcccaggcuggagugcacuggcgccaucucggcucacuacaagcucugccucccagguucacgccauucuccugccucagccuccggaguaguugggacuauaggcgccugccaccacgcccagcuaauuuuuuguauuuuuuuuuuuuuuuuaguagaggugggguuucaucauguuagccaggauggucucgcucuccugaccucgugaucugcccaccauggccucccaaagugcugggauuacaggcgugaaccaccaugcccggccuuagauuuaaguauuugauccaucuugaguugauuuucguguaaguugagagaugaggauccaguuucauucuucuacauguggcuugccaauuaucccaacaccauuuguugaauaggguguccuuuucccacuuuauuuuuuuauuuucuuugucaaagaucaguuggcuguaaguauuuggcucuauuucuggguucucuauucuauucuauuggucuaugugccuauuuuuaaaccaguuccaugcuguuuugaugacugucgccuuauaguauaguuggauguugaguaaugugauaccuccagauuuguucuuuuuguuuagucuugcauuggcucugugggcucuuuuuugguuccauaugaauuuuaggauuauuuuuucuaguuuucugaagagcaguggugguauuuggauaggaauugcauugaauuuguaaacugcuuuugacaguauggucguuuucacaauauugauucuacccauccaugagcaugggauguguuuccauuuguuuguguugucuaugaugucuuucagcaguguuuuguaguuuuccuuguagaggucuuucaccucccugguuagguauauuuuuaaguauuuuauuuuuuugcagcuauugugaaagagguugagugauuugauuuucagcuugaucacuguugguauauagcagagcuacugauuggcauacauuaauuuuguauccuaaaacuuuacugaauuuauuugccaguuuuaggagcuuauuggauaagucuuuaggguuuucuagguauacaaucauaucaucagcaaacagugacaauuugacuuccucuuuauugauuuggauacccuuuauuuauuucucuugucugauugcucuggcuaggacuuccaguacuauguugaauaguggugaaagugggcauccuugucuguucuaguucucagggggaaugcuuccaccuuuugccuauucaguagaauguugauggugaguuuguuguaaauggcuuuuauuaccuuaagguauaucccuucuaugcagauuuugcugaggguuuuaaucauaaagcgauguuggauucugucaaaugcauuuucugcaucuguugagaugaucauaugauuuucguuuuugauucuguuuaugugguguaucacauuuauugacuuauauguguuaaaccaucccagcaucccugguaugaaacccacuugaucaugguggauuaucuuuuugauacgcuguuggauuugguucacuaguauuuuauugaggauuuuugcaucuguguucaucagugauacuggucuguaguuuucuuuuuuuaugauguccuucccugguuuuugguauuaagaugauacuggcuucauagaacgauuaagggaggauucccucucucucuaucuuuuggaauagugucaauagauugguacuaauucuuacuugaaugucugauagaauucagcugugaauccaucugguccuggacuuuuuuugguuggaaauuuucuuuauuaccauuucaaucucacugccuguuauuggucugcucagagauucuauaucuuccugguuuaaucuagaaaaguugcauauuuccaggaauuuauccaucucuucuaggcuuucuaguuuauaugcauaaagguguucauagaagccuugaauaaucuuuuauauuucucuaguaucaguuguaauaucucccauuuuguuuccaauugagcuuauuuggaucuucucucuucuuuuuuugguuaaucucacuaauggucuaucuucuuuuuuuuuuuaucuuuucaaagaaccagcauaucguuucauuuaucuuuuguauuuuuguuguuguuguuguuuguuucaauuucauuuaguucugcucugaucuucauuauuucuuuucuucugcuggguuuggguuuggauuguucuuguuucuccagguccauguuugugcucuuucagacuuccgauguaggcauuuaauccuaugaacuuuccucuuagcacaaccauugcuauaucccagagguuuugauagguugugucacuauuaucauucaguucaaauauuuuuuuaauuuccaucuugauuucucuguugacccagugaucauucaggagcagguuauuuaauuuccauguguuugcaugguuuuguggauuccuguuggaguugauuuccaauuuuauuccacuguggucugagagaguacuugauauaauuucaguuaucuuaaauuuacugagacuugggccaggcacaguggcucacgccuguaaucccagcacuuuggaaggccgagguggguggaucaccugaggucaggaguucaaaaccagccuggucaacguggcaaaacccugucucuacuaaaaauacaaaaaguagccaggcaugguggcacguggcuguauucccagcuacucgggaggcugaggcaggagaauugcuugaaccugggagguggagguugcagugagcgagauugcaccacuguauuccagccuggugacagagugagacucugccuccaaaaaaaaaaaaauuacugagacuucuuuuguggucuaucauaugaucugucuuggagagcauuccaugugcugaugaauagaauguguauucugcaguuguuggguagaauguucuguaaauauccauuaaguccauuuguuguaggguauaguuuaaguccauuguuucuuuguugacuuucugucuugaugaccuuucuagugcugucaguggaguauuaaagucccccacuauuauuguggugccgucuauaucauuucuuaggucuaguaguaauuguuuuauaaauuugggagauccaguguuagaugcauauauauuuaguauugugauauuucccuguugggcuaguccuuuuaccauuauauaauguccuucuuugucuuuuuuaacugcuguugcuuuaaaguuaguuuugucugauauaagaauagcuacuccugcuugcuuuuguuguccauuugcauggaauaucuuuuaaccuuuacccuuuaccugaaauuuaugugaguccuuauguguuaggugagucucuugaaggcagcagaaacuugguuggugaauucuuauccuuucugccguucuguaccuuuuaagugaagcauugaggccauuuacauucaaugcuaguauugagaugugagguacuguucuauucauugugcuauuuguugccugaauacuuuguguuuucuucauuguauuauuguuauauacacaacauguauguauugugagauuuaugcuuuaagguccucugagauauaugcuuuaaggagguucuauuuuuuucuuuuuuuuuuugaggauuuguuucaagauuuagagcuccuuuuagcaguucuuguagugcugguuugguaguggggaauucucucagcauuuguuuguuuggaaaagacuguaucuuuccuucacuuaugaagcuuaguuucacuggauacaagauucuuggccgauaauuguuuuguugaaggaggcuaaaaauaggaccucagucccuucuagcuuguaaguuuucugcugagaaaucugcuguuaauuugauagguuuuccguuauagguuaccugauacuuuugccucacugcucuucagauuuucuuuugucuuaacuuuagauuaccuguugacuaugugccuaggugaugauguuuuugugaugaauuuaccagguguucuuugggcuucuuguauuugguugucuagauuucuagcaagguaauugagggaguuuuccucaauuacucccagaaauauguuuuccaaacuuuuggauaucucuuuuuccuuaggaacaccaauuauucuuagguuuggacguuuaacauagucccauacuucuuggaggcuuuuuucauuuuuuaaauucuuuuuucuuugucuuugacggauuggguuaauucgaaagccuugucuuugagcuuugagguucuuuauuuugcuugcuaauucuacugcuguuacuuuccagugaauuuugcauuucucuaaguguguccuugguuuccagaaguucugauuguuuuuauuuaugcuguuucacugaagaauuuuucuuucauauacuguauccuguuuuuuauuucuuuaaauuggaccucaacuuucucugccgccuccuugaguaacuuaauaauccacuuucagaauucuuacucuggcaauucagauauuuaaucuugguuuggauccauugcugguuagcuaguaugaucuuuugagauauuaaagaaccuuguuuugucauauuaccagaauuguuuuucugguucccucucauuuggguagacuaagucagagggaagaucugagacucaaggacuacuguucagauucuuuugucuuacagggugcucccuugaugugguguucucccccuucuccuaggaauguggcuuccuaagagccaagcuguagugauuguuuuugcucuucugggucuagccacccagcagagcuacccagcuccaugcugguacuggcaagugucugcagaguccugugauaugaucggucuucaggucuugcagccauugauaccugcaccugcuucaguggaguuagcaggggagugaaguggacucugugcggguccuugguuguguuuuuguuuagugugcugguugccucccagggagccugcgguggugauccaguuccuucaaagggucugugaauuaucucagcuuuccugguauguuccugcgguuguucuuggaacaaaaguucaugauguaagucuccacaugcuacucuauccuuccaaauggaagcugcaacuaguccuuccuccuauccaccaucuuggaaaaacuggcagaugugcauuuucaggauaguuccuggucauuguuuucaguaauuaauggugaagaguagauugcuaaucuuaguaagaaucuagugauguuuuugcugggugaucucaaguagauggagaguucagaucagcccggccuucuccucuuaggcauauuuguaacuauuuuuuauuuggguaaauuuaugggguacaaguauaauuuuuguugcauggauacacugaauaguggugaggucagggauuuuaguguauccaucaccuacauagugcauuguacucaguaaacaauuucucaucaucccaccaauucccagccuucugaguuugcauugucuaucauuccacacuccaugcccaugugugcaaaucauuuagcucccacuucuaugugagaauaugugacauuugacuuucuguuucugaguuaugucacuuaaaauaauggcuuccaguuccauccauguugcuacaaaagauaugauuucauucuuuuuuuaugaccaaauaguaucccauuauguguauguacuacauuuucuuuauccagucauccauugguggacacauagguggauucuauaucuuugcuauugugaauaguacugcaauaaacauacgagugcagaugacuuuuugguauaaugauuucuucuuuuuuuuuuuuuuuuugagauggagucuugcccuguugcccaggcuggagugcaauggcgugaucucgacucacugcaaccuccgccucccagguucaagcuaaucuccugccuccaccucucgaguagcugggauuacaggcgcgcgccaccacacccagcuaauuuuuuguaucuuuaguagagacaggguuuuacuauguuggucucaaacuccugaccucauaauccaccugccucagccucccaaaauggacuacaggcaugagcuaccaugcccagccaauuauuucuuuuccuuuguguagauagccaguaauggaauugcuagauuuaaugguaguucuauuuuuaguucuugagaaaucuccauaguguuuuccauagagguuguacuaauuuacauucccaucaacaguauauaagcauuuucuuuuuucccuuuucuugccaucuguuauucuuugucuuuguacuaguaaccauucugacuggugugagaugguaucucauuguaguuuucauuugcauuucucugaugauuacugacguugagcauucuuccauaugcuuguuguccauuuguaugucuucuuuugaaaaaugucuauucauguccuuugcccacuuuuaaauuggauuguuuuuuguguugcugagguguuugaguucugcauaucuguagcuauuauuuaaucuuugggguucuguguguuguguguggugacccuaaagaccagacaggaagguucucagacuuccugagagcaggcagaugucaggacccuguggauaucugaacuuuauccagugucugugcucagaggccuguggacuguguagcccuggacaguucacaaagcccaucaauguauggggcuguauuuaaccucccacguaaggaugcggagucaagguguggguaggucgugguuuccuuggagucagcuuccaaauuaaauaccagagguguggcuuuaucccaguuuuuuucuacccaaaugcuguugguuucauuuuagugcagccaccagaaauaauuuuugcaucauuuucuuuuucucacaaugucacaugucuaagaauaauccuauguuugaauauuuagcuugguuuccuaaucccagguauaaaaucugguuuugcuguccugaggagcaguagaaagaagucccugcauccaccucaguagguuuacauggagauagaaaaugucaucauguuugauuauuuggaccuuaccuuguagcacuucacucuugaggagggaaaucagaucucuggugguugguaaaaucugcugaagaauucaccuuaucaugauuuuguuuuacucacagaaucaugucaacccugccauggacuucacgcagacuccaccugggauguuggcucuggacaacaugcuguacuuugccaagcaccaccaagaugccuacauccggguaagcaagaagccccuuuucagauauuguguguuuccuacucaauguuaauuucaaacucacaaauacggagggauuaccuuuagaugagugaccccauauuuucugucuuucuuaguaaacuaaaaaaaaaaaaaaaaucagaauuaagugagaucaaucaggggacugaaaugaggauuuuaacuuuuaauuuuuuuauuucgaugacauuaaaaaauacgguagauacuaggaaaacauuucauauaguccaauauugaauuaugacaaaaacucuuaaauaacaaggaacaaaaaugaacuaccuaccaaaaacuugcaugacuccaaauucagaggcuguugagucugacacuggaggaacaauaagauaaacagaaacaaagagaaaaaugggagagauggggaaggcagagaaaugccuucuuacauuucacgucagacucgucaaauucuagucacgaagguagauuaauuuguggguggagcagaaggaagugggggacucuauuuucucugugaaauggaagaugccaccugcugaagaugccauccgcugacugggcauugcuggcauggagaauaaaugaauggaagccuaaggcgacagugguggagaaggcucucaucuaucagggcugcucgguuggagcccuggauuugugcugacaccucuccccuguccucagggugaagaacccagauucagucaggaugagguagauccaagauugagaucagggaaggauaugaauaaauggggcaggggaauuggugagugguuaaaaugaugacuagauguaagcuuagaaaguauuugaugaacaaguugccuaaaucaggaagaguaaggcugaacuuaaaauaugguaagagcauguccauuaaucucauauucucuguuggauucucuguagcacuggcucccuggagaccuggguucgagccuggcacuaucaucaucuagugaugucagugugggcauuuccuuuggucuggccucauguuuccucuguaaaccagagagacuugaugguucuuagcugggacaguauuuauuccccuagagagcauuuggcaaugugugggcguguuucuucaguugucaccaugccuaguggugugcuacuggccaaaaucuguaaucuaugggaccgucggcacagugaaaaacuguaccacccagcagugaccuccuugaauaaggccaugccagaucacugaguucucuuuaggaaauauauuuuaaaucuguguguuguucuauauauauggaguuugggaagcuuugaccuauucugaaauauuauuuguaaucugaauauauagagaauuuuauugucauuucucugaaagguuugggaucagguguuuggucagaaauacagucccacauaagaaaauuguuuuuccauaaaacuuugguuugacuuauaugcgaauauauuuuuugcacagaugauuucuaauaauguaaucugcuuuuguaguaaguaaauuaauauuuuugagauaccauguaguauagccuuggagaguugagcgugaaaaguagaagcuaaguagaaauugaauuuaccacuaacugauuaauguucauggaugaguguuucuaaaauuggagcuuauugaugcugaauguauuguuaauugcauaagaagcauaugucucaugaaaaguaauuuaauguuuuaagccuguuuuccucaauguguucuuuaaacauuguaagugaaaugaauaccauggcagccugacaaaacuuuauauuugaucaggacuuaaaagaaaaaaccuauuuguaaagagaaguguggcuuuugguccacaugcacuuuucuuuauugguuagacuuuccuguaucucagaugacuuuguugauuucucagaaguguccuuucccuaauuuuuucugugucccauuugacuuuggggcauuuacuagauagaaagcuaaggcuauuuaugugaaugcaugggguuaguagagcauauauaaauucugaagaucucugcaaggaaauuuuagggugacuuugacaauagauaucuccaugauauggcaguagugcuguagguagugaaaauagugaucugggcagcuaauuaaauuuugauucaugagcucaauggucuuuucugaaacauaaagaugggcucaaucuuuucaauuugcauuuugauaaaaauccgccuuuuugaggauguauaucuucucuaugaaugcaguuuuucauuuauuauuuauaucuuucauuugauaaaugcuuauucuguaccugaauauagccucacuauucacucucuuugccagucagauuuauaguugagauuaaaaaaaaauuguaacacacacacacacacacaaacacauguauauaugcacaaauauucccucguugcccuugucacucccagguaucauggucccucacccacuuucuagccauauguucccaaguuguuuuuugcccuguguucaacuugccugccacucacuuuucagcauccugcuccaagacuucucuccauugcuuucuggaagcuguauugccaaaugcagagcacuuuccucauccuuugucucguuggccuugcccuugacaccugacacucucuagugaccaguccucucuugcccagcagccagugaucugucuuggcucuguugcugaccguugcucuuagucucucuggcagguuucuccuccaccugcccaugaaaugcacaggcccccaggacucugucucuggaccuuugcuugucucagucccucaggcugcacauuuccuaaguaaccaucaaaugcccagccaugagccaaaggauggggauuccucaagaaaacaaguugcucauggguccugacauugaggaguucacugucuagagaucaaaaguagagguggugguggugggguggggggugaagagacaaauaccaggcaguuuccaagucacuugucaugugucuugauugaguaugcugggaacacagaggaaagucaccaacacagaugugggggucaggucaggaaagcuuccuggaggaagugacaucuaggcucagaacuguugaauaguacuaguuaacuaggugaagggaagagauggagaguacuaccucauguggauggaaccaugagagcaaagguacaauggugccugcuuuguucagggagccacaguaguauaggauggccagggcagggacuggcaaacggggcauggcuugugaggcaaaugugcuacuucaguggggaugucuuaagccaucugaagaggucuguuggaccuaaaggcagugaagaauuucugaaguguuuuaaaugaagaugagaauuaaguuuagacaaaucacugucccgcuagaaaaccaaugugagaaaucaagaccagaggcaaaaauaaaaugugggaaauuauagagaaauggagauaacuugaacuaggguagugggaguggcaaugaaauggagcaguuugaaugaguuacuuuggaacuaaaaucaacuugaccuucuccgaggaagagggagguuucugccuugagugggagguagacaguggugccauuaaggaaacagauaaugcaggucugugaaggggcaggcauuuggaccauccagacucuuacaugcaugugggacaucugucuaggaggacauaugccguaggcagugagaucuggguggcugagcugagacccacguagacaucacaaucuauauucuaacuccuuaagcauucuuauucccuccaauucauucuucuguauugucacaauauuaucuuaguggccuccuugcuaaugucuggaaccuucaaacccaucuuccgugccaguugcuaggaugaucuuccuaaagaguuccgagugcuucaagggaccaugccuggcccacagccuaucucuguggcuuuaucucuugcuaccaacuucccuuucccucuuuccauccccccaccaccauaguagccuuugucuauauaaaugaugguaggccaaacuagccaggcaagucucuaccacugugucuuugcucccguucuuguuucugcuugagugccugucccacaucaugugccuguuggacagcccucauggcaaaggccauguucugucugaagaagacuuccugacccucuacccggaugacuccauccacucucuuugcaccguggacacacaauuuaaauccuagaacauuguacagccuuaaauguauuuacuuucuauuuccccuaauugauuguaaaugucuugugagcaggcaccaagguucauuuauauucuagccccuggcacagagccuagcacauaguggcuuuuaaucauuucuuguaauucacaugaguaaagagcuuuuuuuaguucugguuuaaauagucucuugaccaugauaaaugcuuuuuuuaccauuggagaaucauggcuuuuguuccuccuaacaguuauaaagguauauuuuugauaugugaauuuugugauggacagccugguuucucauguuauauuugaauaaaguuuuguaacuguguacugaugaaagcaguggguguaacugaauuaccccaaaacuuggacgggcacagaacaugaggaggaauugcaaaucugaguauccuacugugcauggaguaaaaucuggaggcauagcaugauuucagacuuccgagucuuacuuacucuggguauaauugcuuuuacuuuuucuagaaauguuucacuccccagcuuuccagaccagaggaaugguacaaggcugucucaauaaggagacaaguggagggaggguucuuggcucaugcccaugagccugcugucauuauuuucagagacaagauaaugguacagaguugagcguguuguagauguuuuguuuuucuuuuuuuauguuuauguuuuuuguuuguuuguuuguuuguuuaagauacagucucacucuuuugcccaggcugcagugcaguggugcauuuucagcucaccacagucuccguguccuggguucaagugauucucaugcuucagccucccaaguagcuggggcuacaggcacgcaccaccaugcccagcuaauuuuuguauuuuuaguagagaugggguuucgccguguuggccaggcuggucuugaacuccugaccucagaugaucugcccgccuuggccucccaaauuguugggauuacaggugugagucaccgagcccagccaaauuuauguucuugauguauuuaauuuuauucacugggaacuacugaaaaacccaaauuaccugguuuuagcuuggcugaagaccuaugcuggccaaugugggagccaagauucaaccacaaagcaggaagcaauggcaaggaaaccuagggcucucucaaagguggaacuggaauaauaagaaauacuuaagaaaaaggcuaugacuagcagauagggugaucucaggauaauguaauucuucaugguaauauucaccuucccguuuggccagagcaaaugaauaccuaguguggguuugguaacaugcaagacaggcugcauaguugagcucagucuucaaguaaucccuaggaacaagcauuguuaucaccauuuuauaaauucaggagcugggacuuagagagguacagagaguuuggucugucaaacagccaguagacaagccuccaaaucucaggcuucuuccaguucuguagccucgucucugggcuuggaguaugaugagggaaacaguguugucauucuuggaauggagggaaaggggacagagucaaagagagaauaauuagaaaacauggaaaguccacaggacuaucaaacaagucgucauauucaguuaaagaucuucugaagucuagcauggucaggaagccauuucuaaagauacuugauugacacccaaaagaugcuauuuuaaggaauaagugggcccagggaagguaucauugcaaagcuuuucaugugucagagauagucuuuaguuucagaguagugauaggagaaguaacaugcagaaguauucagauguucagaaccuauugucagucaucugaccccucuuggcauuacagugagacagaagcaaacugugcauuaaucccaggcucuaaaaaaguuagauaaacauuuaacgcccaacaauaaaauccgaaugcaugcaaaugagauguuucuauuauugauuacaucuuuuucagagggaaaaaauacacauagaaaacagaaacaguccaucuucuuaggcgcuaaaaaguauccaacuaaaagaagaaaaauccuuuuaacauucauauucauucauucauucauugacuuuuucaugaaauauuaucaaacaccuaccacgugccugcguggagccaugcgcaguggcugugguggugaagaaaggcaggaucugauucugaaauaccugacauggaaaagcaaucaagugaaggcaguauuuguuuauuuguuuuuuacuugagaguuuccuuguuuccuuugggauuuuuagaugugacuuaugcugggcacaacuaucaaguuauaaaaacguugcuugauacuucuuugcaguuuuucacaauauauugagcagguaaauauuucauuauuuuguaaguuauuauacuguuuauaucagaaucacuuaggcuugcccccuuucccagugaccuaauuuuaaacaacggcacugcuucuuagagaaguauucuguugggcagucaguauggaauagaacaagccugaccccuuuucucuguuugauucggcauggugcuaugugauaaauaaaauauuuucuuuucuuuuauauauauauauauauauauauauauauuuaaauuauacuuuaaguucuaggguacaugugcacaacaugcagguuuguuacauauguauacaugugccauguuggugugccgcacccauuaacuagucauuuacauuagguauaucuccuaaugcuaucccuccccacuccucccaccccacaucaggccccagugugugaugucccccuuccuguguccaaguguucucauuguucaguucccaccuauaagugagaacaugcgauguuugguuuuuuguccuugcaauaguuugcugagaaugaugguuuccagcuucauccauguccuuacaaaggacaugaccucaucauuuuuuauggcugcauaguauuccaugguguauaugugccacauuuucuuaauccaaucuaucauuguuggacauuuggcuugguuccaagucuuuccuauugugaauagugccacaauaaacauacgucugcaugugucuuuauagcagcaugauuuauaauccuuuggguauauacccaguaaugggauggcugggucaaaugguauuucuaguucucgauucuugaggaaucaccacacugucuuccacaaugguugaaccaguuuauagucccaccaacgguguaaaaguguuccuguuucuccacauccucuccagcacuuguuguuuccugacuuuuuaaugauugccauucuaacuggugugagaugguaucucuuuguaucucuuugugcuuuugcuuugcauuucucugauggccagugaugaugagcauuucuucaugugucuguuggcugcauaaaugucuucuuuugagaagugucuguucauauccuuagcccacuuguuuaugggguuguuugauuuuuucuuguaaauuuguuugaguucuuuguagauucuggauauuagcccuuugucagaugaguagauugcaaaaauuuucucccauucuguagguugccuguucacucugaugguaguuucuuuugcugugcagaagcucuuuaguuuaauuacaucccauuugucaauuuuggcuuuuguugccauugcuuuugguguuuuagacaugaaguccuugcccgugccuauguccugaaugguaaugccuagguuuucuuuuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuguuaaauagggaauccuuuccccauuucuuguuuuugucagguuugucaaagaucagauaguuguagaagugugguauuauuucugagggcucuguucuguuccauugaucuauaucucuguuuugguaccaguaccaugcuguuuugguuacuguagccuuauaguauaguuugaagucagguagugugaugccuccagcuuuguucuuuuggcucaggauugacuuggcaaugugggcucuuuuuugguuccauaugaacuuuaaaguaguuuuuuccaauucugugaagaaagucauugguagcuugauggggauggcauugaaucuauaaauuaccuugagcaguauggccauuuucaugauauugauucuuccuacccaugagcauggaauguucuuccauuuguuuguauccucuuuuauuuuguugagcagugguuuguuguucuccucgaagagguccuucacgucccuuguaaguuggauucuuagguauuuuauucucuuugaagcaauugugaaugggaguucauucaugauuuagcucucuguuugucuguuauugguguauaagagugcuugugauuuuugcacauugauuuuguauccugagacuuugcugaaguugccuaucagcuuaaggagauuuugggcugagaugaugggguuuucuagaaaaagagucaugucaucugcaaacagggacaauuggacuuccucuuuuccuaauugaauacccuuuauuucuuucuccugccugauugcgcuaggcagaacuuccaacacuauguugaauaggaguggugagagagugcaucccugucuugugcaacuuuucaaagggaaugcuuccaguuuuugcccauucaguaugauauuggcuguggguuugucauagauagcucuuauuauuuuaagauacgucccaucaauaccuaauuuauugagaguuuuuagcaugaagggcuauugaauuuugucaaacuuuucugcaucuguugagguaaucaugugguuuuugucguugguucuguuuguaugcuggauuauguuuauggauuugcauauguugaaccagccuugcaucccagggaugaagcccacuugaucaugguggcuaaguuuuuugaugugcugcuggauucgguuugccaguauuuuacugaggauuuuugcaucaauguucaucaaggauauuggucuaaaauucucuuuuuuuguugugucucugccaggcuuugguaucaggaugaugcuggccucaugaaaugagauagggaggauucccucuuuuucuguugauaggaauaguuucagaaggaaugguaccagcuccucuuuguaccucugguagaauucagcugugaaucugucugguucuggacuuuuuuugguugguaagcuauuaauuauugccucaauuucagagccuguuauuggucuauucagagauucaacgucuuccugguuuagucuugggaggguguaugugucgaggaauuuauccauuucuucuagauuuucuaguuuauuuauguagagguguuuauaguauucuccgaugguaguuuguauuucugugggauugguggugauacccccuuuaucauuuuuuauugcgucuauuugauucuucucucuuuucuucuuuauuagucuugcuaguggucuaucaguuuuguugaucuuuucaaaaaagcagcuccuggauucauugauuuuuuugaaggguuuuuuaugucucuaucuccuucaguucugcucugaucuuaguuacuucuugccuucugcuagcuuuugaauguguuugcucuugcuucucuaguucuuuaaauugugaaguuagggugucaauuuuggaucuuuccugcuuucucuugugggcauuuauugcuauaaauuucccucuacacacugcuuuaaaugugucccagagauucugguauguugugucuuuguucucacugguuucaaagaacaucuuuauuucuacuuucauuuuguuauguaccuaguagucauucaggagcagguuguucaguuuccauguaguugagcaguuuugaguggguuucuuaauccugaguuccaguuugguugcacuguggucugagagacaguuuguuauaauuuauguucuuuuacauuugcugaggagugcuuuacuucuaacuauguggucaauuuuggacuaggugugguguggugcugagaagaauguauauucuguugauuugggguggagaguucuguagaugucuauuagguccgcuugguggagagcugaguucaauuccuggauauccuuauuaacuuucugucucauugaucugucuaauguugacagugggguguuaaagucucccauuauuauugugugggagucuaagucucuuuguagucucuaaggacuugcuuuaugaaucuggugcuccuguauugggugcauauauauuuaggaucguuaacucuucuuguugaauugaucccuuuaccauuguguaauggccuucuucgucucuuuugaucuuuguugcuuuaaagucuguuuuaucagagacuaggauuccaaccccugccuuuuuuuguuuuccauuugcuugguagaucuuccuccaucccuuuauuuugagugugugugugucucugcaugugagauggguuuccugaauacagcacacugaugggucuugacucauuauccaauuugccagucugugucuuuuaaucggaguauuuagcccauuugcauuuaagguuaauauuguuauguuugaauuugauccugucauuaugauguuggcugguuauuuugcucguuaguugaugcaguuucuuccuagucucaauggucuuuacaauuuggcaugauuuugcaguggcugguaccgguuguuccuuuccauguuuagugcuuccuucaggagcucuuuuagggcaggccuuguggugacaaaaaucucucagcauuuguuugucucuaaaggauuuuauuucuucuucacuuaugaagcuuaguuuggcuggauaugaaauucuggguugaaaauucuuuucuuuaagaauguugaauauuggcucccacucucuucuggcuuguagaguuucugccgagagaucagcuguuagucugaugggcuucccuuuguggguaacccguccuuucucucuggcugcccuuaacauuuuuuccuucauuucaacuuuggugaaucugacaauuauguguauuaugugucuuggaguugcucuucucgaggaguaucuuuguggcguucucuguauuuccugaauuugaauguuggccugccuugcuagguuggggaaauucuccuggaugauauccuguagaguguuuuccaacuugguuccauucuccccgucacuuucagguacaccaaucagacguagauuuggucuuuucacauagucccauauuucuuggaggcuuuguucauuucuuuuuauucuuuuuuucucuaaacuucucuucucacuucauuucauucauuugaucuuccaucgcugauacccuuucuuccagcugaucgaauuggcuacugaagcuugugcauuuaucaugugguucucaugccaugguuuucagcuccaucagguccuuuaaggacuucucugcauugguuauucugguuagccauuugucuaaucuuuuuuugagguuuuuaacuucuuugcgauggguucgaccuucauccuuuagcucagagaaguuugaucgucugaagccuucuucucugaacuugucaaagucauucuccguccagcuuuguuccguugcuggugaggagcugcguuccuuuggaggaggagaggcgcucugauuuuuagaauuuucaguuuuucugcucuguuuuuuccccaucuuugugguuuuaucuaccuuuggucuuugaugauggugacgugcagaugggguuuugguguggauguccuuucuguuuguuaguuuuccuucuaacagucaggaccuucagcugcaggucuguuggaguuugcuggagguccacuccagacucuguuugccuggguaucagcagcggaggcugcagaacagcgaauauugguaaacagcagauguugcugccugaauguuccucuagaaguuucgucucagagggguacccggcugugugaggugucagucugccccuacuggggggugccucccaguuaggcuacuuaggggucagggacccacuugaggaggcagucuguccauucucagaucucaagcugcaugcugggagaaccacuacucucuucuaagcugucagacaggcacauuuaagucugcggagauuucugcugccuuuuguucggcuaugccuugcccucagagguggagucuacagaggcaggcaggccuccuugagcugaggugggcuccacccaguuugagcuucccggccacuuuguuuaccuacucaagccucagcaauggcgggugccccuccccuagacucgcugccgcguugaaguuugaucucagacugcuaugcuagcaacaagcaaggcucugugggcgugggacccucugagccagacgugggauaugauuuccuggugugccguuugcuaaaaccgucagaaaagcgcaguauuagggugggagugacccaauuucccaggugcuguuuguuaccccuucccuuggcuaggaaagggaauucccugaccccuugcgcuugucgggugaggcaacgccucucccugcuucgggucacgcuuggugcgcugcacccacuguccgacaauccccagugagaugaacccaguaucucaguuugaaaugcagaaaucacccguuuucugaguugcucacgcugggagcuguagacuggagcuguuccuauuuggccaucuuggaaccuggaccccaaauauuuucuuaauuaaacugcuacacaaccaguugauaaaauccuacucaacaaagcuguuacccaacggaauuuguauaaucuugagguuuccaggaaaaaauuuaaaaguaaaucuuggaaacuguuuguuccuuacauaucuggcaauucuuuuuuguuuucuaguuuuaucgagauauaauugcuuacccaaaaaaucacauaauuaauguauacaaucuggagacagaaccuugcuucagcgucccucauaauuuaugauuaacauuucaucuaguuggaaaaucuuugcauacuggcugacuguuauagaagauaaugaauuuccugaggggggagaauagaaaugccuuuaaaaauaagauuaaucacaauguuuucgugcaguugugagacagagcauauauauguuucuaauauuaugccaaaucagaagacaaauauuuguaauaugucaaguaaauaagucuaugaguaaagauggcuauuucuacugaagaauuguuuucucaagauuguuucauuauagccacuuuuuuaaacagaugaagaauuuaaaguauguuuaguuuacacuauuuuaaaaccuuuaaguggguuuuuccuccucaugaugcaaugcauauuacaucauacuuacaaaaaauaguugggagaaauaaugauuuagauccuaacuaaugguugggacagggaggccuggauuuuuugaggcagcaaccuaaagaaaaugcucugaaauuaccuagcgugagaaaagcuacuaucuuuugagccuuuacuauguucugaguacuuaacauacauuauuuguaauuucccuucaauguucccagacaugggaagauaaagaaaccuuaugcccuuuccuuccagucuguagaucucucuguucuucuccucaaggcccaccucaaguucagagucauuuuggggaaucucuuuucagccuuuccagucagggagcuaaacaucaaugaucacagcaaucacauguuuggagcucacuagaacaacuaagcugaguauuuucauuuauuucuugcaccaccccucugagguugccacuguuacuguuugcauuuuacagacgaggaaacugacacauggagagguuaagugguuuguccaaagucacacagcuaagguaguaccagagcugaauuuuaaauccagauaauauguguccauuguccauacugugugcuuuugagaggcuuauagauucauauggaggugguagccacaguucaaaugaguccuacagauguguuuugcuucacugacccaguguuauuaaaaagaagagaauuugauugccuuuuuucagggcuuacacucccuccccaauuaacuuagagccccagacaccuucuuguauuauggcugacugcuucaugcuuucugguuaucugccugguacuugaaggcacucgaguuagugcccguugaugaugauagucuguaauaacauuugugaaguucugagcacaccgccagcacauagaaggugcuucaaccauuugaguugauuguucccguucccacuccuuaaaguaguacuugauugauguacagccuucugagaguuucauauguauuugcucgguguuuaucuuuucauccuuguaaacucccagaaagcaggcauuucaucuuugguuggguguuuauucccuggcugagaaugaaggacuuuaaucccaaccuccugagacugaagaaaaggaaaaggcauguuucccaguuucuccuguugugaguuuuaaagaaaaaagucacacgaguauauuauaaacagacugcacuggaccagugcucugggagcucugagcaucaucagcccucuguaccaggagucagaccauagaguggaucccucgcaggacaacaguaugcauugaagggaacaggaaccaaguagccucugugcauuaaggcagggugcugguggaggcgacgccaagacuuuaaaauaaacuaagggacuucuaacauuucaagggggaauuuggcgguuccccaagcgacauaauuacaggacaguguguaaugugcaauuaaacuuaacuaugaagcaaaugauuggaauaaugcuuagugcacaacaguuuuuuguucccauugugcugacagagccuccccuucucucgucccugaaauggcuucaacagcaauugcucuucauuuuuuuaaaaauaaaauuauauguugccaguuaaacacacaauuccauguaaaggaaccuuuuuuuaucugagugacauuuuucuucuaggugauguggagaaaggauucaguuuagaauaacaaggaccccaaaggcacagccuuguugggacguuugaguuugaaaugauucuuugucucauaauucauuuacuuuuuuccuggcuuuaauuuuuguucuuucuuuaaccaagguccacagcuuggaggcuuguuuguauauacaggauuuuuucauguuuuaaaaauaguggcauuaauuucguugauugugaauaaccaagcuguuacugccaaacaaucgggaccccuugagagugugaauaugugauuagauuuacuaauugagcuggaaggaagaauuucugacuuccaaagccagugauuugaauggaaugcuucaagcaugaggaugagaucauuguuaaaugugggcuugguuuuaucucagaagaccccuugucccagggagggagggcagauuccacaaaccucuauuagcugacuguagcagugccugcguggugugcucacaccaccucggaugcucaccuguguucuuguggugcuggaugaggugucugaaaucugaagcagaccugaaagcugguaguuaucuccuugucucucuugguaccaccccaagcugagcauuagguucagaaugcuugcuuguuuguuugccguugucucagguuaacugaaaauacuacagcauugcagaaaaauccaaacagcuccacgugguguuuugaaauuuaucccaacuguaggcugagugacccgcagguuggacagucugugaaagccccaaagucucaguguuuccucagugucaggaccuacuuuagugaucuccagguccagggcuaagaucucaggaacauaauuaucucuccuuuuuucucucucuuccucccacaacuugauggagaugccucucacugggccucuccaaauauccuccaucagaugcaggauguagccugcccucuuguugcggagcuucuugccagagauaauggugaucuccuugcccacacacucguuccuguggaagucauugccgaggcacauguaguacuuuucuaggaugacccaggcugccuuuccaugguuuugaugcaaaagcagcccaucuuggagaguccuuggugaaagagguuucagacuuucuuacuuagcauucuccaaagguuuuuuguugguggugguggugguuuuucucuuuucuuuuuuuuuuuuuaauuuuaaaacacagugggacuuuaaaacagugauggauuuguugagaaaaaagugaagcuaagcuguauagugaacuauauguaguugacauauuguaaacacaagucuaaugugaauugaaagguuaaaaacuucagaaggaucacauguuccugacucccucacugagguaccagccaagacuuagcucacaguaacuguugugguuucucuaucuuagauccaguuaguaucuuuccauuauuucuccaacccaguucuccaaauucagcccauauuguccauuuuuaugucuuguuuagcuaguuaaauauuuauugaguacaguaccugcucugugacaagcccucuuucuuucugcuguaauugaccaagcuuccaccuuuaaaugugcauuuuucuaccuuagcugugcagagcucagcagcugcugugcugggguuucgcuauuucuucucccuuuucugcuuuaauuguuguaaugcaggaguucaaagaacugcagcucacuucuuauuucuuugaaggggaaagguuucugggacuccucucucuucuguuuuucucaagagaaugcagaccucucugccuuuuuaauuuuuuaauuaauagacauuguguuuuagaacaguuuuagguuuacagaaaaguugagcaaaaguacagaggguucguauauaucccaucucucauuucucccacacacagcuuucucuguuauuaacaucucacauuagaauggcucauuuguuacaauugauaagccaauaucuugcagucuugcuguaauuguuuauuaguuccaagauuuuauguauuaauuccuuggaauuuucuacauagacaaucauguccccugugaacaaagacaguuuuguuuccuccuucccagucuguacacccuuuuuuuuuuuuucuuauugcacuagcuaggacuaccaguaagauguuacauaggggugauaggagcgaccaucuuagccuugauccugauccuagggcagagucaaguuucucaucauuaaguaugauguuagccauaaguuuuauguagauguucuuuauguagcugaggaacugcucuauucuuaguuugcugagaguuuuuuuuuaucaugaaugaguguuagauuuuaucaaauggcuuuucuguaucuauugauaccauuauacaacuuuucuucuuuagccuguugauacaaugguuuacauuaacugauuuuugaauguugaaugagccuugcauaccugaaacaaauccuacucgguuguggugcauaauucuauuuauagauuguuggauucuauuugauaauuuugugaaggauauuuacauuuauguucaugagagcuauauagauccgcauuuuuuuucuuucuuaugccuuugguuuugguauuaggguaauacugguuuuauagaauuaguuaagaacuacuccuucugcuucuaccuucuggaacagauuguagagaauugguaucauuuucuuguuuaaauauguuauagaauucaccaaugaaaccauccaggccugauacuuuccauuuuggaaggucauuaauuauuuauucaauuccuuuaauagauauaggucucuucagauugucuauuucuucuuguguggguucuuguagauugugucuuucaaggaauugguccauuucauuuacauuaucagauuuuugagcauagacuuguucauaauauuccuuuauuauauacaugagauccauaaaguugacucuucuuucauuuuugaugcuaauaauuuaucauuuuccuuucaucuuguugagccuggcuagagauuuguuguuuuuauugaucuuuucaaaaaacuagcuuuugauuuuacugauuuuucuauauugcuuuccaguuuucaauuucacugauuuccacuccauuauuuuuuuuuacuucuuuucuucagcuuacuuuagauuuaauuuguauuuuuuuaguuuucuaaaauggaagcuuagaugcuugauuuuguauauuuuucuccauugcuugaauuccucauugauauuuugcuacaaauauccuucuagcaauggcucugccuuccauagggguucagcauggcuaaaccuacucagaacuuugcuauuuaacuguuucauggcgcuaaauauggguugccuugauaaggcaacccagugacuaaagucucuggcucaaugaguuacucuuuauuccauuaagacccaguuaccaacaaacuaaccccagcaaauucuauuuacucuacuuucaauccuauugacucuacuuucaaaauccuauugacucugcuuuccagaaaccuaccuccuuuccccacuucuaccaccauuacaguaauccaguacaucaaaccucucuccuguaucuccuguaauaguguaacagccucugauugauauugccugcucccacacuugcucaucuuuucugucuucaacacaguagccagaacguuaggaaagaugccauagugauucuuccaguauuggucagaucacaucacucaucugccuacaaccuccaguaacucagaguaaaaacguucagcacuuuugccacagcucucaaggcucugcaguguucuggcuuuccagccuuacguccuucuauccuacuccuuccucccucaacuccacccacagagaucagcuagggcugccauaacaaaauaucacauacuggguggcuuaaacuacagaacucuauuuucucacagcucugaaggcuggaaaucuaaaaucuagcuacuggcaggguuggugucucugaggccucccuuuuuggcuuguaaacggcugcccucuugcugccucuccacauggccauccuucugugcacucacacccuguuggcacugcuucuuaugagaacaccaaucauacuggauucggacccuacccuaauggccucauuugauuuuaauuaccucuuuaaaggcccuaucuucaaauacagucacaugcuauacagcggguuggagcuucaacaugugaauuuuggaagggugcaauuccguccauagcacccuuguuggccgugaacauaccagguaccucuggucucugggccuuuuacuuuuugcuuucucuccuaggaaucuguuccuggguagccacauggcucauugccucacuuccauuagucucugagcagcuuucugucaccuccagauauaaaguacugauuucauccucuugcucccugucuaccuuaccuccuuuauuucucucaaaauuuaauguuucuuacaugcucgauauucacuguuuucuuuauuuccuguucacccuuacuagccagcaaaccucauaaaaccacagaguauccauggugucacugcgguaccccagugcccggggcagugccaggcacacagaagacagucagcacauauuuguuaaaugcaugccuggauugagugaguggcaggacucugcccagagaguucugguguuccaccuuuuggcaggauucaccccauggauggaaaccacagaaguagaucucuaucuggaacacgcucuaaccucucuggaugcagcugccuuucuggccuuuguccguccuggagugaaaaccaaauuagaaacuauaucgguaugccccaaaauggccuugccccagauaugcugaugcuugggcuugggugagucacugcugucuucccuuuuugaauaggauucaugugaccagagcccagccaguauuagcaaccugccuaccaaaucagaagggauuuuguauugguauaauaaaauuuaggugguaauguucccaaaugucccuuuguauuaguuaaaaauagcuucccccuuaggaacuaugcuguacaccuggugcacccaguagugguugacauugucagauaauuuuauuuuuucauugaccuuaauuuuaucaacuuuuucccugcacugguaaaacccaagguuccaaaauuuggcauacaucauaaauaauagacaauauuuuucuuguauuuuauaaagcaacugaaacaauuuuaauaacagauauaacaacccuaacaacuaacuucucuuugguugguuuaucaaaugcugcucuguaacacugguccugauaccuggagacuuuucaaaucuaagacuccgguuaaugucauucacaccugucugcaaacuugcauuugccaagaucaggaaggccagccuagccaaucuuucaguacuugacuggugaugcuccuaugccacagggcucuugcaugugcuuauucugcugacucagcuccugcuuucuccaucccuucccugcuugcccacuuaucccuggauuaauccugcagaaccucacccuuuaggcuccucuuucauuaguuuugcuuccaugucacucccuuuauagcacuuaguuuggaauuauauaaucguauguuuuacuauuugauuauuaucucucuuaacaugaaauuuuugagcaggaaccaucucuuuugcccuaugcccuuacuuucugucacuggaccaucuaaauuaaaugaaugaugaaagauaggauguguugaaucucugaacaggguuguguuccucuuuuuucccccucugaaguccuuuauggccuuaagugauauuuuucagaagaucaaaacugaagcauaacuuggaaggaaucucuuuuuccuugaccuggugggaccaucaaauugggcagaguuugagcuacacaggauaaagccuuacaacaaaucucaguuaugaaagccaugaagaugugcauauguuccaugagcagacaugaguucucuauaagccaaugaugaagaagaccaacauuuaguuaguuuucaacagaagggucaguucugcugauagcuuggcagcuuggggcucuacucugcauaugguaggaacaaaaagaaagcuaaacuauauugaguagugaauguuuccaggcuaugguuaugaacauuuuauaugcauuaccuuauugaauucucacuaucauuguacccauuuugcagaugagagcgcugaggcucagaaaggucaaguaaauugcccauugcuacaauagauaguaaguugcaaauggggacuuuggacccagacagcucugguggugacuuuuuaauacuuuacauugaauuugguaguaugcuaguacaaaaguuuuucuuaaaagaaaaucugauuaguauugcagcauuugcugguuucugugguaucaauacuccugcuguggccgauuucaagcucccaacagucuauggccuguaagccuuuugaaagugaugcagcagcugguuagccugcucuagcaccagccacuggaucuugauggugcuuuugccuucucaugcauuaucccauuugcucuucuuagcaauaugagggacuguggaaugggugagguuaacuuacgugugcugaucuuuucaaugggugagucauguguccaguccauaaugccaagucauggccugaggugagaaacacucucuuacugacucucucagggcaggagccugcagagaacgcagagcuggaccaagagccccaaggaaccuacugucagaauggcugagguacaaacaaaagaggaucuggacaggaagagagaggcccacaugguccuggggcagcugaugcugguagaauguggugguaaacgggguaggagaaugaaguaacugagagucuuuucugaauucagaauuuucuuaauucucugaauucauaaauauguauuugauguaggaauucuuccccaaagagcuuaccaaaaaauccccuacgcucaccaccauacccagccaugcaagggugcagcugcuuggaggagaggaaauccuggauucuuucaggauuagggaguggcugucaugguccauggcuggggagagccacagcauggggcugauugggaaagucuggggggccccauagccccuuucuucuuccaucagaggagacuguggauuuuucuuucccaugauaaaucuaggugagccggugaaaugauuuuaaagggaacuccuccauugcuuugggaagugugaaaugacaucauuuuuagauuaugguuuaucaauacuuauauauauauauuuaaauuauacuuuaaguucugggauacaugugcagaacaugcagguuuguuacauagguauacuuuaaguggcagaaaugcugagaccuuuugacuuaacguuuauguuuuuagaaacguacuuaaaauaaaucauuuugcaaaucagcguaaaaguugcuguguaaggauguuugucauuagcuccagucaggugcagaugugaggaccucugggcagagguaggggaccuggagaugaagcugagagugaggcugguguucccugggcaccugugcagauacaaauacagccaggcagcugggccucuucgccuuggcaggcuuaauuaagcacauuggauuuguguccuuguauuucuuaaaaaaggaaagaauucugaaaugaagaaaaaaaguagccuuuuuggcauguaacaucugcgagauaauuaaucucccugauauuucaacacugaggcuguuuaucacggaggcugcuugggaaccaagagcagccagccucucugcaguacccacuacauaccucauguggcaggggaggaccugguucaucccagagggcaaucuggaggcggucaagguugcuuccugguaaaaaccacgagcguucauugcuguggccugcaacacucucuucccuuuucaguucauaucaucagaggucuuuguccauuguugaggaauuaagagaaaugucccaugcaucuuguucugaagaaauauauuugagucucuugcuuuccacuuuuuacuuuucaccugaaagcguccaagaguuaacugagaggcaggccagucuucagguggggaagaccggguggguguugaggcaauguuuccagcuggaaugggggacuuggaaucagaacuguuaaccaauaagaaugaaggggaaggaaauccuauuagggggcgucaucaccuaggaaacacgagucaguuuccuuuucugcacuccaacauggaaugcugagccuggaggccccuucacagauugucccuucucuguuccccacccucacacucccggauccccugggccuuaucuggggaggggggcggcggaggagugcagaguggaggcagcgcgugggguguguggaagggaaggggacauucuuuugcugugggaguuggcucccucucaucucauacauuuuccugcugauucucacucacagcauuuacaggaagcauuuauagcaaauacuugccaaauguuuuccauaaacacacaacgaaggacauuuuucacacauuccaauguucuguaaauguuuauuuucacaauacacaaagaagguugaguguaugguuuuccuaaacaagccuuugaagugugggcuuuggcccagggagauuugcuucugaguguuuucauccacguggccgcauugucccugggggcacaccaggcacaugcuucaaugcagagagucuccaagugaguuuuccccccagcuuguauucucugugggaauacgugcccugaaugcugaguagccucuggguucugagccuccuccugaugaagaaggaaguuagagguucucagugcaucacauaaacccuugcuucugauuaaauccacaaaugacauagaauagggaauauggaggacagggaugacucacuuaagaugcauuugaacauauaguuguaauaaguuauggaaacacucaugcuaaagccaggcaaguugguauucauguaagggauggagaaggugacugaaccuucugugggcacugccagccucaccagaggccagagucaugacucguacuguccaugcacuuguucaauaacugcuucauuacugagcaccuacuguaugugcaacucugcugcaaugucagagauucacaagugaggaagugguucccaaccucaagggguugacucuaucagggaagguaagacaccuauacuuuaccauaauuugggggcauaaaaugggaauuguuuuaagaaagauacagauaaaagguuaucucacuugggagaaaacucacuuggaaagucucugcaaugaagccuguacccggugugcccccagggacgauguggccaugugaaugaaaaaacucagaagcaagucucccugggccaaagcccacacuucaaaggcuuguuuaggaaaaccauacauaagguuuuauugcauaagguuuuauggagaaagugacaucuggauugggucugaaggagagggaaaauugagacaggugugggaggggcagugugucagggaggggugucggggaggcaguuucccuaggagggagccaugucugggccuagccugguaggagagcuguaccagagggagauccuuccucuagcaggaguaggcaagauuuaugauucauacacagaaugagaugugaugagaugaacuccauuuaaaaagcuagauguaauaggaagaaaauauuuccuuuucacaugcuuuuuuaaccucaaguaaaacaacuuauggccuaauuucuuaauuagguuucagucaauuuuuucauugcagcuaacuugucaugugcauaaucagaaaauuaacauuuucuguuugauaauauguuccugaaauggccaauuuauuauuuguccagaagaggauaguaagaaauaguucucucuccucaccuuuccaucuucucaaguccguucucccaaaccagagugaauuucuaaaucaaugugcuaagugagaaagugaggugagugggagcugacuuagacagauucauuuuaucacuagcuuuccuggaauguguuuguuuuguaaaaugaauuauauucaaauauguuucagacaauauauguggugguuaacuuugcuuuaagacagcaguaacuguucagacaauggugacaauuucucaguaagaagucaggguugagaaaugucaagcuuaauuuuucauccaacagugacggucagacaaaagccaaaccucuugguaucuuugcacuccggugaaggagaugugaggcauuuguauucaguaauguaauguugagcgagucaaaacccugccaugugaucuugagauuuguugcuuaauacugcccaagaugcauaggggcuucucugcuuuuauucagcauccauuuucccauuguaauuagucuuucuugcauuccacagcucacuucugguguggaauguuaaaaagaugccuuaggagagaguuugacaucaguuucuucuucaagguugaacucaaggcucacccucuccaugaagccccgucugcccauugcaucucaugugcaccuucacugcacaaagugauacuuccuugugaaaaaugcaaacaauauagagguacauaaaaggaagugaaaguuggcccaucuuacaaaucccauguccuuguaucuuccaaguagauugcaagacccucaaaauggacuuuuguucauacauguauuuuuaauaucuagcaaguugcucagcaauaauugcuuaaaaauauucauggaaugaaugaauuggucaaaggguaauacacuguagggauguugggaaggacuagggcuagaauucagcugauaguuuggggaagcagugccuugauuuucaaaauauggacccuggacuugcagcgucagcaucaucugggagcuuagaaaugugggaccucaggucccaacccacaccuacugagucagaaucuucauuuuaacaaggucuccaggugaucugugaguacuuuaaaguuugagaaguacugggauuguauaugucugcaaaguaauuuacaaugugaacuuuaaaaaaaauuacaaugaagugugugugguuugcauuaaagaguaugcaguagaggaguucugccuuaaugauaccacaggacuuuguaccaaugccacacuuuguuccccucuguaugacagggcacacccaaugcccuguccuuggcuguccuguaggacugucauccugagccauuucaacaccuguagugucuucgucuauuuuugcugcuuuaacaaaauacccuagacuggguaaguuauaaacaauagaaauguauuucuuaugguucuggggacuaggaaguccaagauuaaggcaucagcgggcuuggugucugguaagggcugugcucucuauuuccaagaugguaccuuggcgcugcauccucuggaggagaggagcaugauguccuuucaugguagaagggacagagggcaagugagagccuccuuucaaucacaggcccuuuuauaagggugcuaaucccagucacgagagagaagcccucaugacuuaaucaccucccagaggccacacccuuaauacuguugcauuggggauuaaguuucaacaugaacuucggaaggggcaccaucauucaaaccauagcaguguuccuucuaaacagcacgcaacuuguuuaagcucuaaggcauggcuuccucaucuguaaaaugcaguccugcuucaauggcuugugaggaccaaaugagcuaaacgcuugagaguuugcacaugauaaucaucuaauauguauuaacucuuuuuuguuaaucgagaugaagugcauauaccauaaaauuaaccauuuuaaaguaaacuguucaguggcauuuaguacauucacaguguugugcaaucacuaccucuauguagauccaaagacaugaucaucaucccagaaauaaccccauacccgcuaagcaguggcuccccauucucacuucucagcccccggcaaccaccauucugccuucucucucuauggauuuugacucuuauuaaugauuuuuuuauuagucacaggaaaaacaaaacaaaccaaaaccaaucagauuuauuucuuuuuugucuacuuucauugcuuugcaugucuuuaaaaacaaaagguuugcuaaugauggaaauugggaauguagaugugacagaccuguaagucagugguucccacagugugguccaaaacuggcagaucuguguuaacugggaacuuguuagaaaggcagauucgugaguacaccccagaaugucugaucauaauucuggggguggaguccagcaaucugcauuuuaauaagcuuuuagaggauucuaauagaagcucaaguuagagaacuauugcuuuaaauaaaccuggaguaaagccuacaggugcccccuacaccuguacccauccuuggggccaggaacacacguacuggcauaaaaggggagauuuuagccuaccuucuuugguggggaagucagcugggggauugccccugauaccuccuggccuuugaauagucagcagagcuuggcuucccucaguaauguugugauuacuguguaggcacaaacagaagucauccugcuguuauuuaauccuuugcccucuuugugcuaccugaggugaugcucaaagggagggccuuucggcaaaacguggcuuugauugcucuguguguuuugcgcguccugcuuuuguugcacuauaucaaagugcagggagcauuucuuuuugguugauuaauguucaauuugaggucuauuaugaagcuccaggcuuuaauuacuauaccauuacccagucaauuccuugccauuuuauauuuauggccuuuauuaugccucuguaugugcaauugccuaauuuuauucuggaagcauuucaccucauuagcuggguuuuauaccauuccucucauuuguccagauuguuauuuaucuugguucccugugugcguuuucuuuucuuuuuuuuuuuccaccagucugacucauuauauuaauacauucuuuuucuccuuuuccugggaugcauuguuauuuggcucuuggaaauaucgcuuuaaguuuuuuguccuuuucccuggucgucaguuauacucacauucuuaacuuggucauuuccaaccuucugaaagcccaucucagcugccuggcagcacuggcccuguccaaaggccugaggccuccgcagccuggacauaccauggauggccgccucucucuaggugaccaauuaaagcucagggaaggugaagggauggaguuuuuacuuaagggcaugcuggugaaaguaacuuuuaaauauucucuuaaauccuuuucuaacucucucucccucaauccccucauugucucagaaaacuucaggacuugguuuacugacuuauuuuuguggguuccaccucagaccuucucaaucaaacccuaggggagccucccagcagccugcguucaguauguucuccaggugauucugacacacauuaaaguuagaaccacuuuucuuuuuuuuuuuucauucugagaaugcuuuauuuugcaguaccauauaauuuuaacacaccaaauauauuuuacaguaacaauuauauucuucacucaggcauaagaucaccugaguuuguggauguuucucaacagguuguugucguagcauuuggacaaugugauuagacaacacccggggagguggucauuuccaaacuggaaguuguccagcauuauuaggaacgucuugacuggaagaaaauuaucgaacauuaguuugguccuuucucuguucuuuuuuuuuuuuuuuuuuuuuuuuuuuuuuuuugagauggagucucacucucucacccaggcuggagugcaguggcgcaaucucgguucacugcaagcuccgccucgcggguucaugccauaugccauucuccugccucagccucccaaguagcugggacuacaggugcccgccaccaugcccggcuaauauauauauauuuuguauucuuaguagagaugggauuucacuguguuagccaggaugguuuugaucuccugaccucaugauccgccugccucggccucccaaagugcugggauuacaggcaugaaccacugcucccagccuucucugcucuuuuauuuuuuuuauuuaauauuuuuuauuauacuuuaagucuuaggguacaugugcacaacgugcagguuaguuacauauguauacaugugccacguugugcugcacccauuaacucgucauuuaacauuagauaaccuaauguuagguaucauaaugcuaucccuccccccuccccccaccccacaacaggccugggugugugcuguuccccuucuuauguccauauguucuuauuguucaauuuccaccuaugagugagaacaugcaguguuugguuuuuuguccuugcgauaguuugcugagaaugauguagaaccacuuuucuaaagagaugcuaaaagaacuugaggaaacccauguaagucagaaauaugauuucauccaaguccuuacuuuaccaaaaaaagcaagauuaauaacugcuacagcaaccauguuuuguuuucugucgugcuuuuucaacagcuuuucccaagagcgauaagaauauuucagaaaugcaaauaguaauaccuuggaacaagcguuuauguaauuauuauggugauaguaguaucaguugucuccaucaaguguuugagguguuucaggcacuaaggaaaucuuuacuuccauuuugcuuucccauuuaaucuuuacgacccuuuauggauaaguauuccuucacucauuuucauggagaaaacugagguuaagggauauguacaaagucaccaagaaguagacuuugucuguuagaaauagauccaggaaguuuguuucuguccagagccacagugcugaucacuccuuugugaccaugugaaggccuuuccugcucaaagcuuuauuacuguaauauuucacccuuucuguuuucaauaggaauugguaaccaagaauaugugcuuugggguuaggccaucuaagcuuccaugcugggucuguuuauuucugugcugugugaccuuggaccagugacacaucucuuugucucuguuucuucaucuguacagugagauggcuuaguauuuuggcaugugcugguacacguguguggaaugagacaaucuguacaaagcccuucaaagaaggccugggagagaaaugcuuucuauaaauguuagcuguuagcuguuuguugccuuuugcugccaucuugauggcaucccuaaagcuuuuuucuuuuggguuuauuuacuuccaggucucacuuccuuucuagguagaucuggugaacuagcagccugugguucugaucuguuccauuuuguuugugugcuuggcacacuuucuauaauuuuaauguucuucuuucucugcucauuuaaaaccauccuauuagggcuuggacauguuuguuuaauucucuggacuugauugaaauucaugaucacaauuaacuucuugugcagcccccuugaggcagcucaggguucuuucucaugauggucuucaguuuucuugggaccaaucaucauuagcauuggcaccaagggagaaugaaggagaagugacucccgagucuccauaagaggaaucaaaacugggcuuauucuuugacccugggguaggucugggucuugggauaugaucuaaggacuaacacuucauucuggggaguugccugauacuauuccuaaggggacauugacccuguguuggaauguggggagaucucauugauacugauaaggcuucuuauuuauuuguugauuuaguaugggagaagaucuccaaugggucaggaaacagauuugugacauugacaaggauucugaggacaauugcccuaugguggcuggaacgcuuuaguuugaggacuuuauugccagaaacaccaugucaugcauugacuuguuuucugcgguugugauaaccuaccuuguuuuaaccugagugacucucuccuaggagagagagccagacagacuccguuuuagugucuucacucgcagcccccuuuaucccccuuaagagaauaaccagugcaagcugacuccaagcacauccaggaaugcaccugcugauaagauacugaggcaggcuauaccagcagcuccugggaaugugcucgguggaagguaccuaagagccccugcauuuaucucuuagugauaguuuaagccccugcaccuggaacuguuuauuuuuuguaacugcuucuauaaccaauuaauuuuuuaacuuuuugccuguucugcuucuguaaaacugcuucaguuaaacucccccuccccuauuuagaccauaguauaaaagagaauguagccccuucuucggggccaagagaauuuugagcgcuagcugucucucggucaccggcuaauaaaagacuccaugauuugucucaaaguguggcguuucucuguaacucacuuaguuacaacaggguccuuguucguucuucacacuauugucacccugcauuccugcgggagagcccugcuuaaacagcagcacaugggacuuuuuaucuugcauucuugguguaagcaggugaggaccuacuuuuaucucucucucugccugucaugcuaaaacaaccagaaggccucugguuuacuuucaugagucccuagaagccugucaucagagagccagucucacugcagucaugauuuugguuuagcugcugguaaaaguguugugugaaauguuggccaugggccaugcagaaacaggaagagagagcacaauaaagagauaaaaacacgaacucucugaaggcaguuuuagggacuuugccuuuguugugugaguugauaugcacgacagucccaugaauuggguuuuauguaaggucuucguaucucacaaagacaugcagugccucaugcaaguucauccuaguuggcggcaccuuuguccaaggucaccacauuaucagugcuucucauagcugcuuuguguccccucucuuugcagacaguaccaccucacacacacuguccuucguguggccuguggggaggccacuaugccucaccugacccuagguuaagucaaagugaaauggaaaaagguucacaguggaagagaagccuccacaggugacagggcauggaagaagcccucaagcccucaagggcuggcugcaggaggcacagaaugaauugggcucucccccaaaagagagagcuucaacagagaguggaagagagagugugucagagacaagcaagugaauauaaaucagccaugugaugcugaggcaaggagggcaagagagccagagaagggauucauauuugagugaggguggccuuggacucaacacuucauggucaugcccaagccauaaauguuccugaucuacacaauuggagaagagcgacaagaaacacagagcauucagaggagagccuggaauuuauggaaguaaagucuguggggacacugcagcagcuuuggucacucaccaugaggaauugucaucuucaggggauaaauuagaugacauagaaccuuauagcuuugucuaggaggaacagggcuuauagacaacuucaaggagacagaagaaauugaccaaaguccccuuagcuucuuuagacaugaaaccuacugauuuucaugguaauauguaugugaagccaauuuguaaacuauaaggagacaggaagagauuuggucauuggagagggaucaccugaggucuggaguucgagacccagcucggccaacauggugaaaccccgucucuacuaaaaauacaaaaauuaguugggugugguggugggcucuuguaauuccagcuacucaggaggcugaggcaggagaaucgcuugagcuuggcggggcggagguugcagcgagccgagauuaugccacugcacuccagccugggcaacaagagugaaacuacaucucaaaaaaaaaaaaaaaauugaacuccaggacugacacaggcuagcucugggaugcuagaaagucaccucugccuuuuguuucagcauucuuaagagacuaauaauaccuacuuuauuaauggauggacuuguuggaaaucaauugauagagaauguauaaauauacucuguaaacgaugaagcauuuuauaaaaauauaacuucacauugcacggauauccaguuuuuuuaaauaaaauaugcagaaagaguuuauuuugguguuugauauauucuaagaugagugguaauagcaccuuuuaguacuucauuuugauuucuguucuagcauauuugcucuuaaaacugaagaguaaggggaaaauaaagaugaaaaauaugcuuugauauuuccaaauggagcuuuucaaaaugucuccgauggacaugguuaauaucagaauguugaaauugaauguagauguaucaauguguuaaauaaaagcuauuguccagcuuaagaauuaucucucacuauaguaauaucuaacuaguagcauucauaauuguaaucuuuucuacaauauuuuuguaagaagguugaucuuaaaaguuacacaaguagcuuuaaauauuugugucugccuugacaacagaaaucagucaagaaggcggcggguuuauuuuucuuuagguggguaaguaugauaagauggauggugcauuaaaaaauaaagagcaggacuucuccaagcugauuuacauauugauuacuuaaauuacuacuuaauuuagugccugcuaauaaacugugccuuggaaauguuucccaagcauuuauuggcugcaguaauucuaccuacaguguaugcagaucacagccucauuaaauauuaaugugcucaugaaauguuaauagaauguuaaugugaaauacaagggaaugugcucgcuggaagcugggagccgaggaaaacuaccugucuucugucuucucuuuauguucugucuucuggcucuguuucuuuuuuucaguucauuucucccaucauuaggagcuucagauuugcucucugaucuggcugucucagauacaaaauauuuagaggggagauaaaauucacugauuaauggaacuuauucuccccuccugcuuucuggaaugggaauuucugguuagaaucagaaugguuucccugaaaaggaaaagggugauucaggcugagugaaaugaaauugucuaugcuugggcagacugagugcauauguuuuggggaggccagcccacugcccagcucaccucagugggcucugaccuucaucucuaucuggaauguucuuucucacauaccuugacauagcaaggucuuucucaucguuugauucucaauaguccgagaaccuuccuugaucaccugguuaucuaaacuccccuccccaagcauucccuguuacucucugucacucaacaaguuauuuuuuauuuucauagcacuugcgauaaacuguaacuaccucuuuuguuuuuguguccuucaauuagaaugaaugcuuaaugaggucagggcccuugucuauuuuauggggcucagccaucuuccugguggauaacaggugcucaauuaauacuguugacuaagugaauaaaacaccugucccugccacugaagaguucauauucuguggaggugacaaaacagugagucacugcacagcaucauuguagaugcuacugagagaugaucauucaaagugguguagcuauuaaggaagucccagacaacucuuacuggggaugaguuuuggagaagaagcuuuagacauggauaaaguuccauaacuugagaguuuuguuauuuuguuuugcuuuuguuuaaucuauguguagaguaauucccuuaguugagaguguuaggaacaucucaaauuagcuuaagaaaagaggauaauuuauuagauggacaaaaggauuuucagaggagggauugagcaacgaaaggggaaagacagggaaguaguugugcuauaggaacagggggaccaguaggaauagguggaaccagucucaaacacuucuaggucucuugcugucucuugucucuguuuuacuuugcauuuuaguuuuauuuucuuuuuucugagggccaacauccagguaacuccuaaguccacacuccaggggcaccgucagcauaguugagccaguauucauucauucuuucauucauucauuuuuucuuucuuucuuucuuucuuuuuuuuucucuuucucucuuucuuucucuuuugagguggauucucacucugucacucaggcuggagugcaguggcacuaucuuggcucacugcaaccuccgcuucccggguucaagugauucuccugccucagccugcccccuagcugugauuaaaggcaccugccaccgcacccagauaauuuuguuuuuauuuuuaguagagagaguaguaauuuuaguagagauaguuuuuauuuuauuuuuaguauuuuauucgccauguuggccaggcuggucuccaacuccugaccuccaaugauccgcccgccucggccucccgcagugcugggauuacagacgugaaucaccauacccggccccaguuuuucucuuaguaugaagucucagggaaggacugugauugguccaucaugucacauuuuccaggcaugauuuauucaacugaugccagaggguaagaucuuguaagaauauggacuuccuuggaaaauauccuauugaaguuugagacugaagucacagaaggaguuacuauucccaagaaaagaggacagaaaugggaggacaagagaguuguuuggucacugaagugaaaaagucuuuauuguacuauuccaaaacacucuccaggcuucucuguguaaaugggaacgaacaagcaaaauauccucuuuuacaggguugaagaggguugucaaagauuugggggggauaaaugagacuuuucgguccuguauacuuggaguacuauuuuguccuggccccaagagucuucguuuggggaucugaaguggaucuauguauucaucuauuggaaugaaggugauauucuugauguuuuccacaauugaauuuccuuucuaaucuguucccuuucccauuacagauugugcuugagaacaguagucgagaagacaagcaugaaugucccuuuggccgcaguaguauagagcugaccaagaugcuaugugagaucuugaaagugggcgaguugcguaaguauacuuauuucccacaugggugugaagcuggcagagucccagcuuccaggguugugccccuaccugugugaagaaaucccaagaugccgacagcuucuuacggucaucacuguggauagguugauuauuauuuggcucagguuuacagcauacauacuuuugcaugucuggucuggaaguaaaugugauuaaaaccuaugggaauggagaaauuugcagaucauuguggcugaguuucaaauaucaugaaaaugaguacauauuaaaacaggcuugcuucuguucaggaaaaaaaaaucuauggauuucuuuuuuaaaauuccaguuuauaaccuaccaguagaucauuuucuuuucuuucuaagcaauuuuucucuauaaagaaaaauugaauaccuuaaugaaauucucuugcucucaguguuucuguuguuuggaauacuuucucuaagaaagaagaaauuauuaaagaaaauggguagcugaaaaugaaaaauguggucagcaauauuuuuauugcucuuuuucuuauaucacaaaauuuaugagaguacauacagaaaaagaaaggaugauaauuuucuugccuuuuguucauuggcauaauuuagcuuuaaucuaccaagguggauaugauuuaaccugucccuauuaucauugucgauguugaaccuucuuaaagugguuuacuuccauuccauccaacaucuagaagccagcacacauauaaaucuuuccgcacaggcuuaauaacaugagcaccagaaaagacuguuuauaccagaaaaauguugggguguuugguauuacugugaaaacauaaauauucaguugccugcucgagagcuuaaaauaauggccugaaaugauuaaugggaggaaucugaugauuacauuggaaagagaguuauguuuuauuuacaguguagaacugacuacagguacugcugaaauaaacuagaaaauuuaauacuuaguaaggaaaaauacuaagaaauugagccugguuggccaaguggaaaacuuuaucaucuuccagugugggcucaugggaggaagcagccaaugaugacauggaacaugagcauuuuugcauuagaacaguagcaguguaaccugagagaucucugcauucaccuacucugguuuacagcucaccaaaugugaagauuucuguuuacauggauccuugacuugaguuauccuucuuacucccuaauuacacuaacucgcugagauuucagugugcaguauugcuuacuguuuacucagcuuaaggauguaaguccuaaaucaaacaaauccugcugaauuccucugucugauaacugugacuguuucauguuuaucucaauuucaugggggaaauuggugaaaguugcuggcuggaaaacaugucuggaccaucugggaguuaauuuucaguaacuggagugaguagugguguucuaccaggcagguguuucuguguccaagguacugcucugcacugcccuugguugucuccuccuuucugaugacaaccuuuggcuguuuaugcucaucuugauggcagcagaaggcccacucuccauguguaccuucacucauguucuaugacaugccgugcccagcuaucugcucuucuccuuugcccaagggacauaugucuguccugcuaaaaguaaacacauaagagugaucugguguaggagguagagauugcugggaauagaggggaacugaguucagcucugcuacuuagggccuugugucccugagugaauuacucacaaaccgcacugugcuccuacaccuccagguucucuccagagcagaaugucuagaaauggauuggaaguauuuuggguggugauuugaguaguuguguucauuuucuggcugaaauugcagugaucucagugagaggagcucuaugggaacagucuuauucaaccuggggggaauaguuuggaagagaugguugaauuccagagcaggugcaggcaggguaaacaugacccugaugugggcuggccucugggucaguggauccccauccaguggguggaggggaccucagcuggcaagaaucugggcagguaguccuccucaggugaauguucauuuugugcuuggggaugggguggggacagaauaggggauagagcuugaccucuggcagguguagaguagcccuccuggccuuuccaggaccugguggucaauccaggaaucagggcagaacuccauuugugggcugaaguaacagaguggagaugaaggcaaacaccucgcaggucccuggagaugccacagaugcucuucaugcacugaagacuguuccaucucccaccuucugauggagagaagacucccaacauucugccacaacucacucaggccugguuucugcauugagacugggcuuggacagcugaggccuggcauugucaaagcagucucucuucaccuaagacgacaaacacauuuauuaauuuguucaaugaaaaucuauccaguacuuacaacaugccacagacuaugagggacacugcagguacaaaggaaccagauaugguccuuguccccgaaggaguucagaaaauuuccuauacacuucagaaaguggaagaaugagcugggacugauacuuuuuccuaugaguuuugucauuauguuuuuuaacgcaugcccaucaucuguccugaagaauaauuuccccaauguugugauagucauaaguuuaaguuuuuaguuugacuuauugcuugccaucaucugcaaagcccauucuggaaauuugucaaggcuuacaaaacacauucauguuucugaagccuacaugcccagaugaguuguuuucugcucauaaaauauuaaggauuguuacuuucugauugaaugcuagacaccaaaugauaaaacacccugugguaagagcaaaauugcuuuuuaauggauugcuuuuugcccauugccauauuaaauaaguuacuaauaugcaaagcuaaucugaauacacccuuauguugaaagaaaugccuauuuuucuucugaggaaaauuagauuuacacacaaaucuaucuucacuugguuuguaugugauuauuuuucuccauuccuaaguucauaguucugaacacuucucagauuuguguuaauaauuaaccuugaagaccauggucacuuuaguucuauaagcaagugcuaagaccaaagaaguacucaauuaaaaaucuaacugcuggggagaaaggauguuuacaaaaguagaaagauccaauuuucuagaaagcauuucucuuuugauuuuaauuuuuggucuguugaggaaacccaccucugaaauaccaauuauauuuuggugucuaaagcaaacauauuaauguucaauuaauuacugauaccaaauauuuauguucaguuuucuaagguugcuuuaaaaaaaaaaacagcacuauuuuccugcuucccaauuauugacauugcaagaagcaaauguuaccucuaauagcgugguccaaaauaaugucuauuuacauucucagagcacuuugucaagguuauucaguugaaggcuguaacacucucaggaguuaaucaagagcaauggcaucuauguuuauuagugaagggaagacuuacuugcaccuacugcguaucugaguuuacugagcucaaacuggaauuuaggaagccaaaaaaaaaaaaaaagaaaaagaaagacaguguagacagaggcaagaaaguagagugauugcauuugggcaucugaaugacccaucuuggaaucacagcucagucacuggcuguaugccuugagaauguuucuucucuguucugagccgcugguuccuuauuuaugagauaaaugaggaacugugcugcacgcaguugguuggagccugaaaugagauaauggauguuguccuaguuagaagaugaguaauuuuagggccggauguguuggcucacgccuguaaucccagcaguuugggaggccaaggugggcugaucacaaggucaggagaucaagaccguccugucuaacacggugaaacccaucucuacaaaaaauacaaaauuagccgggcaugguggcgggugccuguagucccagcuacuuaggaggcugaggcaggagaauggugugaaccugggaggcggagcuugcagugagcugagauugcaccacugcccuccagccugggcgacagagcgagacucugucuccaaaaaaaaaaaaaaaaaaaaaaaaaaaaagaauauggguaauuuuuuuugcaagugauagaaccucacuuuccaugagcaaacugaaaguuaggugaggagggugcuguggcauaaaugacagcuggaucuagggccuggaacaaugucccuuguuucuuuaucuucuauauauugguuaaaaguuuucuuuuuaaccugcuuuauucaugaggcucuuuugugagcaagacauauuuucucuuaguuucaguuucaaaaauuacaaagaagaauacuuagggaccuggauguggucacauauccccauagccugaauuggauaauuggcagccccagucagaagaacaagauugaagauugagggaugauaugguuuggcuguguccccacccaaaucucaucuugaauuguagcucccauaauucccacguguuauaggagggacccagugggagauaaucaaaucguaagugugguuuccccuguacuguucucaugguacugaaaaagucucacgagaucugaugguuuuauaaggggaaaccccuuuugcuccguucucauucugucuugccugccgccauguaagacuugccuuuugccuuccaccaugauugugaggccuccccagccacguggugcugugaguccauuaaaccucuuuuucuuuauaaauuacccagucuuggguaugucuuuagcagcagcgugaaaacagacuauuucaagaaaggagcaagucuucaaaagaagaguuauauucccugcacacugacccugugugugcagggucagugagaguggagggggcagggaguggugcccuuacagaaaacaggaggcauagcacagaugaauacacaugugcuuacugucaaugugaagucauuaagaagaugcccagcuccuagcuggggaaaaagaaaugguagcuauuuuuuauuguuguuauuaaagcacuuguccugaaagaaauaauaaauuauuggcugggcaugguagcucacgccuguaaucccagcacuuucagcggccgaggcggguggaucaccugaggucaggaguucgagaccagccuggccaacauggugaaaccccaucucuacuaaaaauacaaaauuagccgggcaugguggugcaugccuguauucccaguuacucaggaagcugagacaggagaaucacuggaacccaggaggcagagguugcagugagucgauauugccccauuguacuccagccugggugacaagaaugaaacucugccucaaaaaacuaaaaacauaaguaaauaaauacauuguugaugagugccaggaauacuugauuucugguacaaauggaucaauuacucucuuuugaauagguagaaccuuacccaauuauauuccgaugucagguacagcuaagauauuuuauuuuccucacucauucauuuauucacuuaauaacuguagggcaccucuaugagucaggaucagggucacuguggacauggauuuagaacccauucuccauccucaggcagcucacacuaacuggaggguccuucacauaaauaaaugauuauaaaacauuuuuccauuuguaacauuacauuugagucacauucauaucucugggaggcaauacuucauuccuucuguuugugaagaacugggcagggcuggggaaaggagagucuugcaaggugugauagagaagaagagauaccugcacgugggguucacaaagacaaagagauaucaggcagucauggcuguguggauggugggaggcggcuguugaaaauuccaggcagugagaaaugguaggcuagaagaccuggagguucaagggauucuaguuccauguaguuaaugcagaggguuugagggaggaagcaaagggcagaggugcuagcagaagcaguugucagaucacaaguauuugccaugcagagaguuuugacuuuaccuuacaggcaguggaaaccaauagaaggauuuuaauaaugaaaagaaaugucccaguuaugggaauaacacgcuagaauuagauuauauuuucugggugugacagacuugugagcaugaugguguacaggcucaccccaguccuggccuaauaaugcagcaguuaggacaauuucagcuacaaguaguagaaaucucaacucaaaauguccugccaaggacauguauugcauaaguccagaguuguguagauccuagagcugguuagcauaccuguccggugaugucauuagggacccaaguuauuuucaucuuucuguucugugucugguagcaagaugauggcuaccuucacauagucagaggaacaagaggccaucucuuccgguggaucucuuuuagguguguagaaguguuuuuggaagacuuucagcacacuuucucucguguuuucuuggcugacacuuuggcgugugacugugccuagcccagccauggacagggaaugggacuguccagagguuggauuagccauuacccauuacccauuaguauaacauaccucuccugaguauguuauaugaccacaggauguuagauaucuaaagaaaacuggaguuauguuaagaugggauaaauaauuacuugaaacccuuaauucugucucuuuacagucuuuucugcaguguccuuacugaugcagaaaaccauaacaaauugaagccagauuacaguccucugucauuuugucuucauugagaauuggggaaaugcacuaguaucuuuuuaaaugcagcaauaucaaagauugcagaaaaauggaaauugagguuugauuauaaugcauuucuucuuucaucacuaagaugcuagggcuccacugcauuacuguccuuuuagcaaauggauauuuccacuucuucaauuaugcuuuuguguggggguuauucucagguguauuuugaagagcagaauggacauacauuugugauugaagccuugaaacaguuuugccaaauucaccuguuugaccguuuauaauuagauuacaauuuaauacuacugcucuggguuuuuuuuuaaaaaaaagcaagaaagaaaccuacauuacacauuaugaaaauguucaccauuuccuuacuuugucuuuccauggcaauauuuauuauaauacaccaguggugccgaguggagcaccuuguauaauucaucacccagacaccucugcuuuagcaaguaaaaauaacacagaugagcaaccugaaggacuguuuggagugcagcagcaauuagaauagacacuuaacucugggacauugguguuuuuguaccuugagaaguaccauccgucacuuucauucuuggggaauacauucuggcuaaagaaaacucaagaaaauuagcuuuuaacaguuaaaucucuuaaggaccuuuuuuuuucuccaaauacgagcuuguacucuugcuuaugcaaaguggaaugcucucagaucuugauucugcccugaauuuucacguucuacucuuacauucuauuucaaccuuaaguuuaaaguaaaacaaaaacaaauguucuaaagccuaacuuugacauuaggaaguugcagacacuuuuggucuaaauuaaaaucaucauaggagagagcauaaaagucauuugaaggugauuguuuuaaauaauuaaaaaacuaauagugggauuuauaaugguauucuccaaggcaggagagaacuucauguaaaauucuugcauucaggaucagaagcccuugugauaggcauaguugauacgaggacuuuugccaugaugguuaaccuucaucuugccccuuacuguccccaucuguaacauagggauaucaucaucagucaucaucagucaugaucgucaucauucucaucugagaaucaggugaggaaauguuaguuaaagugcuuuguuaacuguaaaaugcacuauuuguggaagaaauaaauuaacuugaauaugcacaagcuuagagauaccaagaugcaucuugcagcaaagccaacuguuucugugcauuuuguggauauccuaagaaucugaaguucuguggugcuuuguuuguguuucagaaagcaguacuuggagauacuucugaaauugcaggaaaauguucauccccauaggaagugguuacagagagcaacuaaacuuggcaguuuaaaaggagacuauacuaagcacaucucaauuauaaauggaugaaaauaauauuuaucauagacuuuuuaaggacuuauuccuuuuuacauuauuucugaaaagauauagcuggccccaaucagcauccauuccuguugucucuuagaggucauggcuaagaggugagccugguagauuugcccaagcugguaaugagagauacagaccuguugaaaggcacaggcucccauugucuucuuaacgccuuauagaaacacuucugguucaucucaagcaucguuugggugacuguucugauuccucgccucaucuucacugugggagggcauuacagcucccucagaacuccuguagcacuuuaucugugucucuuuguuaugcuuucuacuguuuauuaauacauacccuuuucuuuuucuuucauuccuggccucacuuccccuaaaaauuggggugguuuauaggaaaccuugaagauaauaaaaaauaaugauaaaugguaaaaaccacggcaaauaaaaaguaaaaugaaaaaauggaugaugaaaaguacauguuacaaaagccuuugcauuugcuagcaguggacacugaauuuggcucaaauauucauuugucucagggaagcaagaggagcuugaaaauaugaaacaggucagugcuccaucucacaugaauaagcucaaugugaaaacccagaugcuaauuucaauuuaaacccaauaauguuaaaauaguguuucauaauauuuaauauauucauuaaagaugauggacuaggacacacucuuaucauuaaaaaaaaaaaucugccagaaagugacaagcuagcaucauucuuaaaauaaagauaccaaaacagcuuucccaucaaaaacugagacuaaacugggaugcuauaugaugcugauuauuauucaccauuacuauuucuccuugaucuggaaaacuuacaaacacauuagagguagaguucaucgauagaaacaaauauuuuaaacuguagguaauaagacuuucuaucccugaagaagcaaaggauaagcuaaugugguuuagaagaguagcuagauagugaauaaacgaaacuuaguagauguuccauaugucagcaauaauuauaaaauggaaaaaaaagauuauaacaguagcaaugaaaauguaaacuacuuuggaauaaucccaauggaaaacaucuuggaaacuuaggugaagaaaacuguaagacuuugccaaaauauacaauagacauuucaaauaaauagagaagcaaaauguuuucuuccugguuagaaaacaauaugcaaagguugcaaguuccucuacauuaguggacaggcucauaucacauuccaaaguaucacugggaauuaggauggaaacuucacgggaugacucuagacuucauuugaaagaauaagggcaugagaauugguaagggagaauugauauuuuuuuuuggcaagaaaguucaaagauuucuuuuuuuuuuuuuuuuuuuuuuggagacaggaucucacucuguugcccaggcuggagugcaguggugugaucucggcucacugcaaccuccgccuccuggguucaagcgauucucuugccucagccucccgaguaccugggauuacaggaaugcaccaccacacugggcuaauuuuuguauuuuuaguagagauggguuuucaccaugcuggccaggcuggucucgaacuccugaccucaagugacccgccugacucagccucccaaagugcugggauuacaggugugagccacugcgccuggccaaaauaacucauucacccagguucaucuauaguuaugccaacauuuugccacauauguuuuaucauucacccucuuuuucucuccuucucuucacacacacacacacacacacacacacacacacacacagucauguauuguuacaaaaauguuucuuuuagccaaaaaaauuguuuuaaaaaauauaacuugaagaaaaauucaaaauagaaguauuuaaaaucaguucuaacuccggccucuugugucugaaagagcaaaaggugcuggagcccugccuggcaggaggcuugcccgggagggcuguggaggaggaagggacucugcugccacagagugaggcuccaucuggaagugguguccagagccuggcugagcaccucugcuugcccuuagagaucugagagagacgcacugccgccuaauucuucccaaagcaggucaacgguguugcugucagggaccuuccuuggaugaaacuuacauccaccuucccuucuggucuuuuccaaugcuaguggaugucguuuuccuaaaaucccagugguuauauacaugaggaaguuuaaauucaggauacaagcaucuuauagcaggagaaacaucauaaaacaaaaucacaaauauaacaggauuccaaucaaugacggaggccauuugcaggaugacaucaucacgucucaucaguaaaaugaguauuaaagugacuagucucauuccaaagguguaaagugcaaaaaccaucuuucccuaguuccagagaugccagucucuucuaaaucucaagcuuggacccacggguuauuuuuuuuuuccaaagcaguaaucacuguucucagcauuucuuguaggaucgugauguaccaggccauacccuucaaaguccucauaaguuguaaaaguagaauauuaguauggaaggcagcaugaaauuggagggaaaguauaagcagaaugcuagaagauucuaauagauaguaaaauaaacuaaccucacuaaaauaaaguaaaacaacagaaaucaggaugucaaacugcacugaaaagaugaugaaaugcuaacuguaaaguuuucaaaaccaaaauauacaugagugaaacaaacaaauggaaaaaaaauaaaaaaacaaaacagaagcauacccacagcuaaagucuuuaaaacacuuuuugcagacacuguggcuuccuacagugucaguuuuucccucagggagucugcaguaguuaggggagcagcuugaggacagaaagcucuagaaugcuuuuauuucucauccuuaaccuggagccuuugguuguaaagauuuaccuggugguuggaauagauuagaagguggaugccaaucaggucucccagccuugggcacuugaacuucaaucaaaaaccacuugcugauuuuggcugggcaggauggcuuacaccuguaauccaaccacuuugggaggcugaggcgggcagauuacaugaggucaggaguuugaaaccagccuggccaacauagugaaacccucgucucuacuaaaauacaaaaauuagccagguaugcuggugggagccuguaaucccaacuacaugggaggcugaggcuggagaaucgccugaacucgggaggcagagguuggagugagccaacaucaugccacugcaucccagccugggcaacagagugagauuccaucucaaaaaaaaaaaaaaaggaauuugcuuuuuuaaaaagagggagaccacugccauuuauuggaugcuuucuauguaacagagaauucccagagucaauaauaagcacacguuaccucuguuaaccccugcaacaucuucauuuacaaauaaggaaccugagaugaagggagagguuaaguagacugaggugaugcagguauuagauggagugaauuauugugagauucuccugugcuguuugcccuuaacuauggugcaaugcuaucacccacugcuuucacuuucuuuguaaauauccugucuuccuuacagacuguaagcccuuugaggacuagacucuuagugaauucagcuuccaucuuaacuucuagcacaguguuuuacauguagucugcauuuaauaagcguuuguugcaugaauagaguagcuuucuguuugcuucagggucaguuccaaaaauauucuucagacauugcuaaauuuuuaauaaacuuugcauuuuacccugaaaccucucaaacaacauucuuguuuucuucuaaaauaagugagaaugaguuauacuaaagggcuccucuucaucccucucccucccgcuccuccucaggguaauuugguugagaaggcccacugaguccaaauuugaauuagaaaauaucaacacuacaguauguucccccaagaggaaaaaaaugaucuauuuucaaucuuguguuucagaacacacagcugugugacuuccuaauuuauuauauccccaacugccuccagacagcucucagcuugcugcuuuuuuucuacccacucccgcucuaugggaaauggguucgacuuuaaccagcacagaguucaaucucuguucuaggcaggacuccagugaggacuccgagaggccaguaaacagcacuuuuccaaagaugccuccuccucagcaggugcuccuauccaccaggacuugaugggagccaggucccuucagaugguggcuguaggaagccaggcuaucaggggcagcuccagcuggcaggucuucuggcugccugucucucuggagugagcucgcuuucuuccucccagagagggcuuucuggccugucugcagggagcaggacacaguuuuagaucccagcaaacaaacccaauguggcuucccuuaauuuggcuucccaaggguuuuggccgcaagaacagauugcagcuguggccugagcaucuuuagaagugugaaucacauuuuuuuucccugaagaagcuauuuugagcuuuauaauuacauauuuccauguuuuuuuuuauagagugaguaaggagaaugacuugcauuuuuuuaaauggaaaucugcugguuucuuugcucuucugucuuguauaacuuaguccagugauuccugacuuggcuguguaucagauucacuuuggggagcuucugugaaaugcaaauuccugcaggggaauccagaaaucagcaagcuuaauagacucugcaguugauuccuaggcagcccgauggcccccucccaaguuuggaccuacccuucccugggaauucagaucauggcuaaguggauauuacucugggguggcaagagccacucacagugccuaagagagauuaagcauuagaagaccuggauucuaguucuggcuccacuaccaagcagcucuagacaagugucuccuguaugguccucauguuccuaggcggggaaaugcugggauuguccagguggcccccagcucuaaagcuacugugguacuccuuguuauguaaccaauaugcugacuguaaccacuacauuaguuauacuugaacuuuguugucaccuguucuugagugacauauguauaaccugaacugacuauuccauuuuguacaagagaauuauggaaaugcccacaggccuuguuauaaagggcuccuggggaauaggcaaccucaaagcacggaccaaaggacuuaccucucccaugcaggugugacgacucucagcuuuuggacagagaauuaagcaaaaugggcuuuucuguuuguuuguuuguuuguuuguuuguuugagacagggucacccgggcuggagugcaguaacgcagucacagcucacugcaaccucugcuucccagguucaagugauccucccauaucagccucccaaguagcuggaaccacagacacaugccacuacacacaauuuuuacacagacacacuacucuacacuauaccaauuuuuuuuugguagagacaggguuucaccauguuacccaggcuggucuggaacuccuggacucgagcaagcugacugcucuggccucccaaagugcugggauuacagacaugagccaccguaccuggcugugaaauaugcuuuucucauucugcauguuuuucuccuuugaaauaucaaccaucagaaucuuuugagaggaguuaaacauuaauuuugccagaacagauauaggaagugguaaaaaaaaaaaucccucuguuuucaucauuuucugcccaacugauuucucccccucuauuuucccaugcaagcauccucugggcuagguuugguggccacuccauuauaaugccagugcagcuuuuggggacuguggcaggugccuggcccaucuuuacguggaaacagcgguaucuaaauaaaccugacacauggaggaagaaaugaaccuaaaugcaaaugcuauuaacauuucugcaagucauaccuauccccaagaagcauagcucucauguuucuuagucuuuuauuggcaauuuaauuguuugagaaauugcuuuuuaccagaguccguaagaauccuaccaaaaugcacugacuuauuuucccaucgacuugcccgggugagaacucagcuugcugcuuuucugugucauuaccaucaucagaagaaacuucaaauguaaggccucgcaggguucauuguuuucauuauuuuuuuuguuuuuguuuuagaucaagaguuuaccuuaaugcacaucguauuaguccauuuucaugcugcugauaccugugacuggguaauuuauaaagaaaaagagguuuaauggacucacaguuccaccugucuggggagaccucauaaucauggcccaaggcaaaaggcacgucuuaccuggcagcaggccaagagggaaugagagccaagugaaagggguuuccccuugucucgugagacuugcuuauucacuaccaugaaaacaguaaggaggaaauugcucccguguuucaguuaucucccacugggucccucccacaacacaugggaaugauggaagcuaaaauucaagaugagauuuggguggggacacagccaaaccauaucacauauacuguaccaaauucuccuaggugauuuuauuauaaaaaugaacuaauacgcauauuacuuuauauccugauucuuuucacuuaauguguuagagacaucuuucagaaaauauguucauucaaaaguucauucaaacuuuuaauaauugcauaguauuccauuuuauagauagggucauuuuguggauauggauauaaauaguauuucauuuuaugaaaguaugucucccauugacagguauuuauauuguuugcaauuuuuuuucuuauaaagagcaccgggaugaacauuugcucaguaaauacacuuaacauguuagcacuggggcuauagcagugaaauaaucugacuacuauccauucccuuaaagagcauauauuuuaguuggagaaagguaauaaacagauaaagaaguaugucauauggugaaaaauggagaaaaaugcagcagaaaagggaggacucaugagauugccucauugagauggugacauugaucacaauuaugaaugaagugaggaagugggccaagauagugucuggaaaagaguuuuccagaaagagggaacagccaaugugaagacccugaggcaggaguguuugccaugagaaaguaagaacacagaggccaguggggcugaagcagagagaaccagggaaagauaguauaagaguaggcuagaggguggccgggcacagugacucacaccugcaauuccagcacuuugagaaggugaggaagguggaucacgaggucagaaguucaagaccagccuggccaacauagugaaauccugucucuacuaaaaauacaaaaaaaaaaaaaaaaaaaaaaaauuaggcgugguggcaggcgccuguagucccagcuacuugggaugcugaggugggagaaucgcuugaauucgggaggcagagauggcagugaacugagaucacgccgcugcacuccagccugggugacacagcaagacucugucucaaaaaaaaaaaaaaaaaaagugggauggugggugagagauucuucaggugcuuguaggcccuuguaaccaauuuggcuuuuacucuacguagaaagagaagccguugggcagauugagcauacaugugacauuaugugauuuauaauuucaaagaauuguguggcucauguauugagauuagacugugggagagcaaguuaauauaccccacuacaauaagcaaguugagagaugaugguguccugaaccagaguguuagcaguggcaguacuguaaaaagguuggauucaggauuuauguuaaagguagagccaacaggauuuuccuggaugauuggauguggaguggggaauaagaggagugaaggauggaugacuagaagcagggagucaucacugaaauugauggaggggcauagaagauuaggaguucuguuuuguuuguguuaauuuugagaugcuguuuagacaucuaauuggagauguugauuucauaguuggauauaugugucuggaguuuaggggaugauuuugaauuggagauguaacuuugagcaucaacaguauauagauaauaguuaaagcuaugagacugaaugaaagcauugaagaggcccuagaauugaugccuagagcaccccaagauuuagaggcuggggagaagaggaggcuggggaaggaguugaguggggcucccaggggcauaggaagaaacucaagagaaaguucaauucaaggugaaggagagauugcagugucauaugcugcaggugaugggguuaaaugaggacugagaacugaccauugauuuuuaguaagguggaggucagggugaccugaacaagagugauuucaccggagugggggaggagagagcccaacuagauggguuaagagcaaguaggggcagaggcaaugggacuauuaguagagaugcaugcugcucagugugggccacugauggcugugaggagauagugaagaggaggcuuuuagaaacauuuacaccauuugacaucaccacagccuucaagcccaugauccuuuuucuagugguuaauuuucauuauacuuuuucaagagugucuguuucuaaucaacaaguuagacauugaaaacaaacugguuuucacugcagauaguuugagagguacugauacagaugaccauuuaaaggggcuuugcuucacagugauacagaaaauaagguagaagcugaaagggaaguuauagucaagugagauuuuuuuauuggugggagaaauaacagcauguuuauaugcuccuggggaagauuugguagagagggaaaauuugaugaagacggagaccuauaucucugucuuuacacacaucuuaauaauuuccuuagccaagugucuaccaacagauucugaauuagauagugcacacuuuuaguauuuuuaaauucacagguaauauaugcucaaugcuaaaaaauuuaaacauguagagaagcagaaccaauaauuaucuauuauucugccaccaagagggauucauauauaccuuuguacgcuuuuugggcauuaauacaggauuaaagcguguauuuuuaaauauucuauuauuuaauauauuguaacuauccacgauaacaaaaauauaauuguaucauuauuuaaugucugcuuaguguuucauuguguguaucuacuauaauuaauuugacuagacucauugcaggauauuuaaggauauuuccuuuuuucaugagaaauagcacugugaugaacauccuuguaauuccaugugauuauuuccuguaaauuaauucuuagaagaaguucuaugucaaaugguuugaaaucuuaaagcuuuuuauuuauuuaccaaauuaaccccuagaaaggcugaagcauuugcacuucacagagcagucauguagauucagauaaaaggcaguuuucaaacuaauuaaaaaauuggagguagaggaagaaaccuaacugagauggugggauuuggggugaucauauauagggagauauuaagauagauggaucauuaauagauauagacaugagagagacuuacagauguaggcaugguagauuuaugcauauuuaugauagagauuuauagguagagauuuauagauagggauuuauggaugcucuuucuucaucuacacuauagccauauuauuacuuucaugugcccuagguacuuuugccuuugugggucccuuccuucauaaaacaguauuaaaacuuaacauuuuaugacugcauuauuauaaagaugaauauaaucgugcccggauucauuauuauauauucauuauucuauuuacguuuuccuucugauuuaaauugaacuuaaaauauuuucaggggccucugaaagcaucaugggccugcagcacuguggcugcugggccuccugacuaggucauccugauucugcuucucuguacucuuuauauuuuugauaaugaauagacauuacuuaugacauaaaaaauaaaagaggaaaauaucaaacuaaauguauaaauauucaugcuuccuauguagguuucuuucccuuuacucacgaaggcaggagguacauuccccuuugcucguaugcucuggaucauuucucccuaacaguggguuagacuggaaggccuggcuccugcaaucaagaaaaagugaaaaugcacuagcuccucucuccaccuguggcuccuccugaccccuggggucaccauuuaccccguuguuggcgccugaaacuugcugccaucuucagucacugccucacauccacagucagccagcggccacguccuguuaauucaguacccauauuucuuaaaucuccugauuuuucugcauauguacucccaucacucuaauucagaucaccauuguauggccugcauacuugccuccuccaauccgccccugcuucauccugcaacuguguauuuuuuccuacagcauugucagaccugucuaaaacucccauugggccaugauuccucuuaggcugaagcccaaacuucuuugcaacaccaccacgccccagaaaucucagugugacgugcuuccucuucacccugggccauggcccacacuggguccucauuccagaauguccuuuccaucccugugcuuguacaauucagacccacuucucagccucucucccugagggcacagcucccugagaccugggcuuaauccugcccuucgcccuguugaggcacaucucacacuguauugaauugcauauuugcauaucuuucuuugcagcuuuucucccgccagcuccaucugccccauaauuaguaucaguuccaucccaauucuaguauaagauuguccuuuaauccaacauguauguaaagcuuggagaggcugcacggguuggagcggggcagcuaguggcuaccauacugaacuggacagaagacaguuuuguuagaaaguuaaauucuuuguugucgggggcauaauugggacaguaaauaauccguaaaaucucccagucagcacaggcaguuacaugagauaguagaaggcaaugggaaggcucuuagccgcagugccagauacacagccugugcucagcagauauugccugucacuaucauccugauggaggcagcauugggaaccuggcuggccagaagugggggcugucugugguggagcguugugcacccucaggaugauaccaucacuggcagucggaaggaggugagaaaccagcagauggguccugcugcugcuagauacucaccaauggaacucaagaucuuuguucucuuuaugugggauggagccccagauucuuugcugccccugaccuugaggaaaaguuagaaucauagccaauaacacuuacugaacuauuuuggcuaacuagagguuuggguuuucaggugauaaggaaacaaauuuaaacagccaaacaagaucaaucuaaccuucugguuguugacuguguuguuuuucccuuaaaacacuggucaucguggcuggugagaugggcaaaagagaccguuuccugaaccuuuauucuuacuucaucggaucccaugccacaugguugucuguauuuaugcuuaagauaauacuauaauuucugucauuuuugaguauuccucuuuagucaugaccuugaguccuuugauuucuagcuuugaguaguucaugagaugugguuguggaggcuuuuuaucucaagaaauaggaaaaaaaauaacuggaaggaggcagucaaauggauuacucucuggaaguaauugagaauagugacucaucaggggguaacgaaaugacuuuagugaauuuuggauagugguuucaaaauggaauaaaauaauuuuuagagugccucacaaguagcaaagggaaguguuucauuaaaucaguuuuacauucaucugccuguguacugggauguaguacaaauguguuucauacuguaggucacagcugaaagaguuuaaaaaguuccccucaacccccaccccauuauaaggcaauucaccuugaaauuacuuacucaacagagcauugucuguuuucacauuaaugaaugcauuacacauuuuuuuauucaaauucauuauuuugugucaggguuuaucuuaagggaugaguugccuggcacacagugauacaaggaagggugaucaucaucugucaccaugcaauuccugcucacagccuuucuguuggugccacuucuggcucuuugugauguccccauaucccuaggcuucucccccuccuagaagggcuucuugauagauuagaaaauaagaaugagugacauuuccuaugugcauauaagaaggagccacaagacaugucuuuuaaauaaaaggacaguguccauccuuuuagcugccgaauagaaccuuggucucauccuccuggagcuaggccuuaaaacagcuucuguguuucucauuugucucaguguuuugccaggguuuuaucggaaagauaauguuccguuuaaaauauuuccuaaugaggccgggcgugguggcucacgccuguaacccuagcacuuugggaggcugaggcggguggaucacgaggucaggagaucgagaccauccuggcuaacauggugaaaccccgucucuacuaaaaauacaaaaaaaaaaaaaaauuagccgggugugguggcgggcgccuguagucccagcuacuugggaggcugaggcaggagaauggcaugaacccgggaggcagagcuugcagugagcagagaucgugccacugcacuccagccugggcaacagagcgagacuccaucucaaaaaaaaaaaaaaaaauuccaaaugaaagccaucaacuacuaucuacguaaaagccauguaucuaaaacccaggcagaaauggcuggcuaaguguuacacaccuuuuauugcucguggacaucuucacacacaauccagggaaugggaauaagugcggcaugagaaagcaauuucaggguuccgacuaauaagaaaaugauugaguagucauucacccccauucaagccaaggucuguggaaaaacccuuacugcuuugggccuugaaagucucuguaaucuggcuucugccuguuuuuugccuuaaauuucuaaugcaauucaaaagaaaacuaacaaccaaaaucagcuugcauuuugcccauuugcaacucccuaaacaagcuaaaccuccucacuucugacucugcucuuugguacguucucucccuagcugcuucuggucuaauauuaaccccacauucauagccggguuauugccaccaccacacaaaacucugggggcccuggauccaggcuaaguauaauucagugcacuucuguggggcaccuacuguguugcaagcaugauacucagauaggacagcaaagacaaaaggauucuugucuucauccccucgcccuccugggaacccaggccacagaguuauuaggcaaauaccuacuggacaucagcuaugucucagaucucauuccaggcacugggaguuuauugaucuggugaagauaaccgaaaagugaaucaugaguuauuucuuauuuguuuauauucuaacaccauuuuaagcuacugagcaaagaguaguucucuagaagcaaaacagaauauuaauaaagcuguuuuacccacaguaauccuuugauuucuaccacuguuuagacaagugacauagcauagauuuuauuuccaaauauuuucuauuauauuuaaauuauacuauauauuuauacccuauauaugaauuuaugcauauauaaaauauauaaauguauuuacauauauacauaaauauauaguauuauauugauauauaaauauauuuauauacuuaaauauauauuuuugcauacuauauauuuauacuauauauuuaauuauacuguauuauaacuuuugagaagaucaguauuuucauuuuuuaaaauagucacauaauuguucuugaauucuuuucugccauuucccuacuucuccuaaaauaucacacaaaaucuggacuguauaagauacauagaaauauauuuuaauauuauaaaaucaauacauuaaaaauuuuaguggucaggugcagaguggcucuuuccuguaaucccaauacuuugggaggccaaagccggagggucucuugaggccagaagacaagucugggcaacacagcaaaacccugucucuacaaaaaauaaaauaaaauuaccuggacauggugguaugugucuguaguccuagcacagacccaggaguucaagcaucacagugaacuaugauauguucgugaaggauacagugccaccguacucuagccuggacgacagagcaagacccugucucuaaggaaaaaaaaaaacaugcacacacacacacacacacacauacaaaaacaacaauaaaaaccagaugcuuguccgcuguugaaaauguagaaguuuuagaaaaugggaaugauauuuaaaggagaaaauuaaagccccuuacuauucugccaccaugagauaacaguguaggcauagugauguguucccuuuuagccucuacuguaucuauauuuguauccucacauuaucugcauaaauacauguguuugcauauacauguauauauaaaaaaugugggaucauacugccucugaaguucagaauccugguuucuuuuuuccuucccucaaaauuaucaucaguaacuucuuucuauaucuuaaaauauccuucaagggcauauucuuuaaugacuagauagcauuauguucaaaagaugucuauuucuauauauugagauuguuuccaaauuuuuacuguaaaaaacaccucuggcuauaucuaccaccagaauuaacgcaaaggauucauuuuuaauguuuuacuuagaagaaauuccuagaagugaaauugcuagucagugggcauguauguauaguuacuuagauagauguugccuaacugcccucugaaaaguuuccuuugauguuucuggccccuuagcagggauaugauaaaauuauagcaacaauaaaagaaaaccaagaaaccucuuugucaacuugagaguucaagguauugucucauucuuggcucuuuuaugagaaagguuaaacauuuuuugacauauguauuguccauguguauuuuguguguccaaaugguugguucuguuguaauugcaugugagugguacucgccuuauguuuuaugaagaagagaaaccaguggcacccccucacugcaggcuccuccuaguuaauggugacgcauguuauugauguaggaacugaagguugacucuuuaaguaauaaggggaauggaugauuccucauuugggauguguauggaguggugguuuuacuuacguaguuuacugcuuuaaagauauuaaaauagaggagcuauauugauuugcauuccgaguucauaagaaguuaaguauugagggaccuauauuguguuuucaugcugcugauaaagacauccccaagacugggcaauuuacaaaagaaagagguuuaaugaacuuacaguuccacauggcagucacaucguacguggauggcagcaggcaaagagagcuugugcagggaacucccauuuuuaaaaccagccgaucuuaugagacuuauuuacuauaaugagaacagcacaggaaagacccacccccaugauucaauuacuucccaccaggcuccuccuacaacacgcgggaauuguggggguuacaaaucaagaugagauuuuggugagaauacagccaaaccauaucagggcccaagcccaauuuucagaggagacccuuuuuuggugcuucauguacuuuaacacucuuuguuuuuugaauugccgaaagccuauagaguaguuggauuaguagcuaauuuuuguaaguuuuagauuauuuuugaguuaauacuuuuagauuuaaaauaaagaaugcuccuccucauucucaagaagaacuuguuuacucuugagcuucagcucccagcugaagagcucuccugaaccuuuuuaauugaguauacuaauauuauauauauugugugcgugugugcacgugugcguguguguguauuuaaaagcuagauaauauuccaaagaaaugucugaccuaagauaauguuugaaaugggagcauuaacaaaguuaguuuugccugaagggaauuuuucuuauuuuaaucuacuagcaaaauuaaagagccugggggaugauauuuuuagcuauuguuaguaaauaaaauaugguagcaugaguuuuguuuuuuucaaguuacaccaaauaaaggaagauguuaucaaauuguauugucuuccuuacuuguugaauguacuuaaauuuuuuagcuuaauuaaaccuggggaguggggaagguagagacuauguguacaccaccauugagcucucucuggaguugaauucuccuuaggagauuugaaucaaaacacccaaaauugauucuguucuugaacuauagucccacucaagacucugaaacacaguuaugaaaucucuugcuaguuucuuuuugagagcgugaggccagcuuugggaaaaauacauuuuuuuuccuaagauugugggcauggugaagaauaugagguuugaauguguagggguggagguggaagggaugaauaauuuauucucuuucuuuucuaccuacuauucauguaaauggaacccuacaauguguagcuuuuugugucucucuucuuccacucaauauacugguuuaaugccaguugagauucaguuuucuuuguuucuuuuguucucuuuuuaagucagagucaucgagggauaauuuauacaguaaaacuuacccuuuuuugauguacaguucuuuaguuuugguaauuguauaccaucauguaaccaccaucaaaaucaggauacaggcuauuuucaguucuccuaaaaguuuucucuggacaaugaguuuugccucuuugacuaguaguucucaguugguggaggauaaucggugggggaauguggugaaaguaaaucuaggcucauugacauaaaucuccacuaaucucauugaguuaacuguuaggaugaugcacugauuccuugaugagaguaugccuccccuuugugaauuguauauaaaggaaugucccagaagagaaaauacaucacagaugcuccccuuaacuggauuacccuacuuaguuuauuaauccaggugugguuaguuccacagggugagccaggagcccugccugacaacagaguaaagcugguacccaucauucugaaauccaucaugucaucuuucacuagaagccaggaauggccagaccaaacaagaaagccuugcucaagacacgugggaccacagaugagaacaggaggcuggaaacccguguauuugcugaucuugguuuccaauuuacagcuguuaucccagacugauacuuaaauauguguuuuaaguauaacacacacacacacaguucacaaauuccaacggaaaucaagaaagggugcaauauuuucagugaacuaaauugauaaauuuuuauggucuuagcccucuacuauagaugaaaaagaaagaaagaauacaagaggauugcaucuucauaugaauuuuucccagccucucauauucucauauccucuucucgucuguuuaaucacacuccccaagauguggaaggcuugugaagagccacagaaugaagagacuuaagcagcaugggcuccucugccauccaauggugccaggaacguagggugaugaggauguaagaggaugcaguggcaguuuucccucuuuugccuccuuugauugcuaucuccuuacccccuagagaaauaucuucugugucugauuggaugaggugaagaaaagaaaauugcauuuauuugaagcuuaaaguuuagccagaugggagccagcuuaaguuucauuugaauauaauuuuguuuucuccccucgucacccuccuauguugaguugccucugacaacugauaaaauucucauuuucaagcaaaucuaggauuuagauauaaauaugcagagagagcacagaaauuagcucauguucucaaaguuaaaaagggugaaauuggaguaacuucacauaagaaaaauuucaacuuaugcugguaagauggaucgaaauagaauauaacaauauuuuaguuauaaaauucuuccaauucuuaauuuuuaagucaguagaacauucuagcaaaguuuauuacuaauucugagacccauuuucucaucaacuuuuaguaugaaaucggagaucgguuccauuugaaacauuucuuccaaagauugagcuaaaagugcuuguuaugaaauaaauuauaaguuuggggcauguuaugagaugugagacuuuagaaauuuuagcaccuauuagucauucacuuuucuuugcuacagugaggcacaauuugagaauuucucuucuagggaauuucuuaauuucauguuugcagcugcuagaacuuuucugauuuuaguaacucugguucuggauuuuuccccugccucauacaugaagugguugggaagugauggaguggauuuguuuugacuuuaucagaucaagaauuaauuuacuaauuugagugguuuucaucaagaaacauauucuuuuccuucuaaauagaucgcuuagaucuauuuagagaggucuuaggaccagacuuguaagguguagauaaagcacauuuuuuuaauguauuccuuuugucucuaguuagacuuacuggggaaguggggaggggcuuacuggccaacccugggaguaaaugguaaccauuuauuggagcucuuagugguuuagaaugggauuggagcuguucccaccacugggaggcucccagggagcagcagcugcaaucuuagaggaaugaaggaguguccuacugucaggauagaacccugacucuuacacggagagaugaggcauuuggagacaugugaccaucauuucaaaaugaggucauuaacacuuuuauauuucacauguagaauugucacuuaaauucaaacugcuguuuuauaauuauuuuguauuagccaccuuuauauuuaagauuuauagccuucaauaauuugggggaccaucucaugaccuaggagucgggcucauuacuauguaauguuugcuuguggggcccagaccuccuaaaggggauuucuguaggaaucccucaagcugucugugcuuuagugagcaccacuaucuccccuuuuguaaaccagcaugaacacuccuuaguuucauuauaucauuauauuggguaaugaaccaacuguaguucucucuacucucucaguuauauaagucugagacauugcauguuaauuucugaguuaccuguauccuaaauguuuuguucuuuuaugaaauugauuuucuuauuuguguuuuacugaggcauaugcuaaaauucaucugccuuaacagagugggccucauaguuauacuagcaagugcaauaagaagagaugggguuauguccugggaauuaauguugacaauaagugucauauacauuggccacugucaacugugaccucaucacaucuuaauggucacaaauauucuauuacuaagaauagguaaagugccaaaggguacaggugguuuccuagagcggguucaagaauaucucuuuaacgucacucucacuugcuaacuuacuguacuuuccugagacagggagacugggauagaguuucacccggacagcugggaacugcuuuacugcacaacccaucucauguuaccacagccuucauuuagggccugccuggggaagggaugaggcaugugaacuuucccaugugucaaaguggaacacgugacccacagucaguuccacuugagagcaguagaccugugcccaggccaucugugccuauuaccuguuggucuucuccauucucuuagcccaguauuuggucucuaauguucaaaugcaaauguucugaguaccuccauaauacugaauuuuggauucucauaaccccaagcagaguucgaacuguuuuauuuaugagugagaauagcucgccuagaguuuauauuucaacucauccuucugagauuugucagugacuccaguccgagaagagccuucaagaacacauuuauuagccacaugaguucuuucaaagaagcuuuuuuuuuaaaccuuuaugguguuaauaacaggaaaauucugucuuuucaaaaaaaaaagaaagauuaugugaguuucaagcuguugcagacuaacaauuucuauuucuaguuuguuaauuuuauaauucuaaaguuaauagagauaacuuagaaacaagguuguuuuaauguuuuaaaugucugaaaucauuucugaaauuaucucucucgacaucuuuuccuuaaacaaggcuccgcuucuuuuccugaugaugaaacagaugacuguacauaguagaauaauuagaaaaggaaguaugggaagaaaauaaauaucuguacauaauacaauaauuagaauaugaaguauaagaagaaaauacuuugcauuucugucgcucuuuguugcacauacguuuagauauuuuguucaucgcuguacccugcugaccaacagaccugaaaaguagugagaugcucagcacauauguguggacuggauacuuuuuuccauguugauuucuuacuuucuuuucaauugauggggcaccuuagcaccaugugaucagaauguuuacucucaaagcaucaugucuguagaugaaugcuuggguugcgugccacccucaguaaucaguggcaucuauaaauuuaaaccuuuaccuaaaaaugaauggaugaguuucuggagaauacauggauucugauuuuuaugagaucuucuuuaaauucugacaaaguuugucucauaaauucagucuguaaaaaauauuuccugccccaaaaguuucccagauagagaauuuacuccuaaguccuuuugauggguauugcugucuaaucagucaaaaaucuuguagguuauugugacccacuaguuuugcuuagcuggguaaugcaaguggauuuccaaguaucagagcagaugaaaacauagugcccucaguuucuggauuuuuaaaauuaauuuuguucuacccuaaaaaucaugcaagcucuugaguccaauguucucuuuaucaauagcucuuuuauuuuuuaauuggcaaauaauaauuguacauauucauggggaacacagugauguuuugauauauacuagguauaguggucaaaucaggauaauuagcauauccaucaucucagucauuuaucauuucuuuguguugggaacauucgauauccuccuuccaacuuuuuguaacuauauauuauuauuaacuauagucauccuacggugguauagaacacuagaacucuuugaggcucuuugaggcacagaggccuacuggccuguagccacagugccuucuuuggagaaugaccccagaaggccuggguacuggguaccaagggacaacccaguggccacagccaggaaagggccugcaucugugcuuggagaaucacuucgugcugagagagauucaguuuugccucauucuugccauugcccucaaauggcuaaauacuagauucagagaaguaaggcuguacacccaggcauaagugcuugcauuaauggacaugccacacucagugcccuacaguuuugauuccaucucuuccucaugugguugugacuuaccuggcuggcaaguuuauucaucuguucucacgcugcuaauagagacaugcccgagacuggguaauuuauaaaggaaagaggucuaauugacucacaguuccacauggcuggggaggucucacagucauggcugaaggugaaugaggaacaaagucaugucuuacguggcagcaggcaagagagcuugugcaagggaacucccauuuauaaaaccaucagaucuugugagacguguucacuaccaugagaacaguaugagggcagcugccccaugauucaguuaucuccaccuggcccugccuuugacauguggggauuauuacagcucagagugagaucuggguggggacacagccaaaccauaucagugagucacagacauaacuuuucagauuguuucuuuuucccagauugcgugaauguuguuagggcaggcagugucucuaugcuuguuuuguuccuccaguccacuagcacgagcguuuucauuuucaaaauagauacauucagacagagaacccuaaaagaaaaccuaugcagagaaaauaaacuggcacuuuuuuccauguggguugguacuaaaguuaugagaugaguuaagauugucucaagagaauuuggagugggaagaacagagguccagcaugcaaacccauggaagaccuucauuuaagggcuucuagaggaagaggagggugaccacaugaaggagugacuugagggggaagggcagaaccagaagacauggagguaccagugaaugcugcuaagagucaaguuagaagaggacugaauuguuuccuggaggacacuggaguccuuagcuagcgcaguucucauggagggauggaaggagauggaaggcagaguagaugucaggccgggggugauggagacaccucuuuucaagaugguagccacagguggaugcaugccuauaaucccagcuacuugagaggcugaggugcgaggaucccuugagcccagaaguucaagaccagccugggcaacauagaaggaguccaccucaaaaaaaaaaaggguggggguagccaugaaggggagugaagagauagggcaauagcuguuuggggugggagguggagguguguguuagaacccuggcuggguuuucauuuuguuuuuguucauggugguguuugggagugaguuuuuguaaagaugagagacacuccaacauaaaucaccaauggacuagaaccaauuauuuucagcaaguuugguagccagucguuaaacagugggcagcucagaauuggcuauggugggaauauuuacacuacagaaacuggcaaacacaacuaagaccuuaccauccccaccaaaagcuagcuguuaaacagguacugcauacugcugagcauaucugaauacagauagacaggauccacuguaggcaggagagacgugcaggagagagaggagacacugauggagccuagucucugcagauggggaaggagauaggaucugaguacuuacggggagauuggcuuuuaaaagcaggaaggguuuuaauaggguaaguaagaaggauaagagaggagagaaccaagauucauaauaacagugauaauuaucaaggcuaacauuucugagugcguauugugugccaaacacuguucugcaggcuuugcccguauuauuuccuguaacagcuacaccacugaggcagguaguguccuugugucuucauagaugaggaauccgaggcacagagggugaaguaguuagcccaaggcccacuggcugucaaaccuuggacccaggauuggaaccugaugaucugaugcuccagcccucauacauagucccugcaguuucuacugcaucgcagaggauaugcagaucccagggcaggagcucccugggacccaagcuccauaccaaugguucaauuuucucuaugaaggaugcagcaucacccuccuagcaugaggggagucaaugagcaagguuuaaagacaguagaaaauuuaugaaaugauguugugcagcaugugagagcaggaugucuagaggaacacgagaaaaugcccaggcagugucaagggcccaggugaugguuuggauccugacuguagugaggccaucuggugggacuguguucuugcagacacuucagcugcuccauguaggcccagagaaagaagcccauggagcuccucuauaguuaggacuaugacaaguggauacggcagacgacccaaggaugaaaaaauuuaggaauuuaggcaauuuggcagaaagagcaugauuguaauaauggaccguggaaucugcaugggagaaagugguugugguggcaggagggggcugguugaacuugcgguuuugccccgguugaagaacuacagcagugguacuuacuacuuaaggagguaggagaggaggcagucuucaaaaacuugaguguugcaaugugcugauucuggugaacgugcguuuucucaauacucucagcucaagggugacugcggagggagauagcggaggggaaucgagugaagggucauuggagaugaggccaagggucauacaaguggauuuaaaagcaacccaggaugaugguagaagcugugaugaagagaaagacugugaucauggcuugaaaacacuuacuauuaaauaauaugucauuugacuuccauaucuauugcugauacuauagguaauguuuauaguuuaguuccaaaacuaauuuguuguauuccuuagggaaggaaagcauaugccuaucuuauaauuuuuuuuaacuuuguuuaguacugacuguaggaccuuuuauuaguuuuuauuuugaagauuuagauuccuuacugaaccugaaaauaaguagcagcauaguaaagaaaucuuaauugggugaauuuucaccaggauuuagcuagucaccaaaagcugcuuauugauuuaaaauacaaccuacagcccuccucagguaauacagucauacuugguccagguguagacuugguccaggugugagcauccauuugaaugacaaucacauaagacuugaagcuuggacuuucacauaaguuucagauuucuguccccuuuucucugcuggucuuuucauugaauccuaagagaacuggcauucagaaguaguaguaagguacaccacagguaugguagcuuauuuucuuaccgggaggauuaaauaaauucucauccugggccugcauguguaggggagcugugucuguuauucccucucugaugccucuggaaugucuaggcucccacuuauugggcugucagcuggucaggucauaccaguugaaggaaaccuuucuuuuccuggaaaguagccugcagugagcugcucaugcaacugucuuuuccucuggaccucaucuugaggagaacuugcuacucaguuaauacaaaguucgaccuaacugugguuucccuugcuuaggggcaguguuuccucauguucuaagugggauuaauuuucauaacuuaauuuaccagguccaggaggcaagcugcaguugcuaugggaacgguaacugaauuuccuggcuuuuguacauuuaacacaucaacagugacgcuaaagugacauaaguauuuaucccuuuccccacuuucauuuccuuuucccuuuguagauggauuauuguuggggaaaggagaaagaggauuuaauuucacagcccaguuuaucugauuagugugucauaauauacacucggugagcuauuuucaugguaguuacaugucuaaaggaugcacgugucuaaaccacuucccaccuuuggugcugguuuugacaggcuuucugacaucccagagauccacguaagaaauuuagagagaaaaauguucauccucauagcauuuauugaacuuaacauggcuuuauguacucugguaagugaauugcaaauuuagaaugcugggcucauucucauuucuucuuaaucaccaugagucauuccuucacuaacauugaaaggccuaucagguuagauaucuauauacacacagagcgugauugucagagaaauacuugcacugcauuucuaggccacauaaucuuuagccuaacauuugcauauuaaugcauaauuguaaaacauuauguaaauuauacaugguggugaauauauuaucaaaucaaauggccuuuagggguaauuacaggaugcugcuaugucaacuaggaugcugcagguugaaugcugaacacuucucauaggaugaaauauaacccagccaggguuuaucuguguccaaagucacgaguugccuuucagugugacccuccauuuuuguuaaaugaagcacauuuggggucacagaauauuaggaaugaaaaggauaaaauccugaaugaaaaauauuaaaauguggaaaccuuuuagguuggcaauuaaucuaaauaucggagucauagagaaaaccccaugaguauugaugccauucgguguauuuauuucaguauaauuuguuuauuguucuuuuuuauuuuuaaauaauccaugcucguuauaaaaggcagcagacagcauagucuccuuaggguaccccauugcuaaaugacuugauucuuuuauuggcugcuuacguguccccuccuugaagaccacugguugauuuaucacucuucuccacuaguccaccucaaugucuguuuuguauaugguggccacaaaagcauuguggacggaaaaaaggacgggugggagugagggaggaaagagauugggucaguaagugcuaccaccaugggauugaauucugggggcaacucuagucacuuuguuccacuauucguuaggccugcuguauucuuuguuucaauaaagcuucucucuagaacgugccuuuugcauuaaggagaucucuacuuuguggcuguauccagugcuuugaaggaaggcuaacucuauguagaaacccuuaguuuuauacaguaggugacagaccaacuggucucuaggaccaguuaugucuguuccuuucaaaucccuuguaucuucaacacgaaggaaaacuaccuuuucuauucugcuagauguccauguaaaaugacgccccccauccccauuaaucuguuucugguucucugagcacucuguucuaucagugacaaaugaagguaaaacaguuuaugccaaagcaaaccuaagguugugacagguaucaucuuugcaaaaccaaaauauaaaugauaaccaaauuugggaaaucgagaguagucauugacagaaauagucauucagauguguacuuggaaaucggaaucuuaguguaggagccucuguggacagaaaccuucugugucucuguccuccccucuccccucugugccucccuccucccuagcccaucaccaaauugggccagaauccagugacuugggacauuaccccaaauuuuugacaaauuaauuuauuuacuuaguuuauaguauaaaugaaauuuugaaaaagccaaugaccuaauauuuuaugggcaguaaaacucaaaggaauuauugacugaaguuuuaauguuuuggucacuuggguuuuuuguuauuuuuuauuuauuuauuuuuggacuuuuagguucagaggguacaugugcagauuuguuacauggguaaauugcauuuuacugggacuugguguaccagugucacccaguuggcauaguauccgauaguuagauuucaacccuugccacccucucuucccuccuaguaguucucagugucuguuauucuccucuuuguguccuuguguacccagcguuuagcucccacuuauaagugagaauaugcaguauuuaguuuugucuuccuggguuaauucacucaggauaccggccuccagcugcauccauguugcugcaaaggacaugauuucauucuuuuauauggcuguguaguauuccaugguguauauguuuggucuaucguuuaaaauuccguacacccauuuccaacugaaaagaaaagaacugugccucauuaaaagacaagucuucacuuucucagggccaaggcuggaauuacaugauuaaacuuucacuuugccucuugcugguucugugacaccugacaaguuacuuaauuuagguucucuuuaugaaagcauggguaauaauucuuaccucaugggacuguuaugaaggucagugugaucacagauaugaaagucccuaacaaagggccuaauccauaguaggugcccaauccacauauuuccuuguagguaucuuguuuccauccucuuccugaggugguaucacagaaaacucuaaaagugauauugucagaaauaaacgccaacagguggcccauguguaguucugugccugccccugggcaagucauuuauuuaucaucccuuucgcuuuucacauuuccagcucugagugguaauuuggagccauugggaucuaaugagaaaaugaaaggcauuguuaccauuauugcucuggugccaugaggucucuggugggaacauuugagagaggaagacaauaauaaagaaaaaagaaaccucccuagaauucagcuguacugucuggggccuccugcacaugacuucaaagccacauuuccuuaaguggccauuaaagucugaaucuccuucccagcuaaaaauaauuucaaaugauuaacauaacagugaaugauuuuuggcucugugagauauuauugauggcaguucauacugaaaagcagugaaacacagaaauggcuucugucacacaaugaaagaggaaaaauauaacaauaguccauaaaauaguuucuacuaugcuauacuagaagauugacgcacauaauauuaguuuucagcaaggauaaguuaucugauuuuuaugauguucccauaaaaagcugacacauuggcccuaagcuugcauuccugccuugaaauaauuuuaaucuuccacucuugacaagcacugcaaagggcugugacuugcuggaacccuguuccacagagcaucugucuguaaaagcccccacuggagugauauuuucccugguggaucagaauuggcucccuuggguuuauuuaaaauacucaucaauaugggaaauauauuggagugaauauaaaggagccaucucaggguaguucacugagcuuuggaaaauauuccagcaugaaacucucaucugagacucuaaccacagggagaccuuuccuugccucagguggcccgagugggacauccugagccaaugggaugccucguguguggcgauacugugccuaauggguauagacccuuccccagcaucccccuuggucauuucuuggguguccccaugaaaggaagaaacccacaauggguuccagaaaucucugagaaauccuuuuuggguauggaugauaucacacugcuaacuaaagauuuucggaacauuucacaaucuuugaggaguccuuuaaccaaguacucucagaugaggauaugggccauguggaaucagggccaguugguuuccuagaagugucuucuaggcuuccuugguccuagaguauccccagggcuuccugcauugagauucuccggaggaaaggucauaucacacucccacagaaggaauggagcccucauagaaccuucaaaaggugugcauuuacucucaugcagacacagaaucauuucgcgucaguaccuccagucagucugaugaaagccuggacagauucccuccuuuuccucacucucuucucugcccacuucugguuggcaugucccccaccccagugcagcaggaaagugaagggacagguuaggugaagagagcaagagagagagagguuggugcauggccucuugccuuuuagguuuuuuaagugaauuuaaaaaucuacaaugaaaauaucauaagcuagcuaaaaaaucucuccuacgagggugggauuuuuuaaauuuugcaccucuguugcugugacuugagugaaacaucccagagaagaugacuuuacauuuauaugaaaccagcccacagaaucaaaaacagugagaaggagaagggaccuuagcauugauagagucgaaggaacucuagacugaagaccuugcuagccuggaguggaguuucacuguucaguagccagucauauguacacugugugugaguguacaugcaugcacuuaccucugugcacacaugugugugccuguguaaaguugcccuuugucuuuucuucguagcacugaaggaauaaccuuuuucuguaaccaaguccugccaaguucuuuaggguuaauaacaucuugcucuuuauuaaauggugguaaugguauaagaauuuucaaaugguguuagcugacacaauaggaaguugguaauauuauggcaauacacaaauguaacagaaaauguuuucuggucugaaaauagagaucauuaacucagugaacugccaguacuccccuccucuaaacccaauuuuuagaugaagcuuggaaaugugaagagaaguguucucacuaaucaacccagaggucaauucauggugggcaugugcgugugugugugugcacaugcacacaucugcguugaaaaggacaaacuagcuucuccucuacuaaugaugcucugaauuugcugggcuaaggugguguuacugaaguggauaaagcuucuguaucuuggggacaucugaaugaaggaguaaugaaggccuuguaaagaacaaagcucaugaaagcaugaaagaagcucuuguguagauuauuucaugagaaccugauggcuuaaggagaacuugaugucacuucaaaaucauuuucccauuuucuaccuggagugagaggugguaggacacaucuaccccacaaagggcaggcugugccuucuggugaucacuaagggagucagucuucuaacacuucauucucuuuaauccuauaaaguuagacauauuccuaaaugguucuuaguuuuuuuuuucaaaacacaugacaacuguguaccacaauaucauugauuuuaacaucuuauaucagagucaggguguaaagcccgccacaaauguauuaaaggaaaaaauaauguaaaaccugcgauugguaauauaauuucccacaaaaugauuagaauuuauuucugucugguuacauguuuguuuucauuuauuuaacaauuauguguuaagcccccucuuccucaucuuuucuauauuauaccuaaccuacuaaaaauauaauacagauauuuuugaguacuuaucuuguguuggacauuuuugauaagaauuuuuacauuaauuauuuaauacugaagccauccuaugaaauagauacuaucuucauuuccauuugacagaugagagaaccuauucagaggugcaguaacuggcccaagaugccccagcugaaaguggaccaaaucagagcuggaacucaggacucugaccaccaaaucccccagugggcuccccuguucuugcccugaguaugucauuguauuucucccccugcccuccccaccaucacaugcacacucacacaaggaugaaauaggcuguuuggaugauagacguuuccaucuguuggugccagggcaccuuuccucuaagcguucaaagggauccugcccuuggugccuuucagccugcuuuucaagucaaaucuguuugcuuggaaacaaccagaggaagacuaugcuucuuuaauuuuccaugucauccuuuuccucuucaaaaacugauggauuaaauaaacucaguuugugguagggauauccuguccucuuuucugacagucaccgacacugcauccuaauggagcaugaucugguuuaagcuuguuccugggagcucugcuuugucuaagccaagagguugcaguaggaauucuaaaggauggugcuccaagaauuauuuaucucguugugaacugacaugugaaaagcugacccugccuggugccccugucaagaaagucacuuaaaagaaacugcaacuguuguugcuuuuuaaucacugcauuucuucccucuuggguacacaaccuuguaaagaacuggcuagggaucuauagucaauaaaaauagcuuguguuuauaaaucaccuuuuccccaaagugugagaacgacucaacaaauuuuacuagaacuaaaaucuucuugaaauauuauugaggaaagcuggaccacuguaaauuguaaauucuuucuggguaggauucugccuuuacauuucucuuguucuucuuaaagcaccaaauguuucugaaugucuugugauuaauugguuccuaauuaaaguuaaguugaaugcuaaaucuuaaugaauuauauggaauaaaacaugaaaauuuagggcugcccuuacagccgagacuacagauaggacaaucucccuuagaaagauuguggcugcccacuguaccuggaugguguaacuccagggugcguggcugacagggacagugaggaugauggugcccacuagaauuggcaccacucaacuggaugcagugguccaguuguggguacugcaggacccaaggcuuaacacagauguggugagcauguguguugccuagaagccuuuuacccucagaauucagggagacaaaauaaaacgaaugagagauuuccacccgcaggagggcuggagcuaacauccucuugaacauugacucacaagcugauuggggcagauccugcaaaaagugaccacauuucauuggcucuugggaggauauuugggcaggugaauguggaagggguuagguagcuugacugcuacaacuuugauucuagauuuacacacauacuugaaagucugaaguuugcauaauuauggacccaggagucuuuguuugucuccugcuguagucuuaauugccaaaagaugaagcauuugagguucacaaagggaaaucagccugcccaaauccacaggacuccuaaguuguuagagauggcauucacccaaaucuuuaaagcguauguucuucacuguauauucuguugcuucuagucuggacagugucuuuucuauagaugccucagcucuuuguuucuuguugucauuucuguaucugcauccacuggucacagaagccaugugcacacauucauuuuaauguccaguguuuauguugcaggaugagucacaaccgcuuuuugacauggcugaagggagacguggauguagugggaaagcuaaaugauaagcuuuuuagaaauguguucccugggugauggaauaugcucagugcuauuguuuuuaagcaguagcauuccugcuaggacaagaaaugcaauacauaugcuaauauguucaugaaugguuggaaagauguuugaaucaaagaagcuugucuguuucacauuuacagccaauggaaaaugaaauuuuuauaacagguuuucaaugaaguugggagaggugccagaaacuggagauugcuacauaguagugccuuccucugaauuacuguaggcaugcaugcuaucuacaagggguuggauaaaauggcugccagcuuuuuugaaacccaaagauucucuaaaauacuacaugaaauagacagaucucucauauacauugaguguaguaugaauaaacagaaguuuuuaaauuuaccuugaauugugauuauacaaaaugauaaaaauuuucacauuuuucucaagauuuccuuaaaauauuuaaugaaacauuaguacauuucaccuauuauuacuaaccccaaagcaaaauggccccuugaaacuguauuucuuuaugauagauaacacacacuaccuucuuccuugcagugccguucuuaugcucauaaccaaucucccauucuuccaagaucuuugaaaauacaggccaugucuuaugcaucuucuugguaggcuguuaguuaguguaugcuaaggggcugagggugaaugucaucauuaucacagucuuuaaaaguagauucugaaacuugccacugacauuuuuaaauggauuuuggaaaagacuagguuuugaugauuaaaagagaaaguaacaaauacugggagccauuuuagguauacuaaauuuaauuucuaccaaaaauaaauuuuuuaugucauaaauauuaaauuacacagguauccuaaauauaguguaucuuggauuuagcuuaaggacauguuuacagauuucugagaaucauuucccuggaggaagcaugagucuacccuuagcugcguauuuuuuaaagauuugaauccauaaucugaauaaaggaaugcaaacuauacauucagacuuuuuaggauaccccaaaccaagaggaguauuuauuucauaauuaaagauuuuuuaauguucuaguagacugaaaccaugggacaaauaucaagauuuguuuaauuugauauaauucuguagacuuauaucaaauaaaacauaucaaauucuauagacuuaaucaauugcacauugcauacauguagaacugaggagacuuugaucaauaacccgaggagaaaggacuuaagcauuuuuguugacaacccugucaaucuaagccaugguaaaugacugcuaaguaaaaccagugcaguauccggcuacacucacaaaaauauaguuuccagauccaaggagggaguuaauagucccgugauaaauauacuugccucagauaauaucuggaauauuaggaaucauucuggggcacaagaacacauccagaagaagguaaugaugucuggaagcaacagucgaugaaaugggguaugauuagccuugaguagggaaguuuaagaggaaacacaugaacucucuucaaguauuucaauaaucaucaagugaaaagauauuugacuuacugcauauaacucuagaagauaaaucaggaccaauguuuggaauuguuaggaaaccagacaauagucuuuuguuguuguuguuuucuguguguguguguguguguguguguguguguguguguguguguguguuuuaacaaaugaaaaugcccugcaaaguuguggggcacuucucuuguguaaccaaaauuacauggcagucuuucauggacauugcuaugauucaaguuagaguuuccuuuuugucuuuugauuuuuggccaugugcauauguacuaacuucucacaaaauaaauaaccuaaagacuuuuuuaaauguguuuuguccaugucuggaaaugaaugcagguucuuagaggaauaaucugacaaaaguacuuucagggauauaaaagcagagaacuggauucuuucugccugacacccacccaaccccaagacaucugcugaacauucuguaaaucacagacacugcuaucaggcuuucuuuauggaagagacagauugcaucauuagggagccucagacaaacacgaccugggggguuggugcucuccuuggugcugaacggaggcugggccuuugggcuuccucccaggcuaagguuggcccuaaccuuaucccuacccugcagcaauucagguugcaccucuugccuguuuaucugauaauucugcugccuuugcuaauuccagcugguaccgugacuacuuugauuccccauucagugaccucucucucaagaaagaugaguuaugcaagagguuugagauuuggauaaggagcuguguggcaggugaaacaucacauucauaggucuauauugacuuauuaaacaguugcgucuucuauaacuuccagagucgucccaugguauacauucauugaaucuuaguagacuuagauaugaaggcaaauauuggauaugguggguugcagccugagaaagagggccuuaaggguucgaugagagcucugauagaauaaauacaaaaauuggaauuuuuaaauguuuuuuauuucucuaauacauacaaagcacuguucuugauggcuggagauagcaguucuuuaaacuaacauggcuuugcaugaaaugaaauagcuuugaguaaaugucaccaaaugacaacaggaauaacuugacaacaaaagcagagaucggaugaacuuggccugucuggaguaggcagucauauucuccugauaagaggagaacacugcugggcuagcagggaaaggugcuucugcccuucugugggguuucaacagacagaaauucacuggugugagcauugcuucccaagagcccaggcaacugggauugagcgaagugaaagcaucuuggagaucucagaauuaaaaggaagaaaaagagaugcuaaaggaaaugaaaaacauggaucauaagggaaugaaaggucugagaaccucugcuguuuaaugaccucugcccuacagagggcagcuuucuuugaaucccaugaacaaauaugacaaaaaaagucuucugaccugagccucugguuuaucuaauuguccuagagagaaggauacagcaggcucccaagaagaagccacauuuggggcagagcagcucugcaccuuucacauauuugcagauuagcuuuuauaaaaaccugcacagaagacaaaccauuuaaguuucauaaauuauauagccagauuuuaauagcaaaauuccuugaggaaaggauucauuuaaaguagcuaacuaguuguaauuuauagaacaguguuacacccaauuauguaguuaguaaaugcuuuccacaguucaugugaguuugguagaaagagagacaaaaaaaaaaacaccuuuaaguauaaggguaaauaaaaacaaaguuucaggaaacauagcaagugaaacauuuaauccucagaauucaucaggugagauucugugauuaauauuucacagaaagaacuuggaaagugaaauaauucauacugucucauaauuuaagccagucuuuuaauaucuggucaaacucagguuaagauuuauuagucuuacaaaaauuauccaaauuaggaagagucacuaaagaagcagcccauuuauugaauaguuuaaaaccuuuuuauccugaguaaaauauucuucagagcuaaagugacccaguguacauuugcaaagcucuuauuaucaucucacccaacaugcauaagaggccaaguagacacgguucauuuuuuaucacuucucauuucuucuagcacugcaguucuuuccaaaguuuugaugcuacuuauaucuauucugaacaaaaacaauauccagucauuuguuucacagaauggcucagaucaauuacuaugcauuuacccaaaaaggaaggaagcugaacacgucaaagaaagaauucuuaugggaaauaccauaguuuaugacagggcauccugucugaagcccuuagaauaaaccaugaugccuuccauauuuguuaucuucugugguuaaauugucuccuuggauggucauuagccuugguuggagcagacuaaauauuaggaacaaauguuugacaugucuuucacugaagugcagauaagguugugauuaaaaaaaaaaaaaccuuugaacuuggcuucuacaucuaucaaauaggguuuuuuuuuuugguaauuguauguauuuaagguguaccacaugauguuuugaaauacauauacauagugaaaugauuucuacagucaagccaguuuggcuuauuucacauaguuaccuuuuguguguguguguguguguguguguguguguguguguguguguguguguguucagagcaccuaaaaucuacucucuuagcaaauuuccagcauacaauacaauacuauugacaguagucuccaugcuguuuuuuagguccccagauuugcgugcacucccuugcagaguuguuguaaggcuugugcaccauagcaggggaauggcuaauucuugguuuucuuucaaggcuaugauuugcacuauuaagaaauagaacugggggccaggcaugguggcucacgccuauaaucccagcacuuugggaggccaaggaaucccaguacuuggggaggccaaggugggcggauuaccugagcucaggaguucaagaucagccuggaaaacauggcaaaaccccaucucuacuagaaauaugaaaaauuagcuguguguggugguguguugucccagcuacuugggagguuggggcaccagaauugcuugagccugggaggcggaguuugcagugagccaagguugcaccacugcacucuaaccugggcaacagggcaagacucugucucagaaaacaaacaaaaaaggcugggcgcggaggcucacaccuguaaucccagcacuuucagaggcugaagugggcagaucaccugaggucgggaguucgagaccagccugaccaacauggagaaacccugucucuacuaaaaauacaaaaaaauuagccaggcaugauggcgcaugccuguaaucccagcuacucaggaggcugaggcagaauaaucgcuugaaccugggagucggagguuguggugagccgagaucaugccauugcacuccagucugggcaacaagagcaaaacuccaucucaaaaaaaaaaaaaaaaagaaacaaaacaaaacuggggaguaaauuuuuauuucugccaaucaguuuuacagcucucaaacaccuggauaucauuugccucuggaagucuuccaccuucauaggaaaucugugauggaccccucuccuccugaagaaagccuacagagggcagcuuucuuugaaucccaugaacgaauaugacaaaaaaaggcucugaccugagccucugguuuaucuaguuguccuagagagaaggauacagcaggcucccaagaagaagccacauuuggggcagagcagcucugcaccuuucacauuuuugcccaugguuuccuuuggaagggaaaagcugaaaugcaaaaggagaagagagcuggacgcaucacauaguuuuaauugguuucgaagggucaccaagcagaauccuuucuguagcagaauagcuuuuccuugggagcugguauggucagagaagaaucccggcccaagagcugaaccaggggcccuuuggggaaagggccuggggagucccaaagcggcacugucccugcucgguugcaggcagugacccucuccccacacccgacucagugccagcuguguccugaguccaaggugguacauuaggugcuuaauguuuaucccuuaacaagacaaacauuaacaggguggucgcucuuaaaacauggccuucccauuccagugggaagacagagaaaacaaguuaaaaagaaauuaaauaauuauaaauucuaccaaguuaugaaucaaaaagaaagcaagggcuugcuuucccagugggucucccucaccacgucacuuccccuaaacucauugggaaucgccauuuccauucuguuuucaugucugugaaagagauaaaaagcugcccacaucaagaaauguaauucaaccccuuucagcaaauacaggauauucugagucaacugaacuuuaacuauccaaauagguuacugcagguaccuaggcccuguuuuuaagucuuuuaaaggacauuggcuuugugauuuugagcuaagguaauacauaagaaaacaucuugaaaauguuaaaggaaucacucugaagauugucucaugaaacguguuuaaacaaguguuuaggcuaagucuuuccaugagaacgcucaaauauacauuguuuacuuguuugguuuauuugcccugaauaaaauaaacgauccauguuuucgcuuuagaguugccuguggguuaggugggggaacagaucucaaaacagaggcuucuacucucugguaccaaggagucagagucuuguucagcauuuaaagucacagaauagucauaaugauuaugcaaaugcacaggaauccucuuucauuugcugucuuaugaaagaauuggaaucaguuauauaauguaacugguugccuuauuuuuuauaauuuaagggaauuuauuuuauaagugcguaauugguaaaauagauuuuuaugcuagauuuuacuguguaaauuagugacucucagugaguguugguuuugugccccagggcacauuuggcagugucuggagacacuuuugguugucccaacuugugggggugcuacuggcauucaguggggagaggccaggaaugcugcuaaacacccuucaaugcacaggacaagccucccucucaacaaagaauuaaccagcuccagacacuaauaguacugauguugagaaacccuagcuuaaaucaauacuguuuuguuguaaauuucaagaugugaagauuuaguucuacaaggcaaaccaaugauuuaugauaagaguggaaugauuuuucagauaaaccaugauuguaaauauuuaagguacugacauauucuaaucaaagaaagcaggguuuuuuuaauuuuaaaauacguuuuuucaaaaaaaaaacugucacaauuuuuuuuacuaggaaaauugggaaagagaaaacuagucuguacuguaugaauucuuuccuggagauacuuaucugauaggcucaacugaaugcacaaagaucucuugcugacaaagagauaauuuauguacuaaaaauuauauacuuuauuuagggaaaagccuuuccaaugcauacacagucuguuuagccacaauucagacacguuuguagugacaagccaugguuacgcuuuauggcauuuaacuagaauaagcccaacgacccagucaggaaaagagguggcaacuguguugcagccagaauuuccuuacucaaaaagaucuggaauguuaauguauugauucuauggggaacaggugacgcuggaguagcugaaccugcccugcugggcauuaguccucccuuacauaucucucgugcuuguaagccgaaaugagcccagccuuaacuggggccaaggugucaugucaguccaguuuugaaccugaauccacuguuguggucagcccagcugucuugcuuagguguuuuaaagcaaacaccagcuauagagagagaaggaaaggcagagacaggaaggaacaccgauuaaugagcuauuucugauuuaacaagcuauucuguuaaauuggccuauaaaaugaaaugccaggucauuuguauucaacaaacuuguauuacagacaaagugcuauaggguggggacagaaaggugagccagccauagcucuaugccuguagacauucauuuugguucagcucuuucucuuucuccuuuacaaguuaaauaagcaacaacagugacuaccuaagaccaacuaugacaucuuucuaaaaaguauaauauuuggaaaauugugauccuaaaucauaauuuucuuaucagugaaucuggcuuguaaacauagagggaaaauuucuauuucauuagcaagcacauagugaguuguuccagugucucccagugccuuucacaagcuugaaaaggauuugaaaaccccuuuguucuuuguacuggaaucacuuagcauucccagguucccuuaagaaaaaaucagaaggugaauuuguguuagcuguuauuuugcuccagaaacucccuugaucuuucaaagaugccccuucuugaccuaagaaaaucugaugcaagauacacauuguggccuuccccuugaucccuccaugaguuucagagaauuaagauuaacggcagacauuuccuucauucuuugauuugucucauacuuugauuucuuuuuguuuuguuuuguuuucaucauucucauucccguguuugauucaccaaugauugcaaaauaucaaaauauaaaauguaaacugcuggucuaaagaaagaaagcauacugggguucuuucuuuggccaacucaaagccugaaaaguagcuccaagugggucaguuccacacugucguucuuuuacaggaagaccacugggcagaggccugggcuuuuuuucucauuacugaggacuaguaucuugggauuccuuaugagcaaaaugaugcuugauguuucuggcagugucaucugagauguucugacuuacuuauauguguagaaaagcaguuucucucuuucagaggccagcccugaguuagucuauugaaauugugcauaauaauuacuggauaguuauacauauucucuauaauuuuaaaaggagucaagaaaaaauuuguuauaggcaacagugaaagaucaacugacucuuucuuggcuuauuuauauucaggaagcaggaagauuguguguagguaaagguggauauggugauuauaaacuuaggauugauuuagauuuuggcaaguugcuucugugggcuuaauccauucaagccugccucccaugagacagccugggcucaagggccagcuggguggaggagcaaucacgggauuugcaggaagcagacagcucugccuaccuaggaaggcuauccuucgccucucagagccuaugagauagggauaauucuaaaccucauagugguuguuaucuagauaaugugugguaagcuguggggaaaugcuuuguuaacucugaagcauugcaugaaagauacuuuccaucauagaaauauagacuguuucauaauccuagacuauuuuagggaaucugggaaaaggaagauguauuuaacuauuuuccuuuucucuuaauuccuuuguggaaugaggcacugcauaaauauauauuuuuuuaaaaaaccucuucuuccucccaaguucaaauaagugguauuuuuacuuccucucuacuaaaauuuaguagagaaaagaggaaagagaaguugcugcugagcaaaagaagugagcaaaggagaaacauuuuuagaaaguuuuugaacuauugugauuugggagaaaaagagaaguuuuuuaaaauaauaauaacaugccauauaaguucugggcaacaggcagauaaugcaaauccucagaaucuuauaccacuaaaagguuuuuuagugaaaguuuguuuuucaguccaguucaagaaaaacacaaagagagcacacugaguucccauguccccugcaucauuucuccuguuauuaacaucuuacagcaguguauuauauucauuaccauuaguaauaguaauaguagcugaaguccauacauuauucagauauccuuaguuuuuaucugauguccuuuuuguauuccaggauuccacccacaauaccacauugcauuuggucauugauuucuauuccagguggucuggauucagucuuuacugguaguaugcgucuguguguaaaaguaguuacucuuucuaagggucucuauugacgaugcuaguaaagcauucauagcuucauaccggcguaguaauauuaaccuccaucccagagcuuagcuguauagccacuuuaucuaagcaaaacauaggcaacaccuagcguggaaauuaaaaaauaaauagcccacagcagccacagcaagugacagcacauagcugcuaacauuacuucucuaauucauacuuuauuaaagaagggaagacuagggaaggggaggacuugaggauggaagccaaacaaacauccaggcuuggauguuacauuugagauuucugugagacaugagaaugcagauaguuggaaccaugcaucucgcugcagaaagagggaggagccaggagacuggguaagaguucaucacccagagagugagaacagguguuggagcaaagaccagcagacugaccuccagguuuggacauuaagaauaggagggggagacagugaagcaggcacccaucauagggagagcugagagagagugccguccacauggggagggcuggucaccaccucaaacaccguguugggcgagugagauggugacuuaccaggcaccccuggauuugguaauguggagauggugggaaagcuacagcugccucauuuuuaacugaagacaauaauagugcagaccuagaauguugugaguauuaguauauaacacaugugaaguacuuagugcaggaaguguacacucacauuagcuuuuuuaaugggauacaguuuacagaugacuuucauguggguuggcugcucugagucuuccaugugaucugaaagagaggaguggccauuacaaucauagucccugcugacuaguaaggacccucacccucuggcugugacagaguugucaauccaucccucauugagcauuuucacaccuagccggagcauagccuuuuugcuguauuuuguuuuguacaaaaauaaaaacaaaccuguuuguuguaauaguuuuuuaaaaugagugggcucuagagcuuuucccuuauaaauaaacaucucaugcuucacccuccuccucguugagucugucugacauguauaaaaaagacuacuucauuauuucaagucuuggggaauggagauggcaucaccauuauaaagagacagaggaacuuggcucaugaaccugaggacccccgaguucuugaucuaaagcaggcagcaaaggacgccugaguucuugaucuaaagcaggcagcaaagcuagccuuuggccccaguuccuugugugcugggcucccugcucugugugacugucuugcugccacaaguuccaaacucucguuggucuccauccugccugcacauuagauucaccgggaaccuuucggauaauguucauguucuggcucacacucugauuuucugauuuaauucgucugggauaggcccagacauuaguauaucauuguaaugaaguuuauugagauauaauuuacacauaguagaauuuccccuuuugaguacaguucucugcauuuugacaugcgcguaggcauccauucauacggccgacuccacagucaagaucugaccauuugcaucacuccaaaaccuccuguguggccgcuuugccauccuuucccccaacaccuggcccuggcagccacuccucugcuuucuggggcaccacuaauucuuaaaugcaggugauuuuuaauaugcaacugaguacagcugccuggcagccuuuaauaagaugcuuggggcacagggacgagaacugcuggacucaguuaacacaguacaggaucauccaucagaugaucuuagacuuaggcuuucuuauggcuuuuagcugagacaagacaguucuauugcccacucuugcugcuguuguuucuuuauuuagugguaauuggaagggagaagggacuggagugagaggaggcucccggcauugucugcggagagcaggccuccugaaccugccacagugaacacugugagggcaccagauauguaugcagccauuuuuuaggugacuggcacuguucccagcaauguggacacgauaaugaacuacauauacagcucaaauggggcuugcuucaagugcauggagauaggcaaugaacaaauaaacauacaugcaaagaagaaaauaucauguaucagaaaaugugaugcgcagaacugaauccaagugauauuccagagugugggggcuaguuuagauugugaguggcccaggagagcuucucugaagagguuacauugacgcugagacuugaauguuacaaagaaagcagccaugaggaguuagugaauauuccaggccaagggaacagccaguguaaaggcuuuacaguuggaaaugaggcucaugggcauuagaacauaaagaacgauguucucaggauguucaggaugucucagauuuuggaagugaacgucuggucacuaaugacccauuucuacugucuucugauagagccugcaucuuuuccauacauauucccagucccuaccuggaauuacagcugaccgggcccaaagacauucagcuguaacuguggcaucacucacagggcaguugagcaacucuguuuugggcugaugggcuccugcagauuagcacaggaaagaaagaaaucagaauucaacuaagagaaaucagugccuaccagcagcaguaggguuaauauggaaauauuuaauucaucacuacaaugugccccauacaaacuggguuuaaaaaaaaaccauggcucugaauauuccuuuacagugaaauguaaaauuaugaaacucaaauucccagugcauauguaacacucacucuuucuuucucucucuucuuuuuuuuuuuuuuuucaaaagucagaaaaacagagucucacucaaacagccaaaguuggaguuggagugcaguggugggaugguuuuuguauuuuuuuuuuuuuucguagagacgggguuuuuccaugugcccagguuggucucaaacuccugagcucaagugauccaccugccacagccucccaaagugcugggauuacaggugugagccaccaugcccggccauguaacucucuuuaacaaaauagggcugucaagaauacacuaaaacaauuacauauaucgugaaauguaaaugaugaaucucucuacuuuugaaaguguaauuagcgacaaguguuucaucaacauagaaaauaaggucaagaaaacccguguccacuuuggugcaacucagugaaugagaaagggugccgucgcagggcucacagccaguguuccugggguggggguugcuuuucugccacguuaacucauguguucuuguuggcaaggucaccaccgagcacagcuugauccucauaucuucauucuccuuucuucugccaguauuucaggggcugugacuucaauuuaaauuuaugcauuuauuuuacacguaugugauaaacucauccuuuuugucucuggugauacuuuucaaacagugucuccccgcuuccuugcuccccacuuccucacucugucugugaauuucugggagauguuggacuagugaaaaaaaauacaaaaacacucacuccugauaaacgugugugucuuuccuuuggcacacauagaccacugcugcaaucccaacucggggccacaguagaucagugaggugggccaagaccuuccaguuugaaauagaccuuguauauuucaggguccucuagucuguccaugaugaauaaggcuuuauguuguucagguuauggcuauaaaaugacaaaugaucacauuaaucuuuguguuauuccuuuccccuaaggacauuauagggacagccaaggucagugcaacaauguagcacgagagucguuuuucccucuuuccuauagagaguauugacauuaccuauugcauaugccccucuuuucucugaucucaacuuccuacucccauauagcuuuuauuuauuuuauuuuauuauuauauauuuuuugagacggaaucucacucuguugcccaggcuggagugcaguggcaugaucucggcucaccgcaaccucugccuccuggguucaagcgauccuucugccucugccuccugagcagcuggaauuacaggcaugugccaccacgcccagcugauuuuuuuuguauuuuuaguagagacgggguuuugccuuuguuggauaggcuggucuaaacuccugaccucaggugaccugcccaccucggccucccaaagugcugggauuagaggagugagcugccacgcccagccccauaugacuuuuagagugcuagaacgcuaauaauacaggaauaagggaggcacauuugcugcuuauacccaccaggauauagcugaugaggcagcuacauaaugcccuguuccuccuucacugauggagaaauacacuaacaggcaguaacauugugcgugaaacauauacuacuuuagguuugugaccggcuguuuuuguuccacuauaaacaaagccguacacuggggaggaguggggauuuggcauccacagaguucugcgugucacaucaugcacaugcugauggcagcugggugcuccuauguuuacauuuuugccauuccuguaucaguuaauguuuuugucauaaugaugcuaaguccuuuacaugggaguucucuucuguuggucuugcauuggaagaccuauuaugcaagaacuguuuguacaauaucacagcuacuuuuguccuuaacaaagucaccauauaaucauuaccccuggggguaaucaggaaaaugaucccaaacuauuuguuuggcuuuauuuaguuuugugcuuugaggaugguuuuugucuagugguaggugucuaaguugaacaccugucucucuaaaacuacuguccaguauauuagccacuagccacagguagcuauuuaaauuugaauuaaguagaaauaaguaaaauuuuaaaauucaauuuaauuccuuagucacacuagccccauuucaagugcucaguccgcacacauacacacacacacauacacacaaacacaaacauuuacauuaucacaggaaagccuacuggacaacauuguaauauacuguaauacaauguaauguuacauuacaguacuguccaguagaauuuucugugauaacauuuuaaaaaucugaguaaaauuuaagaaguuuacaucuuugcacuuuuuaauuauucuggaucagcaccuguaauuuaucuucaaucagcaugauguugcucauguagagagagauuaauucaugucaacaaauaaaaccaacaauuuuauuuaucuaaauaaaccgugugaauuuuaaguauuuauugucgauagcuaggaagaggaauuagacacaggcugaaauagagucaacuggccucaggcuaaaaaagaaaauuuuccccugaggagaaggugcagacugaaacagcuucugcuucccuguuuccauaaggacaauguugaaggguuugugugcucauauagugcuuccuucugaugcuguaacuagaaaaguccaaacugcccucucagcauuucaguaccacuuauuguugagucaguauuaagacaaacuggaaugauagaucuguucuccaguuuuguggggaaaggaacaaagacacaguuugcugugugcccugcccacgagcaggagccugcuagaagagaaccugcccuuguaucucccccuccucauggccugcagucagagugcccaggaggcuucuaggcgucaaagcagcucuuauuauuauggaaagaaugucagcauuuugaaacagagaaaaccaguugaccucaaaccauggcaugucauaaucuguacauucugccccuugauaaguauauaauguaaaggaccauucauuuugugagccuguuugcauccaugugguuguccuugcaaacuaaaucuuuuuuuuuuaaaaauuggagcagugacucauuuucuaaacuucauaaaacuuuuucuaauucuuucaagaaaaagcaugaaucucagaguuuccaagugcuacuaacuuaaguguguccucccuccaaauguauauuuugaaguucuaacuggcaaugugaagguauuuggagauugggccauuaggagguaauuagguuuagaugaguucacaaggguggggcccucauaaugggauuagugcccuuaucagaagagacaccagggagcuugccaucucucucuuucuaccaugugaggaaacagcaagaaggcuuccaucugcaagccaggaagaaggcccucaccagaacccaaccaugcuugcacccugaucaagaacuuucagccuccagaacuguaaaaacaaagaaauuccuguuuuuuaagucacuuagucuaugguauuguuuuauugaagccugaacaaacuaauacacuaaguuuggaagaguaauauuggaagaaaaaucucuaagcaagaaggaagcuugucauaccuuuucauuuccaggcucugcuacugagaauccaagauguaggugaugauuagaaaauucaaaaaaagcaaugacuuuuaugguaagaaggaagaucaaaaaaucugucccaaaauaccuugagcauccuuugggucacugguguggaguuaauuucuugccuccacaaggcuucuauuaaaauaagagaaacaguucugggaaacuagggugcccccugggugaagcuccaggggucaugagcuugcacaggcaggccagcaaccuaaagcauccagggacaggaugaagguggggcugaguucagguuguucccccuuaggugggagccaagugggcaggagaaaagucaggaacaccuugagcaagggagacaugggaaccaaugggauggggagggugaggaugaagguggagcuggaggcucugggaaguuguugucaaggggaucgggaccaaugcuuguuuuguuuagcuuucagugacaggaucuguacaugguuuccugauugaaaagcacagagccacagagacagcuaaggaauauaucuuuuuaagauauaggggaugaugggcaaggcaggugcauccacucaaacaugguaucuguguuaaguuggcaccgugaucccugaaaacauuuguuucacucuugauugcagucuucaggcugucuuuccaaugugcuaccuuuuccauaacuuccauaguucuuuuauuuaguacuaaaauuuuaagggugucagcugcccagauuaacaauaucuugaagccauauacauucacgugucugugugugcaucucaguaucauucauucagacaaaaugaagugaugucaugaaacaaaacacaaagcuuauguuuuggguuggugagggagucggacuagugagcaauucugugaguucugauacaaaacuucuguugaccccagcucacuugauacuagccccuuccucucuucuacucugucugaauuuuauuuagaacagaguuugcuucacuugacuuuauugucagucccuugcuaggggcagaaaaccugugcccagugugcucaggccuuccgauggcccgauuccuggcacugcuuccuaaguccucaccacaggaaauguuugugccuuccuagguagcagcucaauuauuuucccaucuccucugucauagggguuagcggacagaguuggcuggaacccaguaaaagaauggccgaucacuuuuuggcuugaccuggggagggaaaugcaagcaucagugucagccuguaauaaaugaaagguuauugaaaaucacagaacaacguguggcucuuccacauaaugcacaggaacuguuggcauugaacauacucacuugaggaacuucuucaucucagauuuucuuucauuaaaacauuaaagggcauauucuagucuuuuauauaggaaagucaccauuugauuggcugugaguuuaacuaguggaucuggaaaauuccacaaauuaacuuucaacuccucauuuauuauuucauuagaagaauaucuuuuauucuguaguaaccccaugguauuucucuuuccuucucauuauuucuccacuucuuuccugugccuggcuccucauuuacacuggccacuucauucuccugugauuucuaugaacucaagcuucagagugaccuuuguuucuuuuaucuucucuuccacauaaaauuugcugagaaguucuuuugaauauuuucuugccuugggagccaaauccuggugcuaucacuuuugggucauuggauccuuaacauagcuuuccuccaacuccaauaucuugcauccauuuuaaaaagaagaugaaauuccggcaccuacauguguggcccccauugguggacuuccuccugauuucccaucauuuccuggaaguaaccuccuauaacaauccuaggccgggcaugguggcucaugccuguaaucccagcacuuugggaaucugaguugggaggauuacuugagguuaggaguuugagaccaccuugggcaacauaguaagaccccaccucuacaaaauaaaaaauuuuaaaaauugacuagaugaugugguggcacuuaccugcaaucccaacuacucaguagccagaggugggaggauugcuugagccaggaguucaaggcugcaguaagccaagauugcacuauugcacuccaaccugggugacagaguaagacccugucuuaaaacaaauaaauaaauaaauuaguaacaauccugacauuuguaugauauuaagcaucuucaaagguacuuuguauacacaugaguuugcuagggcugccaugacaaaguacaguugacccuugagcaacauggguuugaauugcauggguccacuuaugcaugguuuuuuuuuucaauaaauagguuggaaaauuuuuuagagauuugcgacaauuugaaaauacuccaacaaacuguguagccuagaaauauccaaaaaauuagguaugccaugaugcaugaaacauauguagauacuacucuauuuuaucauucacuaccauaaaauauacacaaauccauuacagaaaguuuaaauguaucaaaacuuaaacauuuacagaccauacauggcaucauucacagucaagagaaaugucaacaaaugcaaaggugcaguguuaaaucauaacugcauaaaauuaacuguaguacauacuguaugacuaaugguuucauagccaucuccuuuugguguugcagugagcucaaauguugcaaguaucugcuuaacacaccaugugaugguaaucaucuccagauaaaguuuucucucugguaaauuguguauuacagugaaaaaugaucucucauaguucucuuuuauuucucaucaaguuuaguguaauccuuuaagccuugaauaacaucauggacccauaggaaguaccacuaaucaugcuggaagugcuuccaagaagcaaagucaugauauuauaagaaaaaguugaauugcuugauauguaccaaauauugaggucugcagcugcaguugccugacauuucaagcuagauuaauccagcauaaggaccauuguaaaaaagaaaaggaaauucaggaagcuguuucugcaguuaugcagcagguacaaaaaucuuucacuuuuuaugaaauacguuuuaaucucauacugaaaaugcagcuuuugugugggugcagaauugcuauuagaaaagcauagcuauagacuugaauaugauccaaccaaaaaagaagucauucugugacaacuuaaagcaaaaggaaggugaaagaucaaaaucuggagaauuuaaugccagcaaaggaugguuggauaauuuuagaaagagauuuaucuuuaaaauugucuagcuaauaggagaaauagcuucugccaacaagaggaagcagaugaguuccaaaccgccauuaagaaaaucauuaaugggaaaggauaucugccugaacagguuuuuaaugaagacaaaagugcccuaucaugggggaauggaaaaugccaccaaggaaucuauuggaaaggaagagaagcaagcaccaggauuuaaggcuggaaggacuagguuaacucuacugguucugggcaaaugcauuuggguuuaugaucagggcugccuuuaucuauaaagcugcucacuuccaaccccugaaggaaggagauaaacaccagcuuccagucuucuuguuguacaagaaggagcucuggacaaaaagaacacuuuuucuggauuggucccauggauauuugucccugaagucaggaaguaccuugccaguaagggacugccuuuuaaaguucuuuccauauuggacaaugccccugccacccagaaccccauaaguucaaaaucaaagaaacugaaacagucuacuugcccccaaacaacaucccuaauucagcuucuagaucagggagucauaaggaccaguaaggcuuuuaucugguuuacuuuauuguaauaauacaauauauaauacauauaacaugcaaaauauguauuaaucaacuguuuuugcuaucugauaggcaucuagccaacaguaggauauuaguaaaguuuugggggagucaaaaguuacacauagauuuuugacugugcaaaggguugguuccccuaacuuccauguuguucauaggucaacuguaccacagacugagugguuuaaacaacauaauuuuuuaaaaaaaucaugauuacagaggccagagucugagaucaaggcauugguuuguuccuggggccugucuccuuggcuuguagaugaccauauucucgugugucuucaaaugggccucccucuguucaugucuguauuguaauauccucuucuuauaagggcaccaguccuauuggauuagagcccacccuguugucauuuuaacuucacucuuuagagaccauuucuccagacacagucacauucugagguacugggguuaggacuucaacauaggaauuugaggguggaaggucacaauuuaacucauguuauuacacauuuuuuucccucugaucucucaacugugugaaguugugaggaauuagaaguaauucaucuccuaaacguauaucugauuuguacaugggaauacaauguaaguaaguccacuaaugcucuaauuuuuuuuuggcacagcacugucucucuuaucuuaaaccuaauugagagaguuacuagcuaacuguucgcuuccucccuuuaucuucuguugucuuuauuccgcaccccugaagauucugaaccacccacucccuucugccucgggcaaugaauagucuuucucuuaguuuccuccacaucucuucgcaguucuuuagggaucaauucugaugaucuuagucuccaguauucaugucccugaucucacaucaugggacagauuugccuugcaauuucuuuuccaaauucuguauucuuaucagaaacaucugucaucaaaacacugcauuugccucauuucaucagauauucaguguaccgggacccuuguagcccuacucccugggaagggacauucaggccuugacauuggaaugcuggcuugcuggaaaguuauaauccagugucuguuugguguauuuuuuuuuuuuuuaacacuaaacacauggccuagacauugguuuugcuucauuuucgcucaacauuuaugauaauaaagcuuuguuuucauagaucacuuaucuccugaaaaauucacacugccgugaacacgauccagccuugcagugugucucggagguaaguagguggcaaguauuuuuauccccuuuuauuaaagcauaggcagagcucacugcacaaggauccccuggaagggggaacaauuuggacuuagcccgucugcgcuccuccugcuccguuuauuuggguaccauaaacccacccagaacugcacacagaagugucuccuuugcaggcagacguauaugcaugcauuucaauggcuuccaggagacagcgauuauggaauguggagucugaauguaaauggaauuugagaugagccugacuaguaaauuauucugaaggaaaaacacauucagaaauaugauuuuaucgcuucucggcguuuuggcuaagaugaaguguagaaguaugauuuagauuccacccauccuuaggugcaauucaaaugccaguuucucuaaaaaauaaagccaacucuuccccuggacucuccagacacuugaccuguccuuacuuugugguguauaacucacugcacuuuaucuuguugcucuccuggucagagucuaugccugauccaucucuguggauaaguacucagaaauguuuucugaaguggaaugaaaggaacuaaccucuguuguuuguaacuggcacagaacccaacaguuucugccagugacaggucaugagcaucuugaggcauccagaagauugucgugguuggauuguccucucacuuugcuucaugcucacugcuugaccacugauuauuuuggagaaugucucucuccuuggccaaggcuuuggguauuauaaccaagagaggaugaucuaaccagccauuuuaucaacagcggcucugagagcccagcguugggugccagcccugcagagggacauugcgaaguaucuuuauguccuucgagcaucccuccuuuccaucaacuggcaggguggagcaauagcauccaguuacugaccuuccaggaauaaugugagcauuggauguauuaggccuccaaaguauaucugugcugcucugaugaaaggugcuuuaaguaggguugcuuguuaaaaauaaguagugccaauucucaggcugcccccuguguuuuccuuucccuugcucccuuagauguuuuucaaaggugccaauaaagccugcaaaacauggguaaugaaaaggaagggagagcaaguucuuuuugucauaagcgugaacugugagucaucucuucugagucaccgugaacauacaaaggaagccaaucaguaggggugcacucuaauaggauguuucuccaaugacucacgcaggccuggaaugaggagcagccugaaucaagccaaacaaguauauuuuuaaaucuggaagggcgcgcuuccuggugcaauaugaugaucaguccuacacacuuacaugcuuauuuuagcccaggcacugaaaugugugggcauggucuccacggagccuucuccuguggucauguuuuguuuugccaguggggaaggauguuuaaugauuaacugucacuaucaagaauauaauauuucagugcaauauuucaaugugaggagaagaauaauuuuugaauguggugacuucaagaacucggcuccauuggguaaggccugcuucacguguaaacaugcauuccacaaacauuuuuugaggcccuaaguacugaauauauaaagacagagaaggcguaguccuaagccucaaggguauuagaauuuccacaaggagacaaaaaagcaaacagagcauuggaaaaguggcagagggucagauggagacacuuagaaggcucagccuauagagaaugggcguaaaagaauccccuggaagugggaacaacugcucuggauucugaaagaccugcaggaguuaccacugaggagcgaauugagaugaggaagggugauuaaggcagagggaaaagcauguauuaagucuaaaagucuuccaaacaguuuauguuuuucauuauugucuuauuuucucaaaauuuugcaaaugcaaaauuuucuucuuuucccuuggcaaaugcauucuggaaacauuuuuucaagcugacccagaaaccaucucauucagggcgagucaggguccguguugugaagaggcguuacuuuaucugaaggauuuuaagcagaggcuauacauguggcuauaguuagguuuugaugagcuccucauggaagacagugagggaaauggaucugucccgagacugggagaccauuguagccuuuugucuuaauccggaagagcagugaugagcaccugaaccaaggucaguggcagugggaaaggaaaggaguaaauauaauauauuugugagauggugauugagagaagagucaacugagcaaaaauagcugagauggagaaccuaguaaguuuggauaagccauaaagaauaggaguuauguuuugucaauuuugacuuugagguggcuaagagauguggcuaagaugggcguguccaauaaggaguugucuggagcucaggaaacuaucuugguucaaaauagagauuuggcaucuaugaauguagaagcuacaggaccagauuaguccuccuagugcaggagugaagagugagaagaaaagaauggugagaaaagaacuuugggcagaaggaaaacgaacaaaaacaaaaaacaaaucuaugaaggagacgagaaagagcaaggagauugggaagaagaacaauuauccagguaucucuucuccaguauuagugagcugaugcuuuuuuccccugugagguaguaaugacuaucaaauaauuuugaagccauucauaaggaauccacaagaguauauacacacucgauagaaugucuuucuuacuaagaaccauguugucauauuggguaucuuauuguacguuauauuaaccauauaagauauccugggucacugcuauguguuguagaauaguaaaaaugcucucuuguuuuagagaauuggcaaguguuuauaaaaugaaaguuucagaaugcauuugucaggggagaggaaaaaaaaacaguuucaaguauuaguaacaaaauugaaugacuaagaaaugaaauaaaauaucugugaggaauaggaacaaaaaugccugagaguaucaacuugcauuucacauaggaggaaguucugaacaauuucaucaguauuuuucuuccuuuaaaagcaucuuauguuuagucucauccuuagguuuucauuaaguuguuuucuuaucuaaaauggucucuccuuagugaagauuuuuaaaaagagagagagagaaagauggccgccaagaagcuggagaggaaaguagcccucacugaauuugguuuagggcaaauucuccuggaggcaaugucugugauuggauuauagccaccugaaaagacuugcagggaucuuauagaaccuucggggguugauuaucauuauaagucaguaagacugaagaaaaaaaguagcagacaucgaguauuacgaauaacuuaggaggaaacuaagguuuuaaaaaagaucuucacccauuaauuuaagacucuaauucuucacaaacauacauuucuaaggcagaaucuauacaugccuccaucccaguggcccaggaauaaaaaaagaauguuuuauucguaggaauaccaauuagcuuacgaugcuguggagaaugaaaaaguagacuccuuauaccaauaacaagaguuuaagccuaauuuuauuagggcauuuuuauggugcaaauaauuuuuauuaacugcaaaaccagauucccuuccaggaugucuguauguucaauacauucugagagcacacccuagugaguaugcuguguuauacucaaauuuauuucccaaaauaccaccaaaacacuaacaucuguuguguuugguuguuuugguuugguuuugaggcucuuucugugaaauaaagaaauccaguacuuacauaaucuucauaaucgccgugauuuuuuuuuuuuaaagaaaucagugugcauggaauuguuuguaaugauucaaacugauauaauuuggcuacuuacugaugagagauucuaaaaccugagacaccugggguaaucuuugauauguaugugaucagucaggaucaaagaggccuguggucuuuuuaugugaacugugggcaaauucacaucuccuacugcauaauggcagcaauuauguauuuauuuagcuucugggccaaggagaccucugaguacacugguugugcacagaucugguuaagaucacaaccucugaaagcugcuugccuccugcacguacgucuggcucugccucucucuggcugugugacucgggcaagucacuuagccucucugugacucauuuuucucaccuaugaaauggaaauaagacccaaaccugucuuauggggaguucauaggagaacuacauaauuugauaauuguaaaacacugagaacaguggcuguuauauauuaagcacuauauaaaugcauggcaagaaauaaauuggucugauuagcuugauuuucuuaaucuuucaggauauuagccuuuuauuaaaggaaauggauuuggugucuuguuuacuaaaaucagaauguacagccugggcaacacagcaagaccuuuucuguacaaaaaauaaagaaucggcuagguguaguggcacaugcuuauaguccuagguacuugggaggcugaggcgggacggucgcuugagcccaggaguuaaaggaugcagugagcugugaucaugccacugcuguccauccuagcaagaccauaagacuuucucucaaauaauuuuuuuuuaaagagcaggauuuauaaaaccaauaaacaaauaaguaguccuugaaaugaaaagucugugaauugucuacuuuucuccccaguaauauuaaaacaauaaaauuucuaugggaauacaugucugccauggauaaauuggaaaauucugugcuguuuuaucaacuguaaggauugcauguccaaaaaauuaugauaguuggcaagaucaagucuccauaaaaaugguaggucggaggaaaaaagaaguggaaucaacuguuuuuaaaaaucacggcaaauaagcuuucuagaaaguauuaacuuucugccuuaaaaauuguccaugaaaggaaauacuucuccagugagcagcaaaauaccgggaauucuguacccaaacugguguuaaacccuggcucucccucuuguuaguucugugagucugggcaagauccuuuacuccucugugccucuguuuucucaucuguacaauggggaugauaauagcugcacuaacuuuguggaacuguuaugaagauuaaaugagaaaauacuuguuaaaaaaaaaaaagacaguucucguaguauggucauugcaauauucuaagauaaacaacucaccuuucuaggcugcucucuuaauuugcugaagcagauucccccaagugucauguuacucagauuauguccuuuucaaguuuuccagccagcuguuacugguuugauauuuaaugccuuauccuuuagcauuccuuuuuuuuuuugguaaaucucaguuaagugccuguguggagcuugaccuuuuccuaaauuguuaucacagugcuggaggauaugcuucuuggggucugggguuguguucaugugcuaagagcgccucucuguguuccacucacaaccuuucccacacgagcuuggguagcaaagagcuaugguccuugccacccucacuuguuuaagggacugaaccaaacaguaaauaggcaaaaauauuaaaauauuuaacucuauuuuuguuuacuaguauacaucucuauccuuucgaaucucacauuagcaaaagcaugacuaucaauggaucauucccuuaauauccccugcgucucccuuaaaugccuuuguccaggauuaacacauaguugacaauguuaugcaguccuugaggugauauguuuaucaugacagaggcugagaugagcacuaagcccaguaccccugcucaaaguagguuccuguaaauggggcagguggugcaugguaaagggaauccccuugcuggggacuagguguuggcaguuguacagaggagggcuaugucucuguauuuuaaaaacguaaucagauuugcuuuuguuuucuguugaauuugugcaaugaauuugcuucuuugugauguuauucauuguucucuuuuaagagaacaccuacacucaguuucagaaaguugggggagagagggaggaagaaugggucauuuugaaggaugaacuauuuuaaggcagugggugaagcuuguggggagccuuccagagugcugugugucugugcuggcccagcugcaggaggacugugguguauguucagggauacuccacgaucugugccugaaguggaacauaaugaaagccacauagaagaaaagcauguagcuggaggcaugaggaggcaggaaaccaaggaagggagugcagucauguguuucuggaaggcuggccaugugagagccgugaaggaugcagacaugacaaagccagccucuccacuuucccuagguuucuaaucaggcgugggaauccaaauagaaggaggaaaugaaagaccuauggaagcauaaagaagugggacagagcuuuagaagugaagugccauuagcagaggucugggcuuuggagguugacucagugggguccaaguagagggaaaaccaagagcuaagcauguggaaaugcaaucaggggugguuuguuugacacagagguauaaauuaugguugaauuuagggugcauucacagagaaaagcaagaaguaguggagugggcucaaguuuagaugaguguugaaugccuugcuaagguauuugcauuuuuuucuaacagcuacaggugaucacuacaagguaaugacuuuugaaggggagucaguuacagagcaccaaagauaagaaagaaccuguucaaugagcaauccuuggcauuuauccuuaaauucacauuuauccaauacagaauugcuuauuuuuagcccauuuugccagcucccuagacguggcuaaugcucugagccccagguuaagguguaaucuaaagucacaccauggcucugcaagacagacacaguucuuacugggucuucagugagggacaucccagcugcucauuaaucugccuguaucccaacauaauccuugggugcccaucucacaugguuggacaggcaauuacuuauauccacaguaaauuugccauaugacagucucuuaaugcgccacuucucugaauaauuuuccucguaaagaaaguuuuaacaaggguaugcagaaaucacuucuugcauauauuuuccuuugcccugccuugaacuguuuaccacacaacuagaauuuuccuuuucaucuucugcuccuccuucuuguauuaggguuauccagagaaacagaaucaauagaaaaaaauagauagauagauagauagauagauagauagauagauagaauauauaauauauauauuuggagagacagagaauccuuauaaaucucauguauauauagaauauauaugauauauauguauguaaguauauauauaugagauuuaucauuaggaauaaucucauguaguuaugaaggcugagaaguucuacaaacugccaucugaaagcuggagacccagaagagcuggugguguaauucaguccaaguccaaggacuugagaaccaggggaacugaucauguaacucccaguccacaggcaggggaaaaugagacgagaugucccagcucaagcagugaggcaagaaaaagggcuaaguuccucuuuccuccaccuuuuuguucuauucagacccucaaggguugggcguuacccacacaccuugggaagagcuaucuacuucauugaguccacuuauucagauguuaaucucaacugggaauacccucacaaacacacucagaaauaauguuuaaucugggcacccauuggcccagucagguugaugcauagaauuagcuacaucucccuaugccucaucaauaccacucccagaagauaaguaaaaucuauuuagcaagauaaguguuucauacucaguuuugcauugcuaauucacaucacaaacuugauacuccucuccaaaaaauuuuuucauuguuguuguuuuuuauuguuauuuuuucucuuugggccaagaacagcauuuccuagaccuaaaagcagcuccaguaaaugauuauuuugccaacggaugaaggguaaaugauccagcuucuguuucugugcacaucuugauuguuuucaacuggaggacaaaggaaaagagcaaacacagagccuauuggcaagaccauuuuucaauuauaagcaaauucccagggguuacuuagcaugcacuuaccagaaaucuuaauuugcuggaauuucugcauauuuugccuuucaguucaacaucucacaagaugaccuugggaaugcugcucuauaacuuucuaggagaucaggguaccuuucuaacgcgaagcuaaguaaauaagauuucaccacaaguuaaaccuuaaaucaaggacuuuuuugaaaaaaaaaucauauuuguauucuguguaacauuuuaugacuaauauuuaugaagugcuuaccaaaugucaggugcuggacuaagcauuuuaugggaaucuuuccacuauaucuucagucaauucuacaagauaugaguuuuuguuauucccaucauaguagaagagucucagggacaugaacagacuugguugggaucacacaguuaaguggcagagggagaauucuagcugcaguccuaacucuagaaugacacuccuauccacuuugugcuaagguauuuaccugguucaucacucauccauaauacgcugaaauaucaguucacuggauuccagaauaacaagaauccucagaucaccugaauuuuaauuucauuaaacagagaccaaaauaaaaguaagaaaagagauggaaaguugucacuuuaucacacuccuauuuuaaccccuuuaauggcuucccauugaaguucaccucccuaaugcagucuacaaagcguugugcgaacugaugccugccaguuucuucagccuugccuuuuaccaaucuguccuugcucaugagcucaaggucacacagauaauaaguggcagugccaggauccaaacucagacagacuggcuccagggccaugcucgugaccgucuugcuaguuagauggauggauggaccgaccgacagauggaauaaugugcacaugaauggauggacagaaggaaggagaaaaggagggaaggagggagaaaggaagcacccauaaauggaugaaggaagggagggaaggaaaaagagagggagaugauuugaaagaaacgugcaacacuucuuagaguucauacacaacuagucaagucuauuacaguuuuugcauugacaucugcaguacccuucaauaagacugggaucuccauucacgaaagaaaaugcauucauaggccgguggcucaugccuguaaucccagaacuuugagaggcugaggugggcagaucacuugaggucaggaguucaagaccagccuggccaacauggugaaacccugucucuacuaaaaaaaauacaaaaauuagccaggcuugguggcacgcacauguaaucccagcacuugaauccaggaugcggggguugcagugagccgagauagugccacuguacuccagccugggugacagagcaagacuccaucucaaaaaaaacaaaaugcaugcauauacucguuuauccauccaacagaugaaauuaaacuaaaguuuagguauggagagguacccccugcccaacuucagaagcugauagcaguuaggugauugguccaggaugccugcauaaaccaguuauguaguuuuuuuacccagccaguaaacuuaguuacauaaaaugucaaucccuauuucuagaggugaugggcaggauauacacacucauucugaaaagcccacugaaaucauauguaugaaauguuauaguuuuaucuugucuacuggauagacaggauaucugcuccuggaaagcucauauucuaccuuuuuaaguuaacuuuucauaaaaaguguaacuuacauagagguguucaaauccaaagaacacacacaacucaaugaauuuccaaaccgccaacugcccauguaacugcuaucuagauuaagaaaagauauuaaacaacccucagaggcccccucuugggccaucuucccacucucaguuucuucucucuuccaaaagaaccaauacccuguuugcauuaucaucugugaauuuugccuguuuugagcuuuaaauaaauaggaucauauccuauggucucuuuuauguggggcuguuuuugcuccacauuauauuuguuucaguucauucaugcuauugugaaaguuauuugaauacacucauauuguauguagcauuuuuaaaaauaauuucuuuguaguaaguaugcugcuguaugaauaaaccauaauuuauuuauccaaucugcuggauggacauuuagauuguuucaaguuuuuggcuguaacaaauagugcugcugugaacauucauauacauuucucuuggaaugcguauguaugcauuucuguuggguuuauaucuuuggcuagaauugcuguauuauaaaguaagaauauuuuagcuuuaguaaauacugcuaaacuguuuuacaaagugguugaacaauuuuacacucccaucaacaguggaugaugauuccauuuguuccacauucuuaucaacacuucauguuuuccaucuuuuauuuuagcccuucugguggauguuuaaaaguagcucauuguuguuuaaagcugcauauuuuuuucugugacuuaaaaagcuuagcuccuuuucauguguucauuggccacuuauauguccuauuuugugaagugccuauuuacguuuugcccauucuucuacuggguugucugucuuuuucuuagugacuuauaggagugguuauauaucauagauaccaguucuuuauuagauaauguugaaguuuuuucucuauuccaaaguugccauuuuuauuguauauuuugacaaacaaguucuugaguuuaauauaauagaaucaaacaguuuucuuaugauuaaugauauuucuguuuuguuuaagaaacuuucgcccaccuuaaagucaugaauauauucuuacaugaaaacaacuuuauuguuuuuccuuuugcacugagaucuauaauccacgcagaacugaucuuugcagaugguaugagguagggagucauaauucauuucuuccagaugcauauacaacuggcccaauucaaccaauugaaauuccuuuccacugcagugucauuuuugucauaaauccagugacuguauauaugggucucuggacucccuauucuguucuauuguucuguuuuuccauccauacaccaauaccacacugucuucauugcugucauuuuacaagucuuuauauuuggucccaaaaguuuuccaaauuuggcauuuuagcuagguacaauaauaauuacuuuguuauuaaaacuaguaacgacugacauguauugaguucuuuaucucgguuaacauaugaaucacucuacauuuaaucuuaacagcaaucugauaagauagaaaccauugguuuuucuuuuuuucuuuucuuuucuuuuuuuuuaauggggauauagaggccuggaggaauuuuaaggugaucaaggucacauugcuauuaaauagugacgucaacauuugcaugcaggccaaccugacugcagaagcucugcucuuuuauuaacugugugccugggauguggccucugauuacuuuugcugaauuggcugucuuuuggugcuaugaggcugauuuucagccuuaacacuagucgguauuuuuuuuccucucuccauguccucaaaaaaggcccaagggaaggugaacaaugaagcauugaauaaauuucaugcuauuuuucaguauaaauuuuauacuauuuuuaggauacaaaagacuauccagaguucuauuaaaccagacuucaggagcugagaagagcugcgaagguuuaaagccucugauccccuguccugaaauagcaggggugguagcuucuaucuaggcugaacucauaggcagugaaggaacuucaaguucuugaccccacucuccucuuuucaccucucccaccuacaaaagguucugaacuuuuagcaucuccccacgcaguaccaccuuccaaaaucaaacuguuaaggaauaccagguuuaaaaauagaaaacucaaaguuuucuaaguacgguaagauuauuuuuauacaaaggaauaaauauacaucugcaucagagaauucauaaauauauuauccagacugacccuagaaccacaaauaguucuaauguaaguuucugugcuguggaucaccaggcagauuuuaaugacugcucuaacagguuuucuguguuaaaugccuuuguguguguaugauauauuccauuuuuccuguaauucauaauuuuacaacaaaacauccauuguguuaggccagugcguguguuuuucaaagugcaccauuuccaaaggcaguugcaauagcucaugaagucaugguaaaaaauauucauauuugcccagugcucccaaaucucuguuauuuguaaauggguucagagucucucuuagcaucaccaaggucauagaaaggauggaacagagcuuuucagcaucucaaaauguguauuugucuuuagaaaauuccugugagagcgaaaaugguaugcauuuucccgucgucuuaucauucuaucauuagucaaguaauuuccuuaugaaauggucugcauuagguaggauuaacaaguugagaaaguguaaaaacaauuggcgauuuucuuacgaaagaaagaauaaauccuugcucaucaaacauuugcuaaaccuaucaaauaccacucuaaugucuucacacucuaaauuaaauguguagucauccugucaauaaaggaaauaguaguuugggaacuaaaguucagugcaggcagacucucuaaguucuacaauuuuggaugggcuuuggggaguugaagauguauuaucuggcaucuauguauauggagacugcuggaauuuuggacuuggcaggggucuuacaaauccauuagcccaacucauuugcagguaggaaaucuggagcccagggagcugcaaugaccuuuguaagguuauggucagcucuagacccauucccuacgcucauuuuucauugcuuguuugcuacagugcaguaacccuuguuuucugagagccagugacaauaccugccccacuacacauuacccagugaaaaauaggaacauaucuacuuugacaggcaaagugguacauaaguguacagcauuuuauuuuuauuuuuaaaaauauguauguucagguuauagcugcuuucaaagcuggcuugcuuauaagugaaugagauaucagcaaauuguacccucaguccugaaaauaucuuaauauuccagacuuaaaaaaccauuguguuggguuuuuaaaauaaaguaaaaucucauuguguuaaaaauagugugauuaaaacaauuucguuuuuaaacgucuuacuauuuuugucccauugaaagugucucucuaaauuucauuuauaaaauauugucugcuaauucuuuuuucucaguaaguauuguuuuccuuuaaaaacaauaauaaaccucacccuuccugguuuucuuuguuuauuuaaaccuaagaacucuauucuuagacuuaggcuaucucugcaaggugacaagcucucguguauaaacguguagccugggagaggcuccacuugauaaauggugaacauggccaccguguuggcccacacuuggauugagcuugcugucuuagucacuguucccauuugauccucacagcgaaaugaugaaguuuguauccaaauacacaaaagccuuuucacuguuucuuuuguuaccugucaagaaccaaguuauucuuacuuuguuauuugccuguaucucccugcaaaggaggagucuucaagaaucuuagaaugauggcaggccaaccccuucauguggaggucagaaacaccagugcuggagauacaaugcuggguuugauuucuggcacuguugcugcuaguuacucaucuucacaguuccucaauuuucucaucugugaaacagggaugauaauaauaggaccuuugucguuguuacacauucagagaguucagacaggaaaagcucuuagaauauuacccuacacaguuaccuccucaugugaaauuucagcuuugaagucugaauaguucaguagguuuuugacauaucaucaagaaugauugguugacucuaagcacccccgccccccgcuuaucuaugggacccuaaaggccauucaccagauuccucuuuccuuccucaucuccuagaauuguuggagucuuuaagaggcuauauaaugugcugagaaugaugauuaaaaauaguaacuaauagccaccguuuacuaagccuaugccauguacuugauuacaaauaguaacuagcugugccugauggcuuaugccuguaaucgcagcacuuugcgagaucaaggcgggcagaucaccugcggucaggaguuugagaccagccuggccaacauggcaaaaccccaucucuacuaaaaacacaaaaauuagccaggcguggugucgugcaccuguagucccagcuauuugggaggcugaggcaggagaaucgcuggaacccaggaggaagagguugcagugagccacgauugcaccuuugcaccccagccugggcgacaaaacaagacuucauaaaaaaaaaauaguaacuaauagcuaccauuuacuaagccuaugccaugugcuugauuaaaaauaguaaguaggccaggcacaguguuucacaccuguaaucccagcacuuugggagggugaggcgggcagaucaccugaggucaggaguucaagaccagccugaccagcauggagaaacccugucucuacuaaaaauacacaauuagccaggugugguggcacaggccuauaaucccagcuacuugggaggcugaggcaggagaaucucuugaacccaggaggcggagguuguggugagcugagaucacgccauugcucuccagccugggcaacaggagcaaaacucugucucaaaaaaaaaaaaaaauaguaacuaauagccacuguuuacuaauucuaugccaugugcuaggcacuuuacugcacacuuuauauacauaaucuaacuugaugcuuacggacuuuauguaguuauauauuucacagaugaggaaacagguucagggggguuuauuugucuaaaguucuauggcacgcuagggggcaucacauuuaauuauucgaaugcaagucugucucacucucuauccugccuccucauuccuguguuuucucugaccuccagugaucuugagcacauguuuucuuaugcuauugucaaugugcuugcuuggguuuuuuuuaauauauuaguaauuucacauggcuuaaacaaauuacauaccaacaaauuguguacaaagaauuacauucaaaagaauuccaauuccauuugcuguggugucuccacagugucaucaggagcuccuacuaacugucuaggguauagcccucauuuuuaugcugacaaaauggcugcaggagcuccagucaucaguccuguguuccagacaugaagaaguugaaguggggaggcagagacaaaaggccacaagucaaccaagucuuuccccuuuuaaaggucuuuccugggaacagugcccagcaguuuucacuuaucuauuauuugggauugggucauaugacgacucuuaaucacaagggaggcgcaaauuguacuuuuuuagcugggcacauuguugucaugaacaaaacucagguucuauuaacaugaaacccagcuggugagcuuuuugaaauaaaucaaauacacucauucaaugugaccuuucccuagugccugaguaccuggggaaaccuugauacguuagagaagcugagaaagauaaaauaucuugaggaagaaaaaaggguugguucagcagaagcuaggaaccagguagaugauuucuuggcugcucagcaagguugagagugcagcuuugcccagacccaggaaaggaggaguaagguccagaaggggagcguaacccugguauuccagucuaacuccauguaagccacaaguaguaggaggaaagcagaggaaucuuacacaguaaauauacaucagcauuaauaggugaagcugugccucuuguaagguuuuacuucauaaauauuuucuguggauagaaaaacaauuguuucagauuuguguugguggaggugcauuggaggcaggguuaauugagaaacagaaugaggaaagcaagugaagcagaauaaugaugcgcuuuggagccaacucgaccuugaauucuagcaccaccacuugcaaaccaugugaccuuggagaagucaccgagccuuucucaaucuccuauuuauaaucuuaaaaagaaguuaguaauaucuuccuuuugugccugacauaauaagugacuaugaaguccaucauucagugcccggugcguggcugcuggcggugcaggccuugguacugcuaucucauggccgaguguucucagucagcaggcacuggcuacgcacuugcugugauccacauuggacugcaggucaugaucuggguuuauguugaaggaggaguacgggagaccuaagagaauggguggaggaauuaauuuucaaagcagcaaccacagagaaaugcaaugagcucuugaugucaacuaaaggaggaagccugcugcugggucagcugacuguggguuucagacgcucauuuggggccaacuaaaaaaagcucaugauggaagguguuauuuauccaaguuuuaccuuucucauauauaaaaugaggauguccauaaggccuaccuuccaggguuguuacaagaauagugcuuguagagcuguuggcaugccauauguacccaacgaauuaucuaguuaauuauuaaugaugucacuucccucuuuacccaagcaagaguaggacuugcaagucucagcuuuuucuggcuuucuuagcuccacucaucacauaaaaacuuuagggcauaaaguacacaaauaaucacacuagauccaaaaaugauacugugauaaugugauuaauaacaaauucuuagauggcaauaguguuuuaagguacagcugaagauuuguaaauuucauuggcuuuggugcuuauaaaagggagaccaaccgcucauugcccagggcagcaaaccacacagucugccaguguugaucuucugaguuucuuaaauagcuuuguaucgcaagucaaaacuucacauuugccaucucucugcuaguaacacaggcuggggugggaucacuuauauguuuuugcuucuaacuguugaaaugugaacaggcuggacuaggaauuaguguggaaaaaucacagaaaaacucacauuccuggaaacaguaggcaggugcaauauuuauugucaucaccaccacuucccuccauaucgguguuaacuuguauccuguccaaagcacuuugcccucaguuggcuuauuugaucugcuuugaagccaagggagaaggcagaggggacuucauuuccuauuuuuucuuuuuuucuguuuuuugggagacggaguuucgcucuugucgcccaggcuggagugcgguggugugaucucgguucacugcaaccuccagcuccuggauucaagcgauucuccugucucagccuccagaguagcugggacuacagcggcaugccaccaugcccagcuaauuuuuguguuuuuaguagagacaggauuucagcauguuggccaggcuggucuuucaaacuucugaccucagaugauccacccgccucggccucccaaagugcugggauuacaagugugagccacugugcccagcccuccauuuuuuuaguuaagaaaauugaagcucagaaagguaaaaugacuugcucuggauuggccugggcugcacuugaacccaaaucuucuguccccccaccccacccccggacucuuccuacaggacugugcauugcuccaggcccaugcccuuacuuuaucuggaggaaaacagcauuaccauaucuucaaaucggguugugcccuuuagaaauggugagcugugcaaauaaacaccacuuugcuguuguuuuaaacuguuaagaagucugaaauucacuguauucaugaagguugaggagagaagagguugguguguaauagcuugguagccguguauccuugaguguguuuccaugaggcuugaucaggguuuguucacugggggccugcucuauaggauucuaaguagauucgcugcucauccacauggcaggcaccagggcucuccccgagaacagaagcucucugcuauaagccugcucccaccccucccuccauccuguccuggacuuccagggccugaaacccuuccauucugagccuugaggaugaauugaccuuaaaagagauuccaacagcaaaugaaacaccuuguguucucacucagaagugggaguuaaacaaugagaacacagggacacagggaggggaacaacacacaccggggccaguuggggaguggggggacugggggauagagagcauuaggacaaauagcuaaugcauguggggcuuaaaacguaggugauggguugaugugcugcuguuuaaaagccugaaagucauccagcucucaugcaaaccaccauguuacauauauaccuauguaacaaaccugcacguucugcacuuguaucccagaaauuaaagugauauuuuuuuuaaaaaaagagauuccaaauaaaauagaaagacuuucacuguauguaacagcauauauauuuauuuuuuaaaaaccuuaggguauugguucugggggucacaaaccuuaguuccuugggcuccacaguauccucauccauaagauacgagugguaagaggaacuguaaagaucaaaugagguauaacuuacaaaagggcuauaaaaauguaagcuugacagaugggaugaugggaggggcugaggaggaggaggaggaggaggagaguagggaccagaccuaaaguuccgagcacuaggugugacccaaggaagcucuacaaugggggcuugaaggcaguuuuggcugauuuuaugauuuugcccaggacuggaccaguugccgccuucaaagcuauucagguugcuuugacuuccagccaucugugccuggaaauguaaaacaaaugguuaauggcaucagaugguuaaugaucucaaauguucccugcuuacugccaugagagagaaaagagccuccuggagaaauaaucauggaugcuguuuccaaaguugcaauuaaucguguauucaggaaaacccaucuucugccaguuauucugauaagaaagaggaaauugagggugacggaggagcugugccugagagggcaguuugaauaaucuguauaaggucaagaaggcagauauagggcucauaaucaacacagcaguuuuggaacaaagccaagagggucuuguccuggcauggguuagggacugacuuuuaugaguccaaaaauaugugucuaaggcuaggucugacuaucuggccuuaaacuuccgaguuguaugggggccauccuuugguugcuuuuuucaaaaauacuuuuucaccauuauugccugaaccaaagauaccuccgcuugucucccuuuggggcacauaccugugguuauguucucguguuucacuguuuuaaaacuuuuucucuuauuuuccaucucuuuccuccagcuagugagaccugcaacgacuuccacccgauguucuucacccacgacagauccuuugaggaguuuuucugcaucuguauccagcuccugaacaagacauggaaggaaaugagggcaacuucugaagacuucaacaagguaauguggaucucggauagaggcaggggauucccgcagcgcuaaaggggccugcugcauggucccuuggcugugugcagaaggcaauuggcaagguggggaaaugaggaagauugcaaugauaguugcuucaagaauggagaaagacaaacaucccuguguagacaugaaucugugugcuggggaugaccucaucccucuggggguacgcuuggagcagcuuuguuccuuugucuaaguuggagccaccagcagagaguuuuucuugggacacguuaucaaggcgaauguuuucuuucauagcauuaguuugggaugccuugucaauauugcaagaucugucggggaaggggccuucccuccaccuguccaggagauugguacagagcaaaugagaucaggaauacugcuccaccuaguccggugguuucuuuguggauuauggauguguugugaucaucugccccgagcuacgucaagaagaauuuuuauuaaaaugaaagaucccuuuccaagaacugagucauuaagguuauaugcaacauuucuugguuuacaguaagcauuugauccuuugaacugagauguccuuuaguuuucuauaucauaaugucucacaagagugugacuuucacauuuccauuugugugugaauaaccagcagagggaagagcauuggccaacuuagagcagaagcacuauccaugcuuucauagagaagcaaaaucuuuguccuuagauaaaggccugauuagcaauaauaacuauugcagccuuuaguacuuuuaauuugcugcuauauacagcugugacuguggucaggcccaucacccaugaccacucucacccagcacuaagggcugugacuguaagagucgaagggucuggcccucagucauacuguggggcuuucaugggcgugcuuggugcauaacauaaucucugaauuucaccugcacuuaauauacuuguuggucauugccucccugucaccuucucccuggauauacaucucauccuuguuucccacuauauuucucauuuguggcaucuugaaccaacaccaauugaaaagaaagaaaaucaggaaaaggaccuaagcuucagucagguccuaaccugaguuucuuccucagcacagugaucucacuugccauaucaucucugucaucccaacgaucuguccuuugcaucuuggucaucgauugaauuccuugaaauagaccccaguaaugcccuucuguggagagcacuggucuggaagcugcaauccagagcugucaugugucugagcagcuaugccggaggacaggcuugauucaagaagggaaguggagaaaagaagcccauuaauuuccuuaggauuauaacugcagccuccuaaguguacuucgcuugauugugagagacuuugcauuucaggugcaaaucaucccugggaaagagggaaggaggagcagggaggccuuuguucaaucaaaccaaaaaagagaauuaaaucaguagucuuugaaauuggcuaagggacuaaggccacuuugcccuggaucauuucagcucuuucaugugcugcugugugaaagccauccaguccucagcuuugcgagcuggggacaccuguuccuccaggagaaggagaccucaccaguuguuacggauuugggcaucagaugucugcuuucugagagaucucauuuauccugcuuuuccuaaauuauaaauucugcauuuugcagaauaauaucugcaaauaauaauguuucagauauuauuguuguugaucuaggcacagauaagcuguguagaaaauauuaugaaaguucugcagaggacugacucuggggaugagcauucagacacuuaaauccuauagaaguuacauuuuguaacaugaagcaccaagaguuccuuguuagcaaaggaagccggaggccccaggauggaggaggugggcacagcugguggagggaggugaccauagcucuagggucccuguggcuuaucauggccaugugcucagauugguggcagacauccugccuguucagggcccugccaggugacagcaagccccccagagugucacugugaaacuuuuaucauaauuagccuauauggcugugaaaucucuucagcaagaccuaagagccagguuuugggugcaguuucuuaccguagcucuaaugccauuuuuugcauuguuuacagaucauagacuaaugcugggggucacaccucuauugccaaguagggaugacaguuuauggcucaggacaggcagcuccaggccugagggccagagguuccugccucacauccaaauagccaucaggcaagagcagauaucagaggaaaauccaggaugggaaggacaaggaauuuuaauuuucuacauuaaauacuuucaucguguuugcuuuuuuucucuuuuuuucaguacuaugcaugccuuacuuauguaaccagaaaaauauaucagguauuuacauuuuugucaugcguauauaacuuuucuguugcugauacaacaaauuaccacaaauuuaguagcuuagacaaugcaaauuuaucuuacaguucauaguucagaagccagcaauggauuucacuaggacaaaaucaaggcggcagcagagcuguguuucuuuccagaggcucuaggagagaauuuguuuccuugccuuuuucacuuucugguggucaccugcauuccuuggcuuauguccuucuuguccaucuucaaagccagcaaagacagcuugaguccuucucagaugccaucccaucacccugaucccucuucugccuuggucuuccaccuuuaaggaccuugugauuacauugggugaccuggauaauccagcaucaucuucccaucuuaaaguuggcugauaauaaccuuaauucugucugcaaccccaauuccccugugcugcagaagguaacguauucucagguucugaggauuggaaugcaggcaccaaugggaagcuguuauucugccuauuuccaguguguauuugauuugcagcuauauuagguuuuuagauguguagaucaguuuaaauuaaugaaacacggacagaggagccuuuuguuugcuuuucuuuuugcugguagacaugauaccugucacagaguucugcuagugacagcucagaugcagauauaauuaugucccuuuucuuuuauggcccuguuccgccuccacuagccuuuuuaaaaaggaagccucuuugugacagcuucugguucauuuugaagacugccuuucugauuuuuuucugcugcccaucuaucagccacuguucugcuuuacuugauaauaaguuggagaagagagaagagcugaaaguuaaaucaguucacuuuucuucuuguuauuaacuugguagcagaggagauugaauuuaggaacaaaugugaguugugaguuacugauagauuuaauguuuuuuucuuauucucugacuguccaaauucaaauucagaaaugucuuuaaaaaagcccaacaugaaacauaauuucuuuucaacuuucuuggacacuaucucagguucuugccacuguaaacagagcauggaagguggguuuauuugucaacccugagacccagggcucugugagcagggcuuagcuaucugucuucuuuagcuccucacuggagaaggagugccccucaauuuaaaauuuugauuugcccaacaaacuaugcuggauucuaucagaggcaggaauagcuucugcagcccgccuuccuugggacaccaguuuauagauaucuagugcuugguaguuaaugccacugcuggaagaggguguuuggaaaagcagcugucgucugcucuuccgggcuugggaagcagcagauggaauguuuuuuauuuauauaagagaaguagaauugaagagugauuaaaauauuuaugcuuugaaaaguacuuucuuucaguuucucaauauagcacucugcagaauaauccauugauucaggccauugaguguguguucuaucauuaccaauauuuuagagcaugcauuauucauuuuuaugggcauuagagaagagcuaaacugcagcuggauaccucagcacacaaguagccccauaaucauuucauugaaauccucauuuuugagcgggauaagaaaggggacacaaguaacuuggauauuuuagguaugggaaucucauuuaaagcauguguggcuaacuacuccacuguaaaaaaaaaauguaaugagaguauacacuuuagaguauaugucuguguguagcaguguuucucagcuuuagcuguacgucagaaucaccugggggcuuuugaaaacccuguuaucccaccggccaaccgcaccacagauuaauuaaaucaucggggguggcgggggaagcuaugaaugaguauuuucauuaagguagauuugaucauuaaaggugauuuauguuaauagaaucgccaucauuaacacaugugauacuuaucacaagcuacuguaaauuucgugcauugauggaguaggaugcuuguugaccugugugacccagguuuucauccuggaucugcuauuccagagcucuaugucugagaaucuaaaaauaauaauaguuuuuaaaaggauacaucacccugucuuuugguggggugauaauaaauugaaguaauuacuguaaaaaugcucugaggaaguaaaaaugguauauguaguuguggaguguucuuuuguacugaauaagauaaagccugucuaugaaaaaugaguaaauugcccuuuucacaaacagacauuuuuuggcuauguuaaaaaaaaaaagugaagcuaugaauuucacaguaaauucugaacugaauuaguaacccauguaacuuugacaaaaauaggcuuuaagcugaaauuuucauggauuuuggaagugucuuccuccaaacaacuuuauuagguaccuuaguuucccgugugaaacacacgguagcaaccuaaaaaacagcaggucccaugauuuucacauauuuaauggcuggugagaauuaaguccuccccaacaauuacuaguugcccagaucucuucgcugaugauugacgcuuuuauaaaccaucaaaauauuuguuccuagcauuggcguuacuuuagacgcuaucaaaauugacauuauaagccaagaucagaugauugugccauacuuucagauuaccaaaauggaagaaacuaauuugaaaaaugaagucacucuagaguaaaagcacuaucuugaaacuuuaucuagcagcauaauaaacuaagcgcacacaauagagcuuagaaucucaggcuugcaaaugaaaaaccaucccuuaaaauagcagagacugugcacagggagaacccaggcccauuaaacaaagcugcagcugccccuggccaggcugugagcuucaaccgagucaaugggagaaaaucucaauuaggaagaacgggagagcaggacagaaggaaacauccugagaaaucuccuaugaagauuauucauaggaaauaaccaccagcuagucacaucuaguggauuauagugugggauagaaaagggauuguguuuaaaaccuuaaaggcagcuaacacaugaauaaaaaagggaaauguguuugcuucucaaacuguuugcagcuuacugacuuucugugcaugcuuuucaggggacaauuauauauucaggagucuccuuacuagggcaguucaacuucauaguggugcagacggcgcucuguugguuagcugagcuggccuagggaaugaaagguggucuguaagucucaucaugaauaaacaugagucuccucauuugcgugaggcaggugacuguaaaauaucuuggagcaagcugugaaaggaagcuuugugcauccaugcccaggggaagcugggaggacucagcguuguuuaucuucauuagaauuccaucuagugcugcuguuauugaucugaacugggccugguguggcuaauaaaguagguguauguuuuaauugaaacaugaauauuugaguagaggagaagucuuuuaaagagcccuaauguccuacacugagcuuuuccauuuuucaacugucuaggcgauuaacaagcauuuuuuuucaaaaggcuucugauguuucacaaaggucuuagguuugccacacaggcaguggaaccuccucuagaagcaaaugcauuauaugaauagauuuaauuauuauuucuuugauauucccuguugaauagguagcaaagaguuucauaugugugucuguguuuaagcuguucauguaagauaguguuaccuauuuccauggaguuugccgcuuucuguuggacagcaaucaagauauguccucuccaauccuuaccagugucaauuauacuauccagagacagcagaaagaccgggaaagugacuuugguaacuuaucuuuuucaauaaguguauguucaaauagaccccaaugucauacauaaacagauauguguuaauaacagguaacauaacccuggccaagucagggaagcacugugguacagagcaauauuucuccuucucuuuugcauuaucaccccgcuagagaguuuuauagguauuuuuccccaaucacccucccccugaaauuguaauuacagauauauuguauaugucuuuguguauguauaccugugccugcuguguaaaaagaguaauauuuacuccuccaagaaccauuuuugugcccucccuaaggaugauguccccacucccucaucaagaaugcauggugcaaaggcaagaaccaaggcugaauuagcaggaggaucugguggcagucccaguuggccccucacagcagugugaccuugagcuuguucuuuaaccaccaaguccuuucucaccuguaaaccgguaguggcaauaguaauaaauaauacuucccagagucacuguggggauuaagcucucauuagguuugcuuugcaaauuguccuauacaaauaggagguccuaaucucaacaggcaaaaccuaaagugucaguaauuugcacuuuaucaugcaguguaauugagcugccuugauuuccccagauaguuuguucaaauauccauaaauacagauuguuuuauaccucuguaugggggugcguugaacuuuaguuuggccacagaggggauuuugaccacuguggucacuccuccccagcccacccacaaacagauguacugcaggugaggcagggggcuggggacaguacauaaaaaugccaagggccucccuuccagcuggguaaccuugugcaagggacuugguucugcuggcuucagauuccucaucugugagaugggaauagguaauuacccacagcuaggauggcugugcgcccugaugacaucaggcagauaaacuggcaggcucagcacuggccuggagccaacaccaguccacaguaauggagagcagggagaagaccaggugacacgggauuccaaaugccucugaaaaggaaaaggaugcucauggcaacacugagagcaaacaucuucaggaaagguggacaagcugcucccucaaguuuagugauuaacuuaguagugacucuuuuuuuuuuuuuuuuuuuuuuuuuugagacagagucucgcucuugucacccaggcuggagugccauggcacagucucggcucacugcaaccucugcauccugaauucaagugauucuccugccucagccucccaaauagcugagauuacaggcgcccgccacgaggccugguuaauuuuuguaauuuuaguacagaugggguuucaccauguuggccaggcuggucuugaacuccugaccucaggugauucaccugccuuggccucccgaagugcugggauuacaguugugagccaccaugcccagccaguaguggcuuaacuucuaagugugcugccgugguggucucagcugcaugggguccauggcagcuuuuaugaagaacauagagaagaccuuagagggugaccaauuuucagggacuguccugggguugugcacuguacccugcaucucccaacccucuacccgcugaauuuacagcccuggcagcaucucuuuauaaggaaggagcaugcgaggaaucugagucauccagaaagaguuggauuuuguugacccuguucauguaauuuucuuuuuuucuuuuuuuuuuuuuuuuuuuuuuuuugagacagagccuugcucuguugccaggcuggagugcgguggcgugaucucggcucaccgcaaccuccaacucgcugguucaagcgauucuccugccuuggucuccugaguagcugggauuacaggcacgcaccaccaugcccagcuaauuuuuguauuuuuaguagagacgagguuucaccuuguuggccagaauggucucgcuauccugaccucaugauccacccgucucagccucccaaagugcugggauuauaggcaugagccaccgcgcccggcccauguaauuuucauaaaaaugguuaaacuauuuaaaaaccuguuuaaagguugacugcuaucuuuagcugaaggcauuuuuaauauguuuugcuuucuggacauuuucuauaacaggagcauuuauaaaaauggucuugaccaagagugaaucuuaccauuuugaauaagccugacaguaguaaauauacuucuuggguauuccuuuguguucaagauuuugcaugaggugcuucucauuucugaagucuuucuagagccagugucuauguuucuuugcauguguagcacgugcuaacuugagauuugccaauuaggaggagaaaauaauugauuuguucuucugcuggacagcagugagauauaucagucccuugguucaauuucugaccaucccugagcaugagaauaaugaugacuuuagguuaacugcuuuccauaacucuguucaguaacuucugaaacuucuuucauuuuauuaacuauacauuggggcuguguagaaaccaguuguuaacugguuucuaugaccugaauuccagauuccguuguggauuauaugaaagguuugauaaugucacagaaaccauuuuauuaguauaugucccauuaaaaggaaauuaccuacauuuuaaguaaggcaugaugagauuuaggcauuuuaaauuaaagggcagauaggaaccagaguuggauagcuaagaaggguaccauuaggugggaaucucucaugaaauacaaggccucauugauuuaaaaaaaauauuuaucuuguaauugcaaaguaaaugauguuacaugggagguuaagaacacauuuccaaaaagagaugagucuccuaaggcagaacagaagagcacauaggugcugucauauaggugcccccuauugccaacugaggguaccagauguugugaugaauggaggguugagggcaacaaggggcccuagacaagauaaaccaagcagucagagugagagagugggaucagaagcuauuugcaaagacgccaaaacaagagcuagaagaaguuaggagauccuaagugagauuuccaaauguuuucugcggaauaccagauccaggugcuugguaguuaaaauauauauuuaaugacuaaaucauaaaacaugcauauucaacuucauaugcauauucaaccucuaauuuacauugguuguaugucugcaaauuuuucagaacugugcucuuuuaucugagcaacagugacuuaugggucaagauuaucugccuucauuuuuccaaguaggagcugaacacugaucuuccuuguucaacccacacacugacccuccugcucugucaccagcauagagccaagucauuaagucagacagguccgaagcaaggacagagguugagaggccagaagaagauaucaaaguaaggcuacauuuggcagugguucccuccuucuuuucucuuuucuuuucuuuucuuucuuguauuugagacguugucucauuauguugcccaugcucaucucaaacuccuggccucacacaauccucccaccccagccucccgaguacccgggauuaaaggugugagcuaccacucccagcauuccagccccuuuuuggcaauuauuacagggagaaaaaugaacauuagaacuugaauuugagagaugauaauuccaaaccgaauuucuucuucugcccgccuccuucuucccuuuauuuucugguuucuauguguuuucuuccuauucuaguaaaguuaaaauaauagaugaucaggccaacuguguaggaggaagucauuuaggcagguaaucagcucagauaucaaucggaccaccaccuuccucaggaaagugcucaagccugcagcuaucacuuuuggcaacaacucacucagaugccccugaguugucccucuugcuuugucccuaggaauaccuauacccuagaacuuaugucagugaacugcaauugccuaucuggcuuccuaagagcagagccuugcucuuucuguauucuaaguaucuagcaccaugccuaggaucuagaagguacucaaaguuacuaucucaccaccaucauacauacagcacagccacaucagcauuccacaucuugguuaauagggucaauauccaacuuacucuucaaaugcuauucauucuuucaacagauauuuauuugugucuacaacacagugcuugugguagacacugggaguacagaggugagcaagacaggaugguuccugcugucauagagcuggcagucuaguaaguuucuacuuagaaauuuaugggcuagucccucuuugugaaacugauuaguggccaaagucgguacaaucaccacaugguccuuuaccuuuucaucauugccucaguuucugucuuccucuucucucaccccaaugugauagauugaauggcuggucacaguucugcacugcuucgugguaguagcauacuuccaaauccuugccaugaccucaugaugggugaagugaauuuccuucacccuuugacuuuugucuuggccaagugaacuugcuugggccaguugagaugugcauggaugugaaacgagcagaagcuugacuguugcucaagugauugagcugggcuuuugcacuuuuaccaucaucaugagaacuacauaccuugguagccacugcuccuucaguguaggucccaaaaugagauauauggagcgcaguuuuuccagucagcccacagagcuugaaagagccaccucagcugaccuguagaucugugaaugugagaauaacuucuuaccuguuggaguuguuuguuacacagcauuaacaugacaauagcugacuaagacagcaacuguuacaccaacuuaucucccagcuuggaaaccuuuccauuuuccgaaucuccuccaacacagaucugaccauaucauucuugcuuuuaaaacuucuguggcuguucauugccugacucauuaaauuuuguggccucagcaagauguucagauuuaucuuuaauucaccuaaaguaauuuuucugcuuuaucuccauaucuucacccugcaccuacccuaggcucuaccugaacugcucuuguacgugcaauugcauuuucaugucucauucccucuaccagaaacgucuucccccauuuaccuguugaaauuucacuuauccuuuaggauuuugcacaagugccaccuuagcaagauaguuaccaucucccuuuuauuuauucagaaugaaauuuuguaugucuacucccacagcauggaauucaaaauuuuuuggaaaauaucuucuaguucuauagcaguuguuuauuuuuaagucugucuucccaaauaaaucauauauuucaauauaucauuggaagcaagagcuagauuuuaugucuuaauauccuccaggugcuuuuaaguaguaucugcucaaauacuuuguguugaguguugaauuaauuaauggccagaaauguuuaauucaaugaucauuaaaaaugguccaccugaccaguaagcugaauucauauacaccgucuuaauaugggguggccaccguuguucaauuccugaaggccauggguauuuugaaauuccacacaauaaagaauuuucuugccccaaaugccaacaggccuuauugagaaacacuucuagaccccuccaucagaaucucuucagaugcuaauacucugaggaaguuaugaaaugauuuugccaucuguuucuuaauaaaaauggcaguugucauuauuuuucugccuauguagcuuuauauaaggugaauagaaagcuucaaagacauugaacuuuugcaaaagaaacugaauuguucuuuuuccaagaagauugguuggaacuccuuguuaaaaaacguguguguguguguguguguguguguauacacauauacauauauauauguauauaucccucuguuucauuuucaccuucacucauuuauuauauugcccuuaagccugcuuaacccacauacccuggccauuccaggagcacuguuuuucccacuagccuuguuuccaggccagugggaaaaauaacaucaguaauggcgcuuguucuuucccaggauggcugccgagagaccuuccagugcaaaggacaaaugugacugucaaccuuccaucccauguaggggacugguacuuagccaagcaugccuaggaaauacgugcuugugcagcaggaauguugaaucacaugugugaacacaucaugccguucacaaaaauuaucuuuuguauuuuaccuuuaccucccgaaguuaucuuaaauuggggggaaaaaaugcaucccccuuagaaugucauaagagugggaagacccaguucuugccacagugagaguuuuaagugcuggaggcaaucagcuccccagaacucuucugguccuauuuuccuucuuucucuuucacauauuuguuugcguggcuuggcuggauccgagguguauggcauauggcuuuuugccgcuugagcugccacagaaguaaaugucauuggcauauaaugccagauuuccauuuugugaaucacagagcacgggauucuguccgaaagcucccuggccacuauguguucuuaaagcagaaguagaaaaggaaaagacccacgcaucacacagagaugcuuuuccuauuaaaauguauuuauugccacaacaaguauauauaaaauggacauacuuuugccccaacguguguuugaaaaagguucuuggcuuguuuuauugugguuuuggcacugggcaagccuggacauuugcuuccaagccucagcugagcagaugcuggucggucagggaaucagaugaauaaaaauuugcuugugcauguaccagaaaaaaaaggcugugaguaaaagauaaucaauguuuuuuggaugcaguuuaccagaauuuuuuauucauuaaauuuucaaguuauaaaagcuuuuaggcugauaauggagaccugaagcugccacagaugcagccucagccuuugcuccccugcauggcugagaaaucaagagagagauuugcagauucaaacacacacacacacacaaagaugacauggagccauaugcaacugccaguauuggacuguuuuugucugacaaauacagcaauuucaaauggcucaaccaaaaauuauuguacauucguggaaucaguuguauuuacccauaagcauuuacuguugguuucugacacagucuucuucuauuauucacaguaccuauuucucuuucuuuauucugugaucauuuaacucaccauaauaaguuguaguaaagucuaagucaggagcauuggcccuggacccaaggagugggauucacacccuagcuccuucguuuccuugcugggugagcuugagcagguuaauugcccugcccuguaucccggucucuucgucuagagacugaucgucauggaguuguuuugaggaugaaaugaaccaagauuagguggaaccacaugaaauggccaauauuggaccacgucugaauggcaaaauuuguaguucuguucugcucaucuuaaucaaugaaaagcauuuggggccauucccaugagggaaaugacacgaagaucacacagcacacauggcgcuccagaugaggcauggagaggcauggauucuaguccagcucugccugugaccuccugcgugacccggggcuuuucuccuauccugcacucaccacccucccuccuagacaaugcuguggccccggggauggccuccuucugugcuuugaauuucauccccucucaccugcucuggggcucuguccguuaucauuucuaaucuuugcaucauuagucucuuccucucacaugcugucuucucaccagaauauaaacacacacaaaucucccacauucuuaauaauaaauaaaugauuuucucaacccccuauucaccugugccccugcagcucgguuucugaagucauugccucaguuucccagcucgccuuuucauguauuaauccacugcagccugccuucugcccacaccgagaauauaacugagcaaaagaagagaaauaggacucuaaaaagcacuaaaauauagugucaguccuugaaaaccucuuuagccacaaaagucacugauuuugacaaagaauggccuccgguggacaguuuuaaaucucaaucuuguuugccaccuuuguagcccuugacccugugaaccacucucuccuuaaaaauuuuuuuuacugugacuuuggaaaugaacauacaugcaagauagauauagauauacagauauagauacagacauauauauauuuauauauguauacaaugcaccuaagauauauguacaaauggcacauugaauauacguggaagaaauaaaauaacuauuauuguuccaguuacuagcaacauuuuuagaaaaaaaauuaaaggauaacuaaaaauauaacugagcucaagagaagaaauacgacuccaaagugcauuaauauauauuuugaauacuugaaaaccucuguagccacaaaagacaugauuucuaagaggcaagugggaauugagaggagucguugaguuguucuaaauuuaagacuggaaagaagucacauuguucugaaucccugcucugaugaagaagagagacaucaaaaaauuuauaaaaauacaucuuuuaucccuuacaccuucaugcuauucgcauccucccccacccccaucucuucucuucagccuaaaaauauaccaaaaucauuccuuuccuuaaacaauauuuuccaacccuguuccucuuucaaguucuuauccaaucucuguccgucucugcacugccaaauuuuccgggagagaaugacaucuccacuuucccaccuccucaccucgacguggucugauguucacccacacccaccugcugcaauugcuucauuuagcucaaggucaucuucugauuguucuuguucauccuguucccuggcucugaggcauugacuuguguugccuccugugcuuccugggauccucuccauuccucauucccauggcacugaccccuuuagcacaggcauucccugaggcccuccucuuuuccucuccuaccacugccuccuccccaccuucaaccagcaccugaggcagacagaauuccacccucaucgucuucugagcuccaccccuguggauggucugcagacuccucaaacucgggauguccaaagcuaaacucuccauucucauggcuccguuccugcugcugcuucugugggcucuaacuccaggagugacaccacaaucaccccauaucuuggacuugaaauccaggagagaucucuggcuucccuaccuuuucucucuaguagguccccaaguccuacugauucaccacucuaugagaagggccaccugccuuuuaaugcugugacuccacuuuccugcaccauuaucucagccccagucucugugcaggaacacaugccagcaugaaaaaucaauuggcuuuugucaggccauaaauaccaccaaaagaaaaucuaaagguguuguuaagacagaaaaaaacaaaaucauuuuccuucucuccuggaaauagcuuaaauuuuuuuucuggucuuaaaagaaaucauuccucucaagaaucacuuucuccugucauagcuuagccacccugugccuuucacuuauggacucaguuuguucuguauccugccuucccgccaccaucaucucuuguguagacgauguguuuguuuuuuaauuggucuuccuaaaucuggacuugacccaagccuaaguucucucuccccuagcugccagaaacaccuuucuaggacacagcucuucucaugagacaucugucuucaaaaaccucuggcucucucuucuuccagcaggauagaaaaacuccacauucuguccuaaaccacucuuccaaacaacaugucuauuacgucuagcagcacaccuccuacuaaccuaucguuagucauacugagugcccagcaugccuugcacuucccaguaucugucccugauuguguucccucagcaaggaggaaccuucacucuuuccggugaaaaaucugccuguccuucaaggcccaacucaugggcccugcaaagucccuccauggggacaggaggaauuuucccucuuauguucacuuuucuuccccucucuuguagcacuuaacuuacucagcuauaugcuaaguucggaaacuuauuuuagccaauuaucuuugauuuaaauggguucccauucauucucugucccaccucauggcuaccuugaggcaaugcugcagaauuccaaaggcuugaaaaucauaucuacucucucuguuucuugacucuaccccuaagaaccaggacugauucucacucaccuuucuaccccagagugccuaccaaaaagaaagaaauauauaugagcuuaacaaauguuacuuaaauugaauuuuuauccuauuguugaaaaaaauagcuaauaauguuuauuuuuaaaucagcugauaaggucuuaaaaggaaaaagcacacucuaggacaaacuuugcaaucuacagaacaaacagucuuauggacucaguuuggcauugaagggcauuguguggcuaugacaggaaaaagagugauucuucuaguggcgauuucuuuuaagaccaagaugaaaaaaauuaagcuauuuccaaaagaaaaggaaagggaauauuuuuuucugucuuaaaaacgucuuuggauuuucuuuuggugauauuuauugucugacaaaagccaauugauuuuucaugcuggaaugugcucccacacagacagggcugagaugauggcaaagacuucccuucccaaaccacgcugggcugagucuggagaucccuggcuuccagcuguuugugaggucaauuacaccccucugcauggggaggagacaagguuccuuuggcucaucauccuuuggcucaauguuggaaauucaccaacauugauuaucucauuuguagauuaucucauuuguauaauacagccauuuagaaucauagucauucaaggggggaaaacaaagaugugcauauagauguucauuucauuguuacuuacgagugagaaauugaaaauagcccaacuauucaacaguggggauugauaaauuaauuuauggauacauuuauuuaucuguuaaaauuuuuuuuacucauucagaaugauauucaugaauaguaucuaaauaucagaaacauguuuuguaguauauuaaaugugaguagagcagccugcaaaauuauaucucaacuaaauaaaacuacaaacuaaaaaggauugaaugauuuuuuuuuuuuuugagacagagucucacucugucaccaggguagagugcaguggcgugaucuuggcucacugcaaccuccacauccuggguucaagcgauucuccugccucagccucccaaguagcugggacuaaaggugugcaccaccaugcccagcuaauuuuuguacuucuaguagaaacgggguuucacaauguuggccaggauggucuugaucuccugaccucaugaucugcucacugcggucucccaaagugcugggauugcaagcgugagccacggcacccagccagguugaaugauuuuaacaauggcuucuaugauguuggguuguggguuugaaagaaaaaugguuucuucugcauagugugauuaauuauauuuuucuuuuuuacuaugucuuuaauguuccccaucuuugcuaccuaacauguauuaucuuacaaucauuuuuuuaaagaaacacuuuaaauuuuguggguguggaacuggcaccaagcuccagguguggucugagcaguggugucagucuaggaggaauuucuuuaucuugacauuccauguuauaacuucaggcuaaguuuguuuauucuuccuugaaauagagccuggguuugggccagcuuugccagcccagcuagugcccagcaucuuagccugaaguugauugguacugagaucaaaagcccuucaggcuugauucaagaaagacucauuaacuggaaggaaguucuaagcagaugugauacacuuaagaaaguaagccacauugcagacagagcuggacccagcaccuagaaugcuuguaaaauggauuucugaaagggguaguguucaggagugcuucuacacagagcacccuagucccucucagacugagauugcaggagugggaggaggaaggaaugggagacaacaggggaugagucauugagauguuuucagauauccucauccccauggcuguaccuacgaugcuggauagaaugacagaaguacucagaagaaggcuuguauaaccucucuaaguuuaagguuugcaguaggauuuugucuucuuggcuaaguuaacagauacaucuagagaugguauuccugguguuguauuaguaaaaccagcccuagaggguucccaguauuggugagagcugugaaaagagcuaagugugcaauagccauagcacauauauuguauggaaagaaugcaaaggaaaaauuacauagaggaagaacuuuauuuaagggagcaucauaugaauagaagcucuccaggugagcagaauagagucugcuuggaaaagauauuaaauauaaugaaauucaugaacagaaaauguaauaaauggaacuuuauuguuuucaagacauuaaggcuguauucuuggguucccaagacuugaaggaaacacagggcgacauguuaaauugcauuaucucaggcacuuccuaaauauuacuugaauaaaugcaccaacuccucacuucccacugggauuuuuuugugugugaaauauguuuucucaguguauguucagaauagcugagagguccaacacaauagacucucacaaaacauaagcaagagcacuuauucaagguucaguguaugugauuguuucaaagauuugcuucgucguucucaugcuuuucauuguguggagagaauuguaggcaaugcauuuuggaaaccauguucuaaauuuagcuugagaugacuugguggggguagggauacauuuuuccauuguauauacauggauugguuauugcccuucagggccaauuuuuauuuuuaauaucaaauuaacucuuuucugcaauuaguagcuucaaguugcaggcaaguacuggacaauaaaauaaaauuauauuuuuuucuaaauuuaauuucuccacaaauuauguuauagagcuuauucuugaugaagauugagaauagccugucaaauaucauuugcuuaggggucaugguucacauuucaaagcuuccuuugauuggaaguauucauagauagagaacaguuugaagcgaucuggcucuuacaugcuguugcuauugaaagauggguuuaagaacagcaauccuguuuuugugauggcagugcugguucacuaagacuaggcacacacuuaguugguuuguuuagagagguuauguguuguugcugauauucauugugugacugguuucugauaaagccaacuuacuaccaagauccaaaguuaaaacaacuggguuuaaacaggacucacccuagaauuucauauggugacucauugggccuauggguacccucccccugugguuccauaucuggcucuguacagaccucuuggaucccccuuuaagcuucucugcuuuguccacccccuucagaacaugaccucccuggaauugacugccuucaucucuaguuucuucuucuucuuccuugcuugccaggguaagcugagucugcuuguguucuugaccuuguugguuucugucuugcucaucagacccuauauucuuccccgcaucccugaugcacucuuuucugauguaguguaaucccuguugucacaggagaccggaaugcauagguuaucugugagccuuuucauuugauaaaauaccugugaaugugugagaagaaaaagcagaaaaaguaagggcaugaaaugucuaaccauuugaaaaaacauggugagccguggguuuaaucucuacacacugcaaugaaauuuguccucuaaugagaauaucagaaacuaguuuuuuucucaaaagguagaauuauuugcaugugaaauggguguguuuuggaauuggaagagguuuacuuauucauuagaucugaaaaccaaggaggaugugaugaagcuuuccuuuuccgauggugaagaagcuguuucucauuuugcaccaucuaaaggauauccuaccauuggcccagucgcuuuuugucaccauauugccaguggaugcgcuuggcaagacucagcugagaauuuuggcauuuucauuuuuccuucuggcuugauuuuucaucagccugcaauucuggaguucauuuccaugguauauuuggaaaauucaaauuggcaagugauaaacacagaauuucaccaacuaucccuuugaaggcuuucagcaugaucagagaugcaucauguuggcccuuguucuucaggcccaugcucuucugggucagcccauucacuuauuaggucugugaugccccaagaacuuccagaccuugacucuccaguccugugaaugcaaaucauggucacuucuccaagccuggugcucuggaagaggcaggaagaaaugcauggguuggggaucuguuuauagauggguaugcauuuuguggauccugguguuauuucuuacuguucguagguaucacuuacauguuaggcauuuuguggguaauaaaaaauagcaaagcccagggaaauaaaauucauauuaaugacucauauuuuauaacucagccuuaggaugcuugggaauaaucccaccugcuccagcugcuugcuuggggagcugugaggccacaguggggcgugcugcucagggugcuccacagauggacaccugaguuugaauccugagugucccacuuuacuagauggcaacuggagacauguuaucugaaugucuugagccuucguuucuccauuuggaaauggggccuuuuauagcauaggcccaugguaagcacugcaucugcauuuuuuguuacucuccuaagcuuccacagauguccaggcuuaucacagagagcucagcauccugggaucaaaagauaaagugacagugugacaggguuugcacauucugcucaggaucaucucuccaugaaaaugaggaaaagagaugcaggugccuacguaugggaauguuuccauggaauauuauugauaucucccuuugaggauaaaaagagcuguaaaaaggucuucugacuauguucaguucagguuuugcauauguuuuggucuuaaaaaugcaccauguaaaaugauuagagauaacuguauacuggucagcccaaauacuagagaaauaucucuccaaagucucuugaaugaaauaaaguaguuucacugagccaguaguggcuacaccucugacccauuggggaagaguccccacuucugaucucacauccuugggagauauggucugauucagucugcacugggccuguugcuguuauggaaacgauaucaguguguuuuaugugugugggcucaugcaugugcacguguguguaugagggcauuccauaagagggcugagauguagguggagaagagccuacugcauauacacccuaacuguuuggaauuuucaugaggcuaaguacccugaugaccucccucauaagaaugaauuaaucaaacaaaacugguugcagcguagccaugucguaaacuguagagaccauuaccaucaccuucauugccagcaaagaacaugaauccuaaugaaauggauacucaguggaagcauccaguuugggaccaggagcuggaaaaugaaaggaauggguauaagugccaccucucuuagugcccgguaaauggaaucccuucaucugccuuuuaaaggcucaauauaaauggugcucauuucaguuaagaccuauaggugaacuaaggagaauuuggacagccaguuuagaaauuauucuauaauagucaccauauuuuuuauucaaaaauacauguauaccgccuaacauucuuuuuugauuuguggauuuauuuaaaaaguauuacaaagguauaagaauuacaucagauuuaguaauaauacauuuaauaaaucaugcuuauggaaaggaauaaaauuucaugagauugaaucugccccaagacaauaugggauaaaugguacugacagugccugcuccaagcagaacaaagaguacagguugaacgugugagcgaaauagaaagggauuucuuaugaccuuuauucagaugcccagcagugauucccaccccacccccugaauuuucugaguauuugauacugugauucccuucuccuuuuguggacagcacauaguaaaucugaauguguucagaagcuggaugauaggcuaccuaucauccauguggagccuguggaguacaaguccauuagguguaugcagaacaacuucaugccaguucuugggaacuugacaagcagucauccaaauaugaugcuaacaaaaucuagguuucccucuuuuugaggcucaccagcagcucuguaagcuuuauguacuuuuuucaucacagucuagaaggcgaaaaaaucgccagaaaguccagguuaacuaaauagagcacccagucugggaucuccauaacaaaaccgcuggacaagaucccaugcaaaaauucuuuggaaguuuccucgaagaugcuauagcuauuuuuuucuugaaguggacccucugaaaauaucgaucaagucacuuauuuucuagaacuaaaaccaugacuagcuagguggacgaaagagcuuauuugcuagcuuucaaauagaugaaggggagaaggauugaaggcuaauauaaaauuaucuguuuaccuugcaauuuugucuuaaaaaugaguuuuucaggauaaaaauuaccuuaaaaaacuuaugacguuucacauagugucaacaauaauaauacauagucuuccuaccuuauugcugaugguucuaauaacaucuguauuacccuagugaauguguucuuugugaacuugcaugcucucucuucauaaaccucccuaguaggauaacuaccaagcaccagacugugcugucuacccacccuccacuuuaacuuuggauuauaugauacaaccaggauuugcagucauucaaaagaaagaugaucuuacucucauauagauggucuuuuguaauggcuugaaauagugagacccucugucccauucuccaaaaacugccuuuuuccauuuuauaugugggagauuaauuuugagguagucuucuccuccuuuacaaaaacaucucuuagcagugguuccuaaacuguggugugcguaagaauuccuggagugcuugggaaaauauucgugauucugcccccugaaauucugauuggggagagaugcacuuggaccccaggaaucugcauuuaaugagaauuucuaauguaggugauccuuguggaucacacuuaaagaaucuagagcuugaaucccuugauucaaauccuggcucugcuacuuuuuuguuguuguuguuauuucagucaaguugcuuaaccuccuuaugccucaauuuccucauuuguguaaauaguguaauaacaucucacagagcuuuugggagaauuaaauugguuaaucuagacaaagugcuuagaaugcacuggauuaugaacugcuagguuaauuccugaauuauuaauugcugaauuaauucuuaauugcuggauuaauuccuggauuauuaauugcucaauaaauguuagcuagaucaacccaacaaaucacagaugucuugaaauagauuguuucaaucagguuuguauucuguuaaucugucauucauaucagcugaggaauauauaucuuggguuauguugguguguuaggaugggcaaggagucauuuaacuggagcacugcaaugcauugucauugcuuguaggauaagaaccagacuccuuaacuuggucucuaagcaucugcuggucuggucuuacaccauccucccagucauucucacugugauccauucacauuuggcuucuuucagauuuucaaagaugccauguugccuccuagcacacauguguuuuguuugggucacucuuccccucacucucaauuuauuaacuuuuacucuuccuuuagaucauggcuugaugucacuuucucugaaaugcuuuuccugaucucacuaagugauuauuugugcuaagagaacacagaguucauagcucuguuuuuauacuccauaucacaguuaugcuuaauauuuuugccuccucuauuagagucugcagguuguaaggcagaaaccuugucaguuuguuguaucacuagcacaagugccuggcauagauacuugcuaaauauuuguugagaaaauuauuaaauuuugauugaggaagacuuggauggaaugaugguuuuggcauaaacugaggauuuggacagccuucaagaggaugggaaggcaaaggguggguguccccauggcagaggagacuaggcaggacaguuaagaggagauguuccagaaagaugguagagaaaaccugagccauccaccacccugagggugaauguugucugggcagagcugagaaagauugacaguguuggcuuugggugcuguaccugggugagacuuucuuccuacacuuaguggcauaaagagacaaaauggaaagccaggauucauauucuugaagguacaaauccaacaucaagaccaaugggcggccaggcgucguggcucccgccuguaaucccagcacuuugggaggccaagguggauggaucaccugaggucaggaguuugagaccagccuguccaacauggugaaaccccaucuuuaauaaauauacaaaaauuagccaggcaugauggcacaugccuguaaucucagcuacucaggaggcugaggcaggagaaucgcuugaaccugggaggaagagguugcagugagccgagaucacaccauugcacuccagcaagacugucaaaacaaaacaaaacaccagugggcuauagcugagcauuuggaguuggauggauaugggguuuauacugagcuucauuuaggaagaaaggaggcugagggcgacuguugcuguuuagacaguggauguguuguagauggauaguucagcuuggcuucaagaaucagaaacacacaaagagcaggucccagucuccucagaagccucaucugggucauuacgggcugagggucccaggcuugcagagaccuuuaaggaagagaagguucuccuugagguuguuaugaugccaaggcagaugacgauagggcagagaguaauucuuuucucucuaacauaagcccaaaucggugccuucugugacacuuaccauuuuccaucaaucucuguggaacugagggcuuccgcagaccccugagugagauugccaccuuaugagcccccucgagucugaccaggaugugcagccauucacugcucaguggcgaccccugcugcuaaggagagagauggcagcacauucagaguuggugacauuaauucuagucaugcaacccggggaauuuggagcaagcaggggaggagucugaggggaugaaaaugggcugaggaaauccagggagaucccuaguguucagggcgccuugaugaggugcuaaugcagaaaagagcugggccugaacacuccguacuuacaaaaucuuccacaagccgccaguguaaucgcuucauuccaaagguuggcuaggaaccaccgcagugcccucugaggaauaccauugcaaacuuuaacuuuuauuugcggagcucucagggcuguuaggcaacaaauauuuuuaaagauaccccucuaauucucuagguuaaaaguugcaguaauuuuaauuagggguagaggcuguuuauguuuguuuacauccuggguaggaauuagaguauaaauccucccagugggaccccugcugggaugcucuggaaugcuugcauuccugaguaugugagcaccccuggugugcaugccuuguguguacauggcaagguaucgcgaggugguucuaugacauuucuggacaaaaacugugugugaagagaagguaggagaaagcaaacucacaaucaaauaaaaguagagagaggggaagagaugagauugcaguugauuaugggucuggcagcagauguucugcacgaauccaacucgcugcagccagucuguuucuauggcaacagaaucgguaauuauugagcccaggcacucccccacuucucccaacaagguggaggcugaugaauaugaacuaucuccagcccaucaccagcuuuuucuuuuucuucuuguccuuauuuguuuuuuaguucuuuauaagaaaaagugggggauauauugagaaguaccaagacggggagcuauggguuuauugacaaaagagcauaggacacuaaaauagaaacgaaguuauuauuuuucucuugugauacucuaagagaaaagcucuuccuggaaaagccgaugaucucugaagaugcuaaauaaaugagcaggaguuucccugaaauggaggcgcccuuugauuggcugaucuuuccccgacuccugccaaucggagcaucccugggcuccagcuccauaaacauaagcaaagcuacaugcuuauucuucuggacuuggaguguauaccauuuaaaggugugcggcgggucucuguucacauggcucaacuggaaaccuguuucaugaacaagcuuacucaggaaccaucuggugguauuccagcacauuguucuucagggggacgacucuaagucgcuuugugguggcagcagcuuagaaucaguauuugugguugggaaagauggacuuacgggagcuuggugaguaaaccuccgucucacacauguguccaccgguauuaucagccugagcuaaauguagcuuuguccuauugucugccgagaaaacugaauuggaacaagcacauggaggagcgggcauucaaggguucccaugauguaggagacucugaauucaaaagacugcaugcuuugcuugggucugauccgauuuguagcugacuguacauuauacuuggacauugguugucuuguuaggauuaguguaaggagcagaguucugcuuuauuucccuggguguugaugcauuucaagagaaaaugcuuuuaaagcuacauuaauaauaagagucaacccuguguauugcuaggaagagagaaaaaggugcaggcacggagcccggagccgcuugauuguguugcugguguuugcauugugaagagagauguuauuacaauggucugucaaacacuucuucagacccccagccacggaaugaagcaucucuucuccgugugccacuguucucugcuuggaaaauguguaacugagcuaggucauguccuuuccuuuuaugaaaccugucuccaaauugaaauauguuuuuuaauuaauugcaaagauaaagugaagugcaauuggaaagauuuuagcagucaaaaagcaugcuucaaaaugacucuauuuugcauccuuucaaaccccugaaaaaccagagaggguuugcaaaguuauauucaaggauuggcucucugccaggaaagggaugcucugagcuauugcucugcucccugggguuuaauuuucugacacuggugaugaaauuuucaauuucguuggguagaaacaggaagaacaagaaagcaguacuauaaacaggcaauggaggggcagcguggggaacgagaaacucuuugccuguagggacccuucuagcugcaaacuuaaaaauguauguggcaagaugcaacccaagcaccgagcaggauuccagacgaguuauaaucauucugaacggggagaggaaagguaaugccauuggcuuggguugcagagagugggggcugaaguuggggcuucuaucucugccuaagaucuuuuccccugauugucuccugauuuugaggauucaucauguuacuuuuuuuaaaaugugauuuccugucuuaugugccugaaagugucauagcacacuugaugucuucuauuuacaguccacuugacuucaaauaauggagagaggaaaagagaaugaagcaucugguuuaugaagaaaugcacaugaaauagucaaacaagagaaaucuuauugguuguccuuuuuaaaaaauguccuuuugcacaggagaaugcugugggucuucacguggcucuagaauagaauuuacuuuauccuaaaugggaccugugaugaaugguuacagaaacagaagagcuagaaagcuuucgccuauagaagacucaaggcagggugagggcgacugggugucugggagagaccuucuacucugucuauuaaagaaguagggcugacguugcaggagagggagaauuuccuaacugcgggugacaaugcaucagggacaccuggucacuugacaaggucagugaccuguuuguuagcugaaugccuuucuggagauguaggcugcucucugaucccaugaggcuccagauggcuggauacauugagaauucugccugacuggaagagcuugugugcauguuaacucugccugcugcaccacacuccucaguacaccucgaugcucgauuuugaggaagucugguuucuagaggaugugcauuaagugacagucagcucguuagagucaauguccauuucgccuuggccucuucucucccccacuagugucacuuuacaugagcgaagugcuggcaccuguugguaagaaugagagaagaaaccagcuuuuuauggaagcaguaaaaaauguuuacaaaaaaaaaaaaaaaaucuaaaacaguaguucuuaagcuauuauuggaucauggaacucuuuaagaaugugaaagcuaugaaccuccucucugcuccccccaccuaaaaacgcauucaugcacaaacacauaacacuuugauaaucaggcauuuuaggguaaagcaagaucccuguccugggggaauagccaagaacguaucauacccugaaguucauugucuccuucuuuucagauggguccgcuaaaugcugcagccccaucucaaucuguccugagcauuuacugugugccaggcacugcucaauacauuuuauauguagauauaauaauucauugaaucuuccagcagcccuaaugggacuaaguuuuuuugccuguuuuagaugaggaaauuuagucgccaaaauauuaaggaccuugccgguguuuauccagcuaggaacugacaaguguuugguguuucaugcaugucgauguacuuguugcugcauucauauguggaaggagagugaguauauaggggaagaugguuucaucagccugucagucugucaaguggagucagaccacagguaguugaauuaaacaaucaccacaauaauuaaagucaaauugaaaaggcauuuuggggugguugggugaauuauuaauaacgccauuugggaaguuugagcuaaguaaaaagcccaucacaaaaugccccauugguugccccuuuauguuacugugugaugcaccaucucauuccuguagcauuuauuugccugguaugauuugggucaauuuaccuaggagaccaguuccuucugggccaucugggagaggugacaggucaccagugucccauggcugcccuuugcuuacauuugccaggaaugauuugcaguggccaaagcaauggcgagggugaugaacaacuaggaacaaccaggcagccaguuuggggguucccaugaacugcaauggcuguaggaaucaccaggacuaccaugcuuucucaagaccuugugagcaggggaggcgggcccagcucagaaauagaaacuguguucgucagaguuugagggaggauugauggcugcuagggcaauguggagcuggaugggugugugaauccuccacuccugguucagccacugcaucuccccuucuaucuguuuuauaaauggauucacaaugaagauguaacaauaaaaaagagaaagaagggguuaggcugcuagaaggaagaauaaaagcuauucaucuuaucuagaugucuuaucugacauaaaaaaauaagcaagauugcaaugcuaaguggaaaggaaucuguaggggucaugguaacagguuuuuaaacauggguucuuggcuaugcuugccuaguauuaugcacuuucuaguauuauacgagguauguaaauguguagaagacauuuuaacaagacuacaaaaaauguacuacagggacaauauagcagaucucauuuuacauugaugcuguccaauggaaauaugaugcaaguuaaguaugugauuuuaauuuuucuaguaguucaccugaaaaaaguaaaaagaaacaggccaguuaauuuuaaugauauguauuauuuuaccugcuaugucuaaguuauuauuucaacauguaucuacaaaacuauuaacaaaauauuuacauugaauuuuucauguuaagucuuugaaauaugacauguguuuuacauuuacaacacaacucaauuuggauacuggauuuucacaggaaaucuguauuuagaucucauaaaauucauaguuaaaaaaguagauucaugugcacaaguuguuccaaacauacaucaaaguuuuccaauaaauaacugaauugaguauugguuuuuaaauuuaaaugagcuaaaauuaaauaaaauuuacaauucagcugcacagucacacucaccacacucacucaccaaggcuucccuagccaccguguuuaguggcuacucuacuggaugguguggcacuaggaucucagaacauuccuugcacacuaggccaguaacuucucucacuccaucaucauaccacagcaccuuuaucucuuuuaccuccacaagguaccuggaccaccugcucugguaacagagaaacagaauguuaguauucacaaacauguuaacuuuuacuuucaccguugcucauggugaacucaagauggacagcuaaaucuuaguuucuccauuacacuguuuggcaagggggaauuaaaacaguaugcuguuuccucuugcagaaagucggcacucauccaucuguggcauuucuuucuucauccuuacuuaucuuggcccugcuauuuacugugcucucuggccccucucucaacucaguauggaacguggguuuaauuuuaauuauaaacaaaccauaacugagaagguaacucuguuacaagcagauaauucuucaugaagacaaguauaaauucaggcuaaggagugauuuaauugcuaucaucuuauucaauucuacaaauuuuguuuagcgagaaaauauugacuaaauaguucuuucaguuaauuuggucuucaaauccgugccuucaauaccagauauuauccuauaucuucacuccccaaaagauuuauuuuaauguaaaacucaccaugaaaaaguaaucagucucuucaauaacuagaucaaaaccauccugcaaagccuuccuagaggcaucuagucuuagucuccuaaugauguccccaguugaugauuucacccaaaucaaacgggugaaaugagugagcuuuggaaaaguuuaagaggacugagcuuagagugagcuuuggccuccauuugccaaagcucacucuaagcucaguccucuuaaacuuucccuuagcucuauuaagaauucugcaaaacaguaagaaaaaaaaaauccaugugauuaaauaccaucuuuccuaucaggaaugccuucugacccagugguccccauuuccugcauuuuggacagaauucccaagaaugccuugugaauguugguuggaguaaauuguguggguccuuuacaacuucuuucuuuugauaauauuacuuaacauuuuguagugaagcaacacugguggaacaaauagauuaaaccauaggcaggguuggaucucagagcaagaugaauugcuuuguguaucugcugauuuucagccaagccaaggccuaauacucucagucaugaauggaaauuagugauuugggauuucagugagugcagagaugcugggaaauagcugaacaucacauacguaaaauuaucauuacaauaaguaucuuuggauuaccacaggauuuggaagucuacuaauuugcuagcucauuucaagcaaucuaugauauucuagaaauacaggacuagaaaauuauucauaugaugaugagcaguaaucuagaauccaaugcuuuaaagugugguuucuagcuuagcaucuaaguuuugcaaguuauuuaaccuuugugcuucucagcaacuuuacauggguaaacugaaguuuagacuuggugacuuccuaugucauauaugcgucaaacuucugaacuaucuauccgucugucuucuggcgcccauguuccauugaaaauaacggucuuuccagguguauccagaucgagcuucagaauccuucuuaacacagcacuaagucaaccgcuagugagauaucagaauugucuuacagcugaaacugauuuuucaucccucucuuauguccuugccucagcucagugccuugugcaagacuuugaaaagaagcauacagggaauuaucaucaguaugcaggguuuuggugauaaggcagacagcucuuuacucauccucuugcucagcuguuccguggagguguugccaucugacaaggagggcugcagccuugcgcuuugggagcuaacuucucuuuuccuuugagcuguaagugaugagagaccugucaaggagagcuguucacuggcaucauucccagaccuggaaguauaaugaaauaaaguuucuuuccaacuugguuggaauucuugcagcugaauauuuaagauagcaucuggggcaguucugacguccacuugccugguuggaaagaaacacccaugagcuaauggaacucaggccuucacacugguagcccaagucagggcugcucugggcaacucaguucuaacuagagucaucuaggccacaggucccagcaggugagauggagcccccuccuugccuaaugagccagcaauuugaaguccgcauuucagaaacuuugucauauacaaagagggauaucaaagcaggagcugguuugaaaaccaccaacauuggcacugucccuagaccuagacuacuuaaugcuaaagguuccagggcacucuuucuaguaccaugaggguaguagcagagccacaccuuuuagcuuuagagauugaugggggacaagggaugacagccgcguccuagauucccugagccagcgucaaauaucugggcaaaguaggcguaagaagcuuugcaaagaccaccuuaugagccaugcuucuguccccucuaaaauuuucugagaacuggguagagggacuccuuaaucucugugaaccuuagcuuccucaucuguagaaagggaagaagguacauuucccaugaggcuguuaacaaaugaaaauauaaaugauguaugugugagugauuaguaaauuauaauauguaugggaggggaaaauagucugauuccaucccuuggguagaagccauuuauuuuucaugucucacagaaugucuaguucugcucuuuugccauggaaguuucucucuacuuucagauuauucuccuaaauaauccucaggcacuaccccaacccucuagcauuaaaggccacccagagagaaaggcacuacacuuacaagccagggccugggucaaguuucagcauagccaccaaguaagauuuagguuucgccauguugccccuucaaucuuuaguauuuuuucuccuggauaaaaauauagaucuuauugacucuaccugguacauagaaauguuuagagagcacauuuauuaauauaucccauguacucuguggauuguaaaauaagggcuuacuauuaugcuucaaaucuaauaucuccuaacaacucauccuuguuuauugaggaggaauaauuggaaaccuauuucuaggguagcaaaagcuccagaauguggagcuacagugauguguauguaguuuccugguuuuggaagccagucaacaucaaaugauauugugcuucuagggagaugccuggcggcauucaagaaggcugugaccugccauaaauaaucgguggcuuuuacauuuguaagucaagauguucuuggucucagcagauggcccauaaaucuuucuggauagcugagcuuuagccauccuaccccaacucuuucuucuucuugaaggcauaaugaaagcuuugagaaacauguacauuuuugguucuuucacaugcagguucccagccacuucuugaugacuuucuucuccacacccccugcacucccgccggccaugcacuucauacccaugauguauucugucaagagaggagaaggggugauuucuuucucugucacaucuggacaucuauuuacugugaacuuauagcauccuagaucuugaaguaaccugaguccuaggaugucagauagauuucaucuggugacaacuuagguccccugguguggcuuccuggggcucuaccucugggcuccaugagccaacagggagugaggggaggguaguagcaugcaguuaccuuauuacagguaaagaaagugagguucagaaacauucauugacuugcuaauauccacuguuaacaagagacaaaguucacauuuucuugcucaauuuauucaacaaucaauguuugcugaaugccaacccuguaucagguacuguucuaggccuugggauucccagcugugaguauauauggauuaaccugcauggagauuuauuuuucaggcaaucauuagccucagaguuggaauuccccagaauauggaagcuacaauaagaaaaaaauucaacaaaccacauuuauuuauguauucacuaagucaucuguguauucaccuaugcauucauuuccaugccuguuuaccugacgaaaauuuauccacuuucaaaaacugggcccuuguaagaguuguuugaaaacuacuugaaaguaaucggugaaaacaaauuguccaacagcuaucuuugccuuccgcccuccuuccccucuaaacaccuaagagaaacugaacuguaaaaacaaauucaagagguguagcuauccuaguuucacaaagcaaccuccaaggagaaaccugggcggaccaaauuuuuucuacuuuaucaaaaguuucugaacuguuagaaccguuaaggagaaagaauuugcaacuaaagugaucuagaacuguugcaauuccaugugacuuggguagaaguauaaauggcaauggauaugaaagucucuuauccccaaauuugaacacuguagguaaauauacaauaauccuauccacuguguguggugaucugucucugucuacaacucugacuccccauuacuugcuucaaggccagaccaaugucagaaacacuugcacugaugguuuuaagagcuguacucucugugugccaggcauuuugcauauuccuuuaaugggauuucuuaaaccuuuuuaaaaauuuucaguguagugaucauuuuaaaauuaccacauggcaugcucugucaagcaacaaguuuuauggaagaguacauccuccuaugcucaaaggauagagggccagacucagggagacuccaauucucagucucuguccuuuuccuaacaguuucaguagcgugcuaaaagcaguguuaaaaggcauuuuauccccuuuuauagauaaggaaacagacacaaagagaguuagcuuauuauccgguuaguaaguggcagagugaaguucaaauccaagugugucuugauucccaagcccacguuuuuacugaggucaggugccuccauuucaacaccaacuguagguagaucuauagcuaauacacuggaaaaguaaucuucaaccugggugcucauucuccugaauggugugaagacuuuucaagggaaaggaaggcauggauaauuagccuuacaauaauccauuuucagauucucagcuuccacacguacauuaaaacugaucaucuugcaacugcaccuguggcuuucacaccaacuuuucccaaccacuguucucccucuugauaaaagaaaggccccugcucaccuccaucaggucuuacuaugauguguugcucaaaguauauaaaccuucucugagagccaaacaaaaggacuugugacuuaucuuuuaaauaaggaaccauaagugggucccugucacguuaagagaugcguucccaaugggauacuucucuuggguuuggaaauuauguaucaaaauuuguaauaaagucucguuuuaauuaguuuauacuaauaauaauuaugcuguuaagcucaaucgagaagaaaaguuuuauuagcaccuucuguucacaggaaguauuuuuuaaguuagauuucaguguguauguacguguuuuuguuucagagaaguaugauaggaugauaauaaaagacuuuuaagcauaaaauuccauuaugauaaaauucuguaugaguagaauugagguagaguggggaaaaugggaaguaaaaugggaguuuugguucuaggucaggcauuaguggaugauggccugugggccaaauauggcccacucccuggacuuguaaauacauuuuauugggacacaucugugcccauuuuucuguguagugucuguggcuuccuucauacuacaguggcacaguuaaguagcugugacagagacuaccuagaaagccuaaaauauuuaguauuucggcuuuuacauaaauccuauugaccccuauucaaggaggaaaauauugauaacaauuuccaacuauucgagaagagauuauucguguauuuuugagucauauggaucucaaaucacuauuguauguacauucaacuauauauugaaaagaugacauacaauuuuaucuuuuuuuuuuuuuuuuuucaggcaagugucacucuguugcccaggcuggagugcagggguacgaucucggcucacugcaaccucugccuccuggguucaagcaauucuccugccuuagccucccaaguagcugggauuacaggcaugcaccaccacgcccggcuaauuuuucuauuuuuaguagagacgcgguuucaccauguuggucagguugcucuugaacuccuaaccucaggugauccacccgccucggccucccaaagugcugggauuauagacaugagccauggcucccagccaguuuuaucuuuuaaaugucaauauuguaguacacugaaaauuauauucuuugaaacuauuucaacuuugaugaaaauuuucuguuuuguuuuauuuuugagacuugcucugucacccaggcugcagugcaguggugcgaucucagcucacugcaaccuccgccucccagguucaagcaauucuccugucucaaccacccaaguagcugggauuacaggcaugugucaccaugccuggcuaauauuuguauuuuuuuaauagagacaggguuucaccauguugcccaggcuggccucgaacuccugacgucaagugaucugccuaccuuggccucccaaagugcugggauuacagguguuagccaccaugccuggccugaugaaaaauuucaucuguugacuuaaaaaugucugagcgauacauauaguuuuuaaaauagggaguggggaaaucacugcuguguccggaauugguggguucuuggucuuacugacuucaagaaugaagccguggaccuucgcagugagugucacaucucuuaagguggcgcgucuggaguuuguuccuucugauguucagauguguucagaguuucuuccuucugguggguucauggucucgcuggcucaggagugaaguugcagacguucgcagugaguguuacagcucuuaagguggcgcuucuggaguuguucauucuucccggugggcucauggucucgcuggcuucaggagugaagcugcagaccuucgcggugaguguuacagcucauaaaagcaguguggaccuaaagagugagcaguagcaagacuuauugcaaagagcgaaagaacaaagcuuccccaguguggaaggggacccgagcggguugccacugcuggcucgggcagccugcuuuuauucucuuaucuggccccacccauguccugcugauugguagagccgaguggucuguuuugacagggcgcugauuggugcguuuacaaucccugagcuagauacaaagguccuccaccuccccaccagauuagcuagauacagaguguggacacaaagguucuccaaggccccaccagaguagcuagauacagagugucgauuggugcauucacaaacccugagcuagacacagggugcugauuggugugcuuacaaaccuugagcuagauacagagugccgauugguguauuuacaaucccugagcuagacauaaagguucuccacauccccaccacagcagcuagauacagagugucgauuggugcacucacaaaccuugagcuaaacacagggugcugauugguguauuuaccaucccugagcuagacauaaagguucuccacauccccaccagacucaggagcccagcuggcuucacccaguggauaccacaccggggcugcagguggagcugccugccaguccugcgcugugcgcccacacuccucagcccuuggguggucgaugggacugggcgcaguggaacagggggcggcgcucaucagggaggcuccagacgcacaggagcccacggagugggggggaggcucaggcauggcgggcugcaggucccgagcccugccccgcgggaaggcagcuaaggcccagugagaaauugagcucagcgccggugggcuggcacugcugggggacccaguacacccucugcagccgcuggcccgggugcuaagccccucauugcucggcaacggcagggccggcugcuccgagugcgggccgccaagaccacgcccaucuggaacuccagcuggcucgcaagcgccgcgcgcagccccgguucccgcucgcgccucucccuccacaccucccugcaagccgagggagcugucuccggccuuggccagcccagaaacgggcucccacacugcagcggugggcugaagggcuucucaagugccgccaaagugggagcccaggcagaggagucaccgagagcgagcgagggcugugaggacugccagcacgcugucaccucucacugccuuagaagacaggaucaugaauguggcuuccauaguucaagaccauccuaaugauggacuggaacuuguuuccuucucauggagcaaauugaggccuaugugggcaucucagcccucacucagucuauugcucugcaacuuagaugguagcugauagagacauagggcccuaaugggacauuguuaaaacacagucuccuaaaugucaggccucaguuauauagaucagaaaaauuuucccuguacuggcacuacugauuagccagcuaggggagaaaaagaacagcagucucgcuccaggaggcagaaggcuggccuuuauccugauguaccuguaggauggaugggagccugcaccaugcucuggcuucacggauuggguuguaccacucaaguggacauuuaagccugcuuagaaaccuugaugcauguuauaguuugaaauauguccuccucaaaaauauauaccagaguccuggccuggcauggguggcuuacgccuguaaucccagcacuuugggaggccgagguagguagaucaccugaggucaguaguucgagaccagccuggucaacauggcaaaaccucgucuccacuaaaaauacaaaaauuagcugggugugguggugggcgccuguaaucccagcugcucaggaggcugaggcaggagaaucgcuugaaacugggagguagaaguugcagugagccgagaucgcgccauuguacuccauccagccuaggcaacaagaaugaaacucuguuucaaaaaacuauagauauagauauaguuauauagauauauagauugaaguccuaaccuccgaaaguucccuuauuuggagauagggucuuacagagguaaucaaguuaaaaugaggacaucagauggacccuaauccagugugacuaguguccuuauaaaaagggaacacuggaugcagagacagacaugcauagaaggaagaugauguaaagagacacagggaggagacagucaucuacaggccaaggagaaaggccuggaacagagccccuuacagccuucaagaggaaccgacccugcugaugcagacuuccagccuccagaacugugagacaaugaauuucuguuguuuaaaccacccagugugccauacuucgucauggcaguccuagcaaacugauagagugcacucaaaagcacagauucuuuucauggacuuuccaaagcccagggacuucuguuucuucuagcuguguuuugaaauugcgacauggcaugggucaucaggauacgaguuguuaucuccuucccguaagagcaauuaaggucaaagacugaagccagagcucuuggguuuaagucccauuagcugugugaccucuggcccuaauggugucucuuguaaaauagaauaauaauaccugcuucuuagauuacuuggaggaccaagugaauuaauaacauguaaaacucuuggugcucggcacauaauaagugcucgacaaugaaacguucauugccauuguuggggggccagaaagcaaccacugccugagagcaccccagacccaugaaucacacagcaagaaagaaagcccgcaugguccccuggaauucuagaaguuuuauuugugaaauuaccuuacaaauguuagagagguuuaaaaaaaaucucugcuugucuuuucucuuguuuuauccugucuuauucuuggaaaaguuaauauuugagaauagcuagcauguccuauuaaucccuuuuuuagaaaaggacccgcuccgacaccaguuggcaguuagguuucaucagucacucgagauuauggauuaacucacugaucuuuuuacccuuugagcuaauuagccucuggacaaauaccgcuagucacagaggccaagcacagcugaccaaacacauuucaaagaguaaauuuagugaguaaauaacgccaggcuuagaucucuugguaauacugcuuuucugaaucaguggaaucuggaugaucuuuccuucccagggagagauggaaguguaauguuuacaacccuucaaaccaacagaaaaaaauguaacgaauuaagucagcuacuuccucccuugacuccuccuguucccccauuuaaaaugauuucuuuucuuaugucuucaaauaacaagcucaguuugacuuuaaaugacuuaaguguauccuuugggaugguuguuuaauagaccucuuucaaagggaggcuucccuguaugcccagcugaaacauaauuuuucucaauuuaauuuaauuaucaccaccugccaaaacuuucucucgccuccacaaagcaccuugaacaguucaugccucaccuuggugguaaggccuguuaaguacuuguagauaauuauccucuuaauguuuggugaaacucaguguuucuagaccuuucguucuuugcuaaagaagacuucuccagguaguccuuuccaagcucccuucaaguuguaaugauucauacacacaacuucaccagugaggccuccauaccuggguuuccacaguugcagggagaacaucucccaagggugggcccaucuccuuggcaauggcagugaggauggugugucauucugauguccagcucugucagguaccagguagcuggaauggcaaggcuccuggccucuccccucaugucucccucaugugagcagccuuauccugugcgucgauguucuucugaaugccauguuuuuuccuaaucccacucuggagaaucaggaguuucagacugaguggccagcucugacauugcacaaccacauaccuaaguaacucagguuuuguguuuuguucuugcauugaggaaaagagaagacaggaagcuauugugcucuuauuucagaagagugguaaaaguguggucauuuugucacuugucaccaguauucagugauucaacaaaaccuuuaucaaguguauacuacaugccuaguaaugugccagggacauggaaggaauucaaaaagaauacaauccagcuuuugcucucagggaucuuagaaaacagugaaaagcuuauaagauuguaagcaacauuagcuaguuaaccacagagugggaagccuccaguggacuaaguugcaguccacuguuuuguggcuaccacauuuagaaaaagcacacuccacacuggcaugguuuucccaaccagguuaucaugucugcugcucagcugcaucuggauaaauuguguaauaugauuuuauuguauagaaugccgugcauguguguguauuggacagaggaagauuaccaagaaauaauucauggaacaaagaagguauuaggacagcauucagcauaugauccuuggugugcguguguguguguguguguguguguguguguguguguguguuaaguguaugaauguauuuguguguguguuuguguguguguuuacauauauaaggagagccugaaaaaugaauacaaugcuaucaagaguggauaaugauggagaaugagacuggagaauccagaagaagaguuuuauuuuuaguauaguauucuuuaguacauauuuuuacuaucgguauaguuugacuuuuauaauaauuuuauuuaaccaucaaaguaaauucuugaaaaauagaaaucuuguuaaaauauuaauaaaaauaaaaccccuuacaauaauaugaacaacagggaagcgacuaaagggguucauaaagggaauguuuuacucuugacuuuaauuauuaaagaaauaugauuuauuuagaguuuguuuuggaaauauuuaaagcagugauuuucauccuuuacuagauguagccaccuuuugagucuuuuaaaaauuaagacccagccccaggaucaucccagacuuucuaagccagaauuucaagugaggcuuaagcaaguguguuuuuaaacagcacacacaccuccuaccccacacccccaccacauacuacacacauauaccaccaccagcagcuuccucaaucaauucugaugugcaccaacuuaaggcauaaaacuagggaagugaugcaaguggggggaagcaauuguggcuguaaacauacugaguuaaacuuccugugaaaugacacagaucuuaaauuggguugaaaaacaauauacaauaucaugaauauugaauucaccacauaucauuaucacccaaauaugagaaaaagcuagaaaugcaagaagaaaugaauaaaaauauagcuggacugacauucauuacacuauuacucuaguauguuaaaauauaaucuauagaauacuucaauaauauaauuaaugugucaacuaauagguacauauugaauugauaccuuuaaauauagcugugauggcaugucuuuacaugguaacuguauuauguuaaaauauaauauauagaauacuuuaauaauauaauuaacaugucaacuacuagguagguacauacugaauugauacccuccacugagaguaugccuuauuuuucaguauccaugcaacuuuuucaaaaaugcaucacuuacauggcuaaagauccucaauaaauucucaaaggcuuuuaaauaaccacugaaccaaagaggaaaucuaaacuacuacuaaagauuacaaaaaugaugacagugagaacaucacaugccaaaacuuaugggauauagccaaagcugcccucaaauaguauauuuguagccccaaaauuauuuuuuuuaauuauuuauauagaaagaaugaaaacaagugaacucaggauauaacucauuuuagaaaauaacaacaaaagcacccaaagaauacaaaaggaaagauaaugcaaggcaauaaacuagaaaauaaaagaaauaauagaaucaauaaaugaaucuaagaacuauuucuguuaaggcaauuauuuaauagaaauaauugacaauugacauugacaaucuaucaaauaaaauguagagaaaauguaagaauuaacaaaauuuaauugaaaaugacauagagacauagagcugauuaaaauauuauuaaugaauuuaauggguggcaauaugccagugugcuuuacaaagcucaauuaguacacccagacacgcaugccugcacaaacaaaauaacuaugggcuaucugugaauaauauauuugggauaaaauauauacauugcucauaaagcaaagugucauacuuugccaguugaaguauagauuaguacagucuuucugaaaauggcaauauauauuaagaacuuaaaauuuucugugauauuuauccuucuauuccaagucaaagacuuuauccuaagaaaaucagaagugcagaauaaauauucuuugauauuuuaagagagacuuuaggaagacucaugucauuggagugagcugaugauauuaaugguuguggggagaaauaaaaccaauagaaugauuucaucuagaaaaaaaagcauggaauuauaaacuuaaaaauaauucuggaagacucugcaccacaauguuaacacucauuauugcaguguaaggauuacaagugauuuuuaacuucuuccuuuuauuuuuauauuucuuucuaauauuacucaauuggaagguaauauuucuauaauuagauaauaaacuuacuaaaacaaaaauuuaauauaaacauaauggaaggguuauaauaacaggcaaagcacauacaaaaaucaugccugcauaauauauugagacugaggaugccaccaaauccugauguucccugguuaguuuguuuacuuuccauuucccugaaaggggcaugaaugagagguggagggagaagauauuagcuagguugcauucucuuuccaaagccugaauucuuuuuuauuucguguuuccaucacugggucuuuuaucauuaaucucuaagaugucagcuguucaucaccaggugccugaaucccuaccagaaacuccuauugguguuaccuauccagggacacggauuucucuugcucuuuccuuucucuguccuuucucucccugaaucugagcugcuuucuggaaguggucagcagcacccucccuuugccagaagugcaaaguuuggccaacacucccccuaguggcaauuuaacagacuccugaacugaccaacccaaaagccaaggacgagcacugaugccacgcuggguuagcuggggcacuuguuaauuaaagacauaucacugggcccuaccucaggaguguggcccagaaauagguauucuuuuuuaacaagcaucucaagcauggguuuuugucccauuuguacccuuccuuugucauuuuuauggaauacauagugauugggauucaguuuuuuauagaaacuugauuccaauuuuuaguacugaaugugaaaaaaaacauucaagcuucaaaucgauuggccuagagcauguauuucuuauauuuuagagaagaggcaauaggauaagagagaagcucuuguaaacuaaauauacauuucuaaaaagaauagagaccagaggcguuuguuauaauguccuccagugaacacuugugaaaagacuagcugcuacuuuauucuaccugcagcuaugucaguguauaaauuacaaccaagcacguuauaccuuggcacuguugcuuucuuauucuccaugucuauuucuaaacauccccuauacgugaaauuuguucuccaguggccagcgagccagccucuuuggagcagccugcugauuuaaucaacaugcugcuuaucauguuuuccagaugguuaaugcaucucuuaaauaaaacuggcccuaauuugaacugguguuucuauucugguccuuucugaagaacaauuugucuuauggucaaaguuucuuuuucauuauuucucuguaggcucuggugaugucuuuuuaccacuucuuuguuuaaaacugccaaguggcacauucauucaauucauugaugcuaaucauacauggaggaaaaagaagacaguucauauuaauaucaacacauuccucaaaucauuuaucacuuacacguaaaguuguagagaacagauuugucagaauuauugauugagaaaggaaagagcccuuuguuguggaaccguagauugguguuuucucuucauugcugcuucugcuucgagaaggaguauaaccuugucacgugaaacagcauuauuuggggagcaguagauacaggccaaguuuuuaggagucucaguuaaaaacccguggucuuaauauucaguguuacacaaaggauuccaaauauaaauaaccuucacgcugacccauagauucaggucugauucccauuucacaaaugggaauacggccaagguauacaguuaggucauauaaaagugacauuaaacucauauuggcagaauuccauuguggugugacuucugcaauaaugaauggcugaaaguaggcaagauaauguaagacuugaaugggguugcauucugaaaggaaggcagccagagguccucagaauuaaauggaggaccugcaguaaaaauauggcucuauuacaccaagcauuuuccucuuuuccuuuccauugccugucugagaugauuuggcagaguuuaaaaauaaaugaaguauauucauuuuuccuucagaguuuuucuuugaaggcauuugguaaggggacaaaaugaaauaugaacacaggcaggaugggggaucaagacaucaaaauguuagcauuauauccaacauauauauccuuaugugaggagguaugcuugcuuccaauuaagaugacaucauacaggcggaugugaugcuuccaagcaguguuaaugaucugcuagguaaugcagaggaaaugauguguuuggaauggguuuuuuuuucccauuuguaccuuuccacuucuuuauggacugcaacauguaaugauugggauuagguuuuuuauagaaacuugauuucaauuuucaguacugauuagagacaggauucuuuugcaggcauaucaguuauguugaucauugcuuuucacauuuuauuguagcugccaaauccuuauuauaaacagaguagaacccuacauauaaaacccacaaaagggcaacucugagggaaaccagguugagcaucucggcaauuccccuuacugagccauuuucuccagugccucccucucuucucccauagcugaguccgaaaacaaucuucugggagaaaggauaagguuucuucuguauaaccuaggggaaaagugccuuuaauuauucauucauucucugcuggaacaaauauuuauucggugccuaugauaagccaggcccucccucuucuagacacugggcugcaguagugaggaggaaagacaaggggacuguccucagggaggcagcgggggaggcagccaggccaccccagccaugaugccaugaauacauuaagaauggggagaaacggaucuuagggagagaacucauggggaaaggaugguuggguaaggccuguggaagaaaccaggaugcugaggaagaguggccacaucaagugcuugggaaaaaguguuucaggccaggaaagcuccugaaaucccagagacagagguauucaaggaaugggaagauggccagagcccauccuggaugggggaugcggggggugauaguggccaagaggucagagggaagcaaggccaguuggagaacuuguacuaggcugugauggaaacucaguauuuuucauuuuaaguuugcuuuuaaccuugguuuaauuguuuauuauuaaacaucuuaugacuaagcuguuuauauuuguauuccuucgacuuccaaaauggcuuugugguaacucacguaugcguuguguaugcgcagguucauuugguucauaaaagcucuagaccauguggaggaggaaggaaguagguuaacuguaggguauuguagugggauugagaauuuuaaaagccagaguagaaaaaacaaaaaaagaaaagaaugccuuacauaauucuaauuaguuaaaaaaaggaaggcccuucauucuuaaggaaagaaacaucuacuacuaaauucuaaaccuaauguacagacuuaaguuuccaaauuacaaugguuccacuuaagauuuucaacuuuaugaugaugugagagcgacacacauucaguggaaaccauacuuugaguacucauacaaccauucugguuuuuacuuucaguauaguauuuaauaaauuacaugaaauacuuaacccuuuauuauaaaauauacuuuacguuagaugauuuugcuuaccuguaggcuaauguagguguucugagcauguuuaagguaggcuaugcuaagcuaugauguucagcauuacgugaauuuucaacuuaaaauauuuuccacuuacgaugggauuauugggacauaaucucauuauaagucaaggaauauuuguauuucacugagucauauacaauaauucaucaacaauucucuuuaugaauauuaaaugccaaauauacaaaaacuauuggcacucuagggagugcaagccuuaaucagacauaaauucugccuuccuggaucuuucaauuuaauaggauauauaaagaaccuacacaaauaacuguacuacaagacagcagauacaaauauuaguuuucaugggaucuaaagguagguuaucuaauugcuuucugucaauuucagauaucacauuaaagcaugacucugggacaguuccaggugaggggaaagaguuaaaguaaccagucagguuuauagcuuuucuguaaucaaggacuuaacacacaguacccaggggcagggcagaagggcagguuauuuaagauguccuucaaaguugacucucucaggagucugggacacagguguucugcauaacuaacugaagacacauuggguauagacauauaggugacaaaucaacacuguuacgaaauuucaguggugcuuuuuguuccuauuaagacauauguuuuauauagaacuaauucaaucuuacaggugaaaaucagagaaacuaggcauccuaaaaggaaaaaugccucuaauccauccacccgaagaaaaacugcagguauuuugguauuuaucucuuagacauuuuucuguguuugugugaggggaguaucacacuaucccaacuuuucuguggucccuuuuccucacuucuuuucacaucaagacaugcaguucaaagaugccuuuauuuauuuauuuuuuuauuuauuuauuuauuuauuuauuugagauggagucuugcacugucaccaggcuggagugcaguggcgcaaucucggcucacugcaaccucuuccucccagguucaagugauucuccugccucagucuccugaauagcuaggaguacaggcgcacggcaccacgcccagcuaauuuuuguauuuuuaguagagacaggguuucacuguguuggccaggauggucucgaugaccucgugaucugcccaccucggccucccaaagugcugggauuacaggcgugagccaccacgcccagcucaaagaugccauuacuaauuacuacaugacacucaaguguaacucuaucaggauuuauuuaaccagucuucuagaguugacacauagguuguucucaguuguacgcuauuagaaauaauacugcgugaacauucuuuaaaauacaucuuuucucacuuuuccaauuuucucacuuuuccaauuuuccguaauacuuuuccaauuuucuuuaauacuuuucuaauaguggggagaacagugauuugugauucuaugucucacugagucacacacauacccaaagcuuuuauuuaagaucuuuguuuauugaugcuaacugcagacaaugcuaagcuuuccuuuuugcagaaggaaggaggacuucaaagcaccuaaggagcucaugaauuuuagauuuccuuuguugugcuuuucuucccacccccaccccacccccguuaauucccuuagaugcauaacucaagccagagcuuggaaggagcuuucaccuccuucuguuuacucaacaccuaccacauccaauuagucaccaaacucuacauucuuccuccugaaaaaugcccugacucucaugcuuaccuucuucccacaucauucaucuuucccugguauuuuucuguagugacccagggucacuacaggaacuucuucagugcucuccgcuucuuggguuuggcucccacgcuaacccaucuuccauacuucauuuucaugucaaucucaugaugcauuccccugccucaaaguuuuuaaucgguccaaauuguuuucuagauacacuucaaacuccucagcuggacauacuggccuuuguuucuggaucaagucaccuaggcugaggccugagaaucaguauucuuuaaacuuccccugugauuucaguucaagcagcuuggcucuucaggggcccccaaaaugggcacuguggaaauacuggucugcuuggaaccaacacuaggucaccaggccaguuagagcuggaaacuucccuaagcuacagccaaaaauuuucuaguacagugugguuauuuuaggaauaauuuaaagagcauuucaccaaagagcagcauuuuugcaaguauagauuaaaagaucauuuccauuuaggaagccuaauuuaauuaagucacacaauuuuugagguaugaaggcuuuucuugcugagucaggauuuuuugcuucucugcuaaugcaaagcagguaguugaaacugaagauuugcucugggacaauacuauuuacaugccuggccacauuaaaggucaggguagaaaguacuguucugugggacagaggggcaagaggguauuuuguuucaaucuuauuagagcacuauguuaaacuguuuuuuucaaguagaauguuuaaauuuuagguucuuuaugaaaaaaugcuuaaaagcuauuuaaugauuuguguuucuuauaggcaagguauucauaaauaucaaaccauuaagaaaaagaaaaagauuuuugagcaguuagauguuuccauucaauuaauggugagguuuucagaaaaaguacuuuugugaaacugaaaaggauauugcaauaauagcauuuuauuuucuauuuuaucuuucacucaucuuaaaguaguuugauggauuaaaacucuguaauuuucauaccauguaaugugagcuccuaguauggcuacuaauauuguuaauaucacuucugaaaaauagagagauuagcuuuuaaaacagcuuugguugcuuuucuuucucuuuuuuccucuaguuuguaauuaccacaaagacugucucugucuuauucauacuguguccccgugcgugggugauggcaggcccaggguacacaucuucugagcuaaugccugcaugaugaagaauggaauuuuguauaacaggccucucugagaagguauaugggaaggagaaauuugauccuugaccuagaggaagcuuauaguaguggaaaauacuuuuuccuagccugucugaguuuucaaaguauugugcuauugauauggcaucaaugacuggaggaacugcagggugcuuggucuugcgccaguuuagauaaaacuacacagacacacgugggaugguuuuaaggagccgagaguuuguuaggcaagaaagaaggaagaagaaaauagcucccccguacagagacagagggaagggggauuugaacaaagagaaaccccaagugcggcagaaaagugguugcuuauguugggaugcuggaggaggcggugucugguuugcauagggcccaguggauugguuugguuugacuaggugugucauuuacguaacacugaucuucaucaaagucuuaucuaauucaagggaucuccaagcugccuuuuuacaguacuauuuucaguuuguugaaugguuauuucuuaaaauauaagauguaaguauuaacaguauagauagauggguggauaauguugucuggucauagaagugucauagaaaaaaaauaaagaagguuuaaggggugagugagugggggggauggggggcugcuucuucagucaugcuugcugaagguuguuucuccaaggagguaacccuugagcugugaagagagagcuacagaacuacagcugggggaagagcauuucagaaacagagaacaggcuuuaaagggcuugagguggacagcaagcuugguguguuuauuuaaaaagcaaggcaaaaaauaaaauaaaauaaaauuuuaagaagccaguuggucauugugccuggagggcagugaacaaggagaggccugugaguggucucagagagcuagucuuagagcaaagggaauuuccucuccgcccucugaaguuuccauaacugagucugcugucaucaacugacaguagaccaauuaacuggagaaaaggcaaauaaaguuauuaccugugugggggcacacaguacucacaggaaagugaguacccaauaacucaaugagauuuagaaaugcauguacccuucuucauuugaaagagggaacugggggcuguaggcacauuuagaggaaaaguaaaugguuuuuaggggagaccaauggacaggaggaacagacaauagacugagacaaaguuccuguaggccgggugugaaugucaacucuggucuuuccugggaguuaaucuuccuuguuugaugagauuauaugcuuugggaggccaagguggacagaucauuugaggucaggaguucaagaccagccuggccaaaauggugaaacccuaucucuacugaaaaugcaaaaauuaggcaggcauggucacacgugccuguaaucccagcuacucgggaggcugaggcaggagaaucacuugaaccugggaggcagagguugcagugagccgagaucacgccacugcacuccagccugggugacagagugagugagacuccgucucaaaaaauaaaaaauuagagaaacuuuuugaaaagagauuauagagagggagcucaagacaauugcauugcuucuggaggaaauucccucagucagacaagggaacuucagggaaagccccuccccucacuuaggaagaggcagaggggugagaaauggagacaggagagggcaaaagagaccugguuucugaggcugcuucuuuaguucaaaguacgcagaugucaaagagccauacuuugggguauuauuuuaugagccucaacauuagccaggggccagauuuuucaggggcuugaaaacuguggucaggacuuuggcuuuuauuuugagugaggcagggaaccacuggagaguuuugagcaccggagugacaugaucugccagauuuuaaaagaccacugagacuguaggggaaugaggggacaugaggcagaugaggaggccccugcugcagaucuggcaagggcagauguggcguagacuaagguggagggguuagagaugacaaggagugggcaugcucugaauuuauuugaaagguagagcugacaggaugcacuaacuggauaugacagaugggcaguguggugggagagacugaugaagucaaguaugacuuuagguuuugauggcaccacucauagagauggggaacguagauucaggcaagcaaguggaagaaagaguugagcuuggaacuguuggcugugagaugcccggauagacacccaagugcagauauagagaaagcaguggaauagaugcaucugaguucaaggcagagguugggacuagagacauaauuuguaguuguucacacauaauugauacuagaucagaucaccuagggagugaguggagacagggaagggguccaagggccaaacucaaggcauuccaaucuagucaagaagaugaaaaaaaccuagcaagggagacugaggaggugaugcuaggaggcaagaaguaugcaaacaacaaguguggcguuuguagugccacgagaagaaaugcuccuuaggaagaggccauuaucagcuguuucaaguucuauuguaaaaugaagauggcaagugaucagauuugaccucauggaggucacugguguccccagugagagcagauucagcuaugauucaccgucugauuacagaaguuaucuuaugauugcuuuuaguuucuuagugaaaugaggaucuaaguuaucugaugaaaaaugaggagggagggaaggacucuggagguuugugaauagaggagaagcuguacauaguugucugaggagugaaucagcuagaaaaauacagucagauuucaaacagaacuaagaacucucuuguuaguuaaggucauaaauuuaaaugagaccagacagcaccauuguaugcuuuucuccagccuguucggcuguucagguggguggaggaggcagagaauaggauuuaagcuagguugguuuugcuaagcaaauaugauagagagaagagguacuggggauguauucaugaauacaaaaggagagauuauaauuauaauggaauagaaguuagguaaugaggaaagugaagccaugaauggggugauggacaaggaaaagguggcaauguuaagagucacagcaggaucagagaacuuuuggaauguguugcagguugcaacugauuggagccagcauugugggugguaaaauaauuuacaaagacaguaguaaguuaaagaaagcaaugggcagcacagcagagaaggagcugucugcaaagagacaggaucuggagggaaguuuuacaggguggugccggaggggcuaccuacagauaagcuugugcugcuggggcuacaugcaaagcgagguauuugggaacaggauguugugucagcagguuguuggugguuagccuucucucagaacaauuguucucuccacacuuggggcaucuuccuuguuguuuacuuaucuugucaggacuccacagaaugggcauacuagagagagugaauuggaaagacacaagauggugcuuguaaacuuacgacuucagcaaugguucuguauuuucaaugacaaagcuuaggcuacagucacagcaaaagcugcuuuaggagauuauaaaggacaagaccuuuggguugaggaggguuguggaacugagaagcuagguauuggguagaucaucugugaggauauugaaguuacuaagaaugaugauaaagagagggaaggguaagaaaaucgucaaugaauuguggcaugaccagguggagaguaagugucauaaagagggauaguggauaguauaaugucaggcaccucaaaggaacugggcagggaguuagggaguaaaaagggcgguggucuggaagcagaaaggaggagcagugguccaguaggggcugcagagcugcaaggcuuugccucaauccugucaaaggcaacuucaagcuuuccaggagccauacuccuucauuuguucauuacuuucuagauuaggaaaucaccacucagcgacuggggucuuugccugaauguauuucagaauuacuaaguugguugaaugcuuccacaaauacuguuuucauggagagcacuucauauuuacauuggaaaagagcuggugccauccucuccacagaaacaaggcugacagcccuuaaauagcuuuggcuaucucuuggggagaucacaguuugugggaaaucgacaacauuaccauggaacauaacuuggaaaugauauuuuucuuugcucgccacugagcauuuuggacuugggaaacaggcuaccagaagaguaguuauugggaaagggcaaucaacacgugcuuuccuuggcucaugauuucuugccauuuuuuccggcguuguaaucaaaccuguaggcuacugauuauuuacucauuaaguuccacuuucucacucuucccauuucaaaguagucauuuaaaaaauugcccgaucgaugauuuuuauauaggaacaacauauuuuuuaugaaagucuuuuucacaacugcuaagaagcuuugucacuauaagcugucacaagauggcaucacuugguagucuucaagucuaauuaguuuucuuguacgccugggugcauuuuugagcuauaaaauaaaacuuguugaauaaagugaccuuuuuuuuauaugcagucuagccuauuuuggaauuguccuuuacaaacauauaacaugaugauugaucagauggcauuugggucugaaauuacuucuuggauguagaagagaacaaggccuuguuuugaaaguuucugacuuaauuauuuuauuucaaaaaagacaagaaggcauaugcagaauuugaagggaauuauagauucugcccugaccaagagaaggauaagaaaaucaucaauggauuguggcaugaccaaaagcagaauaaauaacauaaggaaggcuguagucccauggcaggcaccucaaaggaacugggcaggagguuagcaaguggaaaggauaguggucuggaagcagaaagcagaagcaagaaguacaccuauucagccuccaagaaauauauguagccuucaggacacccuagacaagaaaaggcucucagaaagggaacagguauugagauaaauaaauuugagguggacaccuacuuugcaucacgacacuguguuaagaccuagagaucuaaacaugaaaaagggaucuucuaaagcaucgaguggucuagcagaggagagagacauggaauccaguagcccuguugaguuagcauuauacugaaaaagagaagugagaacaguuuauccucuugggugaguagggagcugggauccuacaaagaacaagaauggagauaucugaacuggacuuugaaagauaucaagaauuuaccacccauuuuggauaggaaugggcuagagggugucagggaaggaauuuaaagaugaggcaacagccugaauaaaggauuaaggucacgaauaggguagacuuugggacccuggggaaguagcaagggacagcaagaagugauuuggauccuuacauauggaaaagacucugaguuuccuggcacccuaccuuugacagauuuaggaugaauaaaaagauguacauguguuuccaagauguuacagagaacacucauauuuauuugauacuuacauacuccaagauauucagaaaucagauuauuguacugaaauaaugcagaauuggaccauuuuucuaugacaagucuaaauaauuuaucugguggauguuuucauaaaggaagguuuuacaccuguucagugugugguuuauccaaauaccuuuacuucggaauuugugcuugaaaauagauucuguaucuuuuggcgaaugggagccaaggguuauaguggugaguaugaagggagaugagauaggguagaaaaagaagcagcuguagagaaaauguaguguagaagcagauaguauaggaaaaaaagauuugagcugagaggaggguuuauuuccuggugugaccaguuaggagcuacucgaccuuagacuaaagucccuugaccuccuggagucugaugccuuccgccauguagagggaggugaugagcuauucugaggcucauaagauacaacgugugaggcaugagagagccccuuuugugugccauaaaacucuguagaaaugggagcugauaguccugauaucuugguauacuuugagaauuuagcuuuguuacaacuucagggucacggguugugggaugaauggcucacugaaugcuucucaagcuuuugggauacaggaacaugucucaccugguacgcuuguaaaaacaucaaauauugggaaccaucuccagaauuccuaauuuaaugugauuaggacagaauuuaagaaucugcauuuugagcagacaucucaugaguugcgaagacaguggaccgaggagaccauuuucuuguagaaacuguccuaaaagaucuuaaaaguuaugugcauccaguaaaaucaggccagaaguugcccagccuauuaauaaaaccuuggacucaccuucugagaaaaaaugcaggcacccuuugcuaggcuucugaagguccucuuugacaggcaccccagcugagauuggccuuguucuccugcaccaaauaaaggaguugcuagcauuuuugaacuccuauguugugcuugugggggaggauccaagaacagauuacccugcuugcugcuagcagaaacccaaacccacugcagucucccaucacauugaccauucauuugucagcagugccccugggugggaaucaggcugacagccuuccaaaaccuccccuccugucccugcuucccccacaccccugccucaagggacaucugugaugcacuggaaggugaccuaaacauuuggccagaacccuaauucugauacuucugguucugugacccccauuaauucccuuacuuuccaaaccuccaauuccucaccugugaaugaggaaggugcaccugggcugcagcauugcugugaagaugaagcaagugcuugaggcucugugagauccugcuguguggggucugcuguccagaucaugaagaacucuugccccucaggaacuuguauguagaugcucuucugagcaacaacagugaauuuggaaauccugccuaggaaucagagcaaggguccaaguuguaggcauggaguugaaaguaaaaaccagcauuuuaauuuuuacuacaagauaauuagcuucugaauaaagauaguaauuuuguauugaaacauuuaauuccccuucuuccaaaguuccuacugaaaugacuaauacacacacacacacacacacacacacacacacacacacacacacacacacacacacaaaacauacccauacacuguaccagaacuggagcagggaagagugaaaucuacucauucauucagcaacaugcaaaacacauacaccuuuaaguugccagauucucaauggauucauuuuauauggcuaagacuguuacauguucaacaguaggggaacagcuaaauaaauaaaaaaccgaguuguccuuaaagaugaugguguauaagcaucauuauuuacauauaaaaaguauuguuacacuaagaagauuaaaaaacaauauauacaauauuauauuacaaccaugcuuagaaaaaccuuuaaaaggauaugcaccaaaauuuuugacagucauuuucuguaaaugauagggauaguucaccuuuuaaaauauugcuuaucuauucugucuaguuuaauuacuuugaauuuaacauacuugcguaauaaacacauaugucugacagguuguaaaaauuggggcuuuuagacuucagcugcagaccuaaaauauuugcauagcuaauuaggggcucuugugugauguccaucuuuaugucaagagaguaguacguucaagaguaguaugucaagagaggcacgguggcucauaccuguaaucccagcauuuugggagacugagguggguggauccacgaugucaggagaucgauaucauccuggcuaacauggugaaaccccaucucuacugaaaauacaaaaaaauuagccgggcgugguggcgggugccuguagucccagcuacucgggaggcugaggcaggagaauggcgugaacccgggagcuugcccugagccgagaucgcgccacuguacuuuagcuggggcgacagagcgagacuccaucucaaaaaaaaaaaaaaaaaaaaaaaaagaguagugacuuccauuauuuggcacauugaccucauuauauugaaaugucuugagagucuuucacucuccagugggucaccuaagaaaugcuuugggaauaacaaagaggucugucuccuccaggagaugauacugcucucuuccuccucugcucucuguguauuuuuuuuuccuucccagcuauucacacaccaguagaauuucucuuauguaaguggaccucucuugagacucugugauggaaaagaauguauucaguuuuuucccccuuuuuugaaaaagcaucauuacaauucccgcuucccauccauucauuuucauaacugagucuagagugauuucuuuuuucuuugaacuuuacuugaauguaucccgucccuuucauaagagccacuuuuaccugggagccucagaagguuagagugaugauauggaggugcugccuuauuaaucaaacguuugcucugugcugggcauuaaucacuuaaagcugcacagcuggauaagauucauuagugucuucuuucacugugcucgucuccccgccccgcuugcucuuggaggcauuuacuaaaaugccaccagugcuuccaucaccagcuccaucucucucccaccucccguggccacgugcuguguuuggccccuggguacagagaaagaucacuaagagguuaccaaacagaacauuaaagggccucugauggcuucuuugacugauuccuuucaaaucugccuggauccucuggaagccucuucucaggaugcauguuccacacugagcccaguggcugcccucaggaguagaugcaggccucagagaugcugaacaccucccuggcauggguuugcgugggaugcaccuguucaucagucaugcccccuccgucuggggacauccugcuggugcccagaccauccucccugcuuccugcuuccuugccagauccuucucuaauccacuuccugacuuccacauagaggucuuugacuucagagucccuugcuuuggccuuuaaaccccccuucauuuaaucauucuucaguaaacaucuauugagugccugcuguaugccaggcucugcagcagucacuggggacguaauucugugccagagaaacaugguucugaccucauggaaguuucuagcagagaagacauguaaaagcaaaacagaagaguaaacaaagcaacguggucucaagcguaagaagugcugugaagucaacaaaaagaaacagagacagaaucuacuaggagugggcaccauauuuugaauggcguggccagagaagacugugguccuuggaccaacaccaacagcauugccugagaaccugcuagaaaugcagauucucagacccuaucccagacccacuucagucugauucaucagagacucccccagcagucuguguuuaaugagcccuccaggugguuccaguggccacccuagauugagaaccacugauuaaggcuacgugaugggaaggagguagguaugugaaguguggaggaaagcaccuuccaggcugaggguccagaugagcaaaaacaggagagagcuuggcuuuuuugaggaacugaaaccaagaccauuuuggccggagccaaguguuggugaugugggcagggauuaaaucagauaggcucuugcagaccaaagugaagggauaggauuuuaaccuaguuaagaagcccuugaagcaucuuaagccaugccuugcacugaucuggacucccuuuuaagaugaucucuauugcugaguccagaauagauuggaguggcuuaagaauggaagugggagaccaggaaggaggcugauacacagguccaagcaguaaauggagguggccuggaccaagguggcaacaguaggaauaagguaagaagguacuugugagauauguuuuagaaauaagcucaaaaagacuuguggacugauuagguguggacagggguagugguggagagggggaaucaugauugacuuccuggugucuggcuucaguaacuggguagauggaugggucauuuacugcuccagagaggcaagaagcagacacgcccucucggccuuccucucagacacuccguaacauggugggucugaaaucccacuguaaacagcuucauggagugcauccucagcuugucuucaugggccaguccucaguucagcccagaccccugagcccucauggagaugaaggagccauugcuucgaucuccauaagggcucugucccucuagcgcaaugucuugugugcagugaacauuugagaaauaccuaaaugacucggucugcuggaagagcaguauuccugucagaaaaauauugagucaguccccagccuugauuaaagauguauaauuguuaccuucaccuuaggaaggacaaaagagauaaauugccuggcgccaugaaacacagacagcccaagggguugaaccaaagacagaagcagaagauaggaguggccaggggcccaggagaaaauaggagaaaccuguggcuugguggugagugacccuuugcccagucacccacugugaagagugaacugcaggaggaaaugggaaggaaaacagaucuuuugacucugcucaucuccugcagagaaggugggcugguuacauaaaaagcuacugugggcugcucaguuccugagucuugcucacagggcugaaggaaacauucccucugucucucacagauguuaauaaugagcaugccagucaauccacccagucaggagucgcucaucuccagcugucccgggcaccuuguugauggugggucuugcauaguacauuguuucuuguuuucugugucuguuuaggauauacagggagcuguaucuucuagauuuaaaugcugaaaaaaaguggugagugagaaggggagaauggaaaugagauguauaggagcaugggggcgaacacagcacgagggaacuccaaccgaaagagccauaaccuaaaucugagaagcuaauuuugcagaaccagcuuagccacgggacuuuggggauuugcuuuggaaagauguuugcauugucugugucauuggcaugaggccacacaguaguucucaaaugggaggagggauuucgcaaugucuggagauaguuuuguuugucacaucuggguggggugguggaggagggcacugguaucuagugagcagaggccagagauaugcugcuaaacauucuacagugaacaggaaggauuugccauggggaugaggggaguuggcaaugucuggagauaguuuugucacauuugguuggggguggggggccacugacaccuagugaauagaggccagagaugcugcuaaacauucuguaaugcacaggacaggcuuccacaacauagaauuaucuggcccaaaugucaguagugccaagguugaagaacccuggccuagaccgagugaagaggacagagcaagagaaccuggucugaugucugccaccgagagaggguguggccaugcacauugagaagggggcucuucagcuggucugucaucaaaggaaccagaugagaaaauuccgugaagucccaccugucuuuucagcucuugugugagucuccgugaaaaucagcagauauuuauauccuccauuuguggccaaggcacaaggcaagggaaugugggggaaacacaguggaauaagaaguggugccguuuccaguucagugauagggucucucaucaugcaaggcagauggaaguaaguaccucuaccauaggguaaaaaaguguuaugagaucuuugaagagugagugagcaggccaggcaugguggcucacgcuuguaaugccagcaguuugggaggccaaggcggguggaucaccugaggucaggaguucaagaccagccugaccaacauggugaaaccccuucucuacuaaaaauacaaaaauuagcugggcguaguggcaggcaccuauaaucccagcuacucgggaagcugaggcaggagaaucgcuugaaccugggagacagagguugcagugagccaagaucguaccauugcacuccagccugagugacagagcgagacuccauuucaaaaacaaacaaacaaaaagagugagugagcaguaccuucuauagggagcauauccuagaggcucugccguauggugggaaaauguucaaaucccuuuugcgucuugauguauauaggaaggugguuaagagcauggauuuaggaacagugagaacuggguuuguauccuagcccucaguuuccuucuucauaggaaggagauaguuguaggguuauagugaagaaaaaaaugagauaaucuaaaaugguucaaauagcaccuggcacacagucaagaggucaauaaaugguagagacuguugugguauggaggaaguuacugcucuguggagggguaguagcugugugauuuuauacaguugauuuaauuuuucugaaccucaguuuccuaaucuguaaaagagagaugaaaugaugugcucuguagaaccuuuguaaggauaaaaggacaauguaugccaagugccuggugcauagaugacauucuaacucaaugugaaaucuucuccuuacuccggacuuugguugaaggagucuggugucuuuugcacaugaugaugucaacuugggucccucacauugccuuagcguccuucacccaacccaccagugcaggacauagugguccuccccaccccgcccauugucuaccccucuaaaugauuuuaagaaccaaguguuuguccucuuaaguacuuauaaacuucucuaagauaaauauuuuauauaaaaucaaguaccucuugauccuaguuauguuuuucaccacuuaucuauucaaacuacacuuauugagcaucuucugcaugcuaggaaccgacauaggaguuggggauaauaagucaaagaacgcacaauaacucacuugacugugucuaugauagacaaguguuugccuagcuuaugucacuugaacucgaccuucauuaauuuugccauauuauucaguuaaauaaaccugggcuacauccugaaggaggaaagagagucagccaggaaaagaauccucagggccuaggugguuguggggaggugaugggacauuccaggcagagggaguggccucuuggguggaggccagaagagagaaggaugcuucuaggucacuggucagaguuugaggaggaaaggagcaagaaaugcagcaggugaggugagccaggucagcuuaggaagggccucguauaaauugcuguggaguucagacuuugacccaagguuauugaagaccacagaaauauuuuaggcuaaggaaagacaugaucagaucugugcuuuggaaagaaaacucuuuggacugaaaagauuaggaggccaacgccugauccaagcaggagauaaacaccugaucaacgucauggcccagauugggaauguggucaguacguguuuaagaugugggaucaacagguuugggugguugauagguugugauggagagugaguuggaaaaugagaaacuggggaugauuuauuggugggcaauaguaccugcaauugagauagagaaugugagaauaagagcacaccaggaauaugggagagaugagcucaguggaugaacuagaugugaagugcuuugggcacauccaaauggagauacuguccugcucaaagcuagaaagugaauuaauacagaaacaaaaucaaauaccgcauguucacccuuauaagugagagcuaaacauuggguacacagggacauaagaguggaaacaguagacacuggggacucccaaagcagagagggagcagggcaagguuggaaaaacuaccuauuggguacugugcucacuauuugggugacggguucaauagaaguccaaaccucagcauugugcaguauauccauguagcaaaccugcacguguacccccaaaucuaaaauaauuuuuaaaaaauaacaaaaagauaaauugacaauuaaaaaauaaauuaauucauugugauuauuuuuaaauuuugcugaagagccuauagaggaaaggugagugagaugggcuggagaaauuggagucacaagaauuagauaaaacuguuaagucauuugaauagaugaucucaccgaggaagaagguggggagugagaagagaagaagggaccaggacugugcaucugcauuuaagagacaggcaggagaagaugaacucccaaaagacugaagaggauaaucagagaaguagaagagaugacuauuuucagugaaaaauggaggaucuugaugguuuuagaagaaaguggguuuuuagggagagcccccaaccccucauccuuaccacagauaacaauaguccuuuggaaggcacggagcaacacaaacacagaggugguugcggaacaugccauucucauuuuaacuaaggguggcuuugaagauuaaauuacaaagaagcaguugggagaauuccaguuuugggucuugacaacucuuugucuucauagcauagcaugaggguccaguggccacuugggcaacagaugcacuuacccuguaaccaugaauaccacucauucucucacuuacugggaggggacuguaguccucauagcugcccccagucucccuuucuagugauggaaauuuccuuuauugacagggaaacagcagguuaauggcacagaugaaauguaaauuuugacagccccgacagguaaauauuggcuuugcacaaacaaguuucuauaaauaaccugucugcugcagaaacgccacagauggcagcagggcugcccaaguguugauuuuucccagggugcuuggugcagaaaagcacagcugucagcuuugcuguuccuguucccagcucaggcuaccucugcugugccugcagacuguccacgucccauccuccuuuggcaggagaggcagggacagguggagaucagucauuucaauaaccuaccuccgaugccuuucauuccaggauuccaaaggaguuucuuaaaaaugucacuuccuuggguucuacaguccaaagugggaaucugucugaucuggggauguguucgccccuuuuaauuaaaguugguccaguugaaaagaaaauuggauggagugagauacagucacucuagacugugugccacauggcccuguugcuaaaaauaguaccgucaaggacucugggcaguaugucaggcuauuauguuagcaggcauggacucugacuuaaggggaaugugagggguauggagccacagcaagucaucucacuggggaaauuugcccgauuuaaccccauccagggagcuaagggaaacacagugagccacuauuggaaaaacagaggcauucuuauuuuucaacuaugcaacuaagagcccauaacucuaauaaagcugauugagguaaugacauucuaaaugaucguucuagggauucccggaaagcuucgugcuaaguuaaaugcccgucacugaggcugggcuccgguuugggguaugccuguaccucccuccuucccucccuaauguuuauuuucugcuccaacuucuuuccuuaggcucauugacuuagugcauuuguauuguaagcccuuucaaaacccuugugaaaguagaaaaggaagaaaccauauaaaagugagucagaggauucuagaagguaccuaagauagcaauaguaacuuaaaaacuuauuuuauauccuacaaaggcuuugagaaaauguaugacaauaauggaccuugugcaauuaaacaaucauaauugaaaauuaggaagaaaacaauguugagaacuggaauaggaaaucaccugugaauaaugaaguaaugaugguaccacacccagagcaaacuuguggcguuuucuuuagccuuauccccggagaguagagcaaagcugccgugagucagcaggcguuggaaaggacagcaaauacacuugcuauugcccuggguucgcagagugaauucaggacccuuuauucccacuucaaggcaaccagucacugcuagcauaggcuccuuugcuuuucugguggggcagccccuucuagcucuaauucuacauuaagaagguguacuaguguuuuagagcuuugggccuuuucucccaaaucuugucuccauguaugagggccuauguuuucacuaagggcugggaacacuuccuaggcugggcuacauccacuccauugugcuucccaauuacuuucuauacaacuggcuuccagcaggcaacaaaucaaugucugugaagucccguugacuucaaggagcuccggucaucagagaaacugaucuccucauuggggaagagaccagugacaugcuucaugaguaaaauuacagcuugauauucaccaguagaacuuagcaagaugcucagcagagaaaauaaugaaucaucuuuugcuaagccugugagaaggauagaaaauauuauacgggaggucccaggaguagagugaaaaucaugugggcuuugaaaucaagcagacuuuaguuugaaucgugcacuccuucgugugagcugguggacuuuggucaaguuugagucucuuugaaucucaacuucuccauuuuaaaaauacagauggugauaauuggauucucaggauugucgugcccaagaagcagccuagugucagguggcaagcagggauucuggagccacauugccaaguucagauuccugcucugacauuuacuagcugagucaucugcagcaaauuacuuagccuuucuauguucauguccuuauguuuaaaauagggaaaguugccaugaggaauaguuaaucuauguaacguucuaagaucacugugaagcacauaagagcugcauguguucuuguggcaauaccagguggcauugagcagagaugccccaccugugguacuccccaccuccaucuugcucucuuacucucccuguucuuuucuugaucauuuuuauguuuccugaucauuuuuuaaaugugaaaccagcccuauuguugugauuuuccuaaaggauugugcagacccugucuaguguauauccacccucagagcagaaguuagcaugacuuucauggaaagccaggaagggagcucucgaggaaaaagaugaguguuguuauucagaacugggguuaagguuucauuuccuuuuuguuaugaaaauauguucugcaauugaaaacaaaagugcaaagcguucugaaaacuaaaaguaauauacauguuucuugaguaaggagugaaugaacuauuuagaggcauauaauacacuucacuuauucgaagcauuaaauauuccaguuacucauucauucaaacuuucuuacguagcaguuguacaugguucuaugccagauucuggggauagaaauaggaacaggacaguccuuaucccccaaaacuccaaucaaauugucuaugaaugaaauuggugaucaagcaguugaacaaagagccucucaugacugaagaucuaaaaugccaacagagagcacagagacaaggagaggccaguggcccuuuuguuaggaugaguguggcagcuuagcugaggcagagcuuacaaaagguaggggaaagggaagacuggauuuauauaaacaccguguuacucugaauuuuuuacgcauaaaagaaaagguauuguugacagucacagaacugcauaaccauaguagauaagggauacugaacguacacaguggaaggacuuuaaugaaugugucgccugcucauuugcauguucacccaccucgacccgcugcaguggccagcguuguccccaguguacagaugugggaacuggagcucaaagggaaugaggcaguagcccucaccaugagcaccucugagguaggacccagguuccgcagguagucugugucacacugaacugucccacaugccagccugccgugaccaugaucugaagguggcuggucauggugauuuuugcugcaugagaauucuggaagcugucaguggcgugcugucaggacugccuuuuuccuuccagauccuuggacaucuuuucuucucuuuccugcgagcaucuuaucaguuacugagaaaggccuuucuguacuguguauucauuuucuugggaaguguucauuauaaguguagauuuuuuacagagccuaaaaaauuuccuggcuagggcacuaaaucuaauuagcaugcaaagcuguguaugaucucauguuaucauuccuucaagccagaacacagugaacccaccaucaaagcaagugcuuucuuaaagguaaacuaugccauuuguccagauuuauucccucuccaugcaaaucuaugguuuuuaugugacuaaagauaaucuguugucuacgccaaagaaaacguccucuucauuucccuccugaaauccccauccaugucauaagccuccucagaggguggcagcacccaccugucuccugagacagagaaaauguugcuuuuaagccucacuacaauuugaggguugucacuuguaauuacuuuauauuucuauuuuaagcauuguugacaugcucugguaaaucauuuuguuuuucuagauauagcugagggaucuuagaaguaaguaaugugcagcugcgcuuccugauagaagaggaaagacguucuagauauggcagagagggggaugccuccuuagugagucaggguugggugccucccaguggccuuuacuauucuuugauccacauccgccagguugugaagcagcuaccuggaggucuggacugacaggggagugcuuuggacuauuguaccuugaaaaaaauugucuguguauagccauuggugaaaugaugauuguauaguccauugguuuuauguaaauuacaaauuaauguuaaccucuaccucuaaaacucuugcucccuggaaaucauucagcacgaagcuaaggugaugcuagcuuacuaacacgauuucaaauccaaggcaccugggguggaguaagcagaaaggcuuaggaagcagaauucaaguccugccacuucccaggugugugaucugaggcaaauugauuuacaucucugagcaucaguuugcucaucugugaaaccagaggaaugaggccccccucucaggauguuuuguagagugaaugcaguaucuuccaaauggagaagaugaguucaauccuuugaaaguacauguuuggccauuugcccaggacuggucacaagacugaagccauggaacuucuuccuagagauccaaauuauuagguuuggcauucuauucuaauggcccuuuagcaaugccaugucaaaugcucaaagugacaauuucuaaagggaacugagaaauucauagguguuaugcuaggagauaaaaggccucacaugaccaaauguuugugaaaugcuagguuuaagaaggugaacagauuuaacuuguagauguuaauauguuuguagauaagagauggaguuucucaaaacauuacaucauagaauccuuuccuuuaucucauacucccuuucuuucuucugccccacccaacacaucguggaaccuguguaacccagagcuuacucugaaaaacacugaucuaaggaauuccaaaguuaguguucucagcucuugacaccugugcuagcagaaaggcacauugucguagauaaugcaaauaccaaacacuauauaaaaagcaaaucugugacuucugaauauaccuuauaguaagugaaggugauugauucgagcacuaggcuuuuauucuacauguuuuuuauuuagcugaaauuucagaaaucaauuuauucuuuuagagccaaucuggauaagaagugauggaauuuauccaaagaauguaauacauaauuggaaacaaacuuggaauuucauuuacauuauuuaggcauauuucauaaaaugcagagcugagagccgaugcuaucuccuucaugaaccuucucuagauuucccagcuauaaguuaucuuuuccuucuccagaccaguuaucacacuaucugugccucucuugugcauuuauaacuuuccuaacuauauaaaucuuccuuuauaacugucgcuguuaaugcaagagcuaauugugugcauggcuugucuccccugcugaugaagaaacucuuguuguagagucccccagugccuagcagagagccugcacaugcuagacacucaaauguuugacuuggugagaguuucuuuuauuucccuaagauuguuaauuugucauuauuauuguuacuaauaguugucaauuaacuaauauuucaugaacaucuaugugcuaggcaauuugcauugauuacuauacucaauauucacaacagaacucugaaguagauacauguccccuccaaaaagaaacugaggcuuuaagaauuuauaaguaucuugcccaguaucagaacuaauauucuaaacuacaauuguaucuugcccaagccugugcuuuaaaucacuaaauuacccucuuaagggcuaaagaauauacaaauaccugcaacccaaaagggcagccucagaggagcuuugguaguucccuauucuccuuaagucccacuguagaaauaaucaccccuaggaaugaaagacuugaauacuacuacucacuugcuuucucacauacagugugaguguagaaggcucuccuuggccuauucuaucuaagguugcuuucaccagauuugccccagugugacuguaagcccuuguuaagcuuggguuaauugccaauuuaggcaagguucucauuuagaaagucccuucagggaaagcagccucagaacuaggagaugguugucuauuuacucuucacucacccagcugcuaaugggguuaggggaauggcaacaacauaugccacuccagauucuucccguuuacaaagucuugaucauuuccacacccaaaauccugucaauugccaccuguggagucaggcaauaaaaccaaccaguauuuauugagcacacgucacauguaaggauaagguguguguuaugaauucauucauacugguuugcuuuugccaggagcauacaguguugugaagaauaaaacaggaaauuuguuuucuuauugugggucagaugccacuccacgcaugccuccggccagccacuuggccccucugccucccagaucccugagcagugaaagcaggagggugggcuuuugcaauuccugcucucuccuugucggccuggcuuucugagaguggggcaccccccgccaucccagggaaaggguugaucugcacuuugaacaugggaacccuugucuauauguggcaugguccagagccacagcaaugcuucccauguauucuguucaccacuucaucucugagaauauuuuaaaaauguaguucuugguuaagugagcugaaucaaaacauauccaaguuggaauaggaucuacucuguguagacuugcuggaagugaaacacacagagccugcgggaagaguuguucuaugaguacuugagcccccagccugacuagguuaagucuucuaugaguacaugaaccccuagccugacuagguuaagucuucuaugaguacaugaaccccuagccugacuagguuaagucuucuaugaguacuugagcccccagccugacuagguuaagucuucuaugaguacuugagcccccagccugacuagguuaagucuuggagcagaucuuagacucugucuucgguaaguggccaagucuuuggccuuuguaugcuguggcuaggagauaaaaaaaaaaaaacucauuucuuaaauguguuaaaauacaguuauguccauaguacuuuagggguuagucucuauuuguauuagcuuaaacaauuuugcagguaaauacauguucauuuuuuuuuuaauuagcaaugucuauagcuuuguuuuuaagagacaaggucuugcucugucacccaggcuggagugcaguuguacgauuauagcucacugcagccuggaacucccuggcucaaacaauccucccaccucagccucccgaguacuuaggacuacaggcaugcaccaccaugcccagcuaaucuuugauguuuaaaucaauugaauuuuuugaaaauugacgucacugaacaaaauagacaaaaaaaucucucucauggaccuuacauucuagguagccauugaugacaacuaaaauagagaaauaggauuuucccauccaagaacacaguauccaaaaugaagaaacuguaauaaaggcccucuuagcucaugcaucaggaguuggcagcugauuaguuaauuaaaaaguugaugacagugguuaugguuaaucauaauaugauauaugcauaccuuaaauauuuuauuuuaacuuaaaacauacaaaugcauguuaaaucaccaacuuuuuaaugugagacucaagcuuuuucuuaaauuugcagauuggaguuucuaauuaccauucuuagauaaaccaugccaaaaagacaucaucugugauuuccaguuucaguuuucuuaaaguggaacaagcucugaagacacuuuugaaguuaucuaaguacaaucucuuccaguuuucugugguugacccacccacaugugguucaacagcagguuuggcuugguuucagcaacuuguuuuuauccagucuuucaaagcauucaacuuggagcuuuuucuacucauauuucaucaguguauauaauaugcaaucaaauuacauaauuacaaugacaacuauaacuggaagaaacacauuuggagacaaagaucccuaaaucucacaucucagcuggugggagcagaaacccaggggcauuccagcaucuugacugugagcuuggagugucagccugggcagcagucaguauauuuuagaaaaaggauggaggauguuucauaaacuggcaagucuguuaugguggccgucuuuuaagaggacuccuacuguacuccuggaugcgaccauaagcagacauuauuugcagcuucuagaauaguguuucucagccugaguucuguggcaccuggcaguuccaugaguggccucaggggccacuagagaguguuagcagcaagucugaaucccuccagcuuccuucagcuguaggagcuccacuuuuguuuuauaccucucacuguugcauuuaauuuuauucaaauaaaaagacugagcaaaccauuauuauuuuuaaacaacggguauuguggugcuuuuagggaggaaaucuuagacuauuagcaguagcauacacuauugucaauagaggacaucugauaacagucugaaauccuuuaaagagacaagggauuuuaaaugucugguuuacacuugauuuucuuccauuacauguuucugaauaagcacuguguucauugcuuagggcugcuguaacaaaguacuaccaaugaggagccuucagacaacaggaaauuauggucucauaguuuuggaggcuaugagaaaguuauggucuccuaguuuuggagcauggcucacagggccuugcucugucugaaaucugcaggggaaucucuccuugccuuucacagguuucuguugaauugcuggccauccuuggcauuuccucgcuugcagcugcaucacuucagucucugccuuuguugucacguggcguucucccugugugacugucuucauauugccaucuucuuauaaggacgccaguuauacuggacuaggggccaacucugcuccaguaugacugcaucguaacuaauuacaucugcaauggcacuguuuccaaauagugucacauucugagguacuggugugaggacuucagcauaucuuuuggggggagcaaaauuaaaaccauaaccggugcuaaagauuuguugaauauaguucuuuccccugccccuagagacugccaaaaauaaaacaaagccucccaacauuuaaaaugccagugaugucccugugcccgaauaaaacugaaguagaucccugggagaacccccuaauugaggugaagcaguguggcccaaaaaagaaacuacaauaaaaggaaauaccauauuuucagugcuuacucuauacuuaauccuguguuaagcacauucuuuuuuuaauguaucuuccccaaaauccuaacagauaucuuuagcuuuucauaugcuuucauuuguaagcaacagaaaaccaaacauuaauggucuuuaagaagaaaaugggccagauucgguggcuuacaccuauaaucucaacacuuucggaagccaagaaggaaaaauggcuugaggccaggaguuugagaccaucccagguaacauagaccccaucucuacaaaaaauacaaaaauuagccaggcaugauggugcacaccuguagucccagcuccuuggaagacugaggcaggaggaucacuucagacugggagguggaggcugcagugagccaugauugcaccauggcacuccagucugggcaacagagcgagacccccaucucuaaaaaauaaaacuaaaaaaucgagagaagaaaauguguuggcucuuuaacuagaagccagacuaagguagaauucagggccagcguaauccaggggugguagcccauuuccccaugauucccugggcucuucccuccucuguguggcagcuuuauugcucaguggcuaguaaggggguggcaguagugagggacauuugcacaccacaucaucccauggaagagacaggggucucuucagaaugugaucccagaaggauggaaaauaauuacagaaacacugaauccacccucugcuugguccuuggcuugaauuugugcccacuucuauuucugaaccaaauacugucacaguaaaaggaguugcacucagaccaaucagggcuaccucuggaggugggugggguggucagcauucacucaggugcuagggcugccuggagggugaguggacaccugaauaaaacaggguccucuuaggaaggaggagggggcaaucuuagguaagcaaccaacaguaugcacugcagcaggcccaggguacagaugaaaucacucagauuuagggagucgcucacuucuuuccaaaaucacacagcuuguaaguguuagaugaacauucaagaccaaauggcuuugacuuuuucuugucuagcauaccaccaccuauucucuuacuggaggggccagccauuuuccuaggcuuuuuggaguaguaguguagucuuagcuuauuagaaauggccuucaaaacccucagcugugcaccuuauaguaagagcauuaagagccucaaaaugugugugccccuuugaaugaaaaacgcuguuguggugucauugaguguugagagagaauucugggggugccugugcugggagaaugccccaccugaauagacagccucaguagaaccacucacuaaaugguuugccuccuuuugugccuuaaugcacuuugaucaagauaucagauagguugcaucaucagauaaggauggcaacaaaaaacagagcugcucuccucaacuuugcaauuaggccaguagaguacuaguauuuuuuuuuagaagggacaaggcuguuuuaguccuuuacguguggcugauaaagauauaugcaagacugggcaauuuacaaaagaaagagguuuaauggacucacaguuccacauggcuggggaggccucaccaucauggcagaaggugaaaggcacaucucacacagcagcagaugagaagaguaagagccaagcaaaagggguuuccccuuauaaaaccaucugaucucgugagacuuauucacuggcgcgagaacaguauguggggaaccgcccccaugauucaauuaucucccacugggucccuuccacagcacgagggaauuaugggagcuacaauucgagaugggguuugggugaggacacagccaaaccauaucaaaggcaauacccaaacagccucucaggaaaaacuugcagugguggagaccacggugguccugauaauauuguucacaguaauagcaaaucucccagauggaagaaaaauuuuccugugucccuggcaucucacucaagugaugagaaaugaagaacaagcuuccucggcuuagaccuuggggacaaccugggucauuggcuguaaccuggaguugaacuccuucugugcauuuuucuuuagaauuucucuggcccuuagcuauuuaaagcuuucucuagugucaccagaggaggauuacaaaauccaagaguuuuucaaggacauuuuguuuagugagcaucugacuucuugucaaggagaaaaaaacuauuuugcccauuauuaaccuucaugcuaauuguuucuuuuuucaucuccuaaucaucaaaagcgcauguuugcauuuccauuucaauuauuugcauccaaagcagaaacagucccaauguuauuaacuuuuauaaugcccaaaaguacacagcugugagcccuuaccuagccaugccugaggguucccauuucccugggaaggcacucucagcagguuuggucuccgagcuaugugccgggagaggggacuagaguguggaugcugcgaagcccagcgcucuucccuccgugcagagcugccaaagcaaaggcagauguugucagcccuugccucacuuucccagauccacuacccaggcugcugucuugccugagccuuuuaagaaagcguugcagcagccucucucauugucuugguugugggaagggcugaguuaaauuggccaggcaugugacuugucauccgcguugcccuaguucgccacaguccguuucuugcuaucauggcccaaucucugcaagaacuuacucucccuugcaaauucccuccaaaccugugacuuacccucaacccagcccucuuggcuucauucccagaggggucucuccaaccccagaagccacccaaagcugcugggauccugcugggagagccuguaucagcacauuucagaccuuuccauaccaaacccuuuuucaaaacaaaacaaaaaaggcuuagcggaaacucaguaaauaauugcuguacagcagagcuguugucauucagaugggacgggcaacuugaaguccugccccuugauacuccgaggugagcccugccucuuuugaacauugaagaucacagaccugaagucacaagccugcagccaugaagccucaggcccgcugccuuucuggcaggugccucagugcuaccugccucugcauucuccucuccaacuucugccugcucugccagauuccccaaaacucccugaguugucaugugucuggaagaaucccacuggguugcccuucaucccacagagacggagccucuuagcaggaaagcguugcacacauccuauugcccugguccuagacuucuguccucccagcaccccacaccugucacucuagggcauccaagugcagagaguauuucacacagagcauuuaaagugcuucuuaugcaauugugauuucacagcucacuucucaccuuagaggcuuagcaggaacuacuauucgucuucccauaccaaguuccaagauaagagugcagauguaagcccuugaggaucuucaacuagaaaaugaccuggacuuuuuagauaaagcgacuaguucuuccugucuggggcaccuuggaccaaauggauuaauauccuuaaaaaugccauuauacacucuguuccuguauuguuuuagcuacauugugaagaguccuaucuaagcaagcuugggauacagugauuccucgccugcagccuggagucucauagucuucucaaagcacgggugagugacauaaagauacugucuagccccacgugcucugagcugcuuugagcagaaguuaacugggccaaaaggacaccucguugucccucuaucauggcagugcgggauugugauugagaaugggacagaagugauagcuucacaacuuuucagagucagucucuacacgaucucugagcccuggcugcagcaccagcccugggaaggcauccgcccacugucucugcagcaccccagaggaucucagacauggagagcaagcauuucccacucaucuguugccugaacaaacaucuagggagcucuugcugucccgggcacugagcuuggacacucagugaugaauggagcacacagaggguauugccagccugacagagcaggcugaagagguacaaggagcccgcaucuuggaaacauccaagagucuaauggauauuagaggcacagagagaagaaugaaaucagaucucaucuuugcucugugucugucuccucucugauccucucagccugcuuuuucuucaguuacagaagcauaagacuccauagaaccuuccagcuuuguuucacuucguucacuuaguuuguuucacuuacuuugcacuguauucucacuguugcccuugcccccacaagaguaagccacagucaauccuuuucugaaguacaaagacuugcauuuagcagggucugaauucaggagauuuuuucauccaugcauuucaagauucuuaauuagaaguagauggacuccuaaaucuaacacacuuuuuuucuccauucaugaaacuggaagugacagaaggguauucagcacauuguuuucuuuuaucacguaucgcccaguccugaauugauuuucauuugucucccaguuaaucagggaacuccuugagagagagaaaacacagaaaacuaauacuucuuaugaaggaaacugagccauguaccaugagggaacccuucccuauguguggacaggauccaugucuuauugaacggugucuaguagugccuugguugccucuuuccacagcuauacuaaguguucugugcaugaaugaaugaaugaaugaaugaaugaaguuaacucuccaaagagcagaucaucuuacaccucagcauguguuuuaguauauugaaucuuuagucuuguguauaguaucugguuaccugaaacaauguauuaugcagagcuuucugauuuucuuacauauccuuaaagagagaaagauauacacaaaaguuccuagaacauaaaauuugcucaauuaguguuuaacacacacagaugguuauuaagagaagucuguagcuagggaauaccauucucccuuucguggaggauguaucucccuccacgugugcccaagguuacgcagcucaagcauuggauuuguguucagguugcauguauucaggacaugcacuccaccaugugcugggugugccacugggagcuggccacgugcuuauaauuuaauccuacagcaacucugcagagucuauauuaguguggugauuggggagaugaugaaacugaggucuguuuuuuugagacggagucucgcuguguugccaagcuggagugcagugaugcaaucucggcucacugcaaccuccgccucccggguucaagagauucucacgccucaaccuccccaguagcugggauuacaggcacacaccaccacccccagcuaauuuuuuguacuuuuaguagagacaggguuucaccauguuggccaggcuggucuugaacucuugaccucaggugauccacccgccucagcuucccaaagugcugggauuacaggcgugagccaccaugccuggccugaaacugaggucuuaagaagaguuuuauuuaaggccacaaguucuuacaccacaggacccuauuccaguagcauccauuacgucuuaagcagcuaguacugguccugggagauugacucucugggauaaaucccgaaaagcugccuuaaauguucuaaaggaagcacauuuuauuccacauuuguauccauccuuuucauucuagcauggugcccaauaagcaugauagugaccaaagcuuucaucuuauuaaauucuguauuauuuuagacuacauuucuuaacuaucaaauugacaaaaaugaaugaaguguaauaggaaagaaagaaacucuuauccauucugaccgcuuuugaggacugauggaggaagagauaggagacugaaggugcgcauguucucaccucaaaguugagucugaaaagguucacugaauuuuucugcguguccccuuugugcagaaagagaggaagcaugucuuucucacccuagaaaacaugcuuugaccguuuuugcccuugccuuauuggaaaacagcugaaauugugaguaugacauguuuggaaugauagacuuucucacuaagggaggaaagcagagucaagcuuauuuuaaaaaaucagugagguguuucuaaaaacacagcauuaaaaaaugaugugccugagcauguucuguagaagaugauuuuauccuaucuuagaggguauuucaauuaugacuacucuuuugaggagcaaugccccuggaauacaggagugaguaacagagcacagcauguggcuugggaggcuucccacuaaaugcaacucagcaaauuaaaagcauauguaauuuuaaugacagccuaagagaaaugaaccuucaaagguuaggaaauuguaguuuucauuugagggaauugcauggagcuagacuuucuacucuuuuuaucuuaaaaaggcacauccaaaaauauuacaguauaugaacauggacuaaaauucacugaaucugccauuugaaagcaagauacagcuuuugaauuagccuaacacuggcuugcuauugauuuuguuaacauaacuacauugggcccaaaaagccaccuaaccauuucuagacacauccagagggcauaaguauucccuggcaaauaguagcuugcccaugggcuggggagacccguacaccaggguagucaguucaguugcauuuuauauaggcaaugagcucaugacuccucagugacuggauguguuucccaacucucuuugauuugcguugaccagugcuccucacaguaggggugcuaccuaaugaccaacauaaucucucaacauaauuuagggccuuguggagaugcacuauuucauuaggccacuuggaucucauggagcagcagacuauucauuuucucaauugcucccgaagggauaugcagagcugaugaaccucuuuacuuauacuuugggaguaacucauggaccggacaagcucuggcuuguuuccaggggacucacuugggaguaaugguuuucaagugcauuugaaagccaguacaauagauuugaccaucauagacuugaauauauaauauuucaguauacaucgccagcuauuuucacauugugguguuacagugagucuaagacauacucucuauaaaagucaucagcugcuugacccauucauuguuuauuuuuucaacaaguauuauaugagugcugaccauucugggcugggccacacuaaacacugagcuggaagaccauaaagcaugcuuaauaaagguuuggaggguggcauguugccccauuaagaaauauuuaugugaucauuuuaaucucagcuuagagaaauuuucaaucugaugccuugauguguauuuaccugugucuugaugugcauuccaucauaucuaaugccuugauguguauuuaccaaugcuuuggugugcacuccaucagaaaacucagauuugagaggcaggagacuuaacgggggagugacccuagggaacuaagaggagguggcagcacuugcacuuucauguggagcuugaccccacuucuauguggaugaaagagucagugcagugcugguggugcggccagccccuggacaucaggaaguaagccuggcaggaauccauaccccaaucuguagcugccuagaccaagcuuaccccauuagaggcaguacuagagaguauggggcuuugguucuagcagagucugcuacuugcuagccaggugccccgaguaaaacucuuaaccucucucaacugcccuuucuuaguaaucuccacuauuagggcagaugcagcauguagcucaguggcuggccagauaaaacuuccauaggugaugguugcccaugacuagugaggucaugcugcuaccagucccuccugucuuucuggucccuuguugugggugcacgugcugugcagcucuuugugugucauaugccacacuuuaguacauucucaccuuucagaaaagcucccuuucacauuuaaucuaguggaagaagaccccuaguuccucagcaggacugucugauucccugaggccucucccacagcccuggugggugggaugacugacugcacuuuagaccauagguaauaguuacagucuggccugggaauggggcugagaguuuacucggccugcuccuucaagaugagcauuguuaaccaggcagugggaaccaaacagagccugaaauagggguugguguuaucucucuguugcagggugucgcugccccugaugcauuucuugucagugcuucuuggauagaaggaaaaaaaacgaugguguaauauacuguucuuaucagagacuucacuuuucaaauacagaaugccauuugugugucacugaggcuguuguaauugccuucugcaccugauuuacaguugguucuucuugacugguuacacuaaaugauuugcuuaaagucuuauugauuggauggggaaggguaagcauugccgucaaggcccuguugagucggugggaaaggaggcagaaggagauuuagaauguuuuaaaauaauccuauucuuggauagaaguacagguggcaggagacagccagcuuucuguuuucucaugaagagggaagaugcacuuacgaauccgggcguuaauccugaagccucacuugaaucaaaggaguuuaucuucuugguuaacaaguggcaaauaaauaaauaaauaaaacuuuugaaucuucuuuuucucucauuugccuuuuaggauuuucagagauuuacuaucacccaaagacaaugcuaaagcacaaagcgauaaauuuuggauuucugaacaaucagagauugacuggcaugaguuauuaagauuaaauccaaggcuggcuucccagaacuguugugagaucaaucaccuauuuacugauauuugaacucccaaaucucuuccccuugagcccauuacuguaguuaaaaugacaguccuuggaauuaaccaauuuauuuaaauauguaaauagcccuugggccccugucacucauucauacucugguaugaacuaguuccuucaaguuugaucucuagagugaugcuaaauguauagggaaggcuauguguuuuaccaaaaacaaaauagucugggacugucucacaaaaguaaggcugaguauggaaccacugugugguccccaguucugggcugccuuguguacuguaagcuuucaauucugcuacucugacucuucacaagggaaaauuauagcuuacuucuugguguuagugugagaaucagccuagguaaacucuagaacuguacuagcacuaauuuaaacaaggauuucuauaugugguuuugcuguugagcagcagauuguaaauuauauuccauggaauaaguguucaagguauuguuaacaggcauaacacguaaaaguguucugucgcccaacaaguucgagaagcauuagguuaaagaaacaaucuugauuucgcuaguuguuucuaaaucuccaguacuauauaucuuuugcauucuuccuuguucauuaaacucauuugcuaaggagugucucuugaggcagggauagcauagugauuaaggaaucuggagccagauaaucuagguucuugguguggccccaggcaaguugccucgguuuucuugucuguaaaaugggaauaauaguuaucuacuccuaggguuguugagacaauucaaugaaugaaaccauauaaagcauuuuaaaauguuccuaaugcauggcaauuucucuagaaguguuagucuuguuauauuuuuugaaacuaaaaggcuggguaucuuuuuaaauggugcuaaucaccaagagacaauucccauaggaacuaaucuuaucaggcuaauuauuguuugcuuuaaaaauaaguuacggggauuuuaauuuuucucuaacacauauggaauuaggaaaaaaauuaaugcaaaaagcagaacacauacuaaauuaugggauucuguugcauuaggaauauagaaaaauauaaaucaugaguaucaauauaggaauugaaagaggccucugagcuucagcaaugaguuacuaaauggaaacaucagaguaucagaucuuauguuauuugcaucuccguauauuaagagcacacgugaaugaauugucccuuaggguuaguguaagacacuaaguagcuggauuuucuuucuauccucuuccuccucacacuaaggggaaaaggaggggaggggaaacuucagucauauggguuuaaguacaauucugaguggaucccaaagcuggaaaagguaaaaccugagacuccaaccucaguugggggggucacuucucccaugggacucuaggggggucgcacaaagaacuaauuugcccuaacgcugcaauacugaagaacaaagaaaaaaaugcccaccuagguuuaaaaauucaaagccaaauucuucagagggaugggaguugagugaggccuggguccuacccuugucacuaacuauaugugugaucuugagugagucacuccaggcccaagccugguucuucaccugcaaaacaaagggacuaucugcgauuguccugagacuuaugaagcagaguagagaugaggauggacucucagucuggaauuugggguucuucccuuccuccaccucuuugccuugggcagcugggaucuuccuuauguaacacguucaggaaaaggagggcaggaagguaaaaauauuacccugcaguuguagccaagcuggguucuggggauggaagaaugaagaugaaggggacuuggagggaaaugggaaggaacagagcccauguaaaaucgagauugauucuucuggaccugggcagucaucuguagucaguccugggugucgcugcugggucugcacugaaaaagaggccaaggggguggugcugggggauagaaacauccaucaccauugcucagaguguuuaaacuuccagagauugucauuaaacaaauuucugcugcagccuggcagcccucacagacauuuguuggaagaaaauuacgaguaggugauuugucagagguaauagccaggcugagcucuggauccuuaauggcauuuggaccuuuugccuuuuuaaaaauugcuuguuaaaaaauucauuuuccagccugucuuuguaauuagaauuggaggggucggggcaaagugaaaagaaaaggaccaaacaguugcugggcuuucaggcccugcacuggggccccaggaaaauugaaacggguugggggcaauauagggacccaaggaguaaugggacagaagagacucugcucauaaggaagagaggccuuccuggaaguaccuggucauuaccugccaggaauagcauccuuucauaaauuaaggucuuaucuucugugcagcagccagcccagagaggccaaggccagacacggcacagggaggaucugaggggcugggagcuauguauagauugcagggcugcucuucccagacucuggaagcguucaagcacucagagagucacgaaaaaaugaucgcuuuguuuguuccuugaaguauaaaaaugguuuuauuuuuagacauuauaguguuuuuaaaaaucuacuggcaguugucuucagaugcagccuugggaaguggaauggugcaugcaaggguggaugcaggcagaaacuuuacaaggagucaaagguuucucagccacagcacugugggcauucugggcuggauaauuccugguuggcggucuguccugugcauuguacaacguguagcagcaucccuggccucugcgcacuagaugccaguagcacucccaccaccacuggagaugaucagacuuugcccuguguucccacaguggguaaaacuguucugaauugaaaucacuucuguauccucaaagucaucagcuuuuuuuccuccacagaaugcaaagugagggcagaaaacacaaccuuucccaaagcuguugcauaguuuuucuucaguuuucaauuauucccccagaccaccaagcucucuugugcccaccugccuuccaguuggccagugccaccccccaccaugggggugcuguuccccuccguucucugauggccuccaucagaugaaaugauucuacacucuuccuccccccuauaacguaauaaguuuagugcacacuguacuugucaugaaauauuugcauuauauuuaccaaauauauuuccuuuaaguaaaaguuugccaaaugugcugcuucagcaggagaaaacacauuuuuacucaguguuuccacuuagcuuuguuuauguguguuuuuuaaaggcagugcuaagaggacguacuccuccugaggucucugggauucuauuuuuuuguacagcauugguuuucuuuuacacuguuucaguauuugggguuccagaaugagagcaaggugauaugcucugccagcaggagggcccucgcugggaagcaccuacauaucauguaggcugguggugaugcauacugaguggacacagccucccacccauggacuugcaaaccucucgcacccaguuucagugcacccccaaagaggaacaagaggcauuucuccuaggaaagaugagcuaaaccauaaagucaaggccaaagcaguugggcaacagucuaaaaucuaaauguuuuauaaguucuaaauuuagacuuuggaaguggagugugguugaaacaagugguauuuagaagagcaguuguucuaauacacaguucucaugaccucagcacuccuuguucacaacccuuuaguggcuccugcagaaugaguucagccuccuuggccuggagugcaaggcuccuguaauugcccauaauugccucaucacgucuuuuccuccagccaagcuuccucacuguuuguguuccacacguauagaaccacuuucaguuuucuagaugugccaggcuauuccacagcuuugccuggaaugucccucucuucuucccuucugccuggaaaauuccuacuuaucauucgugaccuaucucaaacaucucuuuggugcuacuuuucugcccaauaccuguaguauauuauaguucucauaauuuauuggaauuauuuauguuccuuucugaauuuccaauacaugguacaaaguagaaguucccugaaugaaauugaauggauuaaggcaugauccuuaucccaaagagguaauucaggaugugccauucuugagaagauuuuuuaaaaucaguuacuaaguucuaaauuccagaaagugccuagaaaauucuauagucuucacccagccucuuccucuggggaaggccuagauaaucuuaagcccacauacuaagcccucugauccuguggauccaaccaauacaaggguuuuuaucauuauuuucuuccuuguaggcuuucaauggucauagcuuccuuggaacuguuuucuuaaacugaaauugaauuuccucuugaccuuuacucuccuaccugagauauaacauugacacacacuguuuggcuucaagaugugaguccaauuucaggauaaauuucacucauuguuaugcuaacaaacccauuaguucuauaagguuguguucuguccugugaauuuggucuuuuuccuccuuuccuuuaauuaauuaauuggcaucugagggaugcuagaaaagaaaaaauaccgaggaccucacaguccagugagauagcuaacccaucuaauaguuccacugcccacagaaggagcuuccauggagacagguacuggaacuugagagagccuacuggagggagugacagcuugugggaaagucuagacacagccuuccagacgagggacugggcugugacagugagaucccuagagaccaguggugugcccauccuccaugaccacuuugcugguggucauuucuacucaucgucaccuuuaagaaagacaggaggugcauugggagacucugaacacuuuccauaggaagcaugccauuagaaugaaguuuuaggcuaacacucagccauuauuuaaaaagcugucaugaaagacgaauaugaaagggggguucuuaggccuugaucgaugcuggcagcugaguguagcauccacaugggaacacuuacuauugccuggaacucagccaccaugccccuuugaugcccucccggcagcagcaaguuaauuguuaagucauauucauuuauaagauggagcuucucauuuuuuuucuuugucuuacuuguuuuccuuccuuucccuucucugucaagucaucuuugggaagguuucuuaauuuucagaaagaaaagaucccgcaauccaagaauaaaacuaauuauaaugacaaacuggccaaaauaaaaaaaugacaaauaaucugugggcugaaauuuucccaaaagccaagaauaaauaaaaugucuuuuaaagugucugguggaggaggcugauaaaagaacucaauuaucuguugguuuuuuuuuuuuuuuuuuuuugcaagucugugauaucugccuuuaaaagggaaaaaagugauaaaguguuuaagaguauaaaauaaaauagaaguucaugagcuuuugugaauuuugagguugagagaaaauauagucuuaguaaaagagcuaaugaaucuguggguuugcuuucaaaaauagcgucauucaauccgcuuccucuccuuuauguuaaauuacuucaguugcacaacuagacaccugaccaccuauugauuuuauuagaacuuuaaacugguuuacugcaaacagauaccauacuuuguuucccccaaauuugccucauuuccauaagggacuagaaaaaaacaaaauuagcaaggagcaaauauuuagaauuucaagaguuugauggggaauagggaaaacuccacaagaaaauaaaagagaucugacaaugccacacaggcauacgcagcggggucuuaccacucuuagguauuauuugacuuuaccugggcccuguccaaucucuaaagcccagcaaaugccccaggugagauccuuccucagagaacuuucacaggagauauacagccuugaaaaauaaaagacugccauaauugagagguuugugcaaggaauccuauccuagcacuuucuucacugaagagcauuuugggagcuuuucugugcggaaaacgaggaguucuagagaaugcauuauaguuauugaaugccuacaaguauaaccacaauuuuacuugacucuugagccaggugcaagaaagagaaccucuuccaccugucaaggaaaucacaaacuaggugagaaaggaguaguagucauaauaauagcaauaauaauaacaucaacauaauaagaguugucauuguguuugcugcuguguuucuggugccaggacauaaaugucugcucaugggugucauaauuuucacaagacuuuagauacuguuuuuguccucaucuuacaguugaagcaacuaaggccaagagagguuuaauaacuugccuguaucagcuagcuaguaaguggcagagccagguuccaaaggcagaagauuugguccagugggccugcccgcucuugaucacagggccacacugcuucucaaagacauuguguugguccauucaggcuacugucacagcguaccuuagacgggguaauuuguaaauaacaaaaauuuguugcucacaguucuggaggcugggaaguccaaaaucaaggcaccagcaaauguggugccuggcaaaggcucacuuccugcuccauagaugaugccuucuugcguccucacaugguggaagggacuaauaagcucccuuggaccucuuuuauaacuucaguaacccuauucauuacagcagaaucuucaugaccuaauccucucccuucaaaggcuccaccucuuaauauuuuauugcacuggggacuauauuucagcauaugaauuugguggggagacacaaacauucagaccauagaugaagaccuugacacugcucauggagaccuauaaaaaggauuugggguucauagagaagagagugacuugugggagaguuaagaaggacuuuucaagcaagacggcauuucaggagacacaagguggucagucuaacaguagaaaaugaaaucagcaguagaaaacaacauggaaaauucuguucuuaaauuaccauguuggagagggauuuaauauggcuauguuuuaugccagauuuuuuuaaaagccuuucaugcauaaaacuauagugaucuauuuagauucauuaaaauaugugcacauauauaugcaugaauuucauuauguggauauguaaauuaauguauugggugagagauuauguuuuagaauauaaaccaaaaaccauguugugauuaacuuuaaagaaccaucuaguuuuggacauuguggcaguuguuuuuaauauccacaaaucagcugaauuaggaaacauaaacuauauguuuggacuucauauuuagagcuauaugaggucagccucuuccuccagaggcacugccagaugauaguugcuugcauggggcaacaguccaaugaaacaauuaauccaaaucucauucagagaugagaagcaacuuauuucauucacucauucauucauuuucacauacucauugacuucuauucagcaaauauuuuucagguaguucauaagcccuguaguugacugugugguggccuggccaaggggcauauuagccagaguagaagaggcaagagcugggucuuaguggccaggcugaagggauaaagugugagguuggcccuugcagaagaaagugauuggacaucauuccagaguagagugcccaaaggaaagaaccaaagcaucccugauccaggccacuguugaugucaaaagggguggggcuuuuggcaucucauagggcguucccagucgugacacauuauaguucugaaugguucacauaauuaaggcauugauucguuccuuaaaugaaucagaggaagggagauggaaaugauuagacagguuguuuuauuugcagucacauuagcaauaggguucaggaagggcucccauucugaugggagcuuuggauugcagaaacucuuccccgugagcccagcaucgaucacagagcuuggaaauacaaacuagaguuucaugagcaauggggaaucagagcuucuuuuaggauacuugauacugagugugcagcaacacacuuugauuggcagcagccucccuuccacaguugccaggccuacucuguucuaggcacugaguguacauuaucuaauuaucauagcaacccagcaagguugaugccauuaucccauuuuacagaugaagagacuuagcccauaagugagagaaccagguuucaaauccagaguucugugaccccaaagcccacauucuuccuaguuuacuaugcuacuucuccugagccauucugagccucaaucacuugccagagagauugguucaggaauuugucagggauagccugaagucccaaagucuucagccagcaucugagcaguguuagaaaaggcugagacucacacgaugcuauaugcugugggaaauguaauagacaugaacgauuauccuagucacuauuaaccaaaugcuggauaacauggagcacauagugacauucaacagaguuacauucucugccuucuaggaucuugcaacccaaggugcauauuuacuugcuugaauauugagcugugagaagaaaaguugcuacguuugugcaaguucuauuuauuauggaugcuaaauuccuauaaguuagcugaaccaucccuagaauaaaguacuuuauuuuagcccaagugccaacugacugacugacugacugaaugaaugaaugaaugaaugaaggcaugcuugcuugcucuuauagauuaacucucuugcuauggguaaaccaaaagaaaaaaaauauuuuuccuuaccccuuaaagugagucuacuuuguuuugugggagguagcaauuuauagaccugucuacacauuauuuucuaaaacucaaguauuuuggaagagcagaugggguaccauacuguauacacuaaucauauauuuugaaauguauuucuuuuugagcaguuuggugacgcuuuauuuagcaaaagcccuugaaaguuucaaaagcaacaauccaaagaacaugaguggcugagagcacagcggacagacagacccuccagcacaaggcuaaugcuuuucaaaauguacuguggacccuggcccuggccccuauuccuccugcccuuagagaugaugauacacauugucacugggggagggaacgaguggauugggccugauuaucugaauuuucugugaauccccugggugacugugauaugcacccaggguggagaacuagccuucuacacucauaucugagugcuacucuucuuaccucauucucuugagacucauauuuucacuuauaaaauuauuagagaagcaaaagaaaaccccaucccuuuuacauuuucugagagccacagggggagcaaauagguguugagcaccuccuacauugccagaaguuugacuuauagaucugguuuaaucuguacaagaacucaacaauguuuaaagaauuaauuggcccucagauauggaguugaguuaugcauacugcucaguucauagcuuauugucacccuaaggccaugcaagacccuccucuuauuuuguuauuguuccucuucaccccccauucccuacacccauuuccuucccuccucagagaaccaccuaauaugcuagaacuaaaaugaaugucuuuacaaaauuauauauuauuuuuguguguguuuguuuuaauuuacauaaaugauaaaucucuguaauauagacuauauagaaaguaagaaugcuuauuuuuucacucaguauuauguuuucagauauaucuauguuguauaaacuucccacauuugcauaauauuucauugucugcauuuauuccauuuuguuuauaucuuccccaguugauagacacucagcucccugcuaccacagagaauucugcagcuaacauccuuauuugugacccuuggggaccuuugugagaguuauaucugggauacguguccaggaguuggauccugggguccagaugugauguaugccucuuuaauuucagauuguuuuacuuaauagaaacaaaucagaguucccaucuccuuacauccccauuugguaugaaccaccuuuugaauuuucaucauucugaugucugagagugacauuuaauuguuucaauucuuaucuccuggauuacuagucaguuugagcaucuuuucacauacuuuuuacccauuuggauuuuuccuucugcaaauugcauuuuuauauccuuuauccaauucucuauuuuucuaauauucuagguguuaagcccuugucaguuucagagguuauaauaauuuacuucguuuauaauuugacuauuuaucaauaauuucuuuuuugaauaaaaauccuuacaauuuaauguagauaaauccagcaacuuucaucugugguuagugauuuaaguaucuuuuuuaugaaauaauuuucuacucaaaaggauauuauuccuguuuuugugaauaagguaguuauuucuuauucaguacuacugcccaaggucacacuacuaccuagcagcaggauuugaaacuauuaauaauuaccuguuaauaaauuaaaucauguuauucauauuuuaaaagcaaccaaguauuauuugcacuaaaacauuuucugaguuuuaaucagagaucucaaaaaauugcacccugcagcuucuaucagucagauuucacugaauuuuccuuucugccccuaaauucuugcaaaguaucucaaaucacauuacagccaggcugguugaaauuacagcuuuggcccucauuaagcuaauuaccacuuguacccaaauugagccauuucacuccaauaacacuguaaaccaguccuuccucugugaugucucugccuugccuaggaaaaugugaggcugaugucagaauuuucugucuccuuagagcaggagguuuccagcuauuucucuaaggagcucugggaugcagcucaaguguuugauaggcaguguaagaggaaugaggguggaaacuggggaaccagagggaaggcugggcacaggcccccuccucaauuuagcccacacaaguguugccuucuugguuuuguacuuuaggcacuauguaaguaaaaucuauuggaaaagggauucuacugcuaaaaggaaugggggagcuuggaagcacugucuuaaaaaacuagacuacuuaauauaaacugauuuauuuucaucucucugcucauguuacauuuguauaguguuuuacauuuuggaaaacacuguuacauuauuugaguuuauaaaaccugauaagguaggcauaucucaaccacuauggcacaauuuuucacaauuaaagcuccauaucacagaaucugucccagcaggugacugaaaggcugcaucucaggaguguggcagggauuaucaccggcuuggguagaagcuggaccuagaugaucccuaaucucccugcucgugcaaagaugcuaugacuggaaaugacgagagaggaaaguuaacaccaaaagaauuaccuaaauuaaaccuccugccuauuggagguagggaugaugaaauucccauguuuauggaacaccuguucuggucuggucauccaggugccgccuuccacugaauccuuacagcaacccuaggagagagguauugcuguauccauuuuaaaggugacaaaacugaacuuuauaaaacuaacgggaaaagcuuagauuuccucccugagcucgccagcucccauaccacugucuguucuuuccacucacaaggaugaccccaaauaaacaccacaucaguuagccgcccagaaccuuaucuaggcaguggcuguuuggggaaggaaguucuuuauaaguacuucugucucacacugggcaucacguugaugcuuacaucuuuuccaaugcucaccuccugccugggggucaagccacaucaucucugguuucuggcugcauucauccuccuuauugaucaggucacucgcugugacucagcuguuagcaucucuccugcuuugauaucuuggauugccaacacaaacccaugcuauuuuuacuuugccucagaaaggaagauuggaagacagcaguccagccuucugguuuaccaaguuguugauucuucuuggcuuucuccauucauucaugaauucuuucuguacuucaagccgaaaagauguguguggcuggaaagcccuuugugguggauccaucucuaaggccugaaugggggcugaaugugaucacagcuuuggagaucuuugcuuucucucuucugacuagaauccuuuacaguaugaaaucacucuuucccccuccuaucuuagauaaaagaauaaacauauugaaaaauguggcugagaaauuuuguuucaaauaugcauauauuaugaguaguguucugagcaagacagaaaaauuaccaaaaauaaaugcauguaagcuuagccuuuuauuaguagggcugauuguuuaagaaaccacuuuguuagcaccaggcacagugacuugagccuguaaucccagcuccucagggggcugggcagaaagauuggcucacuugaagccacgaguucaagaccagccugggcaacauaacaagacccccaucucuuaaaguauauauauuuuuuaauuagcaggaugugguggugcacaccuggauugcuucaacccaggaauucaaggcugcagucagcuaugaucguaccacugcacuccagucugggcaacagagcaagacuccaucucuuaaacaaacaaaaaacugcuuugcuaaaugaaagcuguauggauuucacaauuugaauuucugaauuucugaaaucuugcauuuuauaccagaaggcaguuuacucaugugucugaucauucuaaaccaauggagaguuaagaauguacauuucauuucggcugggugcgguggcucauaccuguaaucccagcacuuugggaggccgaggcgggcagaucacgaggucaaaagaucgagaccauccuggccaauauggugaaaccccgucucuacuaaaaauacaaaaauuagcuaggcgugguggcccacaccuguagucccagcugcucaggaggcugaggcagaagaaucacuugaacacgggaggcggagguugcagugagccgagaucaggccacugcaguccagccuggcgacagagugagacuccgucucaaaaaaaaaaaaaaaagaauguacauucauuucauauaguaccuuacguuguacaaagugcuuucauaugcaugaucuauuuuacguaauuacucuauaggguaaauuuuaucaucucuauuucauauaagcaaauuaagaugcgaaaagccuuaaacuuucuaauauaguacuaguuuaaaaagcaaaggacguuuaguuugcagucaccuagcccuaacacauacaaguaauuuauuucuuuagcuacaaacaauacuaaguugaugaagaaauaauauuauacuuugggagagcugauucauaagaauugucauucagcugacacucaggucaguaucaaggaggcaggauucauggaaguaagcaggguuucauaucauccgugugaagccagggcucuuauuugugaacugcuuuccuuacccuuuccuuacgcucuccuuucaagauagcuuccuguaccuagcugccacuggccaguuucagucaaagccccagcaacuuuccaaagguagaaaaacgugcaugugcauguucacaaaauauggcacaauuucaguuuguuuguagaacuuucagguaauaauccuugcuuuaaaugggacauggaguuuuaaaacuccaaacaaaucucugaacuaccaaguccuauauugagagacugucaaagauccuaccccacugcuguaugauuggaggauucuagcuaggaccacaugcuuuguuaucagcacaagucaguagaucagcaaacaacugcaguacccagaaacuauagcauagggacucauuuuaacucuuguauacaucacucaaaaccuuuuccucaugaccuucugguuugccuguuucacaaacuccucuccaaacuguccuccaagguggggcuaguagaacacauguucaggcuuuguuauuauuuguugacucguauguggcguuucuugucccaauucauuacauaaggcaaagauucuacuguaaggacaguaagaauguugaacacacacuugaucuuccacuguauccucggcuucaguuggucaaacucugugugcagaacucaacucacuuuugcuaucacagaaauauaaacauucugcaauuuucaccuccaaauuuugccucuuuuuacaagcucuauguaauuuccugugaaacaaacuuauuaaauacauucuauucccccaucuaaccuuguugacauuccucuccucuaauacaauagccuuucagaucaacaggguccccaaacagauacagagauguauuaaaguuuucuguuauuuaguauuugcuggguacuugccacauacuagguuucccuugaggaacccagucuaaugaauguggccaaugugaauuuauaaauuacacacaguguaauuaacauagcagcagacccagaauuucauguugugcaugcuccaccguuccuugucugauggggugagucguucacuuagagcaguaccccucccgagcagugugcuaauaagugcuuuggagauggauccucagauaaaucuugacuuugagauccuuucacagcuucacaaagauacacaaaauaagcuuuauagugggagguagaagugauacgugccauacauauacagaaaaacagaggaaacuaauauuuauugagcauauacugugcaccaaaaauucuuuucaacacuuucacuuauguuaucuaauuuaauauucguaacuaugcuugaggcagauauuaucuucaguuuacagagaaggaaauuaaggcucagaggugauaaauaaccugcugaagaaaucuuuguuccaauacucaugcuauuuccacucuauaucacuaaaaugccuuacaaaagauaucaaaauaauaaagugagaaagaauaugacccauuuaguuucaguuuucucucgacuucauugaucucuuuccuccuuucuacuacagguaaguagauaccugaaacauccuaagggguuggcccuuaggagcuuuaacuauuauggauauuuuaguaauuucaaaaauaaauccguuuggauuuggcccagcaacucccuccugucuuucuccuaugauuuacacagucuccgucaguacucauguuggagauaauuaacugugcugccuuucuaaggugucuuuccauaggugugccauccuaagcaugggcauuccuuaaggagaguugggcguggcagcaccuuugcuuguaaucagggccucucauacccuuuuuaacauaaccacugacaaacccucuauaguauccuuucuugggugggaauuauuacagcuccaguacaucuaugcaguaucucagaaguugcuggauguacucacuaaaugacccagauuucaucuuucucacaauuuaacacuuuaaauaaaugccagcaagcuucaccgcauuagaagauuacuauaugucugaacaacuuggauaucaauauuugucaugcagccuuccucgguguaacaucuaaagcaauacucauuuagcugacguacauucucugcaugguguuuacccaacagucaucacucauguuugcucaugagguguuggggugaugagccgagcugcuguauucucagcugggccuggagccugcuuaguuuggcacugauuaaugauauguggggacugauuaaugacauguggggagcaggcuguuugcagagccaccuuagaaacccaguuagcuaaagacaaauagcugagaguuggccgaugggagcaagggaggugggcucuugagaaaggagagucauuuugagagauaucagcaugacuuuuggugaucuuaacuagaggaagggacagauucugcaguagacaaugcuuuugggucuggcuucuugguagacaccccaggaucaggucuaagguauguuacccauguauucccauaacagcaucauuucucugugcuuugaguuucaccauuuauaaaccugcuuaaagagcuuaucuucuuccuaaucauaccuugagacaaaaugcacuuuauaccaguaaaguaucaugagauguucguuuggaagccguuaugccaaaagagcaagcauuuacagccuugcuuuuuauuuaccaaguguauuuuacacuggaaaagguuucaauauggccccauauaguauuuauuuugccuuauguccuuccuaugucucguuuuucuuucuuauuucauucaccuacugugucauguugguuuggcauccacuucuuuucuaaaauuguaucuuuuguauuuuuuauucuuuagguggggcagcgaggaaaggacgcauugaucuugaaguuguagagauaaugucucagcacccugcuuggggugccauccuuuuaguggcauggcaaaaccaagcacaaaauauuuuuuauuguccuuuccagaauagaucccuuucuccacagcaccaugugggugguuguuccuggcagagaacaccuuucucucucauacuguaaguuccguuggcaacuccugaccagggacaguagcaacaucgauuuccuaaagauagauauccccucguuuagaaggcauuuucucacaagcuuauucagaauacucaagucagaaguuauaaggauguccaagcucauuuugggggaaaaauacagagaggugaaaggaugugcugaagguuacacaggagcaguaggaaaagacagacacaaagccagggaggcaccacguguccuccuuaacuguucaucuuugacuguauagcuucauucgucugcucuaagaucuugcauuuccagccaucguuuauaucugguccuaucaaagcucguugaccaacauucucucuuuuaacccuuccccuacagugcaaggucugcacuguacacucucauuuauugggaaucugagaccuagagagguuuaggaauuugcccaaggacacacagauggcaagugagcaagccaaggauuuggaaucaguucugccugauuccagugccuguuguuuuccuuccaucuuucacuagagccaaacugaucuugagcaguugucuuuccauugaccugcaaaguucuaaccacuccccuuacuccacuuuuuagauugagauuauacccauccugcaggacccaucagagccugcuuuguucauuuaguguuucccagccaccuugaaauggaaguggucuuuccuccuuugaaucacauggcacuagagccuguucauuuggcaccagugccugcaaagcagacagccuggagcagguaggaauagggagcucuagguucaaaucccugcucugccacuauauggcguaugauuuugaguaagccacuuaauucuaucuuggcagauccaucaaccggaccucuaaaguccagcuuagccaaaaauuccaggauucaaaaguuauuauuauauuauugcuaauaauauugugagugugaguugaguucuauacuaaucugugccucccucaccccuacuuuccuguuaucuaugcccaccucaccccuaguuuccugcugucuaugcaaugccuuacgcagaagaaggggcaauggaguauugauaagagacacuuuuugaucuucaguuguaacucacucccauuuauuugucuguuuauucauuuggucauucauucauuuauuuauugcuggcauugaauuuuucuauuacuucccaagauuguuucugagaucuucuggaggccucaccaguacuuugggacaauauggucauagguuuggaauuaaauccuugaagaaaaagacuuuccauuuuuuaaauauaaccaaagcaaauaaggaaaagucacucuuacaaugugagauaucagaaaacaaaacuuaggcaaauaaaccaaaaauacuuuguaacauuuucagcauuacaguuuuuucagcauuuaaucagucuuuguguaccuguacguacaagcccauaguuaccaacccacacacacgaaaaaagaaccaauuaauuuaaaugaucaaguucaugccauguucaauggcgcauguccccuuuugcuccuaaaaucuuugaucgcuuuuuagcuucuacaguuccuugggcauucauuguaggagauggcaguucugccugccccaucagcagacaccauuuugcaaagcagaaaccaucuuugucccuucuacccccagcaaauucccuggcucccaguuuucaccugucagauguccaugcuaauuccaagacuccuuuaucacaauaauaacagaaguaaaauucucuugguggauggauuucauuuauaauaaacaccuuucuuauuuacuuacuacuugagugcuuacuuacuacucaauaggagcuaugcauuacucacuaaucuuuuuaccaacuuagugcaauagcauucauuaaucguagguuaaaguuaaaaacaucuuucauucaacucucacauucugaagucaacuucagcuccauguuuccauuguaauaguuuaaagcauaugcuuucuaauuacagaacuuggauucaagucucucuucugucauuuaccaguauaaaugcccugagacuuguuuucugcaacugaaaaaaaaggauagucccuauuugguaggauucuugugacaauguaaugaguuuaaagauuccaagcuuagagcacugugcccaugcuuaguaaacacccaggaaaugcuaauagucagcauucuguugccucuagcagauaggaggugcuuuauaugcacccaacucacuugauacuguaccuaauuaggugggaaaaaggguggguauugaauuuguuuucaguuuuuaaacauacguuuucuaauucaagaugagauacaugguaagguccaacauaagauguacgcucuucuuaaauaagaaguugagaacugccauuacacuauguaguuuaaaauuuauuuauuuuugaagccggcuuugauugucacuuuacaagauguaugccguuuuuucccuucuuucacacuaucuuaaaaaaaaaaauaacaaaucuuaacauggcauuggcuuugcuauauaacaaaacucuaauacaaauuauauccuuuuggaaaucauuuuguuuuuaauaaacaaguagcaagaacauuuuugauuuauaaauaaacauuacuucuaaaaaauccuuaguaauuucacccaaauuauaauucuaagaaaguuccuuagacauugauuauagucagagauuuuuuuucuaguuacaaaaucauugaaauuugaaaagaaggaaaauggugguugugcuaaacaucaguaggucuagaauuuguucacuauuucaguuuauucaacaaacauucaacaagcuccuucugagcugagugcuuggcacuguucuaggacccauaacuauguccuuacaacaaccagcacaucauugucagagguguuaguauugacuucagcagccaagaugggaagugauauagaaauucuguuuagcuguugggucaaauaauuuucacaaggacauaaaacugaacacaaguucaggcccggaaaaacacuuggauuaguccucaaggaagucuaguuagugcuuauugggacuucuaagaaaaccugauccaaaguuauugacccguccuguguguuagguaagauuaacuaagugcccaccaacauaggagauggaggauagugccauugugaaugccaaauuuagcggauuggugguggcuacuugcagacagaguccagguucagcagaaaaaagaagugccgugauagauuagugaugucugccauuggcaugggagagaggaguggugggauaugugccacauaauuguuguuuauucuguguccuccaaaggacucaucaguaaggaaagggacugcauucgggugagagaaugggagacccagcagauuucuggaaaccauugcaauaacuggcuucacagcugugagagguagaacagaggagcagaaaggaagagggauggaguggagaaacacaagaaccuuuucagaucuugcuuggggucacugacuucacacgacugaggaacuguccagguuuugcagagucagggcacucugggcuguuuuaauugucugaguuuuguagcuguggugggugacagguuccccuuuaaacauaauaaauggcuugcaauuacuuuacuuuggaaagcacucuucugcccugggacacuguaauaaccagccauagaagagaaaaggccuagggauuuaugagggugucccaauuuucaaccauuugggagaaauacagcagaacauugguacagcaguguguuaguaagaguuaaucuaucacugcuccucucucaacccucucuuucccucugcuuaaaacuaucacagggauucgucccuggccuucaugaagacuugccagaauuuuuuuuuuuguuugcacauaacucuagaaauacaaucuaguugaccuucaguuucuggaccaaaggggacauuuuccagguaugagggauuuuaaaauucaguagucauaaaaagacaaaugaagcauggucucuuccuuuaaagggcucaagguccugcuggggagacgaguagugaauaaauaauuucacugcacucugagauauauuguuguuaaagccauaggguaagaauggacauauauuucuaaaagcaaagaaacggugugcauaauaaaucacuuuguuuuccugccccuaaauuguauugauaauagcacuuacugagaucuacucuuauaauuuguuuacacagcaacuuucuaagcgccuuuuuuuuuugggaggucuugcacugucacccaggcuggagugcagugguaucaucauaguucacuugcagccugggcucaagcgauccucccaccccagccuccugaguagcaaggauuacagacaugagucacugcaccuggccucaccuaagugcuugaguuucucagcgguggacacuggucugguuauucucucugcucccagcaccuccucacccagugauuagcacauauuagucuugguaaauguuagcugagcgaauauaggccugaguauacuucuaaugcuucuaacauaauaccaggcaucaacaacuuauuagaaaaaauguagacaaucaagacauauguauuguuucaauauuucauuaauaauucagcugaauguauuugaaaacuaaaaugguguuuucaauuucucaacaaagaaugggccacuuaaaauaugacacaguuugaucugugcuaaaagggugaaaacauaauauuuucuuguauauaucacagaaucuugacgaguaggcucugaaguucaacuuuguggccacuuccacugccuggucugucuguugaggcaaguucaugaacaguuucauuuugguugauuguacucuccucccagggugauuugcuggaguggucuucgauuuccucugaguucagcagccuugccugauggcagagcugguuuaugggaaccagaccugcuuuuccuaccucauuuccccuguggucuugcuugagcagucugcuuaggaaaaguuuaucaaaucuccuuuccagaggggcagguuuucccauuucauuugucacuauuuaacagcuuaugcaaaacaggcuggcaguucuaaguuuguggggcuucggguucuacccuugauaugagacaauggacuuuucauuuauuucuuuguaguaacuaaucuuagaggaguucaaggcuaauuuaucuguauccacugauauuccucuucuccaucuucuguuuagcucauucauucauucacuccacagaugcuuauaaaacugguauuaaauaccagaaacauagagaugaauuggguaaaacccaauauucauagccauugaggagagaucaccacagugaccacugacuccuucuuuucaggccauaccaaugaguugagugaagaaggggcagugauugaguaucagaucuguugguaaacacccugaauguugaaagggaugccuguggauaucauuuauucauuaacaaagacgauaaggauuugcuaaccauuccuagcaucuuguuuuuuggcaucaugauuguguaacuuggaaaagaaaaauccauccagucucagguacuucuucaauggaauuccuccccugauuuuggggagcuccuagggaagugaauucaccauccccuccccaccaaggacaggcagaacuuaggugcaagaaagcagcaccccaggaguuacuccauguaguuuaggagaccuuccauaugggagggucauuccuuguaacuacagaaggauuuguaaaaggcuuuguuuucaccccauguuuggcaaaguauggauaaauuugaacaggcauuagaaaaaccaacaguagcaugauuauuaaaaauuuguagccauuuucucccaauccuguuggugaaagaguuuuccagaaaagaaacucuauuucuuucugcuuuucccccaccgugucuccucaaggucacauguuuggaacugacuugcuugacauguuuauuuaaagcuguggauuaaaugccacccacuaaugugauuugcuugggcuuugccugaggcaggcuccauuagacacuggugaaaauagcuuccuguuguccagccaaguccuucgauuagcuaaccagcaaauuuagcccaauugcuguauuucaauuugacucucuauuuaaauggagaaaagcagcuuugucacauggcuguuugccucuugaucucucaucucaagagcagacugcaaagagaaagcgacgaccccaaaccucaccuuuucugucuccucuuuuggaucagcucccugcagaugcuaaagaaagugagaaggauguugcuugcauaaacauuguucuucaacugagcacuaauugaguuuaagaugaauugcugguuaacguuuuugcuuauuuauuuuuacccauuauaaagaugccuugagccuuaaauuaaagugcuuucucaugaggugcagggcaguuauucauggccugugucugagucuuaggagugggacaacacccagugagcaccugugcugaacugcaggguaagacauugcauaacuaguuauuuagggggcuaacaccaaggcccucaacacuccuguuuuggauuaugaucagauucucaggaugcuugaagcugccugagcaccgcuauccccugccauccauuccuguuucauuagaagcugcaaauccaagcaaggcaguggcagcacugggagcagcucccuucccaacugcuucagugccaucuguuuggcucucgaggcacauuugaaaagucaccuuuuauacuuucaucacagccuguccuuagguucuccaggcgcugccuggacacugccagccacaagccugccugcucagggugggcacucauugcugcccagcucugauggagauucugggaacacugaccaucacugcugcccaaggagguaugggcuacuuuggaagauguuggcugcccuugcuaaagcaggucccuacacagugccugauccagguagccugaugcccuccacaugcuucucacugaggcagcccagggggaguggucuggccucaaguagcagguggugucugagggacccgcccaagcaggcugagagcaggcacaguccccuguccgccaaucugacuguccccagugagaguaccaauccuauccgugcugucgggagcaguugaagaucaagcuuuaggaaaacugugggcaguaacaagcggaggacucagcucuuugguuggcaucuguaagucacauugggcagcacagagggaagggugcaggcccuuucucccuuuucgcuggaacugcagucauuccuccuuccuaccuucuugugcugccuaauucggaccaguguuccuccacccuagcugugcaugcaccuccccuggagagcuuugcaaaacaugacccauguccagaacccauuccagggucagaaucucaagggaugaggccaggcaaagacauccugugaauuguauuauacagugaauguugagaacuacugauuuuagaggcuauuucuuucugguagucauuugaugagcccauuauucauaaauuaaacagauaauuucucaaucauuacucugugacuggacugugcaggcucuggagaugagauaguaauaaaggagggcacaggucauuacauuaugguacagucagugcuaugaugggacugugaugggagaauggggacaggaacccugacuuuggcugaagugcagcaggucaggaagaaugauaaagggugguaacaucuaggccuaggcuugacaaaugagcaggggcuagaaggaagguaauagucauggauaggaggaagggcaggaaugaaggcacaggagugaaguucaagcacugagagaauccuagugagacaagauuguggggugcaagggcuuggccagguaaggacgucucugugagaugggcagguagacggcaaugcauuggagaggcuggccuucacccaagaggcaaugcugggccccugcaggguuuaagcaggugaaugauaugaucagcuuugcauuuuggaaauaagcuggcuggagugaggaggagcuggaaggggcacaguugaagucagaagguuguuggguaaaccaggaaaggcaauagggcaaggguccagggagaggucaaugagaaugacaugaaguagaaggaacagauauucaagaggcaaagucaacaucccaccacuccugaaaacucugauccucagagcagaauuccugacuuucgucaacaugcagguucccaagcucaagaaguuucauuauuuugaucauugcuacaucacuugccaucacuuaccaaagacacccucagaguuacggauggucacaaauccagguauauggcacccagagaacaagacuuggguugucagugguuugcauucaagaauaacucaggaagaagaaaaccaauagagaaaguuucagucugcuguggaccauuauuuuucucauggcacuuaacuucguuuuugaugugaugccccguaagcuucgcauugguuggguugugaaaugccauccuacagaggaggacuuacaaggaccucacugcccacauuaagcacagcacuggcuuuggcucuaaauuaggucucaucaccccuucagacagaugcucacaggagcuuagagcucagagggccauuagggacacacugaagaaacagaggcaggagaaguuaaugacuugcugaguucucuuguuacuggaugccacgauuagaccacacauccuuugugaaaugcagagaagcuuuuuugcuuuuauuaaugaauaaaguguuucaaauucaucugguauaauugaggacacaugaugaaauugagaggagccagagguugcacacuggcugagcugugauuucaaagcaguuucucuccauuuacauuaaggcugaccccacaggacccuagacaaggaggcccuucaccaggggacugcagugguggaaccacagugagaggugaggcagaaaagagcaaggacaggccagagcaucuuccaagcccugaaaccauucaggcagagucgagaauaccauuugaugaaaacaccucucuuuaaucugucggaaccgauucuguucgauuuguccugaauauaaucuugaaccacccugcauguauuauaaaacacccagagucaucuugugaagauacguaaguuguuugcaagcugcgaggggauuauuuuuuuuuuggauaagaugucuaggacugugauucagagggaaccuuauaacauauugggugcaaugcucuacaucucuuaauccuaauuaaagauuauuaccgcuacuuuauagauaagaaaaccaagguucagagaaguugagugauuuucccagcuuguaagugacagaaccagacuuugaaaugacuucugccuaacuauaaagccagguguuguuuucauuuuacacuaggcauuggcaagcuacugcugcaggccaaauccagcccaccaccuguguuuuguaaauaaaguuuuauuagaacacagccaugcccauucacuuauauauugucugucauuauauaaguugccaugguaggcuugaguaauugcagcagacacuguauggcucacaaagacuaaaauacugcuaucugcccuuaacagaaguuugcuaaccccugucuaagccucauuguccuaaaauaaauucagaaaccucaacugcuacuccuucagcccagacagcaccuuuauuuucucucuccuucauuuuaauaugcacgacaccacucagcaaaauguccugcaugcauggccuggccuagguacuccacucccugaucuggcaaaacuauaaagugaaacuauuuugaguuuccggaagcugacccaauuuuaaagaccucuauauggagguaggccagggagggaucaauaauugucccuaccagguaagccaucaguuuguacccucacuucugacacuuuuucugggcaaggccauuucuccacauuguacccuuagaguguagccccaaagcgaucccuggccucugggaaauuauccuucccacacaugagcacuuagggucuucuucccccagaccccucugcaggcagaaucuuuccaauucuuugguuguugugagccuucaguccuuuuguugugcguaaggaacauuccugggaagaaaaaugguccagcaauaaagucucccccacaugagucauuuuuagcuagacuggguuggcaucuguuuuuccuaagacagccuuuucucgucacugugaagauaaaucaauuuaauggacaccacugguuggggguagauuguacuuuuuuuguaaguauugaccacccauuaguggcagugcccagcagcauacaccauuguaccuucuccagaaacccuccacuuggcuguagaucuauccccuuccaacucugcccuggaagcaagcccaaaaugaccucuggagcccuaagaugccaucccacggccacgggcuuuguucuuuggcuuugugaaagugugcuuuauaaaccuuguuggcagacucauaauucugcuaaggacuuauuuguugugucaaucuacagaucaaaggugggagccuaaaagccuuugacauugcucauaccaaccauauuacacucugggauacauuguauuaaguacuaugggccaucauacaaguaagaaauaguuccugcccuccagggacuuacaaucuagacagcaugaaauguacaccaauaacuagcuucacugcuugcuggugauaugacaagacuugcuggaaguuguagaugccauauggaagacucagaaggggugcuggauauuugcugaaaucggugguucucauacuugagcaugcauuaaaaucaccuagagagcuguuaacacagauugcugggugccacucuuagcauuucugauucaguagaucuagggugggcccacaaaguugcauuccuaccaaguggccagcugaugcaaguguggcccaggaauacccuguccaaaauauuuuuauaggagaagcuucuuacauauguaauuuccuucugggauuguaacagaacugacauuuguugagugucuaauauguucuauucaguauauuagguacuuuggcuauaauauuuucuuuagauuuuacaacccugugaauuucguauuauuacuagcacucuacaaugagcaaacuaaggcuuagaaggaggaacuuacauuugccagauauccaguauguaccauaaaggauguggggcauuauccaauuuaaaacuuuuugaauucuaaaugauuaguacuccuaguuuaggagugguaaaaaaaaaaaaaaaagaugaguaaagauaguaaaaaugagucugagagagauuaaguaucuuaaggaaggucaaagccccaggaaacaugcaugcuggauucaaaaucacguguuggguucuaaaggcugagaagccauacugcagcuaguaccugucuguuugccaaaagcuacuaauguagauuccaaaagcauguuuucuuucaugcuugaagcauguacuuccuaccuccuugccuuugcucaugcugcuccuucugcuuagaauucccuucucccucuucuucaccugaguaacucccauucauccuccaagcaaaauguugucucagccaugcagacuucuguaacauccccuccuugccucaacuagagcaggaauaaggacuacuuuguaagcgucccaacauacuuuauauuaucaaauuccuucacagaccccaaaguccucuagugacauauccuugguuacagaaacaaaaaaauccaaauuuuucauuuuagccaucaaagccaucccccaucugacucaacuugccuuucaaccacaccuugcagcucccucauuucuccaacuaaacaagaccgcugaacacuuccccacccauggcuauguucuccuucccccuccaagccuucacucaggcugcugcugucaccaagaauggccccuccccugcaccucagccugucugcauguggccuuuccaccagccccagcuaaagcccuggugcuaugcccucagcccuuugggagggccuccaugaguguucauggagugaacaccugaccccuugcuccccugugacaucgcgucuucccuugggugaggcaaguaugugucuuuccacugucccaggcugagagcucauccggcacagggccuccagugucgcgucauuccuugcacugaguaggugcucacaaaacauuuguugaagaaauggauaaaugaugcuggaugaagguuguggguuaaaggcaggaugggagaagugauuagacaaggagcacguggagccucaguacgucuugcaauaaaacacaggagcgcauuuacaugaccaacagugagagcaggggacauagguggacuuugccagaaugcuugauuccauuuaggaaccuccugugcuuguaccuuuaacccggucuuccaaggagccaaaaggauuucuccauuugaaguacaaaugucuugugggacucucacuuuuuuuguaauguguaacauuauuacagaaaauaugggcuaagaagacuucagaaacacaccacugacaugguccagacaucgauugaaugauggggcaauaccaacaacaaaugcagauucuaagagcgugcuuucuuugaugucuguguuuaauuccauugauuuucugaugucuccgcaacaccgucuguggguuuuucaaacaaaugguaaagggugugauguuuucuaaagaagauagaguuaaggauggugguugugaaugucuugauuugugaaugucuugcacaugugaaacauuaacagagacauaaagcuaucaguuguaaaccuuguagcuaaauugcaaaggcacagaggaauguuugacuuauguaacucuuuugucuucuuaaaaaauuuaaugauaccuuucacagagguuauuuuccuugacaugcagagugaccauagaacuucucagggcuguuggcaacaaaacugugaagugaaguaggugaagcuagucuuugacuccaccaaccucuguccugugcuuuauacccacugcuuauaucccuuccucuggggccaggugccugcuuuuuccuucugccuaucaaccuagucuuaggaaaaguucuauacuuucuucaaacugaacuauaagugauuuggggaaaauucaaaggauugcucuacuuauguauucuugcaucuagcaagguucaaagucuuaagcuagaggaauggggcucuaggaguggauuuuaagccuaaucuauaaauaggaguuaaagaguuccccacauuccauaagggaucaucaugauuuccuugcagaggugcacccaugagccuguaaaugcaggcgauuuuuaaaagucacuuguugaauuaacuuugcuauuuccauccagcuuccuucuccuacuccucccuuucccuggacaaucucagccccacagcugguccuccucuuggacuucaccauauguauuuguugggauucuuugguugcacgugacaggaacaaacuaucauccaagccaucuuacaaaaaaaaaagaaaaggcucuuguaaccaaacaaugaaaugcagggcuugagucaccuuuacaguugaacaaggcuuaaccauuaacacucuuucacacacacacacacacacacacacgucuguuuucuuuguccuacuacugacauuggucucauuaucuuccccuuuccuauaugugaagggacauagucucacagcucucaauuugagggaaagagagcaugcuucaggucugccucaagacguggcagaaaagucuggggaaggauuuugauuggucaguucaggucacgugcccacuuaggcccagugcugugucuaggcagaugugguguaaacaccaucaucucugugacagccccuuaagaaacacaugacaugagggaaucaucuucuucaucuguaaaaugaggggaguggaggucacucuauaacucuuagcuuuaaccugauucuauuuaaaaaucauaucuucauuuuugguauucuuuucacuauaucuuugucucucaccauguccagccucccacaagaaagccagauaucauugggaaacaguaaugaucuccuuggcucaauucuaagucucucuaagugggcaaagcagcaccccuauggugcccgucauaugauacagcaaagcauuauaguucaaccuugaccaaauuuaaucauuuaugccacaugauguaagaugaucacaauuuccaaauuugucaagcaucccaaauuuggcauuuugccuaaguuaaaaaaaaaaaacaaacaaaaaaccagcagaucuggugaaagaucaacuggaaauuugccuguaugacauuaugcugggggcaugaaacaaugcuuaugcaguucguuccaauucagaugcaacccagguucaaagcagcuaauacacagugguguuccagauuaucugucuauuuccauucccaugaaaugucuucaaugaaaagccuaucuaccugccaacagaguccaucagucugucaucucuaucauuucugcacuucuauuauaaugauccuuggccauguccaccuuucuuaugagaccauuaguucacggaaggcaagaaauauaucauaugcauauucguucaacaucaaaucuaugccaaauccaucuucguggguugcuugggauccuaggauucaacuacauauaugugacuuggggcaagucaucaauccuuucucagucgguuuccuuaucuuuuacauagugauacuagcaccuccuccacuguauuggagggaggauuaaauaaggugauaaacagcaaacugccuagcacagaauucaacauauagcagggugcaucugugguuugucuuauuuuuaaguucccaaaugacacgaagaaugguggcauggguggcagcauagucggguguuuacaauccugauauccagucccaguucagccacuuaaugaccaaugguaugauuuugaaguuucuuaaaguuucaaagccucaguuucuucauauguaaaguggacuugaugguaauaucuaccucauagguuugaguggauaaagaaagaaaacauagauaaagcaccuaccacagcaucuggcacauagauaccuauaaaugguaucacuuguugcuaucaccuguaauggagagugaaaaaagaagcagcaagcucugagaugcuucuguguuuuuucuggucuuuucgugcuguaugcguccugaugaagaugaacccacauuaauagaggcagugguuaauugccuccuugugggcuagcacuguccugaggcagaaaauuacaguauucuucuuuuuucuugaagcuuccagugggauaugucuguucuaauuuaauaaaccucuuuuuuuagugccaggcucaaagaggcaauaucacauguacauuuccaaaugcguaauuaguaugaacacucaagcccuaacuacauggcgaaagcagucugggagaggggagugugaguaucuguucacauucauuugaaccagcuccagccaaacuuccacaguuaauuguaucucagcgauuuucuccuggaaaaaaauaauuacuaugcagggcuuuagcugcugcuuggccuucguucauuccugacucuugaguuagcauuguuuacaguguugagucagcagcagucacauaaugugucaagcaaguggaguacaccucccacccugagcuuccccaccccaccaguucccuguuaucaauccauuuccuuccuuguguuccagcaaugcaagagaaaauggaagaugggcauaauggaaguugacuguuuuggaaaagcaugcucaagguuaaugcugagcaugcgugcagagggcaccagggaagcagggagcccuuaacucggaaagacuuuucugaaugggaaaggucagcccccaggaaaaugauggucuuccuuucaucuucagguaaugcagguggugaaggagcagguuaugagagcacuuacaaccaagccuagcucccuggaccaguucaagagcaaacugcagaaccugagcuacacugagauccugaaaauccgccaguccgagaggaugaaccaggaagauuuccagucccgcccgauuuuguaaguuaccuaguauugacuucuaucucccaaaagacucuaacccacuauuucuagaaugaccgccugucaugaagcugggcuguguugugagcuccucagggaaggccagcagaagacauuccaaguaucuccauuuaguuaggggagucucagcagcuccuugaggaagggcugggcugaguggagugggccaguugcuggaagaauggaucuaaaccaggagcuggcccuguuagugacaaguccuccagggauuuguagauuaaaaguuuggaccuuuuccaacacuuggaacaauuuuuuuucucuuugaccaguaaaacuauauuucaugugggugcccuuugaauagcaagaccuugugagccagccagagugaggcccauucauuaaagcacuaugaaaaugaaaguagcaugaaucuaaaugagugggagugagagcuugagaggaagagagugaacuaccuccucuuugcccuguuggcacugguuggcaucggagcaugcuauauggcccucaugacugugaaccuacauuccuacaguggggaggcagcaagccccacuucacaggacuuugcaaggaaugccacuugcaaccauugcaaaaugucauguauuccaaucuuugaaguguucugaacucacacaugagggguauuuugcuugcuucaucuuuucuuagaacugcucuguuucucuuccuuucuccuguucuaagagcugggucaauuuuguuacccguauauuuuaaagaggaaaaacacagggaaaggcauauguguuugauauuuauucucauuuuguccucagaagacuggacacagcuucuucugagcuuuugcaugaagccaacuuguaacauaguuuuaauucugaaggcagugcucccccaccacacacaccugcucucuuucuguuucugauucuuucccuuuuuguuuguugcucuccaguauuugacacuucuaaugcuuggcaauuuguaaugcacccuucuugcuauuucauuucuuuacgucccugugagaugggcaggccuuacucccaugcaaaggcuaggauaggcaggucuuacuccuaugcaaaggcuagucuggaggggugaagaccaugccaacaaguggaagagccgggacugagccucgagucuacugaccccucagcuaauauuguguuugcccugcccuagcuucuuugcaaugugagagacugaaaugagguuuaaaaagugcacaggucuaaaaggacaauagcuaagcaguaacaucuaccguacauuuguuuuccaaucuuaagaagcacuguuggaaacuguggaguagaacccuucagacuaguuggcaugaaguuaguuagcggggcagggaaaaugcuuccaaggcgcuuuggcuucaucauugcaaaaccuaagucauaccugcaugagcaccagcuagccuugacaagaggcaccacugggguuuugcauugguccucagccagaagacgguaacagcuagaaacaccaagcaggaugcacuuuggauaagugacuggcuccucagagaugcaguuucucaccugcaaagagggacaauggcuccuugccccaucccagggccuacaguguacuggauuucauaacaugguucagcagauguauaaacguaggacacuuuauuaugcuuuccauaauaagucuuaaaaccugaagggagacuugaggaaucacuuccguuaaagccaaguaacucugaauuauguuugaugaauuauguuugaccuugacuuuuuccaaguaagaauguuaauuaacuucauggcaaguacgaacauuuuacuccuauuuuggcuuuauaucuucacuuccuaagacuuugccugugacauucugaaguuucuuuccccuuuauuauaagaugcucuuaucuuugaaacuauccaaauaugaaggaaaucuccugcauggauguagcuuuugcauaaucccucggccauggaccaagaaguaccauggcccacuggaguucuugauaucuguagcugcagcaaagucacaaagagugguuaggagccacagcauuuaagcaggugggccagggaccaguuugauagugaccccagucucugaagccggcagaggguagcugcgauauguuuugccuauuagagugaucuacuagacaggaauucauuaugggguuacaugaagucuaacuucugccagaauggcucacacgauaaaccaagucaccuaagagaaagaaauagaggaguagaccauguaugcuuguuuucauucauuuuuucauuucacaaacaucuacugaacaacuccuacaugccaggcccugcucaaggugcugggggcagacagagacccagagacacuuggucucccucugucacaggcuaggauuaggggugggggauuuaccauagacugggcucauugcuuaguuacaggaagagcacagaggaguuggaucuaacccaagcuugaggguuaggauauugggauuuucgagcugaaaaucacccuuaaggccauccaguucaagcuuuucauuuugcagacagggacagcaacuuggcuggggccugaccaccaguggggaaucccacuagccaucaggcugcccuccucccucugugugugccacacacagcaugguggcagaccucagcuccaugcagaccacuugagcaauacacccuguuguuauaaaauggucguuuucugagaagaaaaauguaaacuccaugugaauaaauauuuugggggaauauauauucagugggucaaagaagcucuguuuuauuucuuagcucuugacuaauuguuucaaagaggagguauuuguuauguccuauuuagugcaacuuaccaaggaagauaaguccauccaauuaauuggaguuaauggauauaaaaagcuugaauaguccaaaaaucgaucauuuaacacuaugcuggagaggaaggggagauguaaagacaaacaucagugaaagcagggaagcaaaauguguaaaacuuggacccaauuugcuaucagacugaccuggagucauuuacaaauguggcucuguaagcaaguuauguaauccguucuaagccugcuuuucucaucucuaaaaaugaagauaucaaaaaugucuacaucauuggauugucauaaggauuugacagagucaugcaugaaaagcacuuuucauaugccugggaccuaauauccacuugaagaaauguucugucuuauuagcccguaaccagaauuuaacaaguugugauacuguugauauguaaaugauaaaacugacacugugcauauauuuguauuaauauaugccucucccuugucuuagaaaggacaauagaaauccaugggaaagaaaagcaaaaacaaagccaggaauaaagcugauaccuacccugcaaaucugcauccucgcuaaagaucagccgcaugcuucacugaaagcuuucucauaaccaaugcaagggggacagucuggucaguuagacaauguucaguguucagacagcugacaaauaucuaaugagugccugccacgugccagacacuauucuauguguuggcaauucagcagugaagagaacagacauauuucuuaccccuacagugauuauauuuuaguagggagaaaaaagacaauacacauggugaauaagaugacagcaaguuaagaggagauacaugcaguggagacacaaagcaagauaagggaaauagagugcaguuuuaaauagguugguuagaguagcugucucuaauuaggauggugccaauugaguacagacuuguaagggacuaagggagcaggccauguggguauuugggagaaggguacuccagacagggagaaccaccagggcaaaggcccugagguuggagcaggucuggguguuuagugaauaaagaggaggccagugugcuggagcagaauaacugagggggagagagcaacggaaggugaggccagaaaagugcagggagccccauuacacaaggccuuguuggggagccauuggaggguuuugagcaaaggaaugaugugaugugacuuagguguuuaaauaaucccucugaugcuguauuggaaauagacacuaagaaagcaaguuuuuggaagcagggaaaucaaaugggaaagcuauuuuaauaacccaagcaagaggugaugagaaaugauuauaguguacugaaaaugagauccauuuugaagagaagggacaaagguauuuccugauugauuaggaaauaccuaagggguguaagagaaagagagaagucaaggaugaacucacgguuuggggccuuaacaacuaaaggacagagcaaguggagcaggggaucagaaguucggcuuuggauaugugaagcuacgagacguccaauuagacagucagacagaugagcuuggaguucagcagagagauggacaguggguaguugcucaguagggcagaccccaagucaaagaaggaaucucaccagucugauggugcugucugucuucugugcauggcaguggccucacugggcuugaacuugaaauuguuuuccagaaacagugcuagacuuugaauugcucuucacacacucuuuaaaucuucucuccuuuaaucuuccuccuuuuauuuauuggcaagaccuuuggauagaaugagaaagauauuuagcaaagcaaagcuaguaaacccaugacccuggccugauugaccccaagcucagaauuucaaaacccaguuauagcccaugggguuauuaccuggcuuaccccagagggcagauaucggccacagaaacauacuguagggcuuacuuauguuuucuuaauguguaugaauuuuacggcuacugaguccauucgccaggaaagaagaaauugcuuugaaaaagaaagagcuggugggcaccugccaugagccggguagugcaauagaaagaaagaaagagcugucucauuuccuucauugccuggucauguuuuguaguccuuugaggcuuauaacaaaaaaaaagcggggaguaacucuuguagcagcagauucucuuauucugauagugcauccucagaauaugguuccaugaugaaaugcguugugacaggcaccucugggucuuacacaaaaaagucauaaagcaucaguuaagauuacucagaauuccuucaguuguuuccuucucuuggucuucaucacugcauucuccacuccauuuuaauaacucaacccuggccuagugaaacuguuauuuaaauacauauaucuauaaccuaagaauugaugaaauuccaaaacucuuucucccagauuuucuccauccucugguaccgugccuuugucugcacccugucaccuggacuuggaaguugggagcagugauuuauugcugugugcagcucccuggcaguuacccacuuucuuuuccacucagugcaggguucuucaaagcugcaauuuacugaguccauuuuagguagagcuaagugcugauaauaaauaguuuagugaucugaaagccugaaaugagacccuaagagaccuguacagggaaggcuuuacaaaugucccaaacuauuauuaggacugaauuuccauauuaugcuuuauagauguucaguuggaacaguaucaaaugagagaauguuugagggcacuuaagccucaaaaaauguauuaauggaguacuagaauacccuguuagauggccuuauccuuuuauguaacuuuuuucuuuuuucucaugaguaaaucaaagcaguuugcacaaggaaaaccugagucugugcccauauuccacacguaaccuccacgaguuguuuccccuucuguaagaugggaaugaugggaaugaugacauuaauacuuuccccaaaagcuguuauuuucaggaaggaaggaaggaagguuaaaugagcuaaaauugcauauugcacuaccuggcucauagcaggugcccaacaagcaugaguaccuuucucaccucagaauggagcacugugugagaacagguugccugcaguucagugucaaggcaaguccagaguuaagguggaagcugaugaaugugugagccuugacuacaggguaauaugggccuauggacuguuuggcuugaggaaaggagagaaugucaccaaagcaaauucaguugugccuuacauuccugcucagugcuuaauaaagacuuguauucugucucauuugggagucacagcaggaaagauucuuauucccauuuuauagaugaagaaacugagacuuagaugaguuacaggaaaugcuagucgugagcagagccuagacugaaacucuagucuucugacuuguagaucuauguucuaaccaguacuucuuacacugcuaugaggaaugggcucugggucucccuguccagcuucaacuagaauaguuuuggcuuuacuagacucaaaugcuagggcacuacauaaaauuuccuaugauaaaaauuucugcucuaaaaaaaaaaauuugaaaaccauuucacucuaucaugauaucuuugcagcauaauggaucucaaacuaaauuauauugcauuagccugagacaagauacaaauaaucuuucauuuuucccaucauuaucucagucucugugggcuagaaucugggacaguguuguuguccccauuugugaaugauggaauuggaagcaaaagugguccugugguuugcucacuacacaguguuugcuguggaauaguaaucgugugguugccuaauaugccuguuuaaucagaucacaaacacagucccagaguuuagcugguacaggggaaaaaaguugaccaaggauugauugucuuagcagugcugaauggauuuuugcauaacuuuguauccguggcuuuguaaaauaaaagaagaaaauuuucaggacacuuugcucuggaaaaacaucacugaaguagcugguucuuuuguggaauucuguaaaugucacagaaucuauugugguguuguacuuaugccccuggccacugacucuuaauaaacacuucucuaaagcaccaaguuggagguauuagaugcucaugaaaagaugcacuuguucuccccugcccguaugcccaugaugcccaccaagccacacucuguuucucaaggcaugcuguggaauauguguuuuuccucuaacagggaacuaaaggagaagauucagccagaaaucuuagagcugaucaaacagcaacgccugaaccgccuuguggaagggaccugcuuuaggaaacucaaugcccggcggaggcaagguauuguuucuggggacacuccaaacuuggauaggguaaacaguggcccgcucccuggagaaucacaagggcaugguguugguuuacggguaggccaugcagcauuguacucaggacaggaauagcaguccaggucguuucugguucccaugcacacccagagagaaucaaaguccacaauuaccagaagagccacagaaaugaagagccauucuuugcuauuuagugccacaaaaacugcuagugguggugucaacaauagcugacacguauaugagccuaccaugugccaggugcuucugaaacucuagucuucugacuuccggaucuauguucuggccaauaccuguuacaaugcauuacuuuauaaagcauuuuauccucaccauaacccuaagaaguaacuacuaggauugugcccaguguacagauuaggaaauagaggcacuaaagggcuaagaaacuggcccaaagucacagaagagcaaggauucaaacuccacagcuccaggacccuuccuuuuaaugacuccccuugcuguaggagagcuggcacucacuguuugguuugaucuuggagcuuccagcauggauggcccuuauugucaaaucucccacacugcuucucuucuaggacagaguuauuuuauauguggauauaaguaacagugaacuaagauaggguagcaucacuuacauaauuucucaaggcagauuucugaauugucucuauaaauucuaaccucaaaaugucaaauucaaauggaugucaaaagaguagacccaacaggugggaaacaugucuagcuguuucuuuccuggacaaguaaagcacccuugacuguuuucuugcucucuugacaugcugcugauugcacagcuagagucuucauaccacacucuccuagaagcaaacagccagagcauaaaacugaaaaguaagauuugggaagaggcaaagagauugaagaagaggcaggagcaagcacaggcauuagcagcuauacuaagaacaccaguuauggcccaggagaaacuuuggcagauauuuugaaaccugcuggaugcccugcuaagccacagagcucacccacuaaugacaaaaaucauuuuguguuugucagcugaacucaucccccggccauuuacuguaacuguccugugcugcauauucaguaaauuggaaguauuucucaugucaccauuaaacaucacauugaggaacuuccaaaggcagaacuuccuggaggaaugaaaaugcaguuucuucacagagaaugagaagcucuuagagugaauuucaagcugagccucaggagaggacaaugggcagaguaauaagggcugaguuacagagaaagccuccuauuagugagaccaguggaagagggaacuccucccucccauucagccacugaagaaugaguucaugcccuccucucaucgcguuccuugcaucgggcaucaugucagaguaaaugguguuccaagaagaccacagggcucaguggcaaggacauagcccuggaaccaggcaaugugggugcgaucuugccucuacaccuguccagcugugugaccuugggcaauuuccccauccgaaauggggauagcaaugccugucucccaaggcuaucaugaggaagagaggugauuaugaauguagcaacaagaaacagcaaaacaagggagcuacugcuguucuuuaagauuguguaggaaaaaagcagugagccagagugaguggacuuggugccaggcuucucaguucuuuaaauaaccaccuaggugucuuuaggaaggacacaugaccucucaaggccccaaguucucaucuguaaagugggaggacaggauuaggggauccaggagcucauuuagucagagagucgguuguaugcccugaugucuuuauugccuuuggaaaaaucaauguuugggauauauugcccccauaaagaugauuuauaagauuuuuacuuacuugacauugggcaaagggcacagaaguuuuggggaugggaaauggcaaauagacacccauugccuccgcugcugcccagcuagagucccucacaaccuagcuccuagcaccaauuuaaccuucuagucuacugcgucaugagacuucccugacuagguugaaguggguagguuguaucagaauaauccuguuucuagauguauuaacuacaggguuuguuguuguuguuguuguuguuguuguuguuguuguuguuuaaaaaauguuagucccguaucuauaaauuuuuccaauuuucuaaaaaugaacuaccccugaacaaaaaaauauuagcaucuagauuauaaauuuaugaguugagcucccuagggagcaugaccaucuguguuuaauacaaaaucauccuuccgagugcagaaaggaaggcuuuuugguauuugguaaauggauuugaaaucuggugacuggcucugugcuuaaaaauagggauucaaagcagacugugcugaaauugguuuccuaucaccccaucaaaacauuccauuuagauuuacacagauuaauaagaacaugacauuuuuaaucccuucgagaaagacgcacuucuacaugagaucucagacugggauggacaaccgccugccuggugccaccacagguuaaagagcagacacucccagugcaggagccagcaccauacucccucuaaacuugucugacaaugaguaggacacagaugagugaauuucaguaguuaacuuuauaagggaaaauaugaaagaacuuacagcuccacagaacuggaaagugaaggaacaaauagagagugcucgacugugccacguuuggcuagcagguccccgaguugauacuugcugauccuucugccugucucaugugcagcucugcuacuggaauagucacaugcagacauuuacagaucuggguuucugggaauucuaaccacauuaggacugggagguaauauaucucaaaagacacaauaagcuggguugaagucccuguuccuacucacuagcuggguagccucgggcaaucugcucaaugucuuugugcuccucuuucuucgucuuucaaauggggauaauguuaguuccucuaucaaauagccauaagggguaaguaaaauuauacaucuauagcacuuugaugcuuggcagauuaucaaacauucauuaaugauguuugcuauuaauuuuagcucguagcgccucagaauauagauuuuuuuuuuuuuuuugagacagucucgcucugucacccaggcuggagugcaauggcaugaucucggcucagugcaaccucugccuccuggguucaagcaguucuccugcgucagccuccacugggauuacaggcacccgccaccaugcccggguaauuuuuuuguauuuuuagcagagaugggauuucaccauguuggccaggcuggucucgaacuccugaccucagaugauccacuugccuugccucccaaagugcugggauuacaggcgugagccacugcacuuggccagaauguauauuucuaagcacaggagguggaguagcaugggagcccacacaccugcaucacuccacucucuccccaagcuuauacauguugaccacgaaguauaagcucuggucgcagaauccuuggcauggaaauugccuggcuucuguguucccuggacuccugcaggagagauuucagaugaaaccccagaagaugucuguguuagggacacuguauuaguccauucucgcauuacuauaaagaaaugccuaagacugacuaauuuauaaagaaaagagguuuaauugguucacgguucuguaggcuguacaggaagcaucacagcuucugcuucuggggaggccacaggaaacucccaaucaugauccaaucaugguagaagguggggcagggucagcgaggagcuucacauggccacagcaggaggaaaagagggaggaggaggugccacacacuuaaacaaccagaucucaagaggacuuuaucacuauacaguaccaaggggaggauggcgcuaaaacauucaugagcauuccacccccaugauccagucaccucccaccaggacccaccuccaacacuggggacuacaauuccacaugagauuuggugaggacacagaucgaaaugauaccagccacuauuugcuucaugagaaucuguaggcucaagaacugcccccuacuucucuuguauuuuagagaugaaggucuuucagaaucacuugcauugaauggccuugguaagaguccagggcuaacauuggaaaucauuucaagaagugauaacaugaaaccuccugcagaggacagugucuguuucauugaccagcauucccuaagugcugacaugacaggcuuauguuggaacucaauguugggcaaaaugcguaccuaccacuccugccaacaaggcugguauaucuuacguugcucuggaggcccccucagaagaccuagagccaaguggugcguucaggcaugguaaccauauugcccuguuguggggagcaggucauuccuuucuccaucccugguugaaauuuuauuuuaauauuuuguuacaaaaaggcagguauaaauaaauacauauuuucaaauuaugaaaagccaguucauuuucaugaaaaaaaggcacuucccaauaggucagaauaauacauaaucauuguuuccaaaagauggagggacaguaguguggacgagagggacugccauugacuagaagagcaggaaacuacaaauauguucugagaaccaauucuggaagauguaggauccauacuuuauguguguuuuacucauauaauuaugaccauuguacauaugaagaacagggauuucugaaguuuuuacaauuaggccaaggccccgcagcuaauaagcaucagggccaggugugucauccagcuaugugugacuucaaggcaccuguuagaccaaaucaucuuggaaaguaccuagggacuccggugucauuugcucugagcagcuguguccagggaggcagaauucagaaucaaaacacaaaucuguccuuuuaaagaaagcucagugaagugaggaagauuugaugcccuucgucucuguaucaauaguuguuucccuuuuuuguaccaacaaaaaaaucuuagaucucaucaccugaaagaugacauuucccuuuaaacacauugcugggucccucuuguuuugugacuuggaaaguuuggaccuuaggcagaaagccgaccuuguucugaacacacagaagacuuggcacauuuuagguuauccuugggaaaauucagaauccuaauggaaguguucuaaagacaucuuuuagaaaaaccuguucuccucccuaauacaggacucuuagggcccccggggucagcccccagcugcugacagcgggcucugcacucaaaacaaagauguguccugauuccauggcagucucgggguuugguucuugcugugcccugugucucacugaacuggcuggcauuucacaccuaccagugguugccauuguucagcuugcugggcucuccuggagacccagggaccagccccaagcuugucuugggccuggaugauugaagacagacggugggcuacacugucugauagaacuaccuacggcuguuuaaguuauuuaaaaugaaagaaaauuuauaauuuguuuucuuaguauuggauaaaacagauacagagaauuuccaucauuguaggaaguucuguaggagggcacugcaaaaauuacaguugacagugguuauuagcuccauaacaaucuaugugacauugggaauagcuuuaaucagcccuucuuaccaggcuugugaacucugaaagcagcucuucccucuuauccuucacacacgcacacgcacgcaagaaaaagauugaaacacgaaauucucccuguauuuuguuuuggguuuggagaugaagccuggcuauuaacguacucucauuaguaauugacuggaagaccuccacauuaacuauuguuuucuccaaaaugcuaguaaacaaucuuugauaauguucucacugcuuccugcuaauugcuuuuagugacgcaauucacucuuucaucgcccagagggauaaaggaacaaguaacaucaugcugggguuugaaaggaaaauacacauuugucuugccguaaaagaaacugcaaaucaagcugcugcugguggcugacacugaaacugucucacccaacaugucgacgcacugugcugaugcuauccuuguaguggcucucccuucaagacagaaauacacaacgucuaagccuuccaaagcuaaggacuccaguuuuacugugaggaagauacuggcugaguagccucccauuugauuaugagucaagacaaguuucucagcguuuucagccccuuuuuccaauauuuugccauccauccaagacuuccuaauugaugaggaguggaacacaucacuuauaucugugauguaccaaucuuuuugcuuuuuaucguuuuaguaguagacagaagaagagaaacuuguauaggauaagagaauuagccagagguaggaggaaaaccaaggcaagauggugucauacaagucaagggaauuucagcuuuggaaaggaggaaaaucuguccgcugcagacccuuuggguuuucuuuaaacaaacaucaacuccaacuuugcaaggaagauggcuguuuugccucuugaaacucugacagauagccacuguucucugaucauuacuguauguaagaauauguugcacaagagauuucugcauuccuauuuuucuccauaguauugccagaguugcugauuugucccaguuccuacuucccagaccugggaaacaacaucuuucucuuagcugccuugaagaacugagggagcuccuuuuccuugaacuccuuggccuugucuuucaugucuaccuuccguucuaaugauguuucgcuacacauaguagagugcugugugcauuguagacagccacucagcaaauauucauuggauaaacaaauuuauccugaaaguagagcagcaaaauuuucgaagucuuacaaaucaauauaucuuacacaugaauauuaaguugugcaauuuacucuacaauaauauguguuuguauuauacugugcaccaguuaaauuucuuaauucccucaaaaucaauugagugucauugaucuuguuugauugugacacauuggcuuggcuucaagucccacugcugaccccuagaguuuacuuaccccagcuugagaagcaagggauuccuauaaagcacaggccaagaccuaacucacaauaagcccagcauguccaaguaccacuucucacugucuuccuucccagccucuaucacccuuuagucgcucacacagccaaacguaucaccuagaugcagcaaggaaaggaaaacuuuauagcagauuucuccaguuggcuuucuggucaucacagccacguagggcaggggaaaguauccguggggagaggcagcccccacaggcccccaagagcacuguugauguucagaaagccauugccuccugcucuggaauucacaguuccuauuguaaguuacaagucaaauccccaagguugcucuccucaugaaaaacccauaaguacacauuugccuaauuuaaaugucugugaauuacucagagaauaacuguuuucucccuuugaaaugcucucccagaaaaaugacccauguuugguauauacauagcauaauuuugaaauuuagcaauuucaaauauuuuccuagcuguuaaaugacccuuuucccacucaauuuuuuccacuagaguucagauuccuuuaaaucuauggauugccguacucugacuaugcuucagaauucucaaacucuauuuaaagaugaggaagauaagaaucacagagacacucuccuuuuguggaucaaauuugggcauuuucuuuguucauuguguggcuuuuacuuccauucuuaaaacuucuauuucuauuaaaagaaucauaauuaaaccauggguuugcagugacagcaauuuuagagagaaaaccacuuuucuuaaaauauaaugaagagcuuuuuaguuagaguggcuugaaaacaaauuauauuucaggugcaauaaugagguaacuuggccaaggccucaaaggguaccaaccgcacaguggugcaaaggggcuuguaggugacugacaccucaugccuuaggcauuuugaucaggucgcuuugggucuucauuuaucagcuuagccaacgccaacugugcaacuuuuaugugucagacacugugccaagagauugggauguugcaauuaugaagacagugacugucaucggagagacugugacucuuccacacugucagggcuggaguccucuucuccuaucaauauuaauuguucacaauacacccucaagggcaaguuacuuaccuagggucuguagcagauaaugggaaauacuaagguguuaacauuaggcuccaauauugccaguccaagccaaacugguggugcaaagaagacuguagaacaucucagaggauggggagaggcccuucggcugcagggauaaagagggcuuccuggaggagacagcugcacaagcauugcugucacaguucaagucccuaaccuauaaaaagugcucuuugccucuuucuuccugccucauagacuuacucaaaauuucuucucacuuuugagagacugaggcaguaaaguugaggaaguuguuuauaaggaugacccuaaucuccuggucauaccuauccagagaaguaaauucugggaauuggagaggagaaugauugugcauguccccauucuuuggcuaaauccgugaauuauuuagaugauuuccucaugaaucccacccaccauguguauuaccaguguccuaacaauucguucaugauuaaugugcgugugguagccuaggguagggguuuguuguaucagcuaaaaucuggccuuggacacaacugucucaacagucugaaauucucagagaggaaaguggaagcagaaacauucugagaaaucuguuuuuuuuucuauaucucccucccucuuuugucaguaaaugaauaaggagcaguucccauggugguuaucauuagugauaacauaaccucuggaagccaccaccucauaaaaucuauugcuauugagcuugaagaguucaaugacuuuacuaaugguuaccaaauguauaccaagcaggacaggugauaacuaaauauuaaagucaaaagggaauuuauugcccagggcccuagaauucauucuuccucaagacuuaaaaucaaaugaacugcuuguuuccuccaggcaagaguauuaagaaauaaccaggcuaguauuuugauaaaccacaaucacuuaccuuguaaacuuguguuuuuucucucagacaaguuuugguauugucggcuuucgccaaaucacaaaguccugcauuacggagacuuagaagagaguccucagggagaagugccccacgauuccuugcaggacaaacguaaguagcucuccuuggcagaggccugagugguggucgguugguuguuuccuagucacaauauaucacgcaacagaacuaucagccuaaguaagcccuuugaacacaucucaucuaguuguaagucgucgccugagccaucucaucaaguacaagaccuggauggacuugggguuuggaacugaauaggggagaauguaaaauggaugcaaagguaucuuaauugaaagacguaaacuggggguucaaauguccacuuuuuacauuauuuauccaggugcugugucaaggagcaaaaacaauacaaaccugauucugucagcugucuuuuucugaaaacccaaaauaauuucuuauuuucguaacuuauaugccugaccccuacaacauuuauuccuuacaauuuaguguaucccauaguuaugacacagaguuaauggcagagccaaauauagcuaguuuaccucaaagacacuuugaaaaugaugauccguuaccucuacuguuugcuaaauauuucucuuguauauuuuuuggcuuuuucuauauguugucuguuuuaacauacaugcuuuugaagagacaguaaugugcaggauucuuuuagccccacagggaaccaggugccagguugacaguguuaacaauacaaauuaaacaaguauuauagaaacacugaaauacacaagggugauaaauuaauuuggaggagaaaugagauaaaaugaacguagccucagaggauaucccaaguagaaaaauccgagagggagaaaacauucagagcacuuuuaaauaaccuuuaaaagucaccuugaccuugcaguguucagauaagcgugucccagacaguguccuuacccagagucucacaccuucuguccuguuacccuggggcccauggaagucaaaucuggauuaccuuccucacagcucacggccauugaaggugaaaauaacccaugagugggaaauuuccugacacauucagacucugcgcugacaucucaggcagauagccuagaacauucacucuuccuccagcuuaaaaaugggacagucuggucuuugugaugucacuuaguucagaaaacgaucuuguuuucuuucauaggaaaacuuucuucccagcccacauuauuggcucccuaagucagggguuauagaaagaaaucugaaauccacugcugcagagagccugggacauugucuaugccucccugcuuuggggcaggaguuagggguguccugggccucuaccuguaaaugaggauccuccuuucacaguuccagccuuccccaccccaccuuggccaagcuagaccagcgguucucuaaacguggucccuggaacaucagcagcaguaucaccuaggaacuucuuagcaaugcacauucucagaccccauucccagcccugcuaaaucagaaacucaguggguggggaccagccaucucuguuuuaacagauguucccgccaguucugacaugcacaaguuucagaacugugauuccccaaauguggcuuucacuaauaauuuuaaaaaaacaaaaaguuuaaguaaauuaauagcauguugcuaacuuuuaacuugggccaaaaaaaaaaaaggauauuaaaaaauaaaaucuaaaguuuaauaucacaacccuuucauaaaagaaaggacccucgauuacaagaaaaaaaaaaguaagaaggaccuaaucuuagauaaaagacagucccuucugcuaaacuaaauuagcccucugaaaaacucacaccagcauucucguuuuucugcauuugcuauuaacuggugaaaagcucacugguguaaacucccuugugaacuaggaacugaccagagcccagcgauguggaaucacugcucugcagugguuaaacagaaagaguugagguuauuguugguugaagcaaauagcagcucccuaggaggucccccacagccccauucuuaaccugucacaaggggaaaaguggucaggacagaacaaacacagcuugacuccccauaugguccagugaaucugcucucccacuaacaggacauaguguuuagccccauguuuauagggauguaaucacuucucaacccaaagauaggcacuugaccgacagguuugccagguguuagcacagcacccccaugcuaauuggccagcuaccuaggauauuggcagccacagcaacaaagccuuguguaggggcaguuccuggucuugcccacaagcuaaugccccccagcucugcuaagacccucacccccaagacuccagggugaaaauaacuaaccuggaacuagaggugcugaugccagggagagccagcuugccagggugagugcaggagagcaaggccagagcugcaaaucuccacacagcuuuucgcaguggccacugagcaaggcugguucuugaagggauugugacagccccuccugaccaugccuccaaaacucuuagcaacugcuuuccucugaaaugaaguuccaaagagcugcuccaaaaacaguauauccauugcaagaugaacuaacaaugcauacuuguguggaucuauuuaucugcacaaguauuuauccacaccuugugggagagugugugugugagagagagagaaagagaguguguguguacuaguaagacuguauccuucugcacauaugugcuagagaaauggguauacucauguaaugaauugaaaugaagcaauacugugccugagacaaaaaaaaagcccggccuaauaagcugaaguuucuugcugcaggccugccaccuugguuugcauuuaauuccaauucugcauucugccuggagcaaaauagccaccuuuuggaacucuuaaaagucagaaaccucauuccacuggaaaaaugagacgugcuuuuaauuaauguucagugucauugcucuugccacauaacauugcccucucuugagaccaaggcagagagugucuugugccccuugaguuaauccgugcugaauacugagcuauugauaaaucaaauaguauaauggaguuuucuuaauacagauagugcacaugaggauugagggugccuccuuggcugucuucuccaaagcuuuaggaaaucuuucuuuuuguauuccuuuucuuugucaggaaauuuggccuuugaaaaucgacaucuucuuacauccccccucuccccauaucccucccaagcugacuuacagguugucauagcccccaauaaacauaggaccccacugcuuuccagccaugcccuggguuccucacugccucccuuugaaagaaucuaggccagcauuccucacucccacaucagagggggcagggaggaaaguucuggcucacccugcccauguggagaugaagccugcuccaguggaugcgaagagcggcgacacagggaggcacugugggcaauuugggucaccaaagcacagcgaauaauucaggucucuccaucuacagaauuaacucugauuauugauaaugggaauaauugcaaauggcauuuauugagugcuuacuauaugcuaggcccugugcuaagggcuuuacauaaauuauucucaacaaccuaaagagguagauaauauuguccuuauuuuacagaaaggaaacugagauacagaaagauuaaguaacuuauucaaagucauaagauuaguaaauaguagagaaagaucugaauguaacugucuaacuccauggccuagauuuucacccacuacuguguacugccuagauuaaaagccaacaaugaucucagcuccagcaucaggauuuaacucucagagcaaccauaugggauagauaauguuagaguuacaaauugcagacaaggaaguugaggcucucaaaacuuaagcccaaaguaguagaggcgguugguggauguagaauucaaacccuggcacucugauuccaaaggcgcaucuuuuccccaccauuccaugccauguggcugaucugcuaggccacagagaccagguucuucaugcagcuauccugggaugagccuguaccuccucauauuucugcccacaggagcuucuacuauggagcugugcacacagcaagagcucaaggcuuacuagcuacuuccuuugaaugguuucugccugaacuuggaucucacugaugaaagcugaaacuauuuuaaucauggguggccacauuugcuuuuucaguaguauuuuuguuuuaaaucacaauuaaacuuccuuccacagguauuagcauucaaagaguuuccugaauguccgaagugauaaccacauuuggggcugugcucagcaugauuuggggggcuggccccuuacaaagggagaaaucauggccuagcaggggaacaugcaguggaagaagaagcacuaaacccagcucuuuucaccuacuaaccuagcuguguaucauugcauaauugauuuccucccuuuaggaucagucuucccaucuguaaaauaggaguguugaauuaagauggucucaacccagcucaaacuguaaaaagcauugaaagaaaugaggccaugccccaggggguaaauguggugggagggugcguucuucacuggugacccugauucucacagaucuggagcccacuucuuuaucuugcuuccacacaaaaggccucaucaaaaugcuagccuggcuuugaagucaucaagagcccccugcagccuccuuagaguguagauucuggagauaugagucugaccccucuguuucugcucaugagaauagagaggccaucauuugagccuuucuaaugccuaaucuucuggugcaucuagaagacaaacuaugcaaaaagcaaccuuuaaaagcuacacuguauuuuuagaacuuuguguuuuccuuuuagucauaauccuaugaaugauguagcagcuggucucuaggacaagggacaaugcauauaaaaaaauauauauguacuuccacaaaaccuagugaaaaagugacgcuucuccuuggaagccuuucuauuagagauucugaagaccaccccccaggacagacuaugguauuacucuugucccauuccauacaauggguuuucaaagcuaagggcuaacuuaccaauuguagcuuguggacacugucucuaguucauggaccaugcuauauauuauaacaaaaaaacuuucuacaagacacuugugacucaaacucuauuugaaucuugagaacguuuuuuagaaugaguuuguugacuauaucacauucacuucaaugguggguuuuccauuggaaagucagccaacuucccagaguauccaaaugucccuuccuacgguagggauuaggcagccagaucagcuacugagggaaaggaggccaguucuugguuaugaaaagggauuugaggagaacugaagucaguguucauggucaaagguagguucaggaaucauagggaccacccacaggaagaugccaaccccaagggggucaggcaaagaggcagaaaaggggucugagaucagucaggaggggcuguaaugcuaccuugugcugcagggauaaacaaccccaaaaucuccauggcuugcauaacaaaagguuauuucucacucacguuauacaacauacacagguuggcaaagggcugcuccauauagucauucaggaacacagaccagugugcaccaugucuuccauccucucacuuucuguuuauuuccaacccuaggaauugcccucugacuaucgucaccuuguccucccugagccuccucugcccauccauccauucccugggccucuccugugacaucuggauggaacaggucacuccuucaguuucugcagcaggggaagacagaauggagggccuccaccuagaaaagaagcauuuucuuucacauuucauuggcuaaaauuaaucacaugaccugacugcaaagguugcugggaaguguaguuuucuguggccagaaggaaggagagacagcuauucauaacuacaaguaaugucuaccagaaggguccagaaucagguugcaagauguggugagauauggcaggggaaccuacagagauuccuggaagacucaucacaaccccacucuuaggguuacagagaggccuaagagugucaacagauauggacaaaguuguuaguaauuuuaggguaccuggaaaauguuagcauuugaggccuucuuguguauuguuuuaauauucuaggagugucaacagauauggaccaaguucuuaguaauuuuaggguaccuggaaaauguuagcuuuugaggccuuccugucuauuguuuuaguauucuagguauucuguaauuuuauccuuaucugucaccuucacaacccaauuucccaaugaaaggaugugagcuuuaacugugaaaucucucaucaucuucaucauuaagagagucuaaggaauugauuacuuggcauucucacacaucccaaauucuugguaaagccacacuagccagcgugcauaccuugauucauaaacccauauggggcuggaggguuagggauuggagaggggcagaugacuuugcauuauuuuaaauuaagguuccaaaccauccuauugccuucuuucuuucaguugaucuuuuuguuuuuaauuuuuuauuuucauuucauuguuuguagagacagggucucccuauguugcccaggcugguuucaaaggccuggccuuaagcaguccuccugccucagccccucaaagugcuagaauuacaggcaugagccacucacuguucccagccucuuucaccugaucuuaucaaaaguuuuaagugcacaaacccuuccauaucuuuucuuaucuuccgccaacuccagaguaagacaugagauaacaucauuuugucuaacugcauuauuuccagaauccuguaucagaaaggaauucucccuuuauuuaauugaguuuaguuuuguugucuguaaaacagggauaauaaaaccugcuuuauagaauuaaugagauggcagagaaagagauuuuggagagugagaguucagaacuguuuagaguuggauaaauuuuuugagauagggcugcuuucucucauccaaaaacucagaaacuaaauagaugcaaaugcuguaacaagagacacugauauauguaaagcacuuggcauugcucuugucacacaggagcccucuguaauaucaguaugaguaucacuguuguuauuacaaucacuguuauuucuacugcugcuucuaaugccaugacuucaaacaguacuaugauggguguuuuuuuaggucuuuguuucacugaaccaaauucugcuuacaagcaagcucuuucucuccagggaugcuuuuucccagaauauaagauauauuuuaguuucuaauccugggacacuaccuggcuucucuuccucuuuucaacacucuucuuuuugcaguaguuucugggaaugguaaccacaguagcggacccagugcuuaguccuguuucuuuauugacaucaaaguuuucacaugguguaguuacuugcauuuucuuuuaugaauugcagugccgguggcagauaucaaagccguggugacgggaaaggacugcccucauaugaaagagaaaggugcccuuaaacaaaacaagguaugauuuccaaauuauugcaaauagcucuauuugcccagugcggucggcaacugcagccagccuagcccuccuuuauagcaguguucgugugugugcguguguucagacacacaucucuuauucagcucuccuguuuccugucccgauuccuuuuacgucucuuacccuuauucuuucucuuucugaccccuuuucugaugcucaccaucuuuuccauucucucacuuccugccuacuuccaacccuaagaauugcccucacuauugucacuuuguccucucuugagcccgcucugcucauccguccauucccugggccucuccuaaccucccccauuuauguuuauuucucccuucuccaacuuccaccccaauaucuuucauugucuucugcuguaaucaugcucuuaauauccuccccgggaucucagcgaagccugggacaggcagagagcagcugacucaaagaaucuuagaaaacuuuaaaggccugauacccuucagcauuguggaaaguaggcugugaaauaucuccaacucagacuaaaggagaaaauuuucccagaaguguguauuacuuaagcccugcaauaccuuucaccauccccuccuaguuuaccaaccauuccauuaucauuccauuacagagggcacaggagggaauauuauuugaaaagacagaagaauuucuuuugcccgcuggaaguauuugcccuuggagaggccgucagggagccagugcuuuguuuaugccucuuagaaucuugugaucuauaccauucaugaacaaaaguauccagauuaucuggagcacccagaaaaucugguaccaaaaaugucacauagaucaauagguugcaucuuuauuuccagugucaguaucuaagagggacaccaaaaugauacacaaucuauuuaccaaucagcguuaaaauaaauaguuuccacuguguaauuucuauuguuauaagacagggaauccaguucuuugcaggauggcccuaucuauaguuaaggaaaaacaaaaguacuaugaaaauacuguucaggaaggcagagggcaggggaugcagcugaagaggcugauuguaagaucuuuccuucuuaaguucuauaacucaccucagcuccaugggaacuccuuuguugagcccaucacagcauugucauguaaugcauuugauuggcaagcauacugauggcagggcaugcccaagaggccaggaucuguggucuaucuguuacacagcaccaacggggguuuccguuuaucucuucuccaugcuauggggagacagagauucuauagcucagcagauuagagaagcauccuuagcuauagcagcaaaucuccaguuuucaugguuugccuccuguggagcagacuuucuucaacacuagccgggauuaccauaugcugcacaugucagguauucucuccacaaucucggagagcacgggcucugcucagcuucagccgaggagguccccacaguuacguaacacuuggggcugagcuggaaacaguguggagaaauuggcaauaauaggggucugggagucugcaacccagagaagaccaggaaggguguaccuggaaaaauagcaaccugccagaauucaagugugcuaaauaaagauagagggaauuauguaaaauagguguggagggacuuccuguuucagccccaacauauaaagagcuugagaguugugcucccauccucagaauaaggagaagcgggcagggugugguggcucgcgccuguaaucccagcacuuuggaaggccaaggcgggcggaucacaaggucaggaguucgagaccagcagccuggccaacauagugaaaccucgucuguacuaaaaauacaaaaaauuagccaggccugguggcaggcaccuguagucccagcugcuugggaggcugaggcaggagaaucacuugaacccaggagguggagguugcgaugagccgagaucaugucacugcacuccagccugagcaacaagagugaaacucugucucaaaaaaaaaaaaaagaagaagaagaagaagaagaagcagaacaaagcggaaaucaacaaguuuucuuggaccuauccuagaacugagguugcaggcaaaccaucaccguggaauguggaaagucagauguccaagaagacauaauaauccuuaacaugucugaacuuaacaugaagauaucaaaauccaugaguuaugaaacugauagaacagaaaggagaaauaaacaaauucauuauuauuaauauauuggagacuucaacuucccuuggucaguaaucaguagaccaagcaggcagaagaucaagaauauugaugaccugaacagcaccauaaaucagcuugaucuaauugacauuaauagacuaauccacucagcaacggcagaauacacauccuucacaagcucaaaggaaacauucaccaagauagaccacauuuuggaccguaaagcaugucuuaaaaaauuuaaagaauagcaguuagacaaaguauguucucaaaucacaauggaauuaaacuagaaaucagcagcagaaagacagcuggaaaaucccccaaauguuuggaaauuuaacaacacacuuguaaauaacccacaguuccaggaagaauucccaagagaaauuacaaaauguuucaaacuaaauaaaaugaaaauccagcuuaccaaaaugugugggaugcagugaaggcagugcuuagagggaaauuuauagcauugaaugacuacauuagaaaagaagaaagaacgaaaaucaauaaagcuuccaccucaggacacuaaggaaggagagcaauuuaagcuuaaagcaagcagaagaaaagaaauauaaaauuuagaguagaaaucaaugaaacugaaaucaguagagaaaaucaacaaaaccaaaagcugguacuuugaaaagaugaauaaaauugauaaacuucuagccuggcuaaccaagaaaaaaaugagagucacccauauaacagauguggagaugauuucauuugaacaugugagguaguauauuuggccuuguaucagacuccucucuccuuaaaggagacuaaaaaaguaaaaccgaguaaaugauguuuugcaaccuuuauuuuucacauauugucaugacacucauaaaacauaggauggaugaugauggauagauggaugauggauggacagcuggagaaugauggauggauggaguacgccacuguaaacagauaagacugcaaauagaggcuacuuccugggacucacuggcccguauuucuagcuacccugggcucuuccagucugccaugagggauaagacuagcagaauuucaagcagccuggcccuuuaauuagcauauacauggaauuuacuugucuugcaauguuacuaguguucauauauaccaugucaucaagcaaaacaucaaaaggcagaaggaaagccacgauuuuaccugcugaaccccccaacccacaccccuuuccccguacuccagaggugcccuccugucuaccucugggacuucuggguaggaaaaggggaccugcagccuaaaaggagaauugaccagaauguguucauaagaggucugucaguacacaguggauggaugacaaccaaggcaaauugcuggcucuuuggacaguuuuuccagcuguggaacagcuuuugacauuuugugccaugagacccaugguuaacuuaaucaccgagcaaggcaaacugagacauuggcaucuguaaaagagauacuuuguuaauggcagaguguugauaacugaucauccucucacccauucggucucugcugauguucccagcagggcccugagaacagaaagaagaaaauugguccuuucccuugaggugucuauugcagaggcauuuguucauguagucagucauccacucagucagcaugggagugccugaaauagcacaggacuaaaugggguagcugggguccugucuuucuggagcuuagagucuguuauguuuaacagaguucagugcagcaggcacauuuuuacggagacaagaaaugguggguucuucacacagggaucagaaaguuucucauugagacuugaaaagaauugccaugaguagauggaaauucaguuggaagguuuugauuugcaaggauuaaggauucuaaauucaaacucuauaauuuauaaaaauaagcugauuuguggcugugugcuuuaaggugggcauucuuggugcuugucucacugaauuuggggcuuuuaggucaacagucaacaugaaaucaccagagugaagauccauugauucagauaggaguauauuugguguaugagaagcuuccaucuucccauuugccagaauuaagcauuuguuuuuccagugugaugcuuaaaccugaaauaggaagcauauucuacugaagcugauguucuagcaucaguuugaaaacccuggucuuagccaaaaaguccuuuauucacauuuacuucauucaucauccauucauucauucauucagcaauguauugagcaucuccuuuguccuaggugccaggaauccaaagauaaauaugaccuggccccuggcccuagguguccaguagauaacauuuauauuuaaauaugcaauuacaauucaauaugucuaugccaaaaaaaauuaaacauggagccugggagaguugagaaaggugaugcaggacauggcaucugaucuagcuuuugaaaaggaauuggccaggcagagaaugaggagaagacuuuccaaaaggaggaaaaagucugaaaaggcacaagggccuuugcucaugugaaaagcauccucuaauugggaauguugaauucagaguauaggauggauggggauggggagaagaauauggauuggagaacuauuggccgguuacgcugcuaagauagauuggggcuggagaguuguaacugccugaagaagguaaucucuguuauguacuacaugaaugaguguuuuuugccuucuaaaauagaaacucaaauucuuagauaucuggacagcaauaagcuauaguucugaaaucuacugcuauuucugugaccauaauuuaacacccacacacaugccgaguuauauccugugucuuuuaucaaaagguuuuacccucaugaugaccuggauagauagagaaccaacauaguuaagugaaugcuagcaaaauggccauauguggugaguuaccgucaaacaauguaaggauuggcagccaacacugcacacugaaaauauguugcauacaacucuacucuuguuaucagucgguuccucauuugacccauggaagauggcaguccccaaacccaggaaccauuuuccugagcaucugcugacacagcgugccuugucuucugucccagggccagaguguugaauacaaaggucaggggccucagggcauggaaggauguucacuuuccucugccuccacucucccuaggacucaggcuuccuccacaugacaagguggcaagcaggcaucagugcagcagagaauggagagaagcugcuucuagauguaauuuuucacugcacuaaauccagaggaauaaaagagcuucggucaugagcaacaaagccccugaacauucgaugucuaagugaguguugugguguguggaggcaaguaggcccugaggggggcacagaucagugacagucuacuccaccaccaccuggcgccuucucccucauggacaguguggacagguggcaguuucuggaguauuagccugagaggugcuauugcuccuggcucugcagccuccccgcuccaagugcugaagagcugaccuucaccaaugacucaacaacagcaagccagagacaucaauaaaacccauuacaagcgauaacacccuuuaacacagacaugcagcucagagaauuaauuccucccacccccucccaggcagcuuuggugaaauuaaagugggaauugacauucucacgaauuucccauuuccugccuguguuuaucaggaaucuaggucaugacaguucugaucauucaugucgugagugguauaugucauagaagggcaaagcugaaaguuugccugcuccuuuuccuuccuucuccaucccccugcagaagagaaaguaucacagcaauaaccacgcugacacuguggucucaagugacuucagcacccuguccggagcacaucugggcugcagugcuguucacaccggcucuugucagcaaggggugaucagccacgugauuucccugagcagucaggcacuugucacccagggucagcccaaaggggccuggaugaacuuuaccuuuuccuguuuaccuccaagggcccccucacgccacuguaauauccugacugguuguucagaagcaaagcucacucccuccuuuuucuuucuucaaucucucaagcaugagucagagaguuuuccuaauaaaugacucuaagauuaguaaagaaaucaucauuuuaaugaacaugccaaaucugaguacaauuuguaugaauuuuugaaauuauagcuuagcauuuuguugaaaaaaaaguuguaagaagagauaaugaccuaugaccuaucaccuuaccauaauuauuuucauuucccauauuucuuuccagucucuguccacaaguaggaauuguucauaauugugaucaguguguacaugguguucaugucucgugcuuuucuccacuuaacuuuggcucccuauaauuaucuuacugaauggccaaauacauuucccuugguggcuaauuuaugauuucuuuauuacccaaaagagggagagguuaguuucucauaauguucuuucagauaauaauauuuggcuuuugcuuucuuuugaauuuuucuuuugaaauuaucucaggcauagcaucucugguucuugauauguauuuucauauugauuuuuuuuuaaaaagaaugauaugaauuuauaguacuaauaguaagucugugacuauuuuaauuguaaauuaaaaggcccaagagagaugguuaugggaacagaugcuauacuuaauggcaaauuguuuuuguuuguuugcuuguuucggcgcccuuccuuuuuacauuauugucuuuacuggguaggccugagucagggccuaaagaagaauagaaaaugaggagagcauuuuugcagaauagcucccauuccacgacucagcauucuuuccuucgcuuguuucuauuucugucaaggugaggagaccuuuugagugugagacgcugguagaucuauccucagaacaagaccugcccccucucaaugagggacagcuggaggugaaccagacacugagaacuccaugagagccagaaauaguuagaugauggacugugucaggacagggaugcagccacuuuggaauaauucuuuaauccgucugaaauucugaaaucuguaggcacugaccucaucuuuuugccuuuuaucuuucuggggcauuuuugcugugagucacaggccaaagacaaacccucuaacagauauuaagguagagaaugaugugaagagauuggcucccuaagaaagaauguuuugugggcaauuacugagcaguguggcucacagaucacaggaggggagagggauggucaucacuggugccuaauagaagcacagagaaggaaggcacacuggaaccuccaugcuggaacaguguagagcguugguuuggauacacuuggcucuucucuuccagacuaggaguccucaggaugcugagaagagcugaugacucucaucuucugcugaccgcucagaccacuagaaugaucgucuuacccaguauugguacagcauguacaguuugagaaguguggcuuaauguacauauuagacauggcacugagugccuuggucauuggucauucaccugcaaugaaaugaaaaaugucacuugguuccuagacuucugggccuggcucauugcgugcacuccguagguuuucaccaaugaguaagcccgugcuucucgauuauaccuugcagucucugcuggguaagaccuaagcuuuguguagccuuugcuguacaguagcuuaaaggucaaaggacagauauaaagauaauggguucaccuagcagccuccuuaaagcuggcauagcguccacauuuuagggaauucauaccucugugggccucucugucuuucuuaggaugauagaaggaagggcaguccuuaauccuguugauugggaguuuacuggguuuuuguuuguuuguuuguuuguuuguuuuuguggccucucuggaagggagaugcugaagaaaggagaauaacacaguuuugguggcgggcgaggaggcaggcggugcugucaccuuggacacucauugagccucucuaagccccaccucauaaaggagaugaaaacacuugcuacaugggcugcaugcgaauuaaaugagauaguucacagaccgccgugaauggagagaaggaaucaugccgugaaccuugaagagcaugguuccuccuuccaucagccucauugcagcuccgcuuggcuagacaagcuggcccuaugccauggucaaugugcagccauuugcaacugcaaaaugaaaugugccgauuuuccuuaaggugcuguuuucucucaucucuuguaggaggugcuugaacucgcuuucuccaucuuguaugacucaaacugccaacugaacuucaucgcuccugacaagcaugagguaagggucucgggggugauaauuuaugagauaauguuaucuuuucucaagaaaaauauagaaagaaauuuuacuuaagaaaaauagaccugccugaaaaaaugaugaaccaaggggcaucuugcugacuuggaggagaauagaaaccucuugacaaacugcccguugcaacagauucaacuucuuaguagcuugauugauaguucaugguaaagaaaaaggauguaaaaggccucaaaugcagcaaagguauacuuguuaauccagagaaagaagcggcccugguuacagcuuugguuuucauugaauuuuucguuuuuggucuggauuuucccaagauaaacuggucucucuucuuuaaaacaucugaggaaguagguuuucuaccaaauuucuuuaagcuauuuuaagagguuuagggcugucucugcuguugggauuuuauuuucgagaugcuuuuauuccuuucugacaucuuguuauauguauaauuuguuucucuucuuguagcacgcugucagcuauauuuaaaauauuuagcauaaaucuaggaaaaugcauuuguaagauaaaguagcaguuauggcugauuuaacuuucuuuuauaaacuggaacccaacaucaugcuugaaacuuuuauuuuuagaugauaccauucaaauuuuuguuuugcgugugguugcauaaacagcuuuagaaaggaagagaacauuuuaauagaaucugacuuuuguuccccauuuccccuaggacauuuagcucauuuagaaguuauucaguaucuaguuuucacugguuugaagcuuuugaauaaaauuguauaucccaaagagagaggaaagauuagacacaaauccugcauuuagaacggugcuuaaauauaauucugugucacuugacauuuaguuugcugaaggguaagacuuugucuucaucuuucugaaaauagauacuguguucuacuguuucuguuuuuaaauaaaauugugguucuacacaggccaccauauucaagauguauagagcuguguacaaaacuacuuaaaauaguagaacuuuggauguuauuuaaaucucugcaaggcuguuuuccccaguguacauuaauuccagaucaggauaaaugcucugggacugccagauuuuuauucauaucugccacuucuuauagauacaaugaagagaaaaaugccauaugcuugugaacacuuuuaauuacuucagaccacuuuccuucuauuaccucauuuuauuuccauaauuauuccauacaauagaaaguucuauuacagacauucucauuuaucaaaugagcacggagagaccucccagaacugaauaccucaacaauagaaagguuaacacaguuggcccuugaauagcauggggguuaugggcaccaaaccccccacacaguugaaaaucugcccauaacuuuugacuccccaaaaacuuaacugucaguagccuacuguugaccagaaagaagccuuccccauagcauaagcaguugauucacacacauuuuguauguuauguggauuuuauacuguauucuuccaauaagguaagcuagggaaaagaaaauguuaagaaagucauaaggaagagaaaauauguuuacuauucauuaaguggaagaggaucaucauaaaagucuucauccucauugucuucacauugaguaggaugagggagaaggaagaggacggguuggucuugaggucucagggguggcagaggcuagagagguggaagagguggaaggggaagcaggagagacaggcacacuugguauaaguuuuauugaagaaaaaaauccauguauaagugacccacacaguuaaaacccauguuguucaagggucaacuguaaguauaacgacccuggcuuacucucugccaggcaccauuaaugcuuuauauguauauuucaccccaguuaacccucauauaacucuaaaagaauccccauuuaaaagagggaaaugaggcaagagagcuuaagaaacguguccagggucacacaaguaguaagaggacagagcuggaauuuaaacacuggcagucuugcuccagaagcccuacacuuaaccccugcacuguggagcuaggaagagaaagagcagacacugagcucgcacauuccuggcaggcccaucacucaguuucuacaaucaccaacucauggccaaucugguucaccugugcucccauccacucuuccaccaucacccagcugccaccccugauuauuuugaagcaaaucuggauaucauuuuauguauaaauguuccuguaugcauuucccaacaauaaagacucaauuuaaaaccauaacugcaauacccugaucacacuuaaauaaauuaauaaugugguauuuauuuauuaaaccaugugcagucaguuuucagaugucucuaauugucucauuuguguuuuuuucuuucauacuuuguucaagucagaaugcaaauaagauccaugcauugcaguugguugacauguuuccuagguuucucugaaucuacagguuucucuuucucucucucugucucucacaaucaugagcaugugccuuuuuuccuugaaauuuauuuauugggaaaaacaggucauuagaccuguaauguuaauagucuagacugugcugguuauaacuuuauguauuagcuuacuguugcuauuguaacaaacugccacaaacuuaguguuaaagaacacaaauuuauuaucuucgaauucuggacuucagaagucaaaugugaguauccugggcuaaaaucaagguaucagcagggcuguguuccuuucuggaggcucuagggaagaauuuucccuugucuuuuucacucaagaguccaccugcacuccuuggccuccauccauugcaauggcugguugaaccuuuucaucaccucacuucagccuccucuuucguacucagaucucccucuaccucucacuucucugacucugacucugacucuucuucuguuuccuucucucacuuuuaaggaccuuugggauuacauugggccugccuggauaauccaagauaaucucuguuuuaaggucagcggauagcaaccuuaagucccuuuuccauggaaccugacauauucacaggauccagggaguaggaugugggugucuuuggaaggcggguauuauuuuucccaccgcaaucugcaauauaauucauauauucaucgguccccuguaugucuugugaauuguaguuaaaggauuaaucaaauucaggcucccuuucuaagcagcagcagugguguuuguacuuucauggugacuucuugcuccccuuucuuggauauuagcagccaacaaugaucguugucuggauccuuggaaccauuagagguugcaaaagguugauauccuaauuuuauuauuccuucuuuauuaaagggauauauaaagagaaacuggccucaucaacuauuugguuauccuaaaguuauacaauuuacauaugguaggcaggauaaauacuugauucucuuuaccaguuuucaaaauaguaagcaucuuucaaagaagaacaaugaggcauuugggggcagggguugaguaggaaaucaugcuuuuaaacagaauugugucucaauauguugcaguuacugucguuauuaguuucuaaguuauccugucuggaacaaguaggaacaccauuggguuggcaucugaguccuauugggaggaccccuuacgucuuugauaacuuucuggcauucugguaugauggaguguuccagguuuaucuuuauguuuccugccuuuucucugugaagccuugauuacuuguagugggaaaugauauuuagugaccagaaucuaagcaugaguuguguuuauggucauugcacaccacgaugcagugguucuugguuggucauuauuuuuuagcccuuuuuggggacagagcuaggugguuuucuuuuaagauaaacuaaugaauugauacugauaguuccaacucaaauucaguaucaguacuacaggguuuuuauuuauuggucgauguacuuucacauaaaauuuucugugccuguuguuucuaaaaagaaacgugcugcagaaguguuccuguggguuaaacuaaucuauacuaggaagcuagccaggccugggaaggcugugugaaaagaacaguaauccccaggacuuggggauuuaccaugaaacagcaugaaagcuggaaggggccuuugagaauguagaguucaguggcacccguaccugcguguucguuagaguuuucuaggaagcaaagucuccucacccuagaucuacaugaucaggaucuccaagguaggagcuaggugucuacuucugucaagguuauuuaugaagaaauugaugguuagacauguucagaaucagaucaugaggacacuaauucuuccggaaaucccuuaacacuaaauugauguuucgauggguuaaaugcuuuggcugagaucacauagccaagguagaaccaaagcccuccaaaucaaugcugcccuccugaaacacagaucucauaauacacccauugugcaucuccucagcuuaaaaaggaggaccgcugaugugcaucacggaagauuuccaucacaucauggugacuggagauuuauauagugcuugcaguauacuuugguuacuuuuacguugagaucugcuaccauggaauacaguccagauaaccacagugccaaaguagguuaaagagggucuggaauugccgcuugaacuagugaggcagaaaaguugggaaucuggagugcaugguagaaggaagaccacuucaacagaagaggagaacaauugcuguuauagaauccuauauaggacuacuagaaaccuaaacuccagugcaugaguggagcccagcauccagaaugccaagcagcuuucugagaugcuggcaucaggggugccucuuucaccaggugucaugguucucuguccaugucaguacagaacuccagccucugggaggggaagcuaagaagagaaaagcagguccucagacaaggcacaguucuuccuucucccucacagagaucauagucuccuggagagacaaaaggcuaugaaaggagaagaaucagacucuuaguuggguacugugaagggcuuuccaaaacagauaauauccccaaguaugaggccccagagaccuggugaaaagaaaccuuaggaacuagagacaaaggcuaaagagguccccagacaggcagccaacccuccucccauuaagauugcccaauaauuuuaaccauuuuggcugccagacacugggcagcauaagccuauuuccuagcccuuuagcugagaaacaccaaggugggacugccauuggccauuggcuccagggugggacagggcugucauugugaaugcuaggaucagacaggacaggccgagaugagcuacuagacuaggagccaugacuggagucagcaaagaaaccugcuucaccugauguugaguccagggcuguucgguagauuccaccaguaccuaaaagucauagacucccaccuagguguuacauugcaagucauggagaacuccaauccucagcuguuacagagaagcauucuuugcaaagaagagcacaggcacuggagucagauugccuggguucaaaucccacccggucuacauaauacugagucacuucucuguaccucaguuccuucaccuauaaaacagagauaacagaaguaucgacuuuauauugagaugucgccaaauaugaaaugacgaaguaggcagagcccuuagcgcacagccuacugagggaugaguauucacuguuagcuauuuuuacuauuaauacuucuguaauugccaccaguaaugaucgcuguugccucccuuccugccaguacuguaucuggacggauggacugaaugcgcuacucgggaaggacaugaugagcgaccugacgcggaaugaccuggacacccugcucagcauggaaaucaagcuccgccuccuggaccuggaaaacauccagaucccugacgcaccuccgccgauucccaaggagcccagcaacuaugacuucgucuaugacuguaacugaaguggccgggcccagacaugccccuuccaaaacuggaacaccuagcuaacaggagagaggaaugaaaacacacccacgccuuggaaccguccuuugguaaagggaagcuguggguccacauucccuucagcaucaccucuagcccuggcaacuuucagccccuagcuggcaucuugcucaccgcccugauucuguuccucggcuccacugcuucaggucacuucccauggcugcaguccacuggugggacaagagcaaagcccacugccaguaagaaggccaaagggcccuuccauccuagcccucugcaggcaugcccuuccuucccuugggcaggaaagccagcagccccagacugcccaaaaacuugcccaccagaccaagggcagugccccaaggccccugucuggaggaaauggccuagcuauuugaugagaagaccaaaccccacauccuccuuuccccucucucuagaaucaucucgcaccaccaguuacacuugaauuaagaucugcgcucaaaucuccucccaccucucucccugcuuuugccuugcucuguuccucuuuggucccaagagcagcagccgcagccuccucgugauccucccuagcauaaauuucccaaacaguccacaggucccaugcccacuuugcgucugcacugugaucgugacaaaucuucccuccucaccagcuagucugggguuuccucucccugccccaggccagaacugccuucuucauuuccacccacgcucccagccucuuagcugaaagcacaaauggugaaaucaguagucucgcuccaucucuaauagacuaaaccuaaaugccucuaggacggacuguugcuauccaagcguuugguguuaccuucuccugggagguccugcugcaacucaaguuccacaggauggucaagcugucagacauccaaguuuacaucauuguaauuauuacugguauuuacaauuugcaagaguuuuggguuaguuuuuuuuuuuuuuuuugcuuuguuuuuguacaaaagagucuaacauuuuuugccaaacagauauauauuuaaugaaaagaagagauacauaaaugugugaauuuccaguuuuuuuuuaauuauuuuaaucccaaacaucuuccugaaaauaacauucccuuaaacaugcuguggaauaaaauggauugugaugauuuggggagcugguguuuugauuuaguaacuuagguucuugcuacucagucaucagcaucaccugggagcuuguuggagaugccagcucuucagcuccacccuagaccugcugaauugggugauguuuauguacauugguuugaaaaacacugcugugggaaacccuccaccauugcuaggucaccauaggcucugagcaucaguggagaauguuacuucuaagaagaccaucucgacucacugagaaaaucagacccacuguaugaaaauaucuauuccuuuuacauugcugucucuugaccaugacuuucucuuuuuucuuucuuaccaugauauaauuuauagaaugggucuaauuaaagacaucacaacuuugagggagcacauuuagcaaugaaaagaaugcauacccacagaccugaaauaagccagaacuaaauaaaucuaaccguggguuaauaaauuauaggucagagcccagcgaaggauguuucuuaagucauuugcacuggaggcauuaucaggauuguaaacucccagcacugggagggaugucagaaggguccaagcaugcaguauuaagcguggcacagcaccagccacucuggccucacagcacaagcuguggaagcauccaggucauuucucuuuaccgucaucaggaugugcaauuacagauugaccuggguugagaugauaugguccagagcacugcaugcauugcaggaaaaaaguccuuugcauucacagggguuccuucuucccaucagagcacucacaccugugucaagcuguuaauuccuugaucauuaagcuucgauguuauuaacauguacuugcuaucaggagcaguuauuaaucuacccaucaucaugauaaaacaguaaguguuaggucaaaggcagcaaacaaagucauauuauuuuuuucuuauggguuacaagauccaauccaugaaaaagggaacuuucuggaccaggaucucugagguccugagacacuggguuuaagaaauguaucuguccugugaccuugguuggggagauccagccccucucucuucuggcacuccagcuuuggugcauuuaauagaaagaaaccuuuucaggacuaugaaaggcagcauucuccagcuccucccuagacccuccuuuggaccugugagaucugaagaguaugccaucuguuuccauucauuuugugaccauguggggaaggauuguugcccauauuuggccaccucaccuucucucuccaggcugcccaaggcuuuuuuucccaugcaaugagccuaccaccuccaacucaucuccuguugccugcaguuuccuaagccugggcaacucagccaaauccaaggcagaaguaaaguaggaagacugauguugucgugaaguccaaguugcauucugcuauucauauuacucaaaauaaaacugauuacuuaauuugaau
